United States Patent 7,868,149 (PLANT GENOME SEQUENCE AND USES THEREOF) - sequence listing, part 123

SEQ ID NO: 68624 - DNA, 12921 bp, Oryza sativa
aaaaattggtaaggttgaaaatggcatcaaagtgaataggcccaatgtcttccgtatctccgaaaattggtgccaatcaactttttgatggtttaaaaggtgattttttgctgacgtaatagtatgaccacgattgactagctgagtcagcgggtgagtcccatatatgttatcctaatctcatattctttctcatctctctctcgctaagtggtggtgggagctcgccaaggccccctttgcgacgtggattcctttgctgccaccactatccaggtgaggacggaggcctcgatctatgacaccgtagccaaggaggactacgccacactcgtcacccgctgccgcaagaagcctcggcctgcgtcgacgacgggaggagaactatacccaccacgccatcccgttcttcgatgacaagggattcaatgacgaggatgacgcccctcacgagtggagagtaaccgcatgagcagtcaaagcatacacagcaacaatatgctgctgcagtgtccctttctgccattgccaccatgatgggcaagcaccaagcagctgctatcctccatattcacatcctcaccgagctcccatcgccgccggaaaggatcctttgacttaactgttgtgcagttaagtcagaggatctgcttccatcgccgccgcctagcgaaagagatggggaaagagacatatggagatgtgaggaataagatgagattaatatgacatgcgggctctacatgctaactcagctagtcagccacgattaacctaccatgttagcaaaaacttttttaagatgaaaaagatgttataccagttttacggttggagacaatttaatcaggaaccaaagatgaaggagtccaaataaaactattccgagagaaattgctccagtctccatgtccatgggccggcccatcctagcagcgcatgaattgttgcctcgcatcgcattcgatcgagaaagaatttttcagagccgcaagagagggggagacgaaggttggagctccccgtgcttgtcgcttcacgttgttttcgcctgttcaagagagtgttttttttttcactgcatccttatccataaacgtcttatccagaaagatagaaacccgtggttaatctcaagttttgtttctacaaacaaatcttaagttttacgatgatctatattatatcacttcatactgtgatgatggtgtagtttttctaactccactttaggctggcagagtaaattgatttaggcattttagttcacctatattagtgctgcatgcgtactgctggactactggagtgcaaaattgccataaattttgccaagtatgcctgatgtttgtcataactcataaatacacctccaacttttattagtaaaaacataatatattgcccggccgtctcttataaaccaatgcatagaaaaaaatcaaatgttatgtgaaaaaaactactactccctttaatcattaatatatactgttgatactgtatgtcgtttgtcaaattgaaactaatgttaagaacgtcatacattaattatcgaagatagtattgcacacatacaggatgtatatcaaaatttaataataagtgggctacgagtaacagcccgtacgcgcacgtgtggtgtgtgtgcatgtgcgtataaggcatgcttaatttatgtacaaacctatttttatacctcgaggaaaaatgggaaaaaaaacacctgtcggccggaagataaaaattccacctataaacccccctcggccgttcccacctctccccttctttttcgccacccgatccggcaacaacaacgtacgtaacctcctctctctctctctctctctctccccttccagccgcgcgcgcgcacgcacgccgccgtcgtgacgtcgccgtcgcggtcgccgccatggatccgacgccgcagtcgcacccgatcctggcgtacgtgctgtcgcggctcccgtcgctgctgccggtgtcgccgtcgctgtccaccccgcgcgcgcgggacatcgagcagccgtccccgcgggcgccgtcgggcgccgcggagttcgacctcgtcagccgcatgccggggctccgccacccgtccgtcctctccgccatgacgcgcgccgtcgccgacgtctcctcggcgcgcgacgcgctccgcctcctcggcccccgccccgaccacgagctcgtcgactccgcccgcgccttcctccgctcccacgccgccgaagaggccgaagaggaggaggaggacgagaaggtggcgaagagccgggaggtggtgcggctggacgaggcgcacgagtcgtacggtggcttgctgcgggaggcggaggagaggctggatcgcgtgtaccggacggcgatgagagggagggacatgcaggtggtggccgcggcgcacggcggtggcggggaggaggaggccggggtggtggacgacgaggtggtgcgggtgctccgggacgcggaggaagggaaggcggtggagcgcctcctcctcgccgaccggcagctccgccacctgcccgagcagctcggccggatccgcggcctcctcgtcctcgacgtctcgcgaaatcagctcaaggtattattaattgctgatttgtttctgtcattttctgtggttatcgatcgccaacctgcaaaacctgcattgcgttgcgcggttgcgttcgcggatcacgagttcacgtcgtttcagatttagaaattagaagaactgttcgtccgatccggggaattcgggtgatagggagatttgttatgttttgcatttctcgggtagtttttcagtccagaaatgcagatcgtataagacattgcagatgtgcatgccccaaaaataatggatgacgggtagaacgcaatgctggttaattaaaattgtcactgaaagcaatccacttatgagttaggtttatgagaattgtttttgcattttttttttaagatcacgcatgtttatttttgatatcatgattattgaacacgaatgaattatgagcatagaggagtcaaatatggtataaaaaagaaatcattttcttccaactacgaaattgcgcaatatgctagtaaaactgaatgtggtgatgtggtccattcaagaatttctggtttacaggctacagtcccacaaagctagaaaacactgtaaagttcagttttattttctttccatctgttagtactagctattttcattgaatttgcagaatgtcccagatgccataggcgggctcgaacacctggaagagcttcgcctcgcttccaacgcgttggtctccctcccggactccataggcctcctcaccagcctcaagatcctcgacgtctcgggcaacaagctgaggtctctccccgacagcatctcaaaatgcaggtagaatcaaccagccaaggccaaagcacgcatcatcatcatcttcttcttctccccaatggcatccagatccagttaaagaaacttcaattctcgctaatggtgatcatcacaaaatgatccaaacgtacaggtcgctggtggagctggacgtgagctacaacgtgctgtcgtacctcccgacggggatcgggcaggagatggcgaggctggagaagctgtgggtgcacctgaacaagctgcggtcgctgccgtcgtcggtgtgcgagatgcggtcgctgcgcctcctggacgcgcacttcaaccagctccgggggctccccgcggggatcgggaggctggcggcgctggagtcgctcaacctcagcagcaacttcagcgacatgcgcgacctcccggcgtcgttcggggacctgctcggcctgcgcgagctcgacctcagcaacaaccagatacacgcgctcccggactgcttcggccgcctccagcgcctcgagcggctccgcctcgaccagaacccgctcgccgtgccccccaaggaggtggtggccggcggcgtcggcgccgtcaaggagtacatggccaggcggtggcgcgacgcccgcgccgaggaggagcgccggggcagcgccgtcgccgagagccccagggtgtcgacgcccaaggagtggctggtgcgcagcgtctcgtcgctgggcagctgggtgtccgacgtcacgaggtacggcgccggccaggacaaggcagcggcggaggaggaggaggacgcctacctccagcagaatctgtgatcggagattacagcatttgcttgctccggtgctttcatccgtatgtacagaagaactactgcagaccgtcgccgcgtcgttcgtttcgcatcagccgtgtgtttgtgtgtgtttaccttcgctgattccttaccatttaccatttttgttgttgttgttttaaccgttttgctgtttaaaacttttaaacccaggttactggaccacagtgcctgtgtgtttgttatatttaccttgctgattcctaacatttttttggaggttttcgtttaaccattttgtgactttgtttgatgaagtgcagtcaatcgagaggccatgaattccgatacggtcaagctcaccatttttgttgttgtttaaccattttcttaagacaccaacgctgctttagttaaataaaagggctctggtattccccaaaaaaaaagaaagggctctcccaaaacgcaaagagagcatagatattcatcacgacagtcaacagcaccagcaaagcaacaaattcttactagtagattggagcaaagccggacaatctcaggtcattcattccaacagcaccaacagggcaaccaatagaacatcgggagaaaaaaagaatgaacgagatcatacaaacatcgattaacatacgcaacatagatcttattaatccatcaagttccagtcacagcagtagataagaggcatagagcagctaagcccatagtaattacacgcagtttacctggcaaggtaaccgctttttaagaggcgcgcacgcgcacttaacacatatctccgcgacaaatataccagtcgcacaacaccacacacagttcataagcaagcaggccctgagactgtagcagcagccccggcggccggcgctagccttacacctcgtcacattatttacgcatatacacacatagttaggttatagatagggatggctcaagagcacacgatcttcactggtctttcttctccctagcgatgaggtccatcacagcccgcttgatgcttcctccgttcttctcgagcatctccttgtttatctcagtgtcctcaaagccctgaaaaggtgaaacaacagctaacttcagaaccttgccaatacattcgtgcctgtgaggctgtgagcactgtccagaatagggcacatgtgatcttaccatttcctgcaactcctccaggagagggtcccattcgctgacgccacagagatcatcgacagactgctccaggttgtacttgttctgcctgagtatctccttgttcagatcgacctgcctaaaacccatttcctcaagttccttcagcagtttctcttctgtgagattgtcaatgccatgatgatcagatgatgatgcaccaacagacgcaggtgcattaccagcaggcacattaacagttggaggcacaggagtcacagcaggttcaggcgcaggctcatcaaagacaggcacaaaagcagcagcagttgaactggagggaacatcaacatcaatgatggggtgaagagatgttgtggaagaaacaatgggcacaggtaatggagcaggctcaggattcttgggctcgtcaatctggtggtgtatcaaatgttcaagtaactccttgtttgtgctattgacatgttggttgaagacttgatccacaggctcaatattgacatcaatcaaattacttgtgtttgtgatattgctttctgggggcaaattcaagtttatagcggcagtcctgttgttactgacaaaagaaggatcctccacctgcagatgcaatcagaatttagatgttaagaaagataggtatgagtgtcaagattctagacctatatggacaaaaggaatggtagagttgacaacctggatgtgaacccaaacacgctgaccaaatttctggccagaaggtgatgctaacctccagtaagatatatacctcccaggccttgcaggtgccacaaaatcaacagcaacatcaatctcctgatcaacaggaaacccgtccactggaatctgcacagaacacaaactcaggtttaatgattttacatattttaaatagcatgcagtctaaactacagtcaaaacagtaaactgaacaggggtcacagtatgcataactacaattagaacagtaaactgaaaagaggtcacagtatgcatagtacctacctctaatggaacataggtctgcagtgcaaactggtcgccaccaacccatataagctgtgtgcccaagggccacatgatagacccattgttatgcatacgccaaatcttagtaaacggagttgaaggtgccatcaatgttccatccaggacagttacatccaaaatgaagcgactttcaagtttctcccgctttgacttcatcgcagcccgtgaatggatcttgcgacactgaaaccaagaaattataggacaaactaattgttaatatattattttgtgtccttaaacctatttatacaaaccagagtacaggatggatgagtttgctaaataatgcatcgacaaacatacacgtgcaagcgtatgcctgtgcactcatgcctacaaattgggtactcaccaatgtagggtctctcagtaatctctggggtaagagtggcttgtcaatcctggtgtactcgacctcattgcccatgcgatgaaagcaggcatcacacaaatcataatcttcttttctgttggcaaagaggcgaagaggagggatgtcaaatactgagataggaaaaagaaactagatagagcaatagctcaattaaaatcttacgttttagacttgtatcgaggcccaacaattggttgcactccacaaccatcacactgaatccatctatggaatgtgcgtgctggtgagttctcaatgttattaccaaggtctccatgcagatggccagaggacaagaggcggccagggtaaggaaaatgtggagaaggtccatagctcattggtgcaggcattggtgggggtggacggctcaggggagcatggggttggaatggatggccagctctgcacaatggaacacgccatctggaatcactattggcttttggatcagcttcagactgccaaatagatgggtaaaatgtcgatccacgtgctggtggctgagaccaatcattcagagatggaattggaggagctggacggaaagcaggagcagcaggaggggtaggtggtgtagcagaggtcataacagattttcccttgctttgagcatcactaattcccttgctggcagatttgtcatcacctgagttcggtaaaaagggggagaacagcaactcctcaatggaagggtataatgatgcctgttgaccttgagaagatttaacacccgatgtagcaggagcctcaactgacagagtcttaagacctctagcaccagatgatttggagttctgcgtgtccaagggttgcgaccccaaacttgtgtctattttgggctcgtcattagttttgggatcaacctgtgtttggggcaaaccagttgaggagctgcaggaaccatcagcatgcccattagatgggttgttgttgcttggtgtaaccagtttaacaaaaggttttattagctcagctaattgtggtgatgcggcttcaagtacttcatgggacagcttcgcaagtgtctcaggaactggctcctggatggacttcatagatatcggcttcaaaacctcatcgataactgatttaatatgagctagtgggtcttcagtggtggtggacctgagaggtatattatctgaatcctgctgtttggcctgaggtgctgcagtgtggctgttgtttaactgaacattaatcctgagggggttcagtttctgatgaatagcagcatcatgcagatcatcatcatcatccagcatgacaatatccccatcctcatcagtgtaagtcagaatgaagtcgacatccgaaccaaacttaaaagcagatgcaatcttggaccggagagcggataagttcaggctgaattgtggtccttgcacatacccaccgaacctcttaagagtttcaccatacttcacctgaaatatgtgaaaagggataatttgagaactgctaacaacaaaatttgaatcaaacaacacaaaacacacgaacaatgaaagacaatgtatgattcttaccatcaagaaattaaattggactagataacacatatccaaactgcattacatatttataggaagtcagttgaaagaatagttgaagatccatagggtccattcagatggtagaggatttagtttaatcacttattttttgtgatgtctactattctaatttgagcctaggatagtaagattgaattattttcatcagttgccatatttccttgatgcaaaaatatatctgttgcaacttgattaagaaagaggaagctagatgaacattaaaatatgaaaataaaaaggagcagtgaaaacaaacccatgctaaggctcaatgactttctgcacttggtctatacaataattcattgtgggggtagttaatttctcagacagactcctatggtattactgggctcctaattgaatagatgggtttagcccttcctttgggcaatgtttctccaggcatcaccggattcaggaaaaaggttctatatgaagtgtacaataacgagggcatcacttgtttcatatatatcattagatagaatgtagataaactgtataaggtaatagtatattaaaaggcaaaatatcctagagaagttttggttattttaccaacagtggaactcaaaatatactcgtgtgtttataaagcaagcatgaactctgaaagcatagacaaactgaagatgttaaatctcggtatctcagctaggacaaaatattggcccgatttcatttcaaataacagtaatatcataatcatcgtacctatcaattagaaaaaggcataacaacagtaaaacctacagagtaaaaacatttccacagttgaacaaagtgcaagtacattctagattatcattgtacatgtgaaagttacacggatttgaagctgaagacaatagtttgcctacaaatggtaagatgtattattacctctcccccatgagctggaggttttagaatttagattagccatatacctcactacctcccctggcccagggaatatttaatcccaagatcatgatcccactagacaaataaattcctatcaccaatcaaacagggaacttcacactagcagataatcgaatgttcaagaagttttgaggtttggaaacattcagaaagtttgcatgtggtcgagtacagtcaagaagtaagcacatgagcatatacaagtgaggccataaaggaaacaaatcacaataaacatactaagcacggttgtacgtgaataattgcatcaaaacaacaagaaatatactcagctcaaacatacgcctaagaaatggtaccagaccactaataattgttaggagtacttattaaggacggctgaattatttttttctgaccaatacccaacacccatcagaatggtaaaagaatagaatacatcttagaaactgaactcatgtaggagtatgatttttgttttgtgcaaaaagatgaaggctcttcttttttttttctttttttgattagtttaacaccaggcaggcgcgcgtcatcaacagtcggaggaatcgacattcatcaaaacgagctgacgattcttaaaaaaagaaaaaaaaatcagaccagggcagacctctaagctaacaaagagtaatcaaactcccctaatttctcacaggccaaaaaaaaactaactagcgtacacaaatcccgcaacaccacacatttcgtcaatcaaaccctacgaaaacgataagtacgcaagccccccacgcttcccccaaacccccaccaggagcgattcccctttccccttccccttccccctccgccatcccctccccctaatcacaaaacaaaaccacagctcaatcctgaaaaatagacgatcatctcaccttgaggacgacgtcccactcgtcgggacgcgacgcgagcccctcgtacatcggcgagctccggccggacatcgcgggggtgcgggcgtgcggcgggagggcggaaacccctcaaaccctcaggacgcggcgtcgatcgatcgcgcggaagagcaacaacaatcccccaacagaagaccaaaccctagatcgatcgaagagagcggagccgaggaggaggggaagagagctgcgtagccgtgagccgcagcggcggaagagagcggtggtgcgagagagagagagagaggaggagaggagagagtggcggtggcgatgcggccgagtccctcctcgatgcccccccttttatcgcgcaaaaccgtttccttcgatgcgaagcctgggcgacaaccagagaagacggttgggccattaagtcggctgggggcccacgtgtcagcggcgcgggccacgctcgcgggggagccgtagagggggctgcgtgtaaaaacccccacaggggtatatgtgaaatttattacgtgtaatgttacgggtgagagtgtaaaaactcgtgcggtcccccatccttttcctcccgtggggcccacggtggggcccacgtgccagtgacgagaactggataagggggctctggaatatcctagagtattttaatcctgccatcttcttttcgcgcaaggccggggagagcacaccgccggagggcggcggcctccgctcctcgcctttggggtcgcacgagggtcgctgacatgtgggcccggtgggatctagtataatcctcgcatcggtatttcgtaggagtattggattgtcggtgaggtgtgccgttttgtttaatgatctgctgctagctcttcttggcgtgtaagttttggccttggcgtttgacgactaggcgaaggaactttggcgtcgccgtcgtcgaagtcgtcgaggatgacgacgaattcgggtgtgttcgccacagcggagcgatatattagcacatgattaattaagtatttactattttttaaaaaaatagatcaatatgattttttaagtaactttcgtatataaatatttttttaaaaaaatactgtttagcagtttgaaaagcatgcgcgaaaaataatgagtgaggggttggtgccgaacacatccgcaccgggtccaggactacgggagtggggactagtctcatagagggacgattggcagacgtacggttgtgttcgggagtgagggttgggtactagaatgcaaaacgaagcagcgtttagcacatgattaattaagtattagctaaaataaatttaaaaaatagattaatatgatttttcaaagtatacgggatcgactaaatgagtacggcaaacgctaacaggtgaagtcgcagatgacaacacgagttcatttaggttgaagttgggggctactgtcatgattatggataaggcatacctcctatcttaggacttatggaatatatgaatacggtataccttcacgtatacgggttgtttccgtatgctctaagaaaattcatcagatattaaggaaaatatccttacgagtcgagagactgacaaagtcctactcggtagggatagggtccttaccatattgtacggggtctgatgtcgatctgatgtttctgagttctacttggagatcaagatgacctacggtacaaaaggcaccccctgggaggggttcaaggcatcgaatctcaccgccaacacacccatcatagtctacgaagccatgtatgagattcgaaggcatcgaatctcatagcacgtgaagccaagtcaccatgaggtctcgtcgaatccatcgactactatcccatcggtatcgccaaattcatttgttcccattgtactttgtggttttttcatatcaatcctatataaactggactagggtatgttcatttcttctataagtagaggataaaattttagatattcgtggcacgcttttcaaactgctaaacggtatgtttcgtgcaaaaactttctatatgaaagttactctaaaatatcatattagttcattttgcatgtttttagtaattaaaactcaattaatcgcacgttattactatctcattttgtgtgaagcatttaatctttatcttcaggagattcaaacaccacctaagactattacttgattaggggcctgaaccggtataattcttgtctttgtgtttgcttgatatcatatcacgtagatactcgtaccaacgaaccctaataccccaatcatccagtctacgggtatcgacaaacatttttatctctgtaataactcattcgtttgctgcctcgattgttatcagaaaatcagatattcttccatcaattcagacttatcaaaccgggccttagttcagcacactcaaacctcacgctctcttgggcctcttacatatagccagaccgaaaaagtacaccgaaggtccctcaacttgttatcgagttacaaaatcgtcccccaaccgtaaaaccagatatccggcgtcccttaactaatcaaaaccggtcataataagcctttcggtggttttgacccgattttatcctacgtggcggctgagtcagcgtgtaacccatgtggggcccacatgtcaggctaccacgccagcctcctctctctcttttcccctcttctctcccttcctcatctctctgtcccttctttgacttagccggtgggaggaggagggtgtcggcgga

SEQ ID NO: 68625 - DNA, 9305 bp, Oryza sativa
gatggcgtcggagttgtggaggaagtcaagtgtgcggtcccttcctgccgcccgcgcgcgtgccgccccttcctgcagccgcgcgcacaccgctcctccccctgcccgcccgcgcactgctcctcccctcgtcgcccgcgcgctgctcctcgccgccacgccctcgtcctccagccggctgagtcagagtagggagagagagatgaggaagggagagaagaggggaaaagagacatagagcgaggaggctgacgtggcagccccgacatgtgggtcccacgctgactcaaccaccacataggataaaaccgggtcaaaaaaaacatcaaagaacctattatgaccggttttgatttacgggacgccggatatctggttttgtagttggaggacgattttgtaactcgatgacaagttgatggacgttcggtgtactttttcctagccagacccaagaaagctattgggccgaaatatatacatattcaccctggcccgcttccgtccaccactctctctcgctgcactgtagtcgccgcaacccagaacagcggcacgaaaccccgaactccctcccccctcgcgccgcctccctccccgatggagcctctgcaggaggcggcggcggcggcagccggcggccgcaagcggcgccgccgaggaggcggccggaaccgccgaaagcaccaggcttcgtcctcttcgggggcggcggcgtcggcgtccccgccctcccctcctgcgaagcggcagcgcggggacgacgccgcgcccaagggacggggcagcaagccgaagcccgcgagcctcctcgacaaggtaatcggctctccggagcagaggtttgcgaggcctaggcgtgtattggtaggtaggagcaggagtatatgccgtgccagtagcaggagtcggtggaagtacaaaatgttcggggtggtatcgggaataaattttgactagggttgatgggttatttagtgaatctggatgatctctcagtgtgggtgaagtcaaagcatagggtgcctcctctgttattctttagtagcgacagtagaagtgccaaacctcagtaattcagtagtgcttcgtatgctcttatgcatggttgaatgtgatacattgctctgaatttgcacagtattcacattttctttaggcaacacagtattcacgttaggcttttatttgctgctccttaataatttaataacttttgcttaaaaaacaaaattaatgaactagcctgcagtttggagataactcatgacttattatatgaatgttttacttattttaccttctgtttattctttgaattttttttctctgagctaattagttgatatgttttttttatgatgtgcactctagatgcgtgcaaggttatctggtggtcatttcagaatgttaaatgagaaactatacacttgcaggttcgaattcttctccagataacactacttttatgctaatgatgtgctgctattattgaatgctttacattatcaatactgtattgaacagtcttcaaccaataatgaagtgtaagaacatgacgatactccaaatttcgtatgttgaaatatccacacagtttgtagcttacattttgtacaaaatactgctatctttaatcatgctaagagatagtgacatgcatcaatcttaaccttcatgctttgtctgacccggtactgttaattattggtcatatcaaccggtatgcctgaaaaacatggattgccctctcacgtatgactcagaatattctaaattggagttcctaatgtggcttcgactttacccttggaaactggaaatgtagaaatcactaatcagagcttcatttttgcaatattcacacttttactcaaacattgtttttttttcttttcagtggacaagatgcatttgactacttcacaaatgagcctgatctttttgatgtggtatgctatgcacttttcatccattttggtaatcttattgtttgctagatgaattttatctttgaagagtatgggcaacaaattttgaactctgggtggtgactttttcatatcttacctcatcaactcttcagtcagtgccttattgtttgtacctctacagttctatctacacaaacctcatgctgttagttgtttctttcttatttgaataattatttttgtgtattttgtgggaggaaaatgtattgcagcgatcgatatgcagggactttttgcattgcagcaataattgcccctatggttcataccacctgatatatggctgagatttcactttgttttcttttagtatcatgcaggatatcgagagcaaatgtcgcattggccagagcaaccagtaaatgttataatcaattggttgaagagtcatagtgcatcttggacagttgcagattttggctgtggtaagaatgctaaacatttactctcaatatgccgacaccttttcacaatgttttcctttttatttccctggcataatcatggtaatacaattgacatcttgtctaggcaatgcagcagtttctaaaaatgtgaagaacaaggttttctccatcgatcttgtttcagaggacccttcagtcattgcctgtgatatggctcatgtaagcatttaaccatatcttgtatggttgtacctctttggtgctttaacgtgttggcatgttgtttatgtgtgttagcataaatgaacaaagtgtttcttggttcatttccagtttagcttcaggggaaattctggcaattccttgtcagccatgtatgctctttttccatgattcttactaagcttcacaactacactatgtgtcattacaaaatgacccaactttaatcctccaaatattggttatattcttgtgcaccttgatttcttagtgtgggttccacaatttatctttcatgattccaagtcattacatggtcaatactcttttagcattgaatttttctgatgttaacatgttgttcctgtgttaaaaatagaagccattatggtcgatactcaaatactcagtacactcatgcatgaattacaagtaatgtaagtatgtgtatgagggccaaaggtaaaagcagctggccagttgctattcttacaatggaggtgcattatcaaccaaaaacaatttctgataattctttaatatgtcacaagaaggaaataaatcactagctttgggccattttaaacatagctcttgggacattctaaacatttttcatgatttccattatgtgcaacatatgtaaaacaactatacgaaataaacactaaaatatctgttttttttaattgagttgttacttaaactaaaggctttgttatttctgtagactccattggagtcatcctctgtagatgtggcaattttttgtctgtctttaatgggaacaaactatccgagttatatagaggaagcaaaccgagttctcaaaccaaggtttgcccctaatgattagctgctacacttctatgacaaagtatgtgcttccttttttactattgatacatttgtttatgcagtggttggcttcttattgctgaagtgaggagtaggctagacccaaacactgcaggtgctgatcctgataaattttgtgaggccatcagcaagcttgggttttcccttgtttcgaaggtatacttacggtttcttctacctttttctcaagtggactttggggctgtttggtttgttgccgtttgtaaccataccagctttagcggtgccaaaatcagttaagatagaggtatatatggtgtgtttggtttgatgccttgcctaaacttttgacatgatgttgagttaggaagtttctagaattaccaaattttggtatggaggatatatgaggtaatatttggtttcccaaagccaaaatttattatggccgaaaatggtaacaaaccaaacaacctcttagttacaatgagttaattttatatagtgaagtcctagaaggaatgaaggattataacataatatggcgatgtttactgatgtccaaaccaaaggctaaactcctgaagcgcatatgtgaaaaaggacatatcatctattagcgaactgatggaataacgacttgtatatctcaagaaaaaaaatctctgacttcttggatgttgggctgaaaattagcttgataggattgggtgattattatatttatcccatttcataattgaccatttaatatggtcagaaactgaggccattctggtccactggtttgtgctgatatatttgttactatttaatctatactatcgctcgatgatatatttattactatttaatttattactatctctgggcatcactaaatgttcaaagccatgatgatgttgcttttagtgcagtagttaccgaacaataggtcatattttcaaacatcgcatccttaccatgtacttcagaaactaatatgttctttgtgcccattctctctttgtggtgatggtatctgaaatgtttcctttgatgtacccacatgacggattcccattttgtgtatccttttcatgtgtggtacttattttgtgatatgaaaattgttctgtattgacacaagactgttctgtgcgaaaagagaacagtgtcatcatgtttcctaaattggcaattggttcctttctgtaggatgcgaaaaacaaaatgttcattctgttccatttccggaaaaaggtcagttatgccactgccgtaccttaattgcacttgaaaattactctatactttgatcattgagagattattgttcagctatagtctggcattgaatgctgtggtttcacgtctttgcaggaaaagagtaaggtggtcaaaaacatcgattggcctcagttgaaaccttgcttgtacaaacggcgatgatctcatccattgataactgtaattgtactagacctcttccaaggttctcttaaattaagttgttgatgtactctatgttcccttatctcaggcttatctgtttccgttactttctctttttgttgtcgcgtgattttctttatgcaattatgcgttggacctcaccagacaaaggcctagtcatctagtggcctgtcgaatgaggtatgctcacagggcagagtataattctgaatctgatgcatatcctgcgtgagccttgtactcaaactaaactagcaagtaagattagcaacttacgaatgcaccaatgtgccattttgttgctagtaactgtaacctgtaaatctcctagcttaacaacgtggttgtctacattgcttctggacatttttcttcctgcctttttgacttgtagaacgcaggcttggatcggtattaacgagtgaccatcgctaccgccatggattacgaccgcgaccgatttgcctgactgcctgccactttctggtagaaattttgttccttttcctgggtgggtcaaagtcgtctttacgtctccgactctccgtgcgtgtggttgcgttgcgcatgttgttttcagttgcagacttccagtagcatctccgtgagtgtgggggcgaaatttgattcgattagactttggcgtgccatgcttaaatcgtaagcaaaaggtatcattttgacaattatttggagagatttggtcatatcctctccctagattgaaaattgaggatttatactcctatagcgctgacacgtgagatcatctaagattacaggcatgtgggacaagaggataaatccttaaaatttagggtttgaacgaatgaattaactagttataagtagttaaaaaattgctttagaaaactatttttaaaaaatcatatagaaatatttttgtactacctttgttctaaaaataagtttatttttcacacatcccacacatactaattaaaaaaaagagagactacaatgcttttattttattaaatcataatgcaactatttctcactttatcatcttccaatacaattattccatactttcacaatttctgatgtaatgattactttaaaaaatgaacgtatttttgggataaaaggaaggagctagagatgaacttaatatgggatggagaaagtatgaaatacactatttgaaagctttaaaaacatacaaacgaaaatccaaaatcagagtcaatagggccggagggcacatgatcagatttcatagctcttgccactgtacttgcattccttttccgaaaagaacaaaaaaaaaaacaccattggggcacacgtggcacgcgttagagcatcgaggcccacagccccacactagagaagctgccccttctccaacccgcagcgaccagagagacagctagatcgatgttgcaaattttgcaatcgaaacgatgccctggtttttgacataagtttattttaagtgcaggcttcttctccagcccagaactggcattacaaaattcggagcagataaaatacacatatgaaccccacgggtgacaccctaatccccaagatccgattgtttaataaccaaactaatcatgctgcacagtgattagtccctcctaatggagcatcagagcttagttcgatctgacaagtgccccctgtcgacagaggcgagaaagcatcatcatcatcatcatcattatcatcacaatcatcataccaagtgtacttacactagtactggtgtaccactagcatatactactaataatttaagttctttttaaccaggtgattagccaagataaaccgtgtactaataatgcaataatttacaggacacggagctctcggcctcaggctgcttcgtgccaccttctggcttcatgtgccagtctatctgcatctccatccatgtctatcgctggtgcagagagaaggtcacaactcacacgcgcaacgcctgcctacgccctcattggccggacgcctgggctccagacatggacaaatttggttagcctgtggggtccctgtgaccctaataaacatcggaccaagcatcattagatcagttttaggcccctttgaatcgcaaaattgagaaaacgtacgaataagaaaaacgtaggattttgatagaattgtaagtgtaaaacagaggattgcaaaacgcaggaaaaacacaggaatgaccgtttgattgaaccgcaggaaaaacgcagaaattagatgagagagagactcaaaggaaagtaactaagaggttgaagctcttgctaaatttcctccaaaatctctataggattatctatttcataggaatttcaaaggatttgataggattcaatcctttgtttcaaagagcttcataggaaattttcctataggattgaaatcctccaaaattcttatgtttttcctccaattcaaaggggcccttagttggatttttgtttctctttgttggtacattggtcttctttcagatgcaggggtttgcagtgtggttttgcatgaattggtttactttctgtgaaattctcggaaaatttctccgttcagaaggagaaatgtttcgtctacataccgcaatagtagatattaaaggacactagacatcctgtatgtgcgcacacacaaatgacacattctctcttggtttggtttagggcttgtttagttggcaaaattttttggcacggacatatatttaaagtattaaacatagtctaataacaaaaataaattacagattccgccgggaagctgcaagacgaatttattaagcctaattaatctgtcattagtaaatgtttattgtagcaccacattgtcaaatcatgacgcaattaggcttaaaagattcgtctcgcaatttcctggtgaactgtgtaattggtttttttttctacatttaatactcaatgcacgtgtccaaatatataatatgacagcgtgggaaattttgtttgtgggaactaaacaggcccttatatactgccgattactcactgcaaagaatcactactaggagtaccaaattagccaaccttactttaccagcagcactagtagtactgctacattaagaaccatccctaagaaagaatcattttttttagacaaggatgtggtataaaaccattttcatctaggtgatgtaatgtaagatgccaagataaataatttattcgcatgcatcatggccccaatgattatcattttagcgaaaccaatctgacccattccatgccgtgtttgggcggttttacagacttatctttccgtcctttgaatatgtgcagatcttagggcactaaagtaatcattttccacctattgtttctctccacttttaatactcatggagttatatttgttccagcatttctgttttaccccatatctgttaataagaattattctcctttttagtgtagtggataccccagcttccattgaaagctaataatggcacttttaatgagtataatcatatagttttgattattctttttcataataaaagtataattatagtattgtagtttcgatcttactcttactactatctcggcagctatattttgggtttgagtgagtagtatttctgtttttacccccacactttgacctttttacggttacctatatattttaacattttcatgtgcgatttatcagttataagtttagaaaaaagatttttcccttttttaaactttattccattcagaaacagggtacatggtttcttgttagaagagctttcacaaatcacctctctatacctccatggctccatatccacacaccactaaccacagccaccacccagaagaaaattctaggaaagcggcaagcaattttggagacctgacctgtggagtgcactaacaagagttttaagactttgacacttccttaattaactactaactaataaccgatcaaccaattagttactcctccatgcaaacaaaaacactactaatacaacaatagactaagtctctcccctcaaatccccgtgccacccaagctacagctacacaagcagtgtgctactactacacagtggtcagtggttggatcatggttttataaaatcatacgaatatcgcctgcggtaaccttctcaatttttaaaaccacggtatatcttacagtaattatacggttatcatgataaccgtccaaatcatggggtgacggtaaccccattcaaaacgatttgggaaacagccgagctgagtcgaagtccttagggcctgtttactttgatgctatttcaaccatactttttgggtaaagttgtcaaaaaaaatgtcaatgcttagtttgtttttaaatttggtaaatacataaggctctgttcgggagtgagggt

SEQ ID NO: 68626 - DNA, 2790 bp, Oryza sativa
cactccccggcacacaaaatgaagcagcgttttagtgcatgattaattaagttttagctatttttttttcaaaaatagattaatatgtttttttaagcaactttcgtatagaaactttttgcaaaaaaaacacacctttagcagtttgaaaagcgtgcgcgcggaaatgaggagttgggaacttatactacaaaacagagcctaagaaatcctgctaaaattatggcaatattaccatcttactaaaattttgacattaccaaaatttggtaaggtttattttagctacaatctgaataggcccttagggcctgtttgggagggcttaagattctgagaagcaactagttggaagccagcttttccagcttctagtttattttctggattctacaactacaatttttcagaatctgaacaaaaaactgtattgtttagggaagcttctgattctaggataaactgcagcagctaaaagcttcaccaaacatgcccctagttgaaagaaggcgaccattaaactgttagtagcacaaatctgccattgccggagtcattagctaatccctcttctctctctcgatcgatctctcagtctcacccatccctccctccctggcttttttacccctcacgggccgcacgctgcctcgctccctccgaccgaccgccacaccaccaccccccacccctcttctctctctctctctctctctctctccacatccccatcgtctctcaccgcgttgctgctgctgctgccgcctcggccaccgcgcgcccgcccgcgcgtcgcacgcagcttcttcctcttcttcttcttccccaccctctccacccgatgcggcggtcggcgccgcgctgctgctgctgatgcgggcggtggtgaagaggcgacgagggggagagcgcgggcgctgctgcggctattggagatccggggcttcgtggtaagcaagctctgctccccacccccgcccgctccctactgattcccgcctgatcccgccgggattccgctagattgctctgccccccgcgcgcgccagcggcgagctcggctttgctgtgctgtgctgcggccgccgccgccgctattggctgcgcgacgcgtgggggagaaatgggcttaggcttttaagcgtgctgtttaggcttttgactgctctgtggctgtgcttatggtagaagccgccgttaaaaggtggctcgattttttgttttttctccctttctttttgtgtcagggatcgtgcggggctaggctgggctcgagcaaggtcacgagtgagttagtacggggatggtgatcttgtcatgatacaatgcggtgtggctgtttcttttttttttttggtgagagtttggtagagagatgacaaatcgtggcttagttttcaaattctttgtgattttgtttcccaatgcggcccccaagtagctcactatgtttgcaaagcacatggaataccattttattgaaccattttgtttttttgttcgtggggcattaggttggaagtttaatgctggatatttatgcacattttgttgctctgatcaaaggttttagttggctctgttgtaagcttaagagggaattagtgatttagtgtggctcatgtaccttgagtagaaatggtcgaatgccatggatcattgtagtatatatatacatctacgccactgtgctatacgcttgtatttttgtacaaattaacttctaattctttaggaatgtgaatttgtccaattcgagggtttcttcttgtttattataaccgtgcatttgtaagtgaccaacgtgtcttcgtgatgtaccagtccaactttcaaatacttccaaaaagtttaattggtgaatacatgtgggttcctcatagtttttacctatgtcaagtatcatgctcagcacttgttcatggtttatttctaccccagttttacgttatagtttatatagaaatgtcacactgtcactttctggaacattcaatcagtattcatgatatatacaacatactttacaatactttctggaagtagaatttgcttgaacacgttagatccttctagtttcctcctacgtccaatgaagtgaggtactttacttgtgtttatgatatacttttctatcgacttgcaaaaactttctaaaagttgagtttcttaataaccttaatgtcttttgatgcgctgtacgcgtgccatatgctatgcttttacaccaacttccaagttttccctaaaagctgttcttctatttaagcgattagtggggtcgtgtgaccccacgggacccaaagtggatccatttcgacggggatggaatctgggagtgagttctatgcgggcgaaggtctccagatcgaccccaagtggctcatcgacccaaagcttctctttgttgggccacggattggcgaaggtgcacatgcaaaggtctacgaggggaagtaagtctcatatttttgcactgtcatctataatttgatgatctgtgtgaaagttttgcttctaaattaatttttgattgatgctgggattggcaggtacaagaaccaaaatgttgccatcaagattgtgcacaagggggacacccctgaggagatggtcaagagggaggggaggttcttgagagaggtgactatgctgtcaagggtgcagcacaagaaccttgtcaaggtcttgatctttttgttgactcttatcatttcttttcttggagtggcagttgtggatgcttttgaatgttgaaaatgtactcgcttgttgttcagtattatcggg

SEQ ID NO: 68627 - DNA, 1955 bp, Oryza sativa
gttgcttcatgggcatttacatggtggatttctgcaatccggaataataactattcattagttcatatacaccatgaggtcagacagttgcaggacttctttttgtgtgtgtgtccttgggtgttgggggcatggtccattcctgtgcataatcaatttcttcagtgggtactcatatgtcatcttgtatcaacttctaataataatttgaatttcacacagctgtttgccaaaaaactaatgttttttttattttaatattacattaaacattctttgtggatttaccccaccagccaaagtcacttgaagattcaagacaaataaaatgttctcattagtaacataggatgagaattgagaatataatctactctggctgtctgacctattatgtaaagttaagcttcatattgcacaagcaatgtgcatttttcaagggcaggaatgagctcttctttttacattcaatcttattaagttatggtgaattggtgatgtttggaagttaagtcaaaaggtagcagtgtcaatggcttgttcctcttttcctgtgtcctgttgtgtctgcatgtgatgctattatgggctagtctatttatgggaactaagcctaaataccacaaatagcactaattgtgggtgtaatggaagacgagtgcaggggagcaggcaatctatattgtttgtgtatgtttgtccaatgaggtaataacctcaatcagcaaatatagtgggggaaggaactgattcaatctgtcataccatttttctcttcattctttattattgcatggactggtctgcaatgatggagatctgtctagatattcatggcgttgattgggaaatttactaattatagaaaaatgtttcaagataataatgattatacagctttctgaggatttcttggttgaccttcgatggaagaaaccaaatttaagtccatcttgtactatgttttcaatgaataataatgtggacgaattagtaatgtggaagattccaagtacgaccggcatatgatccattagaggggcccctggggggcgggcatcttaaaaaggtagcttcagttctgaccttctgatagccaccttccaagggcggttccttttggaaagaggtggttctcccaaatggtttattattgtttttcggtttaagatataatagaatctctaagcatgctaagtttatactgtatagtgtatcaagtagcaaaacattcaggacgggtgtacctagtgcaaaagtgaaccagcaactagaaaaggactgctattatttcctctttcgataaaatgccaggaaatattaatgagctgaacatcggatgccagtggagtactactgattctagttcacgaatcaatgcatagctctgttattcaaaaaacagtactatatttctctactgtaaatttacctaatactatttggtgttttttttcagtattttcttttcagagctatttttttgaaaaaaaatcaagccagaaatatttgtacaaataaggtttatcatgagccattgttttgtccttctgtacgtacagagaacttgctgttgaccgcagaccagagaacagtcaagcttgttgaccttggtttagcaagagaagagacattaacagagatgatgactgcagagacaggaacataccgttggatggctccagaggtttctgttactgcagttcatatttgtcaatataattcttttttgtcaatatttgctaatcctgaaatatatccacagttgtacagcacagtgacattgaggcatggagaaaagaagcattacaatcataaagtagacgtttatagctttgcaattgtgttatgggaactccttcacaatagactgccctttgagggcatgtctaacctgcaagctgcttatgctgctgctttcaaggtataattactgatacttcagtataatgtgt

SEQ ID NO: 68628 - DNA, 736 bp, Oryza sativa
tacagtagctcatcagtatttgacatgatgcaagcctcattttctgcagaacattagacctagtgcagataatttgcctgaggagctatcagaaatcctaacaacctgctggaaggaagaacccaatgagagaccgaacttcacgcagatcgtacaaatgcttctgcattacctttccaccctttcgccaccagaacctctggctccgcctcggacgttcagttcagagaatgcaatcttgcctcctgaatctcctgggacaagctccctaatggcttctcgaggcgacctcggcgacacaccgaagggcaagatggaagacaagccaagggggttctttttctgcttcagccagtgctattagcacagaacaaaggaaactcccctggaggatgcaaatatgaagagaacattacctcctgatgcacagcggctcggatcacggcccggcggcgagtcccggtgcccatagcccatacccaaagaatggcagaagttcttgtagaactgttgtttctgctagtcagtccacccctctcttcttctgacatgtttaacataccggcaggataaatcgagtaagcttttgactcctgctatcagtgatgaaaatagttctgtcgtatattttcggtggacaagttattcaatgtctaaactgcgcccgctcatcgtatagtaataatccgcattcatcagttttctcctgtgctggaaatcaagggggtgctatact

SEQ ID NO: 68629 - DNA, 4846 bp, Oryza sativa
tatatgttattagtaaaaataacacgtaaaattgacacactttgtataatttttatctctgatcaactattgagaaaaaggctatatgctatatataaaccatttgatgtggtttataacaatttaaatacatatgaattgatcgtataaaagaaaaactaagatgatgtgagtcaatgagagaaggaaaagaaataacataatagtataaatcaatcatttaaaaacaaaactaaggtgatataactttataagagaagaaaaaagagtgatataatttggacgtagatcaaccgtccaatagttagaaatagttaagataatgtggcttaattagagaaaagagaaataacattattatacttattgaaataaactttatagatatataggataagcgtgttttcatctactttcttaccttaatcaattataccatcccttatttaacttaatctctttagagaaaggaaagtaaatttcatttgatcaagctactccctcctttcaaaagtctaagtcctatttctttttcaccaagatcaagatgtagttaactcgttcatcatgtgacaaaactaataaacatgcaaccaataactactaaaatgacttattgggtttcgatcaaaaatttaatatagcacataatgactacaaataggacttagacttttgaaaaaaatcaaagaatgaaatagtacttagacttttggaatgagagagtattacaaaactagtatatacttaaatatatgtatcataaaacatatttaatatcatttttttatgaaactacatattcaaggtatggtataaaatactacagatttcataaaactacaactttcataatctcaatagtgctatagatataaactttaaaatatgtagtttttttataatttcatcgcttaatctgtagttttgtgatacaatatcttttaaatttgtagttttacgatatatatgatgttaaatatatagtttctatctatagtttagtgataatttaattaaagtaattatggttttatgatatttacttacagaaatgaacttcatatgttcatggagttgacgtgcagcagttgacgtgcgtgaagaaccggcagcggcgagccggcgaacgaatgaaagcggggacaggatggacgtggagccgtcaactccgcacagcagcgagctgcagcctgcactgtagtactcactccgtactaaaaaaattaatttctagctatgaaacatatgcttgtccatattcataagaattggttcttttttagacgaagggagtattacgctaactcgtcaagattctcgggctcccttgttgaaatgttgagttgttggaatgttgagcctctgttgaaacgttgagttgttgccttgttggtaggtgcctccctttggtcaccaacaaaacaaaattcatgctcgctcgtgcgcgttgcgtgctgctgctagcctcgctgctggcctgccgctggttgctccatcggactgattgattattggatgggattgcctctcatgtttctcacttgggcattgccgttcatccttttgtcacaacgagtgttgctgtcgttgctgctatagcccgtcatgtcatactaatgtttttttacaggaaagcaggcaggggaatagaactgtgtctgatgtcttggccccattgctatagtaggacatgtactgtggagtactggcaaatcgtccactgctactattggggtctttgggagcggcgaattctccactgcatgtacagctagcagagtcatcgagaacaattttatcggtattactggtagtaaaaacaaccggagccattagaattctattgccagtagaaacaattgtattcagtatactcctacataatacttccagtagttacaatggtaacatataattagatatggtacatcgattgaggaaaaaaaatggaggtttcggatttattcaactattgtaaaatttgtcactcgatgcttaagagcaaatttaactgtttttggctgccataatagagatttaagagcggctcgctgccaggcctagccaatcatgccaagcagtgtgcactataagagtccttggataaaaaatatatataggaattttatataatttaaattctatagaaaactcctatttaatcatttaataaaaaagattggatattttcaaatcctataaaattcttgtgaaatggctcacttaatatagattttagatgaaacttagtaagagcttcaacttcttaaaaaaattattgaagtctatctttttcatcgaattcatacggtctaatcaaatactccgtagatatttacgtgttttgcaattctatattttagacttacttgattcaaaggaaatttatagaaattttagaggattttattcctataggaatttttcctacaaagccctttgaatcaaaggaatgaaccctatggaatcctatgaaattcctatgaaatgcctcttcctatataagttttggaggaattttaataagaggtagaacctcatagaaaaaatcctttgagtctttatctctcctcaaattcctgtgtttttcctgtgatccaatcaaacagtcattcatacgtttttctgtattttgcaatcatctgttttacacttacattcctgtcaaaatcatatgtttttcctattcctccgttttttcattcctgtgattcaaaggggccctaagggctcatttgaatcgcaggattgagaaaacgtaggaataggaaaaacatatgattttgatatgaattgtggggatacccggtttgagtatggtatcccgaaaccacccgcgaccgtccaggatttcgatcgcacacagattgatatacagaacagctttcgatacatatacccaagtttttacagaaattattacataaaagataactaagacaggttttaggggccgacaggccaaacacactccctacaaacaaaagactcaaacacaaaataggataaaaacaccacaggcaacgcctgagagcagatcaacctagaacaaaaactcgacagcaccatagaattcttccccttcctgcgcctcctcagggaagaactgatcgtctgaaccacattttatgcaagaggtgagtaacgaggtacccaacaagccacatccataataatacaaatagaatatatgcaaggcgtacaaagaatatagttcatcaaggaggttccataacaagcctattataaatagtttttccctactttatcaaacattttattcgcaaacaattataaatcatcattttaaaatggtagcaatattaatcaccattcatcctcatcttcgtcatattccatattttaatttaaaatctactcataccatgataaataggaatcacccaatgacatagcttcttaaccggaagcacggcacattcgaatgatttaagactcatctctgtagagactgcccagctttacccacctgatgtcaacagctagctaggctgaggacaacatagccgtttgagaatcccacttactactagttactgcccagtgggatattgatccgtcctagcagtcgggcacttgctaggcctaagcaaggctagacggtcgctgctttcacgggttccaccgttgtggatcatgtcaacctggccaaagccccttccacatgtccaccccaaacctgctcatagagccaccctacagtctttcatatagtgggacaatgtactaggctaagtctgattactcagtcctatggataggcgcaaattacatcattttccatggcataagggggtagtccttatatccgggaaagccaccaaaactagcacaggcccgtgcatacttcaagtgtaaatatacactttccacaaaataattataacaatatgcacggcctcacacaccacaacatccatcttcacccggaattaatcttccatatcactccaggcgagtgactcatatcaaataacacattttatatcacccgacacgccaccacgtgacgacgggtaaaccatgtatatgagtatagatatttggtagtcttatccactagaatattattgtgaagtatataaatctacacctaggttatcaaaggacgtgatatagcaattcatggatttggccaataataacaatgtaataatgggtaataactaaactaacaagtttattcaaaaataattcatatgcaaaataattttataaatactcaatgcagaaaataactaagtggttctctacaaggtttcaatatgatcaaagattggaactatggcttgcctcgtgaaatgtggccttcgggagcttcaacgtagccttctaggtccacttcagttcctgcgagtccggtgggatcttcaacgcgatctagcgtatgcacacgaagaaacgaccaaataagcctataacaaaaatactacaaataaacgataaaataaatattgtgaatcagagcccgaacaaaagaaaatgttaaatcgagagttaatttgagttggatgaaaaaaagatttatcctagggttatgattcatggcatgtgtagtagtggttgcactttgggattattgttgttacagatactagaattgatttggtttgaatctgggggtgaactgatggaagaattgatatgaatcggttttcttttggttgacaactacatctgtaatttatttttgttattagactatgtttatactttaaatatatgtccgtgccaaaaaattttgccaactaaacaagccctaaaccaaaccaagagagaatgtgtcatttgtgtgtgcgcacatacaggatgtctagtgtcc

SEQ ID NO: 68630 - DNA, 1699 bp, Oryza sativa
catggtggcggacaggagcacgataggaacccgatggaagcaaggaaagaaggttggggaaaattctcaccagtgagaggtggtcctgctggtgctatggtgcggcggaaaaaggtcgacgacggcgaaacggctgcacagccggcttggctctggcagaagaaatttggggatgaaaacgagattagcacttgatgtctacagaggaatagcggacttcggctcgttcactttgaaggagagaaggtctggaggaggaggggaaacaagggagggatggcaacgagcaactgcgtggctgttttggaggcggctcgagcgggcgtgtgccgagctcggggcggcacatgagcagcgcaggcaggagcgaggccgcacgcgactagcgcgtgcgaacacgagcagggcgcaggacggcgcgtgcggcggctgcctcggctgggccaacagcagtcgtgggccagcacggcccaaacagagggaaatgggcaaaggaaatccagaatatgggctggattgctaggaactcggcccgagaagaaacacagtgatctatttgaatttttggagagatttttaatagaattttggtaggatatttttgaataggaatcgatgagattgggggttttagaatatttgcatgattactccggtttaacttaaaataaacacgagctcttctgatgattttgggaattttctttgggatatctcggatttggtttggagagggaaactaaataaagttaagcggaaggtggaaacttagaggaaacaaaaggaatataaggattgggaggctccaattcgaaagaacgaagaacatcgactttagatattttcgcaaaaattttaccctgaaaaatttagtatgttacatgaatgtaagtataaaacagagggttgtaaaacataggaaaaacacatgaataactgtttgattggaccgcaaaaaaacacagaaattagaggagagataaagattcaaaggaaagtttccgtgaggtagaatctcatgttagtttcctccaaaatttgcatggcattagccattccataagattcatttctttgattcgaagggagatatttaaaaaaattactatagtaatgaaagactctaaaattctgatgaattttctttgaatcaatagggataagggtgtgttcgttgtacctggttcccaaccagaaacctccacacagaaaatggaatgatccattagcgcgtgattaattaagtattagctattttttttcaaaaatggattaatttgatttttttaagcaactttcgtatagaaacatttataaaaacacaccatttagcagttttagaaacgtgcgcacggaaaacgagggagaggggttgggaaaaggggcatccgaacacaccctaagcattggagccacaatgagcataactatgggtgtgtttagtttctgaaaaaagttggaagtttgaagaaagttgaaagtttgaaaaaagttagaaatttatgtgtgatggaaaggtttttgatgtgatatgatgctgatgaaaagttgggaataggggaaactaaacccggactaggctgtgtttagttccttccaaagttggaagtttaggttaaaattaatacgatgtgactaaaaaattgtatatgtatgacatgttaatatgatgaaaaaagttagaagtgtggatctaaac

SEQ ID NO: 68631 - DNA, 5948 bp, Oryza sativa
  unsure (1)..(5948): unsure at all n locations
cttccccccctgggtgccccgcggagctagcagagatccgatcccctctcccccaccaccatccatcgccgcgcgtcaaatcgaatccagcgcacgtagcattcgcgcgcggagaaccgcgcccacgcagtacggtacacggccgcgtgggcgtctctctctcccgtccgtccgtctccgatcccggacccggagtgggcggaccagaccgtgcctcgcgccggacccggtgcatgcgcgcgcggagatatgcagggtcggcggggataggcgggcacgcacgcacgttccgttatgatttctcgtacttcaccgatctcccggtaggctcccctcaatgtcctgtatcggattacactaaccagaaaaaaaataaaaaaatcttagatttcatttgcgtcaccggtattttagagctcttttaaaacacatgatagagaaaacacagcaatagataaaacacaaaaattgaaatagaaaacatagaaaatatgaagagggtccctttgatagcaccataggaaacaaaaaaaggaaagaaaaatttccaagagattagacctcttagggcctgtttagatcccacccaaattttttcaccctgtcacatcaaacatttgaacatatatatgaagtattaaagataggctaaaaaaataactaattttacagattgcgactaatttgcgagacgaatcttttaagcctaattgctccattgatttgacaatgtggtgctacattaaatatttgcttatgacggattaattaagcttaataaattcgtctcgcggtttaccgacggattctgtaattagtttttctattagtacccaaacaccccatgcgacaccctatataatacccgatgtgacacgtcaaaactttacacccctggctctagacacccccttacttattttcctatgaaattgagccatagaaatataattctatagaaaaattcttaagagtcccattggttgccctaataagccaaagccaaagttaaaatttaaattttgagatttgctctggtccaacaataccagtacctcacggtaccaaatcatttctaatcgttggatctagctgggcaggatgggcattgttagatataacgatcggaaacgatttggtaccataagataccgatacctcgaggtacattttattggactggagaaaatctcttgaattttcaaacttaatttgaaaggcaattttaagatattttcaatatagtttcttttagcattagtttttaagtcgctaagaacatgcataaaaattttttacaaaaagatgtttttttattttctaataagtcattttgacttaattagtaggaaatatgagcaaccgataagaaccttatactttcctatgaatcaaagtatttcataggaaaatttccttaggaaattaaatcattcagaatttctatggtaatcctttcaaagggttgttactagttgtgtgctcgtggtgtgttctatacgtataccttaggctatagaaactcgttattgcttatctcctccacacggtgaataaaagtagccacgcacggttagtgcgcggatcccccgcacagtttactaaggccctgtttttttaggtctaaaaaagaagtccctccactttaagtccctttaaatctgtagagtcccaaacaggagggactaaagtgctttagtataagtccctaagggagtagcttattgggactaaagtagctcttttccacctgctgccctcatgcatgggtatggtgcatttctctttgtatgattttaggggtaacatggtcattgtgcagcgtatttaatgaactttagtcccttttagtctctataacaaaacagccatggactaaagtgattagttctaggactgaaataagtccccaggacttatggatccatacaccacctaatgtaccgtcgcaatgacatgggtgtgactggtactatatatacagacagtataaaagtgggcgtcatcatgcatgtccggatggggtgaaaaggcagtggcggttagtcagcatatttgttagagttgcaagttgcaaacgaaattgttgtaccaaaagtgtattacatgtgcatatcgcatataagttgagcacaccgttagctatttaacaataacctgaattatcaatttatcatataacattagtcccatgttttagctgttgatcaagatccagccgtccattggcgcgcgagtgttaaaactatcctagctagataatggacgactggtgcccttaatgactgagcttagagagaaatgtgccgcgcagttcattcagagaagctaaatacgaggcatctgattcgcatccaacggtgcagatcgatcaaataaaattgtgtaaaattcacaaaactataggcattttgcataatttatcacaaaactatagatttaagatcttgtttcacaaaactacatatttagtatgtccatttatcacaaaactacagatattttatacaatttatcacaaaactacagatttaaaaacttgtttcacaaaactacagatttagtgtattcgtttatcacagaactacagattttagtgtcttcatttatcacaaaactacaaatttagtgtctccattatcataaaactacagatttaacaatgctaaacctgtagttttgtggtaatgaagacattaaacctgtggttttatgataaatgaagatattaaatctgtagttttataaaataagtttttaaatctgtagtttgataaattgtgcaaagtatgtatagttttatgaaatttcaataaaattttaagaaagcctcaagaacacctcacatgcatgtatacattaatttgtactcggtcggggtaagtaggtaggacaagaggatgcctccaaacatgcacccacgcccacacaccccgtcgatcggcacgaaccgtacgtacgtttacgtactcccaagcggccggggaaggatcagatcgtgtcgcgccggatcgagacgtgccgcctgcatcgatctgcatggtcatagccctgtatccgtcagctaagcttaagctaggcgcgtgcatgcccaactccggccagcgaccatcagacgcatgcacggatacacgcatgcatgcgctttctttcttttgctctcgcttcgcttgcatggctgcacgcgcggcaggccatgcaagcatccacggatgcaaacacggcgccacggacgtacgtcgaaatcatggtacagtacacagtacgctggccggccaccacgccagcccagccgcatgtagcatgcagcgggtagcggatcagcgggcgagagcggttgcgttgcatatattcgcatgcatgcattgcatgacagcatgcgtattactcgtactgctctctccttctcaaaataagtatagttttagtattatttatattcaacgtttgaccattcgtcttatttaaaaaaaattacgattaatatttttattgttattagatgataaaacataaatagtattttatgtgtgactaattttttaaatattttctataaattttttaaataagacggatggtcaaagcgctaaatactaatatctatggctgcacttattttggaaggtagtcctactataggatatggcacggccatgcacctcatctcactcacacactgtgcatgcctctgatcgagcagtaagctactgtccaccggtccgatattaaatggagctagtaggagctatactaggagggaaggctgtgttttggagccttcttgttgtcacggcatgcatggccggagaggagagtactggacgcatgctctgacggctctgatctgtattcagacagagagagatgaagagaggcttctatagttgtagtattccgacacggagccgaaccgtcgtatttacaaataaaaagtaacttgtgaataaaacttatatatatatatatacatatataaaaataaatttcgatgaaaaatcttaaaatcagcttcaaataaaaaattaaaaaattaaaatttgattgataattataaatataagcgaaaaaatgaggggatgtatgcctggtcgtgcggtgccggtgccgagcccagggaactatgggaagtacagcatgcggcggcggggacgcgcgccgccccgggggggggggggggggggggttanacttnnatattgaggatattgcggaatggggagggatgctgcctgatgaaaggcgccatgatggcttctgcgtcgccctgccctttcttctgttcctgcttgtgtgcagaagacatgctccctaggtagggccggagcacgtcgtacctcgcctgaggcctttccatttctgcacagtcaaccttttccttttcttttagagcgacaacggatcggtcaatgcctgccctacacctactataggcttgtttgggagaacttaaaagtctgataagcaactggatggtagcagcttctcagaatctggaaaagctgaatttctcagcttctgacttctagtttatttcctgaattctacaactacagcttttcagaatctagatcaaaagctggattgtttagaagagtttctgattctgtgagaagctgcagcagctagaaactcccccgaacagaccctatataggcggccggccgccccgcgtggacgcaggcgttagtgaaaacagcgatttgtggacgtaaccatccgtgtagaaattaatttcgtcgacgatccactacaaagaggtcatttcaaaccaaatactaaaatgcatcacatgatagttaagaccgaactattttgtttcggtcagttctggttggtcttcagtcatgaccgaaatagcagtgggcgatggtgatggggaggttggaagcagaggtggacgacaggggaatgatagaggtgacaaggcaaaacgaccatattaattttggttcattacaattgacgactgagttttcgatctcgcttagtttggtttcaatgaattgtgtatacccctatagccaccatatacaagcattgtcaaaggggagtagctacattatcacgctatttttatactatcttaaaacgaagtcgtccaccttcccttctactgtgtgtatcacattcatacacgaaaaattatcattgggtacaatgttttatcttcaatcacactactagcccatctctaactatatatatgggcatgatctcttacaacatctcatattactagttccaaaaaataatcaaattattttaacactgtatattccctacacttatattatattgtaattacgctataaattctaagtttatattgtaatttcaatgtaaggtggtgtttgaatctcatgaagatgaaaattaagtatttcacacaaaatgaggtggtaataatatgtgattaattaattttaaattattaaaaagttgaaaaattgattaatccgatattttaaaacaacttttatatatttcgcacgaaaaacaccgtttaacagtttaaaaagcgtaccacagaaatccaaaagtttatccaccccttggcttggattcgaacggggcctaagttccaatatctacaatataatttttctagtgcacaatgtataggagaattatgattagaagtaatttattacgtacttaaaagaagagatagaaacgtactccatttacatacttcctcccgttttaaaattattggcgtttggatataacctcacgttatttacgagagtatattcattttactcaatccgaacatattataaacgtaattgctggtcttgtgctaatggtagtcagtaacgatattttttagcgaacccgtgccaaaacgttaccgtacgcgttggttcgtggcagatcgatgaccgggccggcgcctagctcgttgggatagaacaacaaaattaatactccctccgtttcgt

SEQ ID NO: 68632 - DNA, 4366 bp, Oryza sativa
gcttccagcctctgcctcccaccggctttcaacacccacgccgtcgcagcctcctgaccgccggtcgccagatctggccaccgggaagccggatctggccaccggcgcctttcctcgcctcccggccgccgatgccgccaagtttggcctccgggaagccggattctgccgccggcgccttccctcgcctcccggccgccgacgccacagcggatccagccaccgacaccttcgccacctccacaacctcttccccgactgccggacgccgcctcctccgccgccgaccgatgaccgccatatccggcctccacgaggtcgggggacgcggatccagcgtccgcggcctttcccctccgccaccgaccgccggccgccggatttgtttgtgcttgatgttgtttgtgcttgatttgctcatgtttgttgcttgtgtggatgtgtagtttgttaaaatggacatggatacttgtgtgatgtatattgtcagattgcttcatgtgtagttgtttgttgagatgtatttgatttaaaatacaaagttgttgtatcatgtgcatcttgagatgtatttgatttttcttcatttcgtacatttgggctgaggcatttcttttttttctgggtgatttttgacgtctgtgacgggtgagaactaaaaccagtcacagctgttttgtcacctttgacgggttgcaaagagtcacccgtcacaggtgtgagtcacctgtgacggctatattttttagcccgtcaaaggttttaattaccagtgacgggctttcacccgtcaaaggtgaggtgtagtcatcagtgaccacttgtctctgaccagaaccaaatccgtcaaaggtgagggttagagtccgtcacagatgactggatccggcctagtgtctaacatttaaattttattctaaaatatctaatttatttcaccattactcctatctcaatcaatcacaaccaactttcatttaatttctcaacttcatctcaaattgagattcagcgcggttgcacaaaagcaactgcatgcaattacaaccattcaagacctaacacagacgcaaacaattgctacaacaggatattcacaatggcactctttgctactattgaccatatgtgttgctactatgactgcagtcataatagggatggcaaacgggcgcgacgggcacgggtagtgcctacctatacccgtgcggccgtgcccgtgatattatttgtacccgtgggtatgcccgttactacatgacgggcaatgattgttgcccatgcctatcgtccgcgtgcgccttgtgcccgcgggcgtgcccgtttacgggcaatgattgttgcccatgcccatcgcccgcgtgcgccttgtgcctgcgggcgtgcccgtttacccgccacaaaaaaagcagtggaaaaaaagtctacaagcttctaagttcaaatttgtcggtgacatgggaccggggatatcttgactagaggtttggggcagctgcggtcacccacgtggcctgaccccctcaggggggggtcgggcccgatggtgatgaggccgcccctccctctatctccccgaggggtcgggccgctcccgtttcgaccccccgagggctggggcgccccgaccccctgagggtttggcgccacgtgtgtgggttaggtgagcacagcggcgctcacctaaccgcgtttattgcgggttggacgagcgcctcatgccgcatttaatgcagcatagcgcatgcttatccggtccgtgatcggtcgcagtgtgtgaccggtcacagaccggtcagatcgcgggttagggggcaacaggcggcctgacacacgcctcgccccgtcccgtcggaatgatgagagcctccaggcactcgtccctagccggagccggcgtgggaactcctggagttggcacgtcagccccggccagatacattccaggcttcatcgcaaccattgcaaggaagtcattgtatgaagaagggcagacgtgtagcatgctaaactgacacgtggtggacaagaatgaccggtctgtgactggtctgacgccggtcgcgtcatcagcaaacaaccgtgcttccacgttgcacctgcttccggcggagtggaggttggtatgacccatcccatcggagggtcattcggacagcagccattgcaaatctccgcccattaatgaggaaggacagggttatcccggtgtcagacgatggtacaagccaagttttggtcaaagtaggatgggtccccacccaaaagaagggtaggtagaaatggtgtatgtggtatccccttgagatataaaaggaggaccatgcctaccaagagagaggagggagaaaaagaggagagaggaccggagctggtagacggagaaaagaggagggagaggggctctagagtttgaactctcttgctctccagctctttgtaactccttcatacacagatccaccagaacacaggagtagggtattacgcttctcagcggcccgaacatgtctacatcgctcgtgtcttgcgcatttgctctctcgcgaaccattccacagatcaagggcttagaacctcacttagcgcccccggccgaaccggcaaaggggggcccgcgcggtctcccggtgaggagccccacgctccgtcaaaatcgaacttaaaacatcaaatattctccgcctcggtgtggtgtctctcctctggcagcgatagaggaagggggagagaaataataagggaaataaaagggaaaccgtagaaaacaaagaacgtggcttctacatgtaagttagatttcgcgggtaaatgggcaaagcgggcatgggcagtgattacccatacccatgcccatttacccatcgggtatatcttttgatccaataagaaacccatgggtataaaatggagaacaaacccaactctaatagggtttttacccacgggtaaacgggcaaacggacacaattgtcatccctagtcataatagcaaatacatcggatctggattgactcacaaccaccactaattttattttagctctctccttagggtgtgttcaggtcctttaggaggaggggttaggaccctttcttttcgacacgcgaaacgaagcacgcattagtacatgattaattaagtattaaatatattttttaaaaaaatattaatatgattcttttaaaatcatttttttctatggagatttgtttttaaagttacattccgtttagctgttttgaaatcgcccatgttgaacacgagggatgtgaagctgggaacctcaaacaaacgatcgaattaagccctcgtttgttaaggttaacctcttcatgaaaaaaatccactgtgtttatattttataacaacgaattgaatgacgagtaatcgaacgtggcattccctttaattgaacttacattttgatgatgaatatcagtgctatcatctgcaatttgttcgggaaaataacagttttttttgcagtgataatttaggattatttaagatttgcacagtggctcctttctaggagcatgaaccatcgccattgacacggacaccttacctgtcacaaagaaaaatggggaaataactgctcccttgtccaaaaaaaacataatttagaataaaataagacataactagtactacatccgtcctaaaataagtgcagtcgtgggaatctatgtccaatgtttaaccgcctgtcttatttgaaaaatttaaaaaaagttagtcgcacataaagtactattcatgttttatcatctaataacaacaaaaatattaatcataaattttttttaaataagacgaacggtcaaacgttagacataaatagtgtaaaactgcatttattttgggacggagggagtataacgaatctaaactggagcagatttattatactaaattatgtcatattttattttaggttaggtttttcagtgacggcagagtgccaagagaagaaaatactagcagaggcagagacgatcagacgaatggctggcctctctacccacacccatgccaaggcatgaggatgatgttgtccttgtccacagtgcacagacactggtgcaccgtgatgcacagtcgcacacaggcacacagccttcttcacgaagccatatccctcattcccctctatatataagccagcaagctgcgccatgtcatatcccccgctaaactctccgcccgcgcagccttgcactcgcgtcgcacatatcgacccatccatccggcacgcatgcaggcgcagcaggccatggacgagcccgccaacgcgcagctgtacgggcacgctcacgcgcactcgcaccaccaccggagcaagcgcccgtcgcccggtgg

SEQ ID NO: 68633 - DNA, 24750 bp, Oryza sativa
cattcccattcccactcccacagccgcgcacacaaccccagtactcgcccacccacctccgcgccgccgccgcctccacctgccgccgcctcatccgccacgaccgcgccggccaccacgacaggcgccgcagcgacgtccgcgccgggagcggacgacgacgcgtggggcttcctcctgcgacgtgagccgccggaggcggggctcctgcaagacgtcctgcacgggttctacccgaccaggcggccgcacgacgacgcggggccggcgccgaagctggagcggccgtacgaggcgacgtcgtcgtaccgcgtgtcctccccctggggcgccgtcgaggactgcgacgacggcgacggcgacggcgacgacgactaccgcgggttcccgatgatgccgcaggggctcctcgaggacgtgatccagtgcccgccctacatggaggtcttggcggcgccgtcggccgccgtcggccgcgtcagccgcaggggctgagccgaaccggcgacgtcgagatctccgccgcgcgcagccgctcatggcgcgcgtgcatgcatgcgtcaatgcgggcgcattttgcttcgctatcctttgttactatctgcatcttctctaatcttgctgagattacggtggtgttctgtgtactagtttaacttgggatgattgatatcttggctagtactaattccatgcatggccttcttgaaacttgatcttgttgaaaaaatgaatcttgatcttattgaacaattaattcaatcttaatgaaaaaaaatctcgctcattagcatgcatgcatcaacagctagtttgctcatgcacagggagatttttcacaaccagtttgttgtttgcatagtgccatagttcgattaaaaccttttcaactttcagctcttttttgctaaaaaaaattcagctctgatatgatcgaaagctctttaatgccctgcacgtaaaagcagggatgggttatactaattgatggcccttattacatgcacaatctcatggttatttcatcagtgtgggttttcaaccacgtttcaacaaattactagtactacgaaattattatattgccgttttcaattaatagcaacgagcaaatgccatcgtagatcaattctttgaaaaaccgtcgtatagattgactagcaatcataaaaatgttgtgaaacatggggcattgttatagtcaaatctatatcagcacttttactttgaagcgcattatacagtcctactatgccacatccatccatcagtgagctcggcttcttaccaaacgacaagcagcagttgtaactttatatgcacgagttaaatgtaagttgtactcccttggttggacgagttatatctcggttggagtaccaactaaactgaggacacccacaatggttatttataggctctctataagagatccatgcccgcatattttcttacttggaagagattaaatgaagagagagagagagcaaagctatctactaacctggagatagtctatagagaaaaacgaggcaatgtattagagagctatagatacccatgtagatatactactattgaggtggtttactattaatctagtctattgctgagatgtacatgttttatagatagcaccttactttaccattgtgggttctctgagggtgtgtttagttcacgccaaacggaaaagttgaaagtttttgtgtgtagaaaagtttggtgggaactaaacttggcctgaacacaaaaaacgattcaaaggtaaatagtgacataacgaataaaaagagatttttgtaaaaccatctattattccagtatggaactaaggccttgtttagttactaattttttttcttaaaaacatgacatagaatctttgaatacatgtatggggcattaaatatagataaaaagaaaaaaaattaattgtacattttgcattaaaaagtgagacgaatcgtttgagcttaattagtccatgattagttataagtgctacagtaacccacatgtgctaatgatggattaattaggcttaataaatttatctcgcggttttcagacaagttatgtaattagtttttttcattcgtgtccgaaaaccccttccgatatccggtcaaacgtccgatgtgacaacaaaaatttcttttcgtgaactaaatggggcctaatatttcagtcacaacttaatgctttagattatcttcgtgacgcgacaaggttgcaattgcaagtactagccactaatagtgacatttcaatcagttgtaactttatatgcacgagttaaatgtaagttgtactcccttggttggacgagttatatctcggttggagtaccagctaaactgagggtgtgtttagttcacgtcaaacggaaaagctgaaagtttatatgtgtagaaaagtttagatgtgatggaaaagttgaaagtttaaaaaaaaaacttaggaactaaacttggcctgaacacaaaaaccgattcaaaggtaaatagtgacataacgaataaaaagagaattttgtaaaaccatctattattcgagtatgaaactaaggccttatttagttcctaaatttttttttcttaaaaacatgacatagtaatcccatggcatttcttgactctctacgcaaacgtgcgtagtcattgtgtttcttatgccatgtcttctttcatcttatcgtgcaagcctagtatggtggtgtttaaatctcctggagatgaaaatgaggataaagatttaagtgtttcacataaaatgatgtgataataatgtgtaactatttgggttttaattattacaaacttaaaaaatatattaatctgatattttagaacaacttttatataaaaagttttcacacgaaacacaccgcttagcagtttgaaaagtgtgtcacgagtatctaaattttcatccacctattacagaagaaactaacgggacaaaccatactcgctctttcagtccgctccttacatggctttgactctagcaagtgaccatgttatgttgcctttttccacattttcatcaagttgcaaagccagtgccgccgtcaaggccggtgaggcggtgactaatagcgtttgttagttactgactattttttcatacgtcgacaacaatcaacagagcaatagtggatacaaagctagagatggagctcgagcagttgcctgatccacctgagaggtgaacccgccatcgtttctgcctatgtggtggctcactatagaattggatgcaatcccatactttgcagcgggatatctagttaagaatggttgctaaacatatggcaaactaaatgtggtagaaattttagagattaaaaggtgggttgaaaagaaaatgaggtgggagtctatttgggcctatcttctagtttaggcctcactagttgttcctgtagacctaataatctaacagttgatgtttgagggacacattgatcaagcgactaaaatatgttgatgctgtggttcaacatggacaaaccaacaatatgaataatttctatgcttaagttcgatgatcggcctgctaatagttgtagccaaaatcggcttgagctggcccagttgggctagactagtagttcggccatgtttaggtctaaagtttttttttaaaatttttaattttccatcacatcaaatctttcatacacatatgatttttcagtcacatcgttccaatttcaaccaaattttcaaacttcagcgtgaactaaacttcgttgagcaattgagctcgatggaatggaatcgaagaacacgcacgcacgcgattctcgcagtacggccgcggggccccggcccggcgtctggttcattctctgcgcgtgcgcgcaaggatagagaggcgatatgtgtgatcgagctgagcagagtcgtcgcagtctgcatgcggccggtgataaatttcttgttcccttggtgcatgcgtgctgcatcttgcatgctgcgggcgcggattccggagttggtgcttcgctagctagccaaatctcccgtcacccctggcccaaatcaagcggttcaattgtcaattgccctgtcgaccaatccgtcgccaggaagacgtgagcaccggtggttaacagtgcaaagccggcgccaaacgataggtgcagacgtgcagcggagtactcctatctcggatgtcgttgttgtcgcggcggtgagccggcggcaacgcaggatgtgagggtaattaagaccgaacggttctgttgctgggagaggggagagagagagagagagagagggatagtatagcacgtctggattcgcgcgagagttcataacgctgtgcaggggcgcctggaacactgcatgtgtggcgctttccatcgacgatcttcgatggcgtattgtgcgggtatgatgggtatgatgggttgctgtgggttcaagtgaaaaaaccttgcttggccttatagcaagctgtgcgcaccggcgccggagaggtgtatgatcgacgagctcaccgaagaatggcacgtacataaacaagttcaaaccccccttgtaagcttgttgtacacttgtttgtactactattccactccagatacgtatagtacgtattattgtagattccagtacacgtattagtacgtattattgtacgcgcagcgtctcccgagtactaatacccagctaagagcaagtttaatagtatagctgactactggctccaaatgaactatagtctattttatagccaattcagggcctcattgtttgccgtatggcttataagccaaagccaaaatttgaattttaaaacttgatttttaatttgattttgatgctttttcagcacatattttcttagctttggcttttcaatcactacgaacatatatacaaaagttttactggcatatcattttataatcgcttataataagtcattgtcaaccgatggggacctcatacaatagttatctatatacatatactacacaattcgtatctggtcccacatgtcatacacacatgtatcttagagtccgtgctgtagctggctataaatctgtagcccgctgctcttctcttttatcttttatattctcaaaatatatttatagttggctacctgctctaacgggttgaccgccacttttgttgcaccacgcgctatcctacaggacttgcattgcaaaagtcatatcccgattcgtgaagatcttctagtactactactactccagtggtacggtgtagtaacagaaaaaagttcccatcggccatcgctgctacagcctacagcctcctccagctacagacctacagtacagtaggagtactacggtacagcagcggctcctctctcccccgtgccacgcgcatgcacgcatgactgcgcccacacacacacacacacacacaggtcctcacccatcttgtcatccccggcccgccggctggccacactgtgcgcgccactgtactgtccgcgggaagagcatgcgtgcagccgtactggttggttcccagctgctgcatgcatgccgtcgtgacgcgaaaaagggctccttgtcgcgggccgggctccgcgggcgcgcgcacgcacgcacgcacgtcctcctctgcccccgcggccgacgacggcacggcaggctgcacagcgaatccaggcggtggcgcggcagcaggcgctggctactagtaccacccggcacccggccctgcccgccgcgcgcatcccgacgttcgtgtaccgtacgtgcgcattccgctagctgcgcttccggtcgtcgtgccgccccccgcgattgctcgataggaaaacctgtgaatccggccacaacggaggtcggggggtgatctctgttgtgatcatgtcagctgggttgctgatggtccagttcttcacacacacatacacaaataaataatattatatacgtacagaatataattttttttagttgttaagaaagttgatagaattatatgagagaagattataattagatgagaaatgaaggtaggtagaaaaaatgaattgtgtagggttgtgattgattatgaagagaatgttggtaaaaaagttgttatattttttaataaatcttgaaggttaaaagctgttatattttgggacagagatggtactactgaatttgaagttctttgtctctgtcccgtgtaacccagccgtggctgaatatatgcatgcattgtgttctgaaaatcatacgtgccaaggaacacagacgctgccgggctcacaggatctcactgcaccatagcagcaagaatttgatatctcaaatcatggcagagtttgtttggcgctggcagtgcaaagaaaacaaatgcgctgtgccaaagtcagagtccataaattcccaagatatgcatgcatggaccgtgtagtttttttccttttcgcattttgaccgtgtagctcatgcttgggttgctctagcaattttgtgcagggtggtgtccgaacagggaagagaacagagtaggacaaataaactaatcaggcccggccaggccatggaatagaagctggtcagaatagctcgttgggcagggcaggatgcagcagaatgattgcagctggagtatccagaagatgtccccctctgctctcaaaaaggctcctttcttgtgtgtgccttcatcaatgtccatgcttatggctccagtgcacttcattggccaagatttcttcgctatagctgctctcagtaggggtgggcagaataagaccgaaccaaaaaactgaaccaaaaagaccgagatcgagaccgaaaagaccgagaccgagaaattcggttagtgattcggtgccagccatctaaagaccgatttttttcggttaattcggtcatatgcttcagttaaccgaattacccgagaaaatcgaaatttggcccaacaggtgtagtaggcccaataagcccactaaatagaacaaaccctagagggactcagggtggagcagccgagactagagctgctcactgcctccgtgcctcgtatccatcgcgccgcccccagcccccccacgcctctgccttcacctgcatcgcgccacctccgccgtccgcctccagcgccggcgccacctccgcctcggcgccgcctccgcatccactctccagtcagcccacctccaccttggcacctccatcccgccggcaagcaaatccaccaagtcgtcggcttctaaacctaaacctacatgatcttcaccaagttgaacacttttaactatttcccatcttctctgtcaatatttctgaattgtaatcaagttttgttttggttgcttgttttaaaatgtgtttcaggttgctgaaaagtggaggaagaagactaagatgggtacatgtcaagcctaaaacttatttactagttggctgttgctactgcttgatctgtgatgtaatgttatcaacctataacttgtactgtggcagtcgtgactcgtaacttgtgaggttcagacttgagacctatcctgtgataatttggtgcttgatgttgcctattttttggtatttttgtgatatatatgtctgtgaaaaaaagtctaaaaagagggaaaatgttgtcaaaatttttcattcccctcaaatttcggtctgaccgagatcgaaaagaccgagaccgaatttgccggtcataagttttttttatgaaattcggtccggactttccaaagacggaattacccaaataaccgaagaccgagaccgaatttttcagtctgaccgaatgcccacccctagctcccagcgcacacacacatacacagagtgtgtgtgccgtgcgtgtgtgttgtgggcatggcaatggcatgggtgtgactgggttggagtttacgagcaaacacaagacattcaattgcctgcagctgcagcagtgttctagggtttggaaaccaaggacccttgtcacatggtcctgtccctcctatactgtccctataccactcctctgcctacgggtctcactcctgaccctgctggttgtaccaccattgccatactgcttgcagacgtgtactcgatccgtcaggacaaacatactcctacatacagtagttacagtagccgtatgtgtgtgtgcgtacaataccaccagtagtagtacatcagttataactagaaaatcagcgcgccagttggcgcgcatgatttatagcccgtatatattatttttgtgttattaattagcacattgttcataaaaaatatagaaatcaatttaatttctttgaaactcatgcaaaaatcatagttgaatggaattttctgagttccagtttaacataacagatcatattgttgagaaaatcatcaaattttctctttttttccacccatgctattgtttcttcctttgtttttctaaaattataattaagttattaactaattataaaattggtgttggtattttttaaaaaaaacaaagtgtttcacccctcacattatttctacaatattttaacaaatatacatatcatcacattatttctacaatattttaacaaatatacatatcatttttataatatttaacatatacttatcaatatgctccacattaaaaacgggtatcatttgtttattttatgataagtaccgataaaacttcacgtttcattattttctattctttttactcttagtttacttgttgaacaaaatatattaaaaattgtttagtgatcccgtagcaaagcatggagaatcacctagcaatagaaagtggaagggccttgaatcttcgatgattcgtccccttcaccgctcatcgccatcgcggccccgggtcgttggatcctggcattggaactttatttgctgcgttggtgctgggagaaaggcgatggccattagggaagacgacacttgcgagaacaaggattgtcgcgtcggtgctgggagaaaggcgatggccattggggaagacgacacttgcgagaacaaggattgccgtgtcaatgctgggagaaaggcgacaaccgttggggaaaatggcgcttgcgagaacaaggattgtcgcgttggtgctgggagaaaggcatcagccgttgaggaagacaacgcttgcgagaacaaggagaaaaggaggaagatgatggtagcgaaggcaacatcgccctcgtcccttgattgtccaaagctgggtatcctcattgagcccttcttcatccctctctcttcttcctcctggatttggtcgagcttggggtcgtggttattgctaccgtggatggtgaggacgtgctcgacctcgatgctcgttggctggttggcgcatccacactcgcggactatcacagctggtatggctcgacgccctccacttgctccattgagtgagtggatcttgctcgttggcaacagcttccgtggatccggaaaatattgcggtaaatgtcttcctcgttgccgatttacgacagctaacatcggctcgctgtttatatttttttgggaattgctaaaaagttgtcacaagtttttttggcaaaaaaaaacttttaaatgttactgtagtatagttgtagtataactacaatgtaactacactatagttacattgtacataatagtgtaactgtactgtagtaatctctatataagtgatataaagttgcatatagtattttaatacttatatacaagttacaatattgttacggtatagttatagtggaattatattatagttagatttaaaagttgttcctttaaaaaacttgtggcagttttttggatactatttttttcttatccattgtttcctcagcatgcaatctttttcaccagttcttttcgtgttatcgtgtgatttttttcaaccgagtttagaatgctctggattttttcctttgttttatctagactcttcacacacgttcaaaatgaacgtgctcttctggacacgtggcacattttgatgatatgtgaacttggtttttggtttggccacgtggcccaatgatttggtagagtttgcaccctgcaaccagtattttagatttgtgtgcacgcatgttatagtaataatagtatatatagctctatcctattatataattaaaattagcataaatggaaaaaaacagtttgctcgtccacttgtatccctaaccacgtagtgtttgagagcccggcagggtttcccaaaccaccggggtcaggttaccgcgctctagcggtaagcacggttatcgtgtggtaaccgtggcaaaccgtatgaaaccgtataaaatttatcaaaatttcgaagtatattttaaatttatttgaatttaaagaggttatcgtagtttttcttttacagtacactcgcggagtcgcggtaagcgcggtaactctagagcccggcggcggtactgttttgctagcgtaagtaaagggacaacgagaaacaactccgacgcgcccattgtatatttacgtatatcacatgcggtacaagtagctgcacgtatttggggggtacgtatggcagtactgttctccagcacatttgtcgtatgccagttgacatgtctctcagagacaaattaaggagggtcgtagctagccagacacagccacaggcgcggtgtattgcatggtgcagcttttctttttgtggaaaaataggggggtcgtagtgcatcatgccatattgccatgcatcggatgaattgaagatgatggggacgaaaatgcgtgttacatgatgcggcccttgtcgtctcctgcgatcttcatagctagagaatcataactccaagtctccaacgagttgtagctgctaacgatcgagtggtacgaacgaaaaaaaacgatccgccaaaaaaaaaaaacccaacgttgcgtaatgtgattaaacaaaaaaggaatttcagaaaacattgggcctgttcggtaggccaactgctgcggctgcgcacagtgagtgcgacactgttcatgccgactgcgccgcagccgcagccagggcagccggacaggcccattatttgaccgaaattagatcgtataaaaaaaattctaggagagaggttacaggaaatgaaaaactgacagaaattgctgggggatccaactgctgatcacctaagataggaaatggaaaacagtagtagtattgtattgtggacggacaacgactactgaaagtctataactatgaggccagcagtaaactaactctatgaacagtaaaatcataccgtgtgaggggaacagtatttgggagaacttaatttgggccgttacatgtgtaatcggatggtaaaggaagagcctaacgcaactcttgtgaaaacggcacagttgaagccgaatgttatagagagagcacatggcctcgtagaactaacggcccaggatccggtccatgtgggccatttacagattgttgggccttttgagcattaatagatgggctttgagttgtaccagattgggctaaaaacatggggaaaaagtccactttgactcccttaaatatacaccgaatctaattcgtacccatcaaccagaaaaccggttaggacgactcccccaattactaaaaccggtacaaattgactccctaagtggttttagagggtggttttgctgacgtggcatgctgacttggtctgttgtgctgacgtgtcagcccagtcaccaaaatacacatgaggcccacatgtaagtgataggagaaaatataaaaagcgtagggcctacttgtcagccatcttctccctctctattttttcccccaaatcccccaaaaagaaacagtagagcaagcggtcgaggaagccgagtgcgtagttgttgtgcgggcactgcactacacgttgtcgtaggtgtagacgagggtgtggttgttgctgctcagcatcagctctggctcgctcctctcttggtactgtgccgccgcgtcgccggacccggacggccccgctagcggcctcgcgcctggcggcgataggtccggcaagcacttcgccgaccgcttgctcccgaaccgccccggcgctgccgctgctgccggcttgagcgtgcccccgccgcggatgagccggtggattccgaggtccgccaatagcggctccatgtcggcgtcgagcaggatattgctcggccggacgttgccgcacgaacttcttgtcgtggaggaaggccagccctctcgccatgccgcgggcgatgcgtcgtcgctgccgatcctgcgcaccgccagcacggcgccgtcgtccaataccgccatgtacatgatgctgctgcccgccgcgcctaggatgtacgccgacgccttcagtagcgtctccatctccagctccacgtcgccgtccaccgtcaccagcaccgcgccgccgccgccaccgtccttggccttcttgccgccacgtcgtccgtcttggcggcgacgacgccctccttggcggcgaaggacgccgacgtgtcagtcacctcctccgtgtcgtcgctctcgtctctggcactgaactggcgccgcgcacggcaagaattataccatttctcccctcgtcgagtgtacaagaactcctcggcgtgtcgagggacaactccggcgccctcccgatgaccttgaccttggccggcgccggtagccgcatccagcacccgaacttcccaccgctgccgccgccgccactaccggcggcggcggagtgttaacaacatcgcatcaacacggaggtggagctgtaccgccacggcagccgcacccggcacccgatcttcccaccgctgccgccgccgtcacctcactgtaggatacgcgacaggagcgaccgcggcgactggcagctctcgatgccgccgcttcgcccggccttcgcgccggccttctccacccaccgccgcccacggcttcacggcttcgtgcactcccttggcgccttccactccgctccctcgccgccctctgctccgccatccgtgccctcggcaagctctccgcgctactcgccgacgggaagagaaagagagaaataagggagagggagggaggcagaaaggttggaaagagaatgacatgtggaccccacaagtcagtggatcctattataatttttgtgtgtgagtgacaaattggtcccacatatatatttttaaatctaatcttacatcagtgccacgtcaacgccatgtgggacgaagaccaagtcaacaacgccacgtcagcaaaaccgcccttgaaaccgccgagggagtctatttgtaccggttttagtaattgggggagtcatcctaaccggttttctggttgagaggtacgaattagattcggtatacatttaagggtgtcaaagtggactttttccaaaacatggcactcagtccccttccgtgggctaccacaatgcacccgcagctaattaaaggaataagttcactttgtgacccttaaaagtgatcgaaatctaatccgtaaccctaaaccacaaaaccagatatttcgacccccaaactctcaaaaccggtgcaatttgactccctcgacggttttggaaggcggtttcgctgacgtggcgcctacgtggcagtattgactcggtctcctttttcacgtggtgttgacgtggcgtttaggtggcattagaaataaaaaatatgtgtgaaacccatttgtcatttatcaaaagtatggatgggcacactgacatgtagggcccactagctagctcgatcaatataaagagcaaatcatgcattcatcaaatcacatcagattaccacactaatcacgattagtgtaacaatactcacgtacatacactatacaccatgtcgccgcaggccaaatcccaaaggcaaactgcttctcttggtggtcatctccttcctctccgtgttgccatggcacacgctagcaagcggcagcggcaagcccctcgtcactgccatcaccaaggacggcgccaccaagctctacaccatcgccgtcaaggatggccaccccctcgccctcgacctctccggcgagctcgtctggtcgacctgcgatgcctcccactccaccgtcctcccctatgagcgcgagtgcgtggaaatcatcctctcttcatctttatggggcccacataaagcaaggagacggggaggaggaggaagggcggggtcgagccatgggtggtccatcaaattcggtatccgccgccccaatctcttcctccactggctcctccggtcttcctcacgcaccgatttgtgtcgccaccgccggccaactctcgagttcatcgtcttggctacggctggcgtggccgaggaagaggaggagacgacgaagccggcagtggcctcactgagactcggcgacgtctagggcagcgcctaacggtggctggagtgcgtgacggcgatggagcgagcgtggcgctcgagcggcacggggatgggaaagagcaggtcttggggattctctttatataggccggaggggagaaggtcgaccgcacggacggaaaacggcgccggcgacggtggagctccctattgaagacaccggtttaagaaatcgattgagggcgatttagtgcgggattaagcgggatttgttggggaaattgatgcccactacacaaggaaccgatttttctaattaatttagaggagaaacgatagggcagggagatcaatggaggcggcagtgcttgagttttacgggagagatgaacagacgacggacagaggtggaagaagctcctggcgagcggggcccacctgccagcgaacggaagagaaatagaggggaggatgaggagagaatgattttatgtgggccccacatatcagtgggtcccacccatacttttggtgaatgacaattgggtcccacacatattttttatttttaatgccacctaagcgctacgtcaacgtcacgtggaaaggagaccgagtcaatactgccacgtaggcgccacggcagcgaaaccgctctccaaaaccgccgagggagtcaaattgcaccggttttaagagttagggggtcgagatatccggttttatggtttagggtcatagattagatttcgatcaatattgagggtcacaaagtgaacttattccgttatagagagagcacatggcctcgtagaactaacggcccaggatccggtccatgtgggccatctactagattgttgggccctttgagcattaatagatgggctttgagttgtaccagattgggctgaaaacatagcactcagtccccttccgtgggctaccacaatacacccgcagctaattaaaggctgtaatggaccaaatgtccaatggagaccatgtcttgagctgggcctcatccagtcatcctggaccatttcaaccatagcaaagccctactcacagaaggtttttggttttccttatctctcgtgcctttgaatagtcccgatgcatttggattatctatagtgaatttgctgcagaaaagaggtgattgctttgataagatcacagaggctaataatttactattatattcattctagaatataagcatcgttttgctatatacctagatatttcttcataataaatagccagaagcgattatattttggaatggagagaatcacctaaacgtctgcaacggtgcaaaaagaattccgagtcaaagattctttagataaaccacctatactttaatactagtattacttatttgttcagtttagccttcgttaaaaaaaagctgcagttagccatggtttaggagaatacactgaagaaattaaggatgaaattaaggaggcagcagactggcccagctctttacgtactgcaagggcatgttcaccattcaagtgagcaagacatgctatttggcagatatgaatatatgaagcatatcttcagagagctgctagtattattttggtttcatgatagagtagtgcttctactatcattgctcctgaatggatggcaataaaaactgaacaggcagagtacaactaggttggctttgtgttgttttattaatcaccggattatttatttattttacacaagtgacctttttctccttttaatacaatagacttattattgttgtgtactatggctctgcaacgtcgcacaggacttggatcagactatgtaaccagggcatttatataacgtcagtcgtcagacatggccagcttcactattgctttcctcttgattatgtggcgccctacgcaattagatggagattttgaatttataatgccatgaaaagaaatgaaatgcaaatgtttagttgcacaaaagatagggaaaagaaagcctcaaacaaaaagaaaaggaaatggttgccctgcctttgtagagaagtagattgcaatgatgaacccttgaactccaaagcaagatttcaggtgccattcgcataaactaaaccggcttgagagatgttgagctcagcgtagggaatcagtattataaccaatgatggtctgcagccacactatcatggaagattaatactagattaacatgagggacagaattgacgaccttcaggtgttccattcaatcgtatcactcaagttttcctttcttaattatccacccataatcttcgtgtttgctcgccagatttgcagacagggcgtggcaagctctgataaaactaatgtgtttcagctcattaaccgatgagtttgtccagttaatggctataggaaattaaccatgcgtttctgaacctttgaacagctaggtcaaaccctcggactagtagtagagctcaagccatggagcagtttttaacatggacatttcgttagttatgggagtgcgagctctgaattttcctgaaacggaagaatcttgctgcctctatgtcagaaattcagaaagaggaaaaatcacaagtggcgggcaggcgcttgatccgatacaatggttatggaaataaacgggcagcctcaataattagcttgagccatgactaattgtatatacaatataaccaaacttctaacctgcattttaattcttttttcgaaacaacctgcattccaaatcttcatatttggtagtactagtcatttccaagggcggtatagaaattactagtactttggactcgtctaaccaaccaaacaacaaaaccatacaatttcactcctatgaaaaggcgatctatcttagtataaacacaatattttcttagataatgaaataaacctgatatcaagtgcagatgttcacatgttattttcatttaaacttccatatgggaaaaaaaagggaaaaatatacatttctcttaattaaagtagaacttttatggtcgcagacagtgcgacctttttcctttcgactggagttcagacccaccatttaatttactaattgctgcgtctttaattaagtggtgacaagaattggatagaaaaatttatccagaggtgctccacatccactccatttgatttaacaaacgctaagtagctaacctacctatgtcgcgcctaaccgtagctgctaatgaaaacacgaccaaacgcaaacgtagctaattaatctagctataggttatctgagtaattaacacaatcaatcaatcaatttaatgttggacataaattccttgtgaacaaactgctaaccccactttttgcatacacttgatgacttaattaagattataatggtaaattcagtttcccgtcggaggacgacggcgtctcccgttggcgttggtggccctaggggctgcggtggctctcatcggcaccggcagccctagggactgcgacggaagacgatggcggtttccgtcggcgccggcggcactaggggttgcggcagcccaggacggcggtggctcccgtcggtgccggtggccctagaggctgcggcggaggacggcggcagcttccgttggcgttggtggccctaggggcggtggtggctctcgtcggcgccggcaaccctaggggctacggtggcccaggacggcggcggctctaggggttgcggtggctcaagacggtggcggtctgagcactttggatagtagatccttaggaatccggtaaagtggaagccgatcccgtcggttcgtgtctagttggctagttccgactatacgacgaatgatggtggttgagagtgggcttataagcggcgtgtgacgtcagctcacctgaaactgatgaagatgacacaaatggaggttttcatcaacggtgcactaggggcgacagcgactagtagactttcactcgtcaaatctagctgttttaggagaatatggaagcagaaaagcaggatgtgctgaagtcgtttggttttcttttctattttggttgtgttcttttccttgttgagacgtgagtctaagtactattgtatccttttggctgtgtatatccttcgtggatatagaggccagattaatgaaaatccattattaaaaaaaatggtaaattcagttattgaccactgtatgacaatgatatttccaaaagaaaattatcagggccttcttagaatgcaagatgtttttttctcgattcagaatagaattaaactgatcgatgtgaaagtaactttggcctgcattagaagagaacatttaactagtgatccaaccgagtcctgtatctaggagcccatcatgctcatctgatccccagcaaaaacctgcaagatcctactcatttctgagcccctccatcctgacttttgcatgccactctggtccctgtttcacatgtccccttccaattcaagtcccaaatcctaatcaatacccttgctagcactcatcagagttcatcaatgacagtctggtatatgaatagtttgaattgcaaattcccactccctcgcccttgaatcccagaaaaaaaaacacctcatgttagtgtactaaattagtgaaattcttggcctttcaaaaaaaaaaaacattgttagcaaggctagggagttgccgctgatctctatctctccgagcatgtgttagtggacgcttttcacggatgtgagtgtggtgttgcatgtcgtacacgtaatcggaaaaaacattttgaatacttccattatccaaaaaaaaagattttttttcttttttgcatcttccttgtttggcccttgcttctctctctctctctctcctccccaaccacttgggcatcatgatataagtagagccaccaagaaaccatttccaagggctcacagaaagtcaggggcctagccagccagccaagccagtggttataaccaacctcccagtgaaactttcagaccctcccgttttagcaagtgagagaagccctgcgactctcgctcgctcgctcgcccaagatgaagtttatgaaacttggcacccggcctgacaccttcttctccaacgaatccgtgaggtgtttttttcttgagaaatcctgatttgtggaatcaatcaatcaatcaatcttggcatggtttcagactttcagttcctgggattcttgcctgtcgtctgaggtgattgaatcgtggttgcctgatttttgtgggtgtttgttgtgatgttcacaggtctgtctgcacagaggtcgccactgacctgcaaatcttggtgggtgactgcttgtatcagcttcacaaggtaatgggacatgaaagattgttgttgttttttgtttcgctgtggttctagaacggatcttttctgcaacttttgtgataattagatcgtgaattttaggggaattttggatttggttgcatgtttggattgttttgatatcgaaggatttgttgatgatgtttgtttggaatttgtttttgacagtttcctctgctgtcgaaatgcctgcttctgcaagcgctgtgcgccgagtccggatgcggcggcaatggcggcgacgtgatcgagctcccggggttcccgggcggcgtcgaggcgttcgacgcgtgcgccaagttctgctacggcatcaccgtcacggtgagcgcgcggaacctcgtcccgctccgctgcgccgcggcgcacctcggcatgtcggaggccgccgaccgcggcaacctcgccgccaagctcgacgcgttcctcgcctcctgcctcctccggcgatggaaggacgcgctcgccgtgctcaactcgacgcgccactgcgcgccgctctgcgaggacatcggcctcacctcccggtgcgtggacgccgtcgcggcgctcatcgcgagccccgccgccctcccggcgcactcctcgtcggcgtcgccgtggtgggcgcacgacgtcgccgagctcggggttgacctgttctggcgcatcatggtgcccgtcaaggccaccggcgccgtccacgagaagaccgtcggcgacgcgctcaaggcgtacgcgcgccggtggctgcccaacgtcgccaaggacgggatcgtcgtcggcgccgaccagccgttcgacggggtcggcaatggcggcgacggcggcaatgccagcgtcaagcagatcgccacgaggcaccgcctcctcctcgagaagatcgtgagcctgatcccggcggagagggacgccgtctcctgcagcttcctcctcaagctcctcaaggcggcgaacatcctcagcgcgtccgccacgtccagggcggagctggtgcggagggtggcgtggcagctcgaggaggccaccgtcggcgatctcctgatcccgtcgctgtcgtgcgtgtccgagacgctgtacgacgtggacgccgtggcggccatcctcgacgagttcgccctgcgccacgccgccgcgccgccgccgccggtggcgctggcagtgagccccgacgacgacgacgacagcccggcgcgttccggcgggcaccggcgctcgcggtcggccgagagcgtcgggttcgacggcgccgcgcggcggtcgtcgtcggccgcgcccgtgtcgcccgacgcgctcgtcagggtgggcaggctggtcgacggcttcttgatcgaggttgccagggaccccaacatgccgctcgacaagttgctcgccatggccgaggccgtcccggacaccgcccgccccgagcacgacggcctctacaaagtcgtcgacacttacctcaaggtgagaatatatttgaataccacaaacattacaaaattctactaatatttaacttgatatcaatcttgttctggttttggatttgaatttgtggttaacttttgtttttgtttttgtttttgggtgacaggtgcactcggagatgagcaagagcgcgaggaagcggctgtgcagggtgatcaactgcaggaagctgtcggacaaggcgtgcgcgcacgcggcgcagaacgagctcctcccgctgcgggtggtggtgcaggtgctcttcttcgagcacgcgcgggcggcggcgatggcgggcggcgcgcacgccgcggccgagctgccgggcagcatcagggcgctgctgcagtccaagtcgtccgggtcggatcaggaggacgacgcggcggaccgcgtggacgagcagcggctgcgcgcgctcgccgcaggcgcgtcccccggggacgactggagcgtggagggcctgcggcgcgcggcgtccaagatcgccacgctgcggatgaagctggaggaggacgacgaccacgacggcggcggcggcgacgacgaggagttcgcgcgcaggcagcaggccgggctggcgcgcagcgcatcgctgcggttcagggcgttctgcgccatcccggcggcgaggccgaagcggatgctcagcaagctgtggccgctggccagaggcgtcaccaccgagcggcattagcgtcgcaaccagtagccattactactaggttttttgtacttcttcttcttgggtgtcttgcttgcattgcttgcccaaggcctgagaatgcaggtttctttgcttgtctcttcttcttgtttctccttttcaattacagtgtcaaggccaagtgtaccttccaggcttccatgtagttgtaatcttttctctctctccgttttttttttgggtgaggcatgtagttgtaagcttaattattaaaaataaataggaactgcacagtttatatacttatgtaaggagtaaggtgaatggatggagtgcaatttacttcatgcacatttcctcaataattttgctgaacatgctgatgcagggaactcatatatcaacgataatcgacattgtattcgcttcgtatctatattcaatgatattcgtttcgtttccattattatagtctaggtttctgtatttgtttatgattccggtatatatgaaaacaaatgtggtagaccgtagaactactgttcattcatatatgagtcgttttcacccctagttagaactattggccaccccaatttcctcttttatagagtatattatttgtgcgaacaaattgttcatgaaaaattatatattaacaaacaagacttttgtgattcaaaggcaccatattttgtagtgttaataaggtaaaaaaataatactaaaaataattgtaccttatggtgtgttcttaaggaccgtaaaaccacttgacaaaatgattttgcaagtatactcgctccattctaaaatataggaatttccaagtgtttagcaaaaattaaggtatagacaaaagattatcttgtagtcactttagtggttaaattttaaactttgagttgacaatatttttctttccaagcatctcattggttgaaaatgtatatatttgtgttcactgaaatcagcatctcttatgacaatagtgcacatcatagttttcatggtacaaatagcaaaagaggccatcaccatgcactatatatatctccctttctttaatgcgcgatcgagaagcaggcctatgattgttatccacttggcttgagaaaaattgcatcctgaagagacccaagagggagagagaaagagagagagaggaacaaagaagcatggaaaatccaggagggaatcaaatgcaccgcggatattattatttcatcttctttttacctgaaagatcccctttgttaggtcttcgcgtgtgtgtaggaggggtatatatgccccggccgcggcatgatgatttggtgatgagacctcgagctcgaaatgttgttgggtcagcaaccactataaacaagaacaggtcagcatgggcagccttttctagccaccctatgatcctttaacttgttgttgctcatcactagcatgcatgggggcaggctcatccacccctggcccccaatgttgcttcaaaggatgtgtcatgtcctagaggaaaatttttcaccagaatatatatacacctcagcaaaacaatcttgtgagatcctatattgctatcatgctagtatggtttatcttttgccccttgaatggtggatgactctctctatgcactactagaaaaagtatttttcccaggcgggggaaatgggtcttcccaggcggacgctggctccgcctatacctcacaatcttcgcaggcaggccggcggtccgcctagtaagaccattatcgtaggcgaactggagctagaggtgccgcctaggaaaatagattcagtgcgccagaaaaaatgtgattgatctgcctgcgaaaataggtacaaaatttttttaaaaaaatgctacaataataatttgtgataaataattttccaaataattaattaattgatgcataaaaaatattagtaactaaaaaacatttgatattaacaaatatacatatattgcataagtgaaaagtgtcgtcaaaatgttacaatatttataacattgtcacttcgaatacactatctaattatattatggcaccgcgttgttccactcccaagattcttgtattcttatcttgtagccaggatgctctctgggtcgaagaactatcctttgatatgacagcactcacggtggatgaagtgacagagatcgcgctgcacatttgtaatgcatgtatcgtcaaagcttgtttgatattctattctaggcagctgcatgcatgaaagaaccacaatatatatattagtaggttctaaatgtgcatttctccaatgcacttatacgttgagtcgagagatttacatcctctgcgttaaccctttatttcccattaaccctgaggaattcgcatgcgtaatacctgcagaggaccgtgcctctagattgcttgtgacacttaatgacatatcatagaaggaaaaagttaaattttgtaattagtaaaacaattggagtacatttactgtgtggactattatatatatatatatatatatatatatatatatatatatatatatatatatatatatatatatatatatatatatatatatatatgtattagcagcttctctcttgtttgaatctgctctccacccttcttcttgtagtagttgttcgaactgtatgaattttttaccgtttcgtattaaggaggagatttaattgtaaaacattaataatagaaatgcaagagtatcagaatcacttataatgtgattctgatactcttgcatttcgtgcgaaactttctatatgaaagttgctctaaaatatcatattaatctattttttaagtttgtaataattaaaagagtaaattgtattggtggtacacaaacttattaagtgggtgcaatttagtatatgaacttgtaaaatgctcgttttggtacacaaacttatctaatccgtgtgaactaggttcaacatggcttgccaaggttaattccacctaggtgatgttaattaggatat

SEQ ID NO: 68634 - DNA, 6967 bp, Oryza sativa
  unsure (1)..(6967): unsure at all n locations
tctttctctgcaatcactatatatatatgtgtgtgtgtgtgtgtttacgtagcatccgaatcagcacataaatcaacaaaattagtcatgtaatgtccttttgaccttatttcgcacgcacaagataaattcatgtaccaaaacgagcattttacaagttcatacactagattgcacccacctgacaagttattgtattgccgatgcaatttactctaattaaaactcaatcaatcatacgttaataacatctcgttttttataaaaaacttaatcttcatgttaaaagagaaaagaacaccaccggtgttaacttactaggatcatttggatgatctatcgacagccggcggacagggcatgcggccaacaaatgcgcacgcacgctccgtccgctataggacgcccagatcgatcgacagtcgacagggaggacaggcagcaactagcagctgcaacctatccctccggttacgacgagctgagaaagccagccaaccacagccagccacacacatgctgacatgcatgcgccatcaccacacgctaataatcaaccaatcgatcgatcgatcgattcggccgtttcccttgttgcgacgctcgatcgcactcaccttccagctcccggtgaaacgtgcgatcgagagggatagtatagtagttgttgcagtacgcggctgggctggctgttgctcatcagctcgatcgatcgtgcagatcaggagaagtacgtacgcgtcgcgcgctgtggatggatggatcgatcggaatcattgtgcgtgcgggttggcatatggcatgggatgcagggcagcagggttgggatttttaggaccaccggcaatgcagcgatcgatcgacacatcgtcggcgttttgcggaaatgcagacgagccgtacgtaacgtggtggctggctgcctggctctctggcccctggccctgccctagccgtgggggtgatgttcagcgttgcactttttcaacttctactttcacgtctcttacgtacgtgtatgtttctaaattactaaacaatgagtaattttttttaaaaaaaattgtttttataatcaagttgtttaatttataaaattgtattatctttttaaagtttttttaagttaatacttaactaatcaatacgcttaaatccgtatgtaaaattttcgaagggaatatagatactgtttacacatttggccggcctttgcatggcgcacagttgaagaatgacaagagaaaataagatgaagagagagatcaacgggactacatatcccaccgtctacaataataatatcttaatttgaataggaatttttttcacctgagcttatttatctatacacaaatggaggggagctgccatatctaaagtagtgaaaaaactaattttccttaaataaaataataaggcacgtcatctactaaacatggactgtccaatttctattccgaaaactttaggccgtcagatattgtgattggcgaaatatttttttattctttctctagaaatttctttgacaataatgtctttctacgttcatgaggtaaaaaaaagagcgggactcttctcgttaactagataaattaattgaccatagattatatcgacctccatattaaatcaatcgcacaattgaaaatagcattgcgtttcatctgttttatgttcaacagatggtactcataaattcacatggtacacacgtaacagtgacatatatatgggcgtacttatattatatccatgtggctgctgagatttctcgctttaccccgacctggtgacgtgctgatgatggcattaatcagcggccaggccgacaaataacgtggatgtcgatgtacaaattaatcactccacatcatcgccacatcaactgggaagttaatcaaatgacctcataatttgtcttgccttgctgcacaggggacacgctgcgagcaacgccacaatctcacacaaggcaaagggagacgcagatcgacaacctgattaaccctgatgcacaagtgtgcacaggcaacatggcacatttgcaaccaaccaaaaaaaagtcatcatcgcatcgactagaagcatcaatgctactactacatgcttagactaggtacaatagcgctataaatatattttaaagagataaaagaaaagagagaagagtagcacgctataaatctgtagctagctgcagcatggactccaacatgtaatgtgtgtatgatagatgggactaggtattacacagtatagtaaacaactattatatgaattggctattacattagtatagttatagatgatttggagttagtagttggctatactattaaacttgctgagtaggtaattaatcaatcaatctctctcacacacactctctctctctctccatgtactacatgatgcagagacagcatagctgcaaaggcataaatctccagaattgggttcaggaccacacatgcatgattaagcggcatcattgagggcctctggcgatttgtttatggatcttttttgtggttaattattctggagatgttagcaagatcctaggcaataacccaacacaaagccctcgtcacaggttgttttccaggctcgtttgtacttgtatctgtttgcttcttcagttagttatagtttaattatccgtgaaagcgcaaaagtacagtcctagtgcatgtgcacaagaaagaaaaattgtgtactagtgtacgtacgtgcaactagatacgaccagataaattaattttgcaaaattaaaaaaaacaaagagaaataaatcggcaatagatataaaacggtggtcacaagcattgaagtgaggccaacctgcattgcgctagtacaaattcaagggctaagctagctagatatcccaagcttccagcatggcaagtcaaaaaaaatgccaaaaaattgtcggagcttaagtttaatccaagcttttaagaagggacgaaacataattaggtggcataattgcattttgtatcaccctaacttaattcccctgaggttaactattgtggggttgcaaggaagatgcctggcaaaattaaaccttgacaggttgttttcctggaccatagctgttatctgtgaaaagcacaaaggacaagagtgtgcatgtgcacatacatatctggtgtacgtgcgagactaggcatgaccacaccaacatttatgtcacttttaagaatatatctataattatctatatgtgctttacatggttttatacaatgatacttaaaccaagtactcatctgatgtggaacgacaaagggtgccagcatgcgtgtctttaacaagttcatgcacacaaaaaaaaaaaaagtcttagccacccccctcacagtaagatgcgtttggtttcctacaaagggtcaagtcaagtctggcttgtatcattcgacctggtttagatgagtctctttgagatgtgtaaggacgtattcaatctgctactaagggtgtgttgagaatcccctttcccaactcacacctctctttttccacgcgcactcttttcaaactactaaacggtgtgttttttacaaaaagtttctatgtgaaagttgcttacaaaaatcatattgatccatttttttaaaaaaaataactaatacttaattaatcacgtactaatgaattactctgtttttcgtgcggagagtttagttccaaactccccccagcagcgaacaacacagacgctaggagaagaaaacctttatttttctccaagccggctcttcgcttggtggcacactacacccaccaccacttaggcaagtcaaggcatagttaggggtgaagacatgcataaaacagctaaggcattaattaaaataaaaatactatttaattttaaaaatattcactcttctatttattagctcatccctacacacgagaatttcttggctcttcccttggttttttagggtaccaaacatacaggggcgaagctagcatcaaaataagagggtgcgctaccattgagaatctagaaattttcagtgcaacactgtatattttagtctttttaagtgagaaattaggaatttgggggttcatgtgtaccctcaaacactataaaacttcgtcactgtaaacatgggctttcttactaaaagactctattacctgtacagttaaaatgcccccactaacattattacacagagtctcatttcctgcgcaaaatcgcaaaggaaaaggaaaaggaaaaggaaaaaccaaaattggaccttgggtccgatcggtagacgctggtgaggtggagccatctgggtcatgatatatacgtctgcacgcacgtacgcttagctccaccatcctccatccaagctggttgccctgtccctgtttgggctccctagctccacgagatattgtagagagtacatggatccaaagctatctcctgcacttatggtagaacacatgccactttggctcgttggctgcatcatggcacagggccttgcgatcgcagccatgagccatcgattagggtatatcttctctgttaatttgccccttgctagaatcgatcaaatcgatactattcgtcgaccggagaggcggcgacacgatcgaattgtccctctcctcgtcttatcctggatgagcaccggcctcgatcaactataattttgtggagccactcatagtttgttttggtgacagtagcgatgattatttgtggagacactcattgtttgttttggtggtagtggcgatgattatcttttttcttattttttttggtgaagggtatttttactcggactttacatctaacaggatatatgccatcaaactgtatgatcgaatagaaatagctaagccaaccagagggaggtgaatggttggtatacccaaaaaccaaaacttttagcggaattaaaagttaccctaaatttcgacgaaacacagtccgaccgaagtagacgcgctggtctgaccgcctggaagccgtcggtctgaccgggcttgatcctccggtcaaactgccgagatcaactgccgtcgcctgaaaccgccgccggtctgaccacccgtgatccaccggtctgaccgctggtgtctcgccggttagactgccgaacccgagcaaacacaaatcgaagaactcttgatgtagatgacaactttattacttctctctgtgtttacaaagtgcaacaacagcactcctcacgaaaatctcgactaaactcgaaaccctaactcaactatcaactcaatgctctcaaaagcgatatggggatgcctcacgctccctctctatttatacatgaggtagatagtctaaagccatgaaccaaactcatacaggaagtcctaatctacctaggaaatcttcccgtacaagaaacaaattttacaaactccaaacataccaaatttggactccttccaaattcgactccgcatctcgtacgcacacaatatctccatcatatggcatggaatcttcaccaaccacgtgcattgaactctagcctaagtatcccgcatgatatctgtccgtccggacattgccttatctccaagtcgactcccgatccattaccggcactactctcccgaggcatcaagtcacctacacatgaatcaaacaaagaaaccatattccgagaccaagctatctccaacttagctcattgtcagcaaacaatagtattacatacgtatagtatccatctagaagccataaacatgaaacatccacggatatccaaacaaaaaacccgaaaccgaaaccgacacagagtcggccggtctaaccgctcgatacacatcggtctgaccaacaacccatgtccggtctgaccggacccaaatctctagcagcacctatttaacacctgcaaatccaatcatctccaaaaccacttcgccaataatctccaaatatcaaaaccaataattacagatgccaattgttcatcacagaataagaatcataaacactttgattttacacaaacaacttgatatgaaattcgttcctataaagatttaaacttaaaatcttggagcgctactcatgtcactgtaaccactgggctacatgccttttgcgatgattatctatctgatctgattggatgatgtagaactggagattacgtgtcgtgtgataacgctgcattatatgtatcatttcgtgccagttgcgaaacagtgatgctgagaccgatatggcagcaagagtagcagatgccggcgtgatgcaatggaagcaagcaatatatcattatctcaacaacagcaacaaaagaacagaaagaaagtagacaatagaaatatatcttttagataatgaggtagacaacacatacgctactgtttagttggaaactgatttcttggttagttaatttgtgatttgctgattacagagacgttgtaaaagcagatcgaaatgacgggagcaccggagcaaagagcaggcattcaccggtttttcttacatcagtctccaataatgatagtttttgcagactcactctcttttctccttgctaaaacctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 68635 - DNA, 879 bp, Oryza sativa
cgaaacggagggagtacgacctctaacggtggatcgatcgcctgcatcaccgcgctggctctatggctcaccgttcatgagaccgcgcgcacgggggctgtgcgcctgtgtgcacgcgaacgcgacccgtacgtacgtacgacgcgtgtgtggccgcgcgctgacttcgatcctcctgcaggtgtgttggtggatcgatcggagtagagagctaatgatgaggtgattaatacgcgcgcgcgggccacaaaacggcagccattgacttcgcgcgggcggggcgagtccatgcattggccacgcaccggtggcgtggacggctacctgcactagctagctccatcgatggatggattgattcatggcgcctttctccgaataattacagtatcagtaggagagccaattccctgtactcccactaaccaccacccccctgcaggtatgagtagctagctagctagctcttgatttatggagcacggagtatagcgagcagctagcgccttgccgtttgcatcggccatcccgatcgatctatcgcaagtttcttctgctactcgttctgaaaaggaaccatgtaggcgtagttttcgggcattgggatcggatacaccatcagattgaatctgataattttgtagagtgctactcatatctcaaccgatagatcaagaattaggagaaataatactcactcactttctcctccacttcaaaatataaccatatctcactacaccagatcctcacatctctgacgggatacctgtgacgggcaaacgaaatggtcactgatgaccgtcacctctgacgggtcatacgggatgccgtcatcggtgaggcatccagctacgacccgtcacaggtaactagtca

SEQ ID NO: 68636 - DNA, 877 bp, Oryza sativa
gtcgccgccgccccagccggcccggggccgccgcgcctcccctcgccacggcacaaagaaagaggggagagatagagaagaagtggaagagatagaggagaagtggagaagagggagccggccgaccttatctcctcatgtgggccccgctgggagaggagacatatatatatacagtggcagaagtcatctcaaacgggctgggacttaaagccgtttgaggtgagtaaacctcacctctgacgggctgtccggctgcgacccgtcacaggtaactagtcacatatgacaggatctggcgtagtgacatatggtgatatgtagacgtggaggagaaagtgagtgagtattatttctcctaattcttgatctatcggttgagatatgagtatcactctacaaaattatcagattcaatctgatggtgtatccgatcccaatgcccgaaaactacgcctacatggttccttttcagaacgagtagcagaagaaacttgcgatagatcgatcgggatggccgatgcaaacggcaaggcgctagctgctcgctatactccgtgctccataaatcaagagctagctagctagctactcatacctgcaagggggtggtggttagtgggagtacagggaataggctctcctactgatactgtaattattcggagaaaggcgccatgaatcaatccatccatcgatggaactagctagtgcaggtagccgttcacgccaccggtgcgtggccaatgcatggacttcccccccccgcgccaagtcaatggctgacgttttgtggcccgcgcgcgcgtattaatcacctaatgattagctctgtactccgatcgatccaccaacacaccttcaggaggatcaaagt

SEQ ID NO: 68637 - DNA, 1537 bp, Oryza sativa
ccttagttcatgctgaaattaattccatcaatgtatgacgcaggtcttgctattcctccacttccaacaacttcacccccagttttcccacctcccatcagatcttatcctccacttcctgcaaataagccataccccaatagtatgtctctgaagcaatttttatacaagaactatatattttttatctgcttaccattttcctgtactgaaatatgcaggaccagcagtgtctccagcatcaataatccatcccaccaaccatgggaaggcccatggagttccaattgcagcacattcaaaagaaaggcatcatcattccatgcttgtaaataatacacatggaaatacccatgcaggtccagttgtggcacctccaaagggaaggcatcaccattctttgcctgtaaataatacccgtgtaaaaggtattccaccgactgcacaactaccataatgaacctattgctggtaataaaatgattcatgaagttgtatcgagcaggacctgcctattctccttcaaattctcccagtatccatagaaaacatggcattccagttgctgcacctccaaagcaacattccagcaatttaccaccttcacatcataggccccacaaaggtatgctgacagtaaaaaaaaaaaaagtactcatctcactaaggcaatgtttgctgcaggatcctttcctgtcataagccctactccacataaagctgataatgcttctgcgacgaaacatggacgttctggcttacaccatagtcctgcacctgcacctgtaggcttgcctccatctgaaggaaatgcacgaggaaatcctgcgtatgcaccacgtcatccccatgaatatcactcgccttcaaattctccaggtcagttagacattcttgaaatttctccttttcctttatgttgtctcatttgttctaacctctgcaaatgctccagtcataccccccctaagaacaggccataacatgcacggccttctatttatcatgatgttgaataggattataggacactgagattttgcacggtgatgcaagaattatctctggtatacttgataagagtacggagattgaacttacaccttttattttagtttgcaacccgtcctaccttgctatggtgattaaacacatttggatatgatactaatatttaggtccacaaatttccaccttccactaagtttatctaaatgcaaaagttttatcttctctcaacttatgtcaatcccagtagggccaatttagctcccctgttgcttttataccaatttcaccatataatttgtttttgttattttccatgtcattacgcctatgcagaacctggtctaccacctgtgaatccgcccgacagtcatgcatttaaaaagcccaagagtttggcaccagcaccccaatcatttccgccaccgcctccgagttcatgtatgctacctgaggatactatcttttgtatatgaattcatcaatatatgtgctctatccaatcatgtaagctactcagctgtgatcc

SEQ ID NO: 68638 - DNA, 2492 bp, Oryza sativa
tgagcttcgtttaggtatagctttgtacacattctgtgcattggtatcagaacttgcacaagatattgcatctggagtgctcatgaaacaaagtcaagttcgtgtaatgggagcaaatgctgcaactgaggacccagagaaaacagttgtccttattgatcttgtgccactgggagaaaaatttgacaaggcaacagcacttttagtatttgaaaggttttggcacaagcaggtcaacataaactctatgcattttggaaactatgatgtgttatatgttacctaccaaggtaagagctatttgtaatttttattgtgtcattatacatattctctttgttaattcctataaaccttattggattttccgatattcgagtaaatccttaattattttgtttattattcaggtcaatcagttcacttcctctgtgtgtgtgtgtgtgtgtgtgagtgagtgagtgagtgaaaccactggcatgatattctttttagccggatcggccaaaggaagaggctgatcaaatttcattaagattgatggagaaaaaaaatagaaattgtaaaagagtacaacaacagtagtctgtcgaaactggtggcaccccagctagctgggtaaccggaaaaagaaaaagggtagggatgggctagagactagtcgccatctcctttcaaaattcctgctgtcctccagacagagatttcatctctaatttcattgacatagtttgttttttagaaagggtcttgatatggttactttcacttattcatacaggtcttcctccgtcgccaccaacagctcccaggatgaacaatggtcttagcaatgttaatgatccaaggttgcatccacttgctgttgatgtgggaaaccacagagaaacaaaaagcaggggcataattgttataattgttctttcaagtgtctttgcttttattttatgttctggagctgcgttggtaatttgtttcaagattagaaaccgcaaccatttaactgaagagtcacctatgccaccgaagcctgcaggtaacaagacattcaatccatgcagtgttgctgtatttatctttattagtcacatattagaaaaggtgtagcaaatgcaatctggtgaaacaatcattgtcattctttccatgactatgggtgagttcgctactggaggtttccaaccgggaacagtgcgcgcggaaaacggagcggttcattagcgcgtgattaattaagtattagcttttttttcaaaaatggatcaatatgattttttaaagcaactttcgtatagaaactttttgcaaaaaacacaccgtttaacagtttaaaaagcgtgcgcgaagaaaacgagaggggaaagttgggaaccggcagtgccgaacacaccctatatccattctgaggccttgttaggattgtttgattattttgtagaaaaccaatccacataaaatgatcattcgttttctagctttcaagaactgagaagttatgtttcatatttgtatggttgaaaagtaatattaccttgaaataatcaaagaacaagagttatatttcatgcttaagtagtgaaagtacttggaacagctttgaccaaatctgaaaggattatatttttgcaaaagttaaaaactgatgctaaattattttcttccatcaatgattgcattggaaatgtaggtcctgggtctgcagttgttgggagcaggctaggaagcagacctatttcagcatctccatctttcagctcaagcatagtgacatataaagggacagcgaaaacatttagcttgattgagatggaaagagctacacaaagatttgacaactccagaattattggcgagggtggttttggacgtgtttatgaaggtattcttgaggatggagaacgggttgctgtcaaaattcttaagagggacgaccagcaagttacacgggaatttttagctgagcttgagatgcttagccgattgcatcacagaaacctggttaagttgataggtatatgcacagaagaacatatccggtgtcttgtgtatgagcttgttccaaatggtagtgtggaatctcacttgcacggtaatattttgttctctttttttttcctctgaacagtttctaaggcatcatttgttactttatcgtgtctattttgcttggagagatgcatcaaaccagtcaagcactttgttgacaagaaattcataattctgccctgtagataatacagctgttgtcgcttataacaaagtcacacatgtgaacactgtgcactaagacatgaaatgtattgtgcactaatctcctgttacattatgtttttttaagggaatcccattacataatgtttcttaagggaattcctttccatcatgttgacaaatacaaacttgcattttataaaattttgacatgtttcatggattcatagtacatccagtattctattctccttaataggtgacttttttggccagacata

SEQ ID NO: 68639 - DNA, 4733 bp, Oryza sativa
attcctgcagcccgaaggcaggagcatgatattgcttcaaacctttgaaaacaaaacatgaacagaatagctaacaatttgtcagcatagcaagccataatccagaaaccaaaatataatagaacgaatgggttgtctttggagcttaaatgtaatataaaagtggcaagagctttgttcaagggcaataacttaacaatgaattgctaacaaaaaatacgactggtcaaaaatgatcagtgatgtccatgatcattgtatttttgggttaaaaactaataagatggcaactaaaactgaaaatattatcagttgacatatatagtgcatgcaaagttacagcatttgtccgagatttatgttctaaaagtttgtccatttgaatttgtctgtcttatgccccttctgaaaaataagcttcagtagtttattttgcagctaaacactctatttgtcataggaaataaaaaaggtagctaacgaaatggacataacactcgcccctgcccccaaattttaggtgcatagaattgaggcatctgtatttctaatttacacgtgccatcttattccttctcgtatgcttaagagggcgatgttcttcagaccctgcaatattctgtgatcctagcagatgttacaatcagggcacccatcaaatcacaacaacgtcctcaacctcaacatcaatcacccatccaattcgaagaatcagagacccaagtgaaaaaacttaataatagtacgaaacttccgctgcaggctcgggttctggcagctcaaaacccaaaaatctaacaagcaaaccactctagcattcaggatcggaactgcatgatcctggccaaactagaccaacaaggaggcccccaaaactcccacagagcagaccagcacagcacagagcacaccactgcacatacctccagctccacggatcacgagcacgcagacgaccaaggtggcggcgagcgcaagtacacagccaccaatccacgcgcctcccgctcgtcctcctcctccacgccgccccatctcctgtcctcccttccccgcctcccagcccagcggcagagctcgggattcgccacgatcacatctctctcattcaccccggaggaaaaggtcggcactcctccgccgcagcccggcgacacagcaccggcgcgcggggcagccgcggaagcggacggcgggtgtcggcggcgtggcgagcgaggtgggaaaaatattcggtgcggcggcgactagtaaaacaaaacgtgggggagcagcgagcacgaacccaacagtagtcaggctcgggcaggcagaagaatcctgccagttttgacaaggggaaatccaaaaccaaaagataaaaaaaaaaatcgcggacgctgaggcggaggcgcggtggccgtggtggtggtggcggaccaaaccgaaaggcttgcctccctccgccgcgatccgcgcgcgccccaaaccggcagcgattcgctgtcgtctactcgtctccgcgcgcggccgcgagggaaactgttggttttattttcgaggtttggtttcgcggcaggcgggagacggaggagaggagaggagagggcgccgtgctgcggtggacttgtggcgagtggtgacgaggagacgtttctggttgatgttgtgcgggggagtagcggcgcgtgagaattgttgaatttgttgttgttcggtagggtctcacctcagcgaccatactactgtagttaggtgggagagactggccagccaggcaggccaggccgctggtggtggtggccgcgtgggggcttttttcctgtccttttttggggacagcggcaatcagtgagattactatggcccccggagctatagttagctatggctatactttgattacctccagccatctcatgcttgcgactttgcgagtggcaacagcagaaacaatggtcgcttgtaattgaccgacgttttaccagtgtacaaaccctgatgaatttaaaaagtatattagcttatggtttggacaggacgatttggcatccctaaaacttctagcttactgtttgtagtcattatagtcagtagtcatacgtctcgcagaatggatcaccattagaaaatcccatgttagaaaatgtcatcacacgtcaaaaatgagctaacgttgattaatcatttaacattttcatttgaacttgtcaagaccatggagtctccacgaagcaaggccaggtagcctacttccctctacagtgtattgtttcacctcgtgcatattgtggcctagcccttttccctaaactagtgtaatgcgtagctgtacttttctccaagtgtggcatggcacttttatgtgctagcaatatcggttgaagtatttatactagcaataatgtgatttatttgtctgttttaaatcacgtgggcatctccaaggataatttgcactgaactgttttgctgggatccactgtaaaaaatgattggttgattcaatgtatggttcgtttgtggatcatggtagtagaatgtttttactggcagtagaatttataaatctggtcatttctactgtcgtttgatagtacagtattactggcatagagcattataaagatacccttgaatcataagaaaaggttaaatatatgaggaagtgttgaagcacggacgaattgctcatccttttctatgtttgtatagctagcatatgaccattgcttcgcaaataagattcctcggctagagaccactaaaagaccttattttgtacacttatttcttttccaaacaaaatgtgcattttaagacgcaccttattaggcggctaaaaacgacaaggcagccaatgatctggactggtccagtatacgtactcgatcgctcagagctggcaatccacaataataattaaaaaaaaactgacacggtttgatgtcacgccacgtccagtgtgagatcatcctttgctgtaatgctccacacagaacgggagattgataaaaaaggacacatattgcggtaccatgtgtggagcattttgaaaagcaggattaatgactcaacagcggatcagtggtaacgcagtcccacaaaaccaaagattatctattcctgtatattttccgttccttttccaggagggcaacctagcagagaaagcgaaccagggaggaagtgccttgcgtgtcactgatgcattgtctttgatggcaaccggacaagccacactcacgttagaccctttggaactttaagctagacgtgcaatcagtacggtgaaagtaagatgcccattttccagcaatggtaaagcttttcagacttctttttggctgatgttggtttatccatcgtcccgaattgttcatggtcaattagtactcagtgattgaaatctcggttcaaattttttgaaattttgaaaccccggcaagcaactatcgtgcccataaatttcagatttttccaaactttttggaatttggtaaaaaaaaaacaaattcagtcaatatttattattttttaaaaaaaaaagtgtgcaaaagagtaccaaaaataccaaaaaaaccgcaataaattggtgataccgaaaatttggtccaaaccataagtgcaaacctataggaagccaatatctacatgtgaaatttcgcagcaccaaccgacataaagtttagcgtgctttgttgagttatataatagtaatagtattgcacatcagttgcgccatagctgtgctataacaaattagaacagtagctgcactgtacaacaactagcccaacatgtcatttgtataggcttcacagtcacactctgatgcataatactaagtatttcaataagcattagttattgccatatttatttttttaatatacaatacaattaacttgctgtattgaaaattgatgataatatttattcaactgattatttaattacagtaaaatagttctctagatgaattaactgtatgataatagtagcacgatgcactaccggattacaatcaaggtggtgtttttttcttctaaagatgaagattaagttttttacgtaaaataaggtggtattaacgtataattgattgggtttaaattattataaactttaaaatagattaatatgatattttagaacaactttcatatagaaagttttcgtacgaaacgcactgtgtagcagtttgaaaagcgtgccacgaaaattttaatctttattcaacttttgttggagaaaaaacatgacccaaatctcagagcagctatccaccaccgcacacacgcctttggagtttggaccgccattattcatcatcttttcctcttgatggaccatgcatatgggcaaattgacaacgacatgccacacacaacgtggtcactaacgatcctagatgtatactacatacatgatacatttgatgatttcaccgaatcaccgatcaggcgatcaactgaaggacacagaattattgtgatttgtgaacgtgagctttctgtccagtcatccaaggacgctgatgtcctctattaggtacacgaggtgtccatggcaatacccgtggtatacataaaggtaggagaaaacggaaaatatgccactctctaagattggttcggataaaatgtcactcaatacaatgcatcggataaaatgccactcaatacattgcctaccggatgaaatgccactttagagacttttgtgcctaaaataccttaaaaagagagaga

SEQ ID NO: 68640 - DNA, 1760 bp, Oryza sativa
ggccgcctccgccgccggccagccctcccctctcccctcccccctctctctctccagggcattttgggcacaaaagtctctaaagtggcatttcatcctgtaggcaatgtattaagtggcattttatccggtgcattatattgagtggcattttatccaaaccaatcttacagagtgtcatattgtccgttttctcataaaggtagacatctcaatgcttcgctggaagcgaatgctaggtacaatcaccagcgaagcagtagtagctacgggttaagtagctagaatagctaaatgcggaggcgtcgagcgccgctaatgcggatccatgcacgcgtgacaataacagcaaccacaaagccctctcccctcagcctgcttgcagctagccttgcactgtgtcccttttcaaagcgacaaagcactcacactctcacacactcactgcactgtgcagtgcaagcgtgcgtaaatgaaatttcaccaccaacttccataccggcatagtactcatcaagtctctctcacccagttgctagtgtacctgtcaatcactgcttgcacatcatccaatgttcagtcactgcatctgcatgctgttctatctaccgagcacgaggtcacctgtaattaaaccatccaagccctacgtgtccaacaactgcgcgtcgtcggattggtcgagaacccagaacggacgccgaccaaaaaacggacgagacgggagcgacgcacgaacggacgccttgaaccgcaccagaagttaattccgtggttgtttccactttccaccagcaagtggtcgacgactcgacgggcaacgagctagcgaccgagagcgaagcgacccgctgtcccgcttgcgtcggcgacggagtccggaattccggataatatagggtaagcggctatgcgtgcttttggtctggaaacgcatgtgacggcacggcaggtaggcgacgcgaacgcgagcttccggtacgtaacggcgcgaacggtatgtacgtgaggtgggcgttttcgccggtagcttgcggaagttaggaacggtttgacgcgtgacgcatgacgaagttgggcggcggataggttggatcggaggggataagctcatatcgctgtttagatcgggaattcggtccgcttttggtccgatccaacgaattctcccctttgccgacttcactctcaccccatttcttgccgcgactctgcaagtgggttggtcgagcggctggaggggagatgccatgttttgttattccgtcctccaccagccggcaacagaggggatcaaatcaaagaaaatagagcccagtcacgctcacattcataggctcatgctaatctctgtttcacatcattttggccccgtttagttccctaaaagttttttttcaaaaacatcacatcgaatctttggatacctgcatgcatgtatcattaatatagattaaaagaaaaaccaattacacagttagggaaaaaatcgtgagacgaatcttttgagcctaattagtctataattagccataagtactatagtaacccacatgtgctaatgattagctttatcttcaacgcctactagtacgaaatccaccctcgcaagcacgcgtggctagtagtactccggagctagcaaggggcagggatcctgttctaacatgtggtacatcaatataggccctgtttggatccggaggtctattaaatagccctccggaatcttactatttaggagtattaaacttagatta

SEQ ID NO: 68641 - DNA, 5685 bp, Oryza sativa
cggtaatctaagtttaatactcataaatagtaagattttaaaggactatttaatagctcggaggatccaaataaggccatagatgtgttgcgagactgctggtgccggtggtggagcagtagagtaggagtagaaacgtgctgggggcggggacacggacagcaaaggtggtcgctgtcggcgacgacgacgtgacgctgcgagcctgcgtcgacgagagacccacccaaccgttggttatccatcggtcagccgaccggatcggcctgtcgcgttctcggctcgatcgttcgcccgcagccacagccccgcaggtgcccgtacgtggcccatcgcggctcgaatcctgcgcgcgaacagcggaacaacggaagttcatgcggtgctccgatgcgatcctgggcgcgtgacgatgatcggccggggcgcgtgcatatgcatgtgcgtcgcgcgctgccatcctgcctggcgcatcagacggaccgcggtcaggcgcgcggtccccgcgcaaggaagtgaggaacaacaccgtggccggtgtttagaatcccggaacgttattttgagcttcaaaccatttgatctggtgtgtgcgttggataccataattttttcccaagccaggagtagctaggaagttctaggaacaaacatggagaaatgggggatgtgaacatattccgaaaactatattttcttatggacaaaataatctgaacatgcaaaaaatcggtggtcttgggacggactattggtgccatgatgcctaacatcgacgtctagagcacgatgctgctccttcgacttcgagtgattattcaaaatcgagaattgacatatgcccaccaagtacgattttcaggtttggcacactgtctcatttcaagatttcagtcgccacgcgttcacgttgattttatttttttgacagccatttatatttgacttagaaaccataaaccttaggccttatatttagttaataggttagttaaataatttctcgctcgtcaaaggacatctataaatcttaatcattcattattcattatgtttcttccttttgatcataaccttcactcatttttctattccagtcccactcttcttaccccataatccaaataaacccttaggatgggttcgttagtgttggttgacaaccttcccctccaacatgaaaaacagagcagctcattaacatataattaattaaatattaattaaaataacttgaaaaatagattaatatattttttaaaacaacatttctatagattttttttttacaaaatacatcatttagtagtttcaaaagcgtacacgcggaaaacgaatgagaggagatgggaacacaaactgatgtgaccatcaagtatatgcatacaatcaagcatgataaatataaaacatcgctaaagaatacatcggatgaatggatgatctacaggatattaaagtccaatgagttttggaatcaagttcacctccgaagacagcagtgacttcaaacggacctagtgcattcatgccaactctgatttgagtggtcatggacttgatggaaagcttatctcgtcacctttcaaacgcatccggtctcatattcaaatttatcccgagtcaacaggaatcatcaaaataagacagtattgttgttgaaaccgaacttgggccttgggccttgtaatagactaagcccatatcggaagtgtctccctccacctccacaaattagcaattaaccctagatttattttcgtctttaaatgtctatgtacaccctctgtaacaatagggttttgtttagttgaattttgccaggtgtcattcaccttggagagaatcccttatttgccaccggaaattggtctggtcccttgtatgccattgaaaattggctcttcccttatatgccattgttccaaatttacgcaccctctcatgccactcccgtctgttgactgcgtgttggtagttaactctcaagtaaaaaagacatgtttgcccttctgagttgttaggcatgtcctaaacttagaagggcaaatatatcttttttacttgagagttaacggtcaacaggcgagagtggcatgagagggtgcataaatttggaccagtggcatataggggaagagccatttttcagtggcatacaagagatccgaccaattttcagtggtatataagagattctctcttcatgttgtctctagtcctcattagttggcgactattgattcagagcccccaatagttggcgtgttgatttgccggttcctcactcgattagtcagcgattattaattcagagccccaatagttggtgtgttgatttgttggttcgattagatctaccacttcaatcacaactatttctctgtgcttaatcacttttccgcaatatttagattgaatcttatcttattcttgcaatgttcactcgtttgcattgcagggatcatcaaccatatgtcacggttagtatgacatcgtttgtggtgtaccgatttgcacggcgtcctcgacttgctctggttgatagctacgtcacaaacgtcacactgatcaaagtgagagttatcctctcaccagaagatcaggccatgagagagagcgtcatcataaataaacaaacacaaccttagtacagatagcttatgctaccatctactaccttccgtcccaaaatataagcattttttagctaagaacctgtgcttatattttaggacggagggagtactatcaatatcagttctatctcaagatatactggtttagtttttcggacgtgtttatatgatagctgtgagtgtatgccctgttcttttctccaacaacttttggattaaattttggatactcgtggcacgcttttcaaactgttaaacgatacgtttcgtgtgaaaaggttgttctaaaatatcaaatcaatccgttttttaagtttgtaataattaaaagcttaattaatcacaccattattaccactccattttgtgtgaaacacttaattttaatcttcatcttcatcttcaggagagtcaaacaccacctttattttcttaaaaaaacccagttctatctaaccgacattttacgcccagatagaaatgggcctatcccacactattcatccgttggcccaatacaaatgggcccagcccacagcgccgcatttgtttcgaccgcttcaagccttggatgctctgctctgcccttgcattcgggcacaagaggggtggcatctctgagcgggagccacgcgcaagggtccagagcaaacgctcctcatacgacagagagagcgtgacagcgcgagggggttcggaggcgggagcgggcgacggcggcggcggcgggcgccagcgagcggcgaagggcgcgctggagatgaaggagaaggggtcgagggcggcggtggacgagcgctacgcgcagtggaagtcgctcatcccggtgctctacgactggttcgccaaccacaacctcgtctggccgtccctctcctgccggtaaaattccccgcatctcctcccttccttcctcccttccggcggtttcccgcgcgtctcgtagccatcgtcctccgtggagatccatttcgggctagggtttttgggggactgtatctagggttttagggcgtggctctgcttcggtgactccagatctgtcgcttgcatggtgatttggcggggatggcagtggggtgaggatgtcccggccccggttgggatgttagggtttttgggacggggaggttttgtgggatgcgactgtttgtttgagtttggtggtggtggtgtgtgtgttttttgggggggggggggtgtgggtcgattcttccgtgttcatgtaatgcttgctgatgcgagtctcccttcgagattttatggctagtgggttgctgttcgtccatttctgtctatatagtcgatataatagggtcgattcttccgtgttcatgtaatgcttgctgatgcgagtctaccttcgagattttatggctactgggttgctgctcgtccatttttgtctatatagtatatagtcgataatatgattacctgttatgttttagagttagattgtcatgctttatccgtgcctgttctgtgttgagttgtgacatatcatcttgtaattcggtttaaagctgtgcatgttggattctgtcgtgcttttgaccttcaatagtggttctgcaactaacgatttgatcttctcatcattaattgttaacaggtggggaccccagtttgagaaggctacctacaagaatcgtcagcgtctttacctttcagagcaggcaagtgctcccaaaataagttgttctttttctttcttttgctgtagggatgttttgaagctcaaatttatggtgaagtttgaattcagatatgcagatgggtcttcttagctagaaaatttatgtattcttagttggatattaaactttagcatttgctaaccatgtgattgttgcagacggatgggactgtccctaatactctggttattgcaaattgtgaagttgtcaaaccaagggttgcagctgctgaacatatatctcaggtttccacttttttcagtgacccatttgagtttgtaaaatgcagaatcatgctacgtttgagatgaatggacatagctggtcctttttgcagatttaattgacccgaggtgtcagcttcccatcttaatgtaatcattaatcagagatgtggacctgtagtaccaactgatagtttactatgcctaatctgtcttattaaattaataaaaatgtcataactcgaacatctagatttgcatgacttcagtcttgtgatagcggtgtatgagactgccttacattggccttaaaaagacctgaattaggaattccttgcactaacttgaagtctgtttacaatgaaactgaccggatgtctcttattttttgttgcagttcaatgaggaagcacgatcaccttttgtaaagaagtacaagactataattcatccaggcgaggtacaagctcattcaatcgtgattgttgatttctctttccttaacttgaggatcattgcctctgtatgagatcttccatgttgtgtggtgcatatattggctataaactttagtggtttagatggcttgcttttcttttggagatagtgcttgagatgtgtcttttatttgtttaaccccgtgtccccgtcaacatttatttaacccaatcgttgatgtattgtttctgttttaccatggacacaggtgaacaggattagggagcttccgcagaacagtaagatcattgccactcataccgacagcccagatgtatgcctagaactttgtagtgctgcccgtttcttgtgatcatcaatccctaagcatttctgtgatggatttgtagactgaaggcttttttgttcatttgcaggttctcatttgggatgtcgaggcccagccaaatagacaagctcaactggcacagatggagtctcgtcctgatttggtaccacctgactctcgccctgatttggtatcttttcttattttcattctcaacctatatcattttgagaagctgaaattgcagcttcatctggtgtatctgcacacaagtcctaagaaactgtgttatggaatcatagaatatatctgaaaggttttcatctttcatagtt

SEQ ID NO: 68642 - DNA, 12461 bp, Oryza sativa
taaattaggcatattgattactatgtaaaccagctgctagctagcttgggtttgggcctaacttgaatcacttgctaaagtttatagacttggaagttttgttgccaagttcaggggacacgttttttctctcgactcaatgtgctgctgtgataacttggacttcaatacgaattgtaataggaaaagacaaatctgttgtatggtggagcatccaagaccacatatctgcactgggagattcctcgaaaactgaatcttctccaggggcatcaggaagcaagggaaaaactgcaaatgataaggatagtcctaaagttgatcctcgtggtatctttcttggccacgacagtactgttgaagatgtccagttctgcccttctaggtattgcaccttccccttcatgttattaaatgttgtctctctagcatgtgtatatgttgtttggactatgagcttcagtggtttgcatggcctaaagtttttgtcttggctaatagtcgttctttatgatgataaaacaatagcagctatcattattgtgaacatctgctgggaacttggaatgcatgctatattttgatattgtatgatctatacttctatcaatttatcttcacagtttatttttttttattttttgaagtgcacaggagttttgtagtgtaggcgatgattcttgtcttattctttgggatgcccggagtggtacaggcccagctgttaaggtggtgctcttctccattttaagcagattaatgatgctttacgtgaaaatgagcagctcaattctatgcaccatgttgaaactggtttattcttcatttccaggttgagaaagctcatggtggtgatgttcattgtgttgactggaacctccatgatgttaactatatcttaactgggtatgatggcatgaaatgtttctaaattctaaataatatgtaacatgttctttagtgttcatttggtacaagaagccgtggatacacttcttgatagtgggtttagctatttacacatttgagtaagatggtttcttttcgtattcagttctgcggataattctgtccgtatgtgggaccggagaaatctgggttctggaggagctggcattccagttcacaaatttgagggtcataaagctgctgttctttgtgttcaggcatgtacagatatttattgttactatattttttatgcacatttggttactgtcgtttattttttttgtgcctttatgctataattcaaaccttgtgtgtttcagtggtcacctgacaaggcatctgtatttggaagctctgcggaagacggcttcttaaatgtgtgggatcatgagaaggtatctttctatacaattcgttaccatttcagtcatctctgtcatggccctgcagaaagtttggaattgggatgggagttcatgctccatttgtccccttcatttcatgtactttttaatagctttagattcataaaattcttttgatgcaggttggaaataagaaaaatcccaacgcacctgctgggcttttctttcaacatgctggtcataggtatgctatcgtatgatgaaatgtaaaattttccttatgtgttgtaatatgcgtaactcaataccatattccttcaaatgcttaataccacatcagttggctttttattcctgtcacatttacgagacattcgtttttacgacaactttaggttgcatcactgtgcattgcttttctgtttctgcaatgagatatttttcctaagatattttcattaattagttttgcaaaattgaagatgggacttgaatcctctttgaactggtgtttgacttatgctgagagacacttgtgcaattgcaaatttgaacttaagaagcctaagacttagagggataaatcttgattatggtgtactctgtatcttagttggtaaggccattataaagtcagcctgtgctttctccacctttggaataactgttatggttcagaacaaatggataatcagtacatttgtaagtagatcatatttcagtttttcaatagatttatgctacagcatatgcatacaatgttagctctttttagtttccacatgaactgggcactataataaattgaggggaagatgtattagatcttaaggaatgatacaactgttatcaaagtgattgctgttgattttcattgtatgtattccataaataacgtattttgtgatatttttattggcagggataagattgtagacttccactggaattcttcggatccttggactattgtgagtgtgtctgatgatggtgagagtactggtggaggtggaacattgcaggtgtgtttctttatttttatagtgccagacacaaaatgggactgtactcatatttcattggaatagtgactgctaccatgttgtcttttatctgatattatacgtcagttgttcttatgcatattttatttgtgtagatatggcgcatgagtgacctgatataccgtccagaagatgaagttcttgcagagctggagaacttcaagactcacttggccagctgtgctccaaggagctgaatcgtgtgactatctgtgtaacccagtcctgtaataactctagtaggtttctaatttcttgtccatttagaatgttcctttcaaatattggttatatcctctggtgcggaacccaggcttgtacccttcaagtgcttgtgcgactcttttaccttactgtatcgactcaaatcggtaagctagtgcaaacacagcagagcagaatctctgtgggcagattatttggatgctaaacattgttctggagtctcgtattggacctagttgtattgttagcctgacttggtgacttaatcagatggttcttcagatagatctgtccaatagtaatgtagccttgaatacgtctgcttgggctattccttgcttgtggtatatcgttgcactggataccccagtggaagcagttttcccgcctctaaatcttgtcggatttgaacatttggtccaatgccgcgttgttcttgaggtcgtgcgttgtgcatctgagttcattggtatggtcacaaatccaaaatataagtgtgcttgaaagtcatgttacaacgtcacgtgggagctttaatttggactattatcctggttactcaattgtcaatcacggccgataattgcctcatcacctcatgtctcggatggatgcatttaaattgatgggagtcctgtgcccgacatgtgcctatgaatattatgctgggagctcatatgctgcgggacttcgtctcggcagctctactgacgttaataagtgcgcggttggttgagtcaggttgacctgcttaggttccgatctggccactggatggatcagagcaggtctcgcggcacaccggcacgtgacgtgaagcaaggcgcgcagagtctcgcaccaggtgggctgatatcactagctggacggtcaatccacgtggtttgttcattgcctcggaacggatgttcatccgactgtgcagacttggtggtggctcacctgcttctcctgctcgagcgtacgtttcaacgccaactcattgccgcggttgcgtcaaaatgatgaagcgaaatgtgcttgacgcattgttcatcagctcatcgcagtagtcggcaagagaaatctcagtactccaactccccgaaatgcttgttctatagtctagagtagtaatcttgtgatttgttcatgacacaacttgacacggtttgggtttgccacaggagaagtttctgttttggcagacttgagacgatcaaccactaaaatacaacagtaaagtattggataacggagtattactaaaatactagtacgctgtacacggcattatttccctggagatggagcaccgtggccggtgcaaccgacgcacgcacgcacggtgacgcccctccctgcgtcgcaatgaattgagggctcatgggcttggggatctccaacctgtcacggtgggtgacggggtggtcggtcgcgagcgcacgaggaggccctctcatacgcacgccgtttctcccatcccccgcaactccgcaagcattcctccctcccatccaccacccgcctccgcgcgccgcgtgccctcagcctccctgtatatttaccacgcaccagtgcaccacgccgagcaggccaacgcccagctacaccacgcagtcacatccgcctcaacgcaccaagctcttcccgtgcacgtgtggtaggcagaacgtgcgcggcgatctcgacgaaatggacgtcgcggcagacgcgacagcttggccgccggggtggtcgctggtccgcggctacttctccccggcgacgctcttcctcctgctcaacgtggtcatcggcaccatcgcgctcacctcccgcgcgtcccaccgccgccgccaacaccaccacgacgagcactacaaggcacagcaccaccatgaccaccatgatgagccgcagcgctgccatgatcagtacgctccaccgccacccgcgccgctcgagcgcacgtcgtcggtcatggagcggctgcgctccttcggcctctaccgcttccgctccggcgacttccctcccgagtacaacctctccgccgccggcgccaacgccatctgcgacgagagcgagaagcagcaggcgcagtacacccggagccggtcggagcctgctgctcggcccgcgccgccgccggtggagaagagaggcaaggcggagaacgctgccgccgccggcgccgccagagcgaaggtggcggtcaagaagtcgtcgagctcggaggtgaggaagctggagcgcgccccggcgcaggcacagcggcaggtactgcaagtgcaacgcgcgcagccgccgccgccgagggcgccggccccggcaccggcacgcgccgtgaagtcggcggcgagggaggaggtggagaccgcgcaggttgggctcgccaccgcgagcagcgtggacgcgagggcggacgacttcatcaacaagttccgggagcagctgcagctgcagcggctcaactcgctgctcaactacaacgagatgctcaaccgcggcacgtagctcgatcgcgcgcgcgcgctctcaaaccgcggcgccggtgcagatgcaaaaggcggctcggcgacccatgcgtttagagtggtcactgtgtacgcgttgtttgtaaacggcaattagttttcaattttgggtgtttttgaagttcatttatctcgtgtatgttcgactcaggtagtactcgaatttgcccgactcgagagtcgtggtaacgaggcgcccagcgtctgaatctgttccgtgtataattcaaagcggaaagtctagattaaagtctcactgaaacaatcaagtatgggatgtgtttggcagaacagcccgttcccctcttttggttaaggcttcagaacgtcgtcttctatctgtttgggccctttcaccgttttcacgtacgcttgatgtacctgggttcagaactcggatgactaaaaccgaaagcaaaaataaaaggctggaccatcctccataaactttggtagtgagttagtggctgcggccaatcgctggttaggcaggacaggaaagcaggcgagactcgagaggaaactgaagaggaaggttttcgttggggtcggagtagaaaactccgaatcccttgcacccagttccctagcctatccagttcaacaaacggcccaatcgttctcatggtccaaataacggcagcccatctttcgggctgcattgcttgtcaccgaaataaccgggccgcataaatagcttggattgggataatcgttcagctacaggcagagtgcagtttctcataaatcgcgggtaaacggaagccggaggagctccggcggatgaggcggcggggaacagatgctgcgacctgctggctgctgctatctggtgacccatggaagcgatccaactcggactaatcttgatacgggtccagagcttttccatgtcccggcttggtcgacgcgagcttttgccacggaaaggagttgtacgagctgttggatgaacggtttgtgttgcgtaggacattttttttccaaacagggagctgtatcatatatcatcattcaccagcgtgagcgcgactagtaaccaaggcccgctccggctgcttgcatgcaaattcagtgtacctgttcggatttgtcctttagaaccaaattgaaacgatcattatcgtctctcggtttccacttcgaatcttcaacacgagcttgctcaattgtatggttcgtgactagtacgatcgatgaacatccagtcacgaacgcatctgacatacggttcaaattcgcatctactcgccgggccggcgaaagccggcagagttttattaagaaagggagagtatatagtgcaaggcacagattacaacttaattagttagccacatctctgtccgaaacaacacaattcgcatctctactcgatcgagtatatatggtatgggctcgtctgaataattgttgaaatctctaccaactatacagtggctgctgagtgctgacgtcctcgttctcatatttccggtaccaatctcgccgtggcgacagcaagcaaattagcaaaagaccatcgtccttgatcaactccggcggtaggtacgggcctgcggccaattcagggaggcgagactcgagaggaatcgtaggctaggcagtcagacgagagaaagctcggaaatatggttttggcggagttcggagaataaaactccgaaccccctggaaccataccaattgttgttcctaacctccattggttgtctctgatataactgcaccggcataaaaagcctataatgctatcaaggatggtaattccggcacatctcgatcgcctggattggatcagtacagacggttcaattcccagaccctagagtctcactatggtgctctctactactactactggtagtagaaaaaaactcatcggttgatctcatttgatcaaaggatttaaatctatttgtactaccacccaattagcggtagaagaaatgtggagagatattattgtaaaaagaaaatgtgaaggggtataattgttatttagtagcgatggacattttctctcttttttaagctttttcgatggaatatgaccgatgccagtggaatggatgaccacaaattgatctagatgaaatgtaaatgacaaaaattacccctaatcactctattggtaaattactaatttatccttaataacaaacggttcagatcatttctacttgcagtataatactagcataatataattttattttgtttcagtagcatgtttgcctaaactatcctggaaacggaatgcagtcactatggggctagctctatcagctagtactgatttggaccaaagacctgaaggtagtatttttaagcagattcaggaggtgtataatcagtttgattcttgttcaatctcggtctacacaagatcatgtcacaaggtagcagattgttttgctgctttatggtgttaatgtgctgccggttaacgcacgggagttctggtgcaatacacaccaaagatttgtaacggtccaagtagttaattgaagcctcatttcaaaaaagaaagaaagaaagaagtttgcctaaaagatcttagagaaagaaaaaggaactcatccgaggagaaaaacttgaccaggaggctcaatgaaatgagtgatacaatgtgggagaaattggcggctcaccgattcgttaaaaaaaatatgggagaaatatcgtaatcacggcatcaccttttctatcttgctgtctttctttgcattggatcttacaccactagaaggcaaagtagtcaagaaaggaggtcacgcattcccttctttctcataaacaaacaaacatctctttttgtgcaggagtatatttttgtttatgtttcatcttccatctggactaacataaatttgctggaccaatggtcggtaggcctcgaaggctagacatgcataattgcatatcaagatctggatcttattagcaaagtgacgaaagatcagatcagtccaagatcttcccctgtcatctgctttctgcgtcgcaacagatttcctgtattattaatcgaaccaatgcatgcttcctgcatcgtcgcagaatgtgattcgaagcaaagttatggctgtcatggattggtcaatcaagggaaaggagatggctgtcgtcgaacctttggccggcccttccccggaccaactgcagcagccgaatcaaattgctgtcattcatgcactacaagtagtactaggcactactgctggtgtagggtatctcgtactgttttgtgccatgttgatgttcctagaatttcatcttctgatcaagtatagatagcaggaatcttgcagaaaattctccgcaatttcataattaacaaacagcccaaatctttgcaggaactagtagtaatctggatagcttcttgcatccacattatttgcagcttatagattattcgatcatgagcaacactggagcctgcacagcctgaagcccgaacagatcgaacattgtgtcatcgagtatcgatctcagcctgtggaatcatgaaacttcatccaggcagaacaaatctagcgtgttaattaggtgtactcgtttgcatcttatccccttcaagagaataagactaacattatgtcactcgactaatgtttggttattacttattagtgttagtaacgtcaccgatatcgacgtgcaagaaattgtcttgttaagccataggtccggccaaaggtggttcaatcgagtactatagactactagtacgatagacagctcttggggaggacggaggatactctgtcaaatgtcaatggagggatgatccatgttactatgtcgtggtcttacaactcaccggtttgacacgtgtcagaaacagacaaaggagatgacaatgagcaagcaacgctcaatgttgccatcgtgtcttctggcgccaaatgacgccgtaatacggcgggaaatttcaaagtagacactgttttgctgaactcaccagtctccctagaccaatacggacatggattgacaatttctctcgattcccgaagaggtgaagagagaacacgttttacacatgtactagaagaacacatcacctcctcatatctcaattttatctccatacctgaagcaacatggatcgccaaaccggcaaattaagccatatccaaccacgtgaatcacaccattgtttgagatgagcaacgcaaatcgtgatcacaagggaaaaaaattgctacgtggtgtgattcgctccgccgcggtagtgttgcagcagccggttagcctcgcgcacgccgctcaggtacgcggcgtgcgtcgttgagtagtgcgtgcggtgcgtcgcctcgccggcgaacagcagccgcggcgacggcggccgctcgtcggcggcggcgtctggcccacgtggcagcggttcggccatgcgatcgaggtcgtcgccgctcgatccgacggccacgtagctgtatgacccgaggaagagcgggtccgtggcccacccgctccgcttgatcctcctcaccctccaccgtggcgccgccgggaggaaggagtccagcgtggcgtgggccccgcggatgacgtcgtcgtcggggagggactcgaggtgcgccgcctcccggccggcgaaccacgccagcgccacggtggagcccgcgtggacggggcagatcgactccgtgccgcgcatccaccacgggatcttggacacgtgtccccggaacgccatgtgcaggaacgggaagcccgccgccgccggctgcacgccggcgacgtcctccggttccgatggcgccacggcctccacctccatgaacagcttgttcacgacgccgaagccgaggcgcgcgacggcctcgcgcttgaaaggcgggagcggcgggtcgaaggcgatggcggccgcgccaacgccggcggtgtccttgttgccgaggctggccttgaggacgcccagcgagaccgtgaggatgacgtggtcggcggtgagcggcggcgcgccatccgcgaagtggaggcggacaggggttccgccccacttgagacggcggagacggagtccgaggcggacggtgccgggcgggagcgcagcggcgaggcgctcgaccacgcgggagtagccgccgggaatcgtgacgtgttcgccggggaagtcgcggtactcgccctcggcggtgaggtcgaggtcgccgaggtcgtcggcggaggtgtcggtccgctcccggttgatgtgcatggcgagcagcgcctcgtccacctcctcaagctccttgccgccgccgccgccgccgccggcagaccgcgccgcctggtacgcccgtaggccacggcgcaggtactcctccacgccgcctccaccaccagcctcgccggcgcgcgcggcctccatcatgcccctgtacagctcctcgatcgggccagccaccgtgtccgcgtcgacgacctcgccgccctctgcgacggtcagcacgcggtcggggaagccgtccatgcgctcgtacgggagaccacgaccctcctcctccccgagcgcgccggcgtcgcgcgccagagcgtacacggggctcccgacgacgccctgcacccacgtggcgcccatctcgacccggtggccggcgaactcggacgtgaggatccggccgccgactcggtcgccggcctccaccaccgccacctcgaacctgtccccgcccgcgccgcacagccggtgcgccgccgcgaggcccgatatccccgcgcccaccaccacaaccctcggcttcttcgccaccatcgcgaacgaaaccgcgcgcacgggtgtgcggctacgccttcttcgtcgtagcaaaacccaaccgcctgcgcgcgtcgatgcagccagagccaaccaacactccagctgttataaacgaggagcagacagaagagtggagcaacgcaagcaagttgacacttgacatagcttaggtgcgcaacagccaacagcgcaagcaacgtgacggtccggctgcatttgagcgcaaagtgtcgtgttagcgcgcgcgtcgcgcacgagtcgtggcgtacgttcgtgcgcgcgcgcggttgggccatggaatcggatgcggttgtgttgatttcgaatgggatcttcattcttaagctgctgcgaatctgcgagttgtggtttcctgattagtgactgctacggcggatagcaatccgcataccggccggtttctctgttaaaatgctcaatgatgcatggttacgttagacacacatgcaccggggccctgtggcggctttaatttcgtcctagttgagtcgccgtgtaccgagccgggcaccgccgctcgtgcaaccacgactccacgaatccatggttggttggcgaccgggcggccggctggatgatcctagcggactcgcggtaatcgagctacaatgtgcaggtgcatagtgaagacctgctgtttagatccagtgacacaaggaccgaaggacggacggtttgtctacttgtcttcgtcatggtcatgcatgcttactttctcatcgacgtctagacttgcgtacgccagctataaaagactcagcctccgaggctccgagccttcggtcatgtttaaacttgctaagctacggagtggagtcctccgtatatatgtagactgttcttacatcttgtacgacatgagtaaatctgctgccaattattaagaacatgtcttattcttcacatgtcaccacagaacaaattactcctacttactgtaaggactaaatctgatgccgattctgaaaagaagaggggaaaagtaggaacatgtcgcactgttcacctcatcgcgttgtcactcgctgctgaaccagtgttgcatgatacttacagttatagctaagttattgacgttgtttgcatgtacaataagtatatgccgggcacggcggctgacaaagttgctaactctcggctctcgcatcaaaagaaacgacgtcgaccttctttgtcgtttaagaagcctacaacacccatctgtgtcggatgctctactcgatttacctactcgctgcttcttaacttgcttaattaccctgcaacaaattaattactccatagtctgtgatgataagtttgtttagttatagtataatcgtacgtaaacacattttaaattaagcagcttgaaatgcacaatgctttgtcttttatccaagtggcgcttctgattttttgaagaaaaaaaaacataatcgacatttgtaagtataggagccctatccaaaatgtggaactagcgcgtactagtacaaaagtagtactactcggtacaaaaaataagtactactgcctttgtacctaaataagtacagcttaggcagagtttagtttcaaatttttttctttaaacttctaa

SEQ ID NO: 68643 - DNA, 4236 bp, Oryza sativa
gttactttacattttttattatcatataagatcaagtaaattaaactcgaaacatccctgcaaggcatgcatatgtattacattgttcatactgtaaattacaagcattatagtaagagaaattttacaatccttgagaaaagtatcttaagatacctaaattttacataaaaaaattgttacattgaggtatttagtatctagatatatcaaattttgcactaaaaaaatatgatacctctatgtattttttcaaagatggtaaaattacccttatactaatgtactaaactttgttgaatgaacagcacaacaaactaatgctgcagtgtatgcagacctaaaaaaataatgggccatgcaagtttttaacttaaagcatgtcgcgttggctggcgctggtgggttggcacatatgagtggatctaacgtacgtgcagagaacctcaggtcctcgatagtccatactccactggatccctgtgaggaagtgaagaggtggaaggggaaagaagggaaaggtaaagaagagtaggggtttgaaggggaaagaagaaaatgagccttctctaacctgatgctactcctactgtactaaggctgtgtttagttcgtgtgtcaattttttttaaagtatacagatacacatttgaagtattaaacgtagactaataactaaacagattacatattctgcctgtaaactgcgagacgaatctattaagcctaattaatctatcattagcaaatatttactgtagcaccatattgtcaaatcatggcgtaattaggctaaaagatccgtctcacgatttacatgcaaactatgcaattgatttttttccgttcacatttaatgctccatgtatgtgtccaaacatttaatgtgacggaaaaattgaaagtttgaataaaagagtttgaatctaaacatggcctgattgtcagtggctcagtgtgacagtgtgtcctggtcaccgttttcgcagaagggaaaaaaaaaggaaagatgagacctgggtactgttccttcctgaagatccgaacaaatacttgctggcacgaattaagaaaaacacacgcatgtgtggtcgacagcgctgcaaatagcatagcagtggctcgcaacaaactagatttgacttgactcggctcagttagggaaacaagctaaaacttgagttcagctcagctcgttttctggctcgcgccagtctaagctggcttgcaagcctttctggttgaaatacttcttcatatatattttataatcattaaaaaaacaaaagtaaccccgcaaaaaaaacaaaagtaaaatttaaataagtttatacattcaattcttcaaaatcttaatgataaattgtaagttggcaaataataactctataaccaaataaaataatccatataaacacataatcgcctagacacatgagccaaacaagctgctcacgagccagctcggacttggtcaattcagcaatgagctgaaaaaaaggcttgcgcttaccagcccaccgagccaaccaagctcgagccaagcctgagttgagctcacgagcccaagcttttttccacccccagcagcaaacccccataaaaatcatgcctgccgtcccccagcatctctggttcgccttcggtccagtacataacactagcctaaaaaattgtggcacgcctaaggtttggtgtggcatgttagagttcgtctatgtcgtaggcagcagctttgtaggttctgaagatgtcgctcgttggcgaacgatgaacaacagcttcagcttgatcaaggcacaccagcggtgctgtcttcaaggagattcacgccctcgccgaggtgcacgagacggacggtggctctcctccaagatacaatgatctcgtatcctcagccgtgcactcgaccaagaacaaaccagcagactttcgtgggatgtaactctctctatgcaaaacaagccgatgaatgtgggcaaaaactttgtgtaacaaatatagcagcagtacgtggcttatatagccttgtatagaaacaagaaaatcttatctctaagccggataacaaacaatcaatagattgattttcgccggactgaatatctagaatgataaagactttatcttccacgtacagctcaaaccaacaagaccaaaactgaaaaccaaaatctgaagataaggcaaaagttcagatatcttatctgaaccaaactgacgaatcactggtacaaaatgaacagaaccaaagagataaaatctgaacaaccatcaaacatcatttgtgactttcattcagatataatcagaaggaaaaccacctaaattccaacatggcatactgaggccaccagccaaacagccccttactcccgcaatttggtcaaagtcaaattgctttttgtttgtagaaaaaagtagtactctctccatttacttttgatagtcatatttcaacttggcacacagaccaaagataaataattatacttatcatctatttaaacatgctactagtcattcctcgtaaacaaacgattcattaatatttacatttctcgatacccatgtagccaatcttgtgtggaagaatggagagtcacgcattaaatccgagaaagtcattaatatgataggttgttagattgaaatatacctatcaaaaataaaattttcagatttgataatatgactatcaaaagtagatggagggagtatcatttttaacccaagacaaatatattataaaaatatatttaattttagatttaatgaaacatgtttcgtgttataaatattggtatatttgtttacaaatttaatcaaatttaaagtagttttattttgaccaaatcaaattgactaataatttgaaaccgtgaaacggagggagtagtgtctgagtatgaaatgtcacttgacataaacgtgccacacatcttactcccctacatcaaaagaatcaacacatattacaagggagaaagcagaaaccacatgaaactcacacaaaagaaccatgaagcatcatttaactaatataaacacgcaaagttgctttaatatatattataatagaatacacacctaaatctaatagtcttctaaagaagacggtaactagcagtgccctatttctaaagagggcacaattatgataaactcaaagaaaccttcttcggtatactttaaattaaaattgataccttttcctatttcaattattttgtggagttcagatcaggatttgaaatgaattcactattggtgttgggtgtgggctaaactgtcccatgtgttcactgctaaccctatctcggaatataaggttattttggctatacgtctacttagaagggtggggggggggggatgctgcaattttttttacttggacttaaaaagaaatggcaatttttgcttgagcgttgtagttaatatattttaattccactttgtcttgagtattttctactgtcactgttctaactgcacgacattgtaaccccagactcaaatcatggcttgccgatttggcttgtcagcctatcggaactaggtggttgctgcaggagtttactatgataacaacaaataaaaataatatgtaagataacctaaataatataaacttacataagttgatgtgaattaaatttatatagcatgtagaatgatgattcaaatgtaaaagtaagatgattgtggatttatgagagaatagaagaatgaagataatttagactatacatctatgggctagaaaaaaagagatgacatggtttaatgagagaagaaaaatagcatgaactaagtgaggatggactatattaaaatattatgtgaattatgtggaatgatttgacatacttacattttaattctctaaaatttaataaattattaaattgtagataatatagcatgcttgtatgatgtttaaatataataattattagtggatgatgatgtaacatctttacatgttaagctttaggattaagaatagagaagccccgatggctggatacgtctgcaaaaatgcctctacgcatgtacaaatgtgttgcacaaataaataaaaagaacgggcggttttattctccaaaatcaaaataatcaacacatattacaatggagaaagcagaaaccatgaaactcgccacaaaagaaccatgaagcatcatataactaatataaacatacaaagtcgctgttaacatacagtggcgt

SEQ ID NO: 68644 - DNA, 10889 bp, Oryza sativa
aggtcgtggaacaaattctttcatatatgtgtgtgctatgatttgttttcttcctcaccaaaacaaatcttgtaatagatctaacgattcaaaattatgtgaaacttacatataagttacactgtagttacatgcaagttacagtgtaattacatataagttacagtgtaattacactacgattgtactataattacatctgtcaaatttttggggaaaaatttgtcgacaaatgtataggtagtcccaactaacaagtttaagaagcatgataagtatgtatagtttgttttgcaaatgatccatgaattttgatagtagggattaaggtctctatgctaaaatctagggtagtcctgtgcccatatggactataagctagctacgccactgttaacatatgttctaagaaatacacatctgaatctaaaaggtcttctaaagaagacagcaacttaaagtgccctatttctaaagagggcacaattatgataaacttgaacaacccttcttaggcatactttgttcaggctagggctgacatccttcctgttgtaattctgttgacgttattactatcagggagtcccatcgcatatttcacaattgctacagtcctaaggaatggtgctgcaatccacatcaatatgaagaagggctgcatgactacaattatggacagtgccaccaacatttcgtattccttgatagcagtaaccatgccaaaaatgtagagaaacactgtcgtagccatgtataaggtctgcaaagaaagaaataacaggtaaagtgagcgaccattcactgggactacaagataagaaattctggatgcaaagaaaattatacatgattgaagtaccaacaaaacaactagcactagataataacaaggaaaaattggttataccacatcaaagattttagaaaaatgatgacacccaaacttcctggtgcacaataataatagcaccgaaagatgatgaaatttagcattctgtcactccatctgctggcctaatcactggagtgagttaaactaccaactaaataagatagcaatatgaatcagcaaatgacaatggaaatgctcctaattaagtcagacccaacgacccgcaactatttcatcatttggttagttaccgaattgatagtacgatttcttctgttttagaatgagagatagagtgctttaggttccgacctgaatatgcatcatctataatatataataaactacttggcgcaattctaggttcatgctaggtgatggttaaaaagtagcaaaccacaatcaattcccacagtactaggcagtaggcaccagataaaaatttggaaactcccttttcctccttgagtcgatccatagattgtccgatgaaacaaaggcagaaccaaaattgtaatcttgcaacagcatatatataaatatatatatattgcaaggaggaaacaaaacacttacgtaaacagctcggatgaaggcagccagtagaggattgttgacgaccaggccatccggcggagcgtaacgtagcccgccgaatatgcggactgctactgcgggcttcaccttctcgcagatcggcttgccggacttcatctccggccgccggcttattccttgtttctttccaacactctgcttcctctcctctgctctcctcttcttgctgtgtcgcggcggatgtggtgtggtgtgtgggtgggggatccgatcgatcgatctatctatatcaacatatggagaagaacagaatcggacacggaaaccgacggacgataacggacacggacgccgggtccgaaacggagttcttcctcccccggcctgggaagccgtcgatggcgatgatggggagaattcggagagattgcgttttgaggaagaagaggaacgacgcgggcggctgggaccgggatctagtgtttaccccttccttctataccctgatcacaaattgggccaatggacgtgggcttcctttacgattttgacagggaataagtttactttaggtccctcattcttgaatataacatgttgttcaacttgcgaaaaccaagatattagcacggatctcttcttcttcatagctgtaggcatctgacatgcgggccagatatattctctcttatctacttcttctgtttcaggttataagatgttttgattttggttaaagttaaactgctttaagtttaactaagtttatagacaaatataataatatttaaattaccaaattagttttattaaattaataattaaatatattttttataataatttatcttgtatcaaaatattatcttttttataaacttggccaaatttaaaatagtttaactttgaccaagtcaaaaacattttaaaacctgaaatggagggagtagaaccatataattaatgagtatggttagctcttgtcccttctctctcctatagaacctcctctaaatacaacattgtgtttgcctctagagcatctccaagagactagccaaatggctctctaagttaaattttagctaatttggacaaaaaaatctactccaatagactagccaaatggctctccaagccatctagctggctaaatttcccacctcactagccaaagttggccagccaggacggctggccatatgatgtgggtcccacccctctctcctctctctccctctttccccatcccatcatggctcccttcctgcccgccgcccattccgcctagcgtcgtcgccgtcgtcttcccgtcgccgccgctgccatcctcccggcgccgccgccgccgtcatccttccggctccaccgccctttgccttcccctcgactctccgagatctggagcggggcggcgacggcaacggcgacaacaacggcgacggcgacgacgagtcggccctccgcctgcgtcgccaacctcgaggcgatggcggcgggctggggtcgggggaagggaaggtagccgccgcccgcgcctacgagggacgccgccgcgactccgccgaggccgccgcccgcgcctacgacaccgccgcgacttcgccggcgtcgcccctccgcgccgccccttcgcctgcgtcgccccccgccggcttttcccttctcgtggcctgccgttggtgatgtagttgggaggaaagtgaagggggaggaaggagcgagagactgacatacggtcccagtgtcatacactcagaatagagagggtggatggagagcctattggagtgagcaacaggtttaacttgctaaattaattagagagttagctatataggtatttggagagtgtgatttgggtaggctgttggagatgctcttatatcacgggaccgaggatcactcgccgttcaactctgtcgttgtgctgcgttgtaccctgctactgctgacgaaaccaacgacgacgtcttcatcgccgcggtgaccagctccaagctcttctatgatgatggcgcaggctccgaacctccgacctctactccctcctcctctagcatacagattttacgcctgtttagattatagctaaactaaaccttacaaagttttggtaatgctgaaattttagcaggatttcttatgcattcatcaaatttagcaacaaactaaacgtagatatttttttagggttaattggatccataccattataaatatggcatattagaaaaatatcattacaattcacgtatttggaaccatgccactcccgtcactcttccatcttcctctttcacatcgtcaccctcccatcattaatttagccaaatgttgcatagcgggtttgctaaagctcttaagcatatcatctaattaattatcactttcttcatcactagaatcatcatcaagagaagtgtgagagggctttgagtcatcaccttgcggccttgggccatgaaacatgagtagtggtaggagtcgtcatcgtcatcactcaagttgttgaagagacgctccttgcttgaagaggatgacttgaaggcgatggtagcaacactaccctctccttcaactttgtcttttggcttgggcttgggcttaggcttggcctcggaagcttcttcatcttcggagtaccacacctccgccatgtgtgcctccgccacatgagcacgctccggcttcttcttgcctcccttagccttagcttcatttgacttggggcaatcggcaatgaagtggccatattcgccacaattgaagcaagctctctttgattgcctctttcccttgtcatcatccttccttcctttcccatagccactcttgcgaagaaagtgcttgaatctcttgacaataagagccatctcttcatcttcactttcttcacaacttgactcttcttcttgttttgccttcaaagccacttcttgatttttgatcatggcggcattcttcaccatttgcctcacttcacgagcttcctcttcttgcatctcatgagacacaattcttccaagaatgtcactagaggtgagcctcttgaagtctttcctctcatgtatcattgatacaagagtggggttccttggaccaaaagcacggagaagtctcttgaccacaaagtgatttgtcatatcctcacttctaagtcctttaatcttgttgacaagaatcatcatcctatcatacatctcttgtggtgtctccttgtcatccatcacaaatcttcctagcctttcttccaacaattcaatcttggcctcacgaacggcgggtgatccctcatgagccaattgcaaagtgtcccatatctccttggcctcctcaagtccatccactttgttgaactcctccggactcaaggcggagagaattgcattggaagcttgagcattgcggtggatgagttgctcttgctccgaagtgagctccatgccatcatggggtacatcaatacctgtacaaacaactttccaaatacttggatgcaaagagattaaatgccacttcatcttgtgcttccaagcggcatagtgtgtcccatcaaaatgaggtgcacgcccggaaggcacggagacgaagttatgagaaggaacattaagtttgctgtaatcaaagtgaatagtagccccctttgatgcaatctcctcggtgctggaagcgtctcccttgtccccttcatctatctctccgtttccctcttgatgcgacatcggatcactccaagcggtgaagcttgaatcaggagcacaaggctctgataccaattgaacgtgctgatgaagcctagaggggggtgggggtgaataggctgtccctgaaaacttaaaaacaaatcacagcggtaaaattcaaacagaccctgaacttcctagtaaggaacaccggaacttccggtctgccaggcccggaacttccgagtaacagaacaaggatgaaattcaaatttcgaaacaagagactaagccaatcttcacaagatgaagcacaggtattctaagcagaggatagatcacagaaacatccacagaaacatcacagaaaagacaagagcgatttttcccgaagttcggatcttgcgatcctactctccgttgaggagctccaaagagctaggtctcgattaatctcttgcctcacttgtgcaaaaacccagaggaaatccacagctttcaatcgcaaacactcctaggcaaatttctagaattgagtgaccaccaagatcgaactcaaccaacttctagaaatccgccacaagtgtaggttgctctacttggaaagcctctagaatctcagcacaagaacttcattaacttacctcgttccctttcggaggagaggagatccttcacaaacttacccgggacatccacaatatgcaacggattctcgcgggcgacacctaaccgtctaggagatcatctccaagagtaataagcaccgagatgacagcccacgagatattccaagtgctcacccaagatcctaatcttcacacctctccaaatcttcttctctccctctcaatctctctttctcacaagaattaggctcaagattgagtggagaaggcaagaaacacttgggagaggctagcaacagctctagggtccaaaagtgaaagtggaatggccaaagaacgagctggaaacgagctggatatgtataacggctaggtgacgtcatctagccgttactcacaattttgaattggaaactagacaggaagtttcggacctggaagacaggaacttccggactacacttaggaaaatctttttcacaagacaggaagttccggacctggaagacaggaagttccggacttgcatttttggacagatggagtatttgcaaaaataactcctagggaaacttgtcacttggttcaacctaagaacacttgacatatcttagagcaccacctggaaccccccttaataatacggtttttcctaaaaactcgattgcaataaataaactatcctatgcactcctcgagttccggtctgctttgattttatacttttggggggtctccaagcatccatcttccacaccttggactaatgcacctaaaagtagctcaataaactcattagtctcttaaccacatttatcattaatcaccaaaacccactagggggattaatgcactttcagtggctacgccggcggctggacggaggtagcgcggcgttcgcagcatggacccgaaggcgacaacattgacatcgagggcatggcgctgctatagccctgcttctggggcgcgcggtggcagccgtcggaggaggaggcggccagccggcacgacgagccgccgatgctcgcgcgcggacaggctggacacgctccggccgtacgtgacgagcgccgccgccggcaatgacgccctgcggatcgaccctcccgccgaggatgtgtcgttgcttccatgctgccgcgcgctggtcgccgtcgctgagaaggacatactgagtgaacgcggccgccagtacaccgcccagcttcgcggcggcggtggtgggcgcgaggtgacgttggtgagtcggagggcgagaaccactacttccacctataccggctggcgcgcgctagcacctaatggatcgtgtcgcggagttcatctcggcggccagttgccttcagacggaggagcttcatctccatggcagccgccgccgcatttttgcatcatttccccggcgatggcaacactccggcggcatcatcaggtgttcccacacatcagctcgtcctgtcaggggtgctttggcgtgaggcggtacatcctgcgccacaggaagacgcagcaggccccgacccctgcgcacgaccgtgcagcgccaccccagctgaggtgccgcactggcccgcgcctcgctgcgccggcgccctcggttgaagaaaatgcaacgagaaagagagaaagaatgagagaaagagaaaagataaggaagaaaaaagaaaaaaaaattgaagggtagaactgtacttacataggtgtttctctctccaattcctccaaatataataaaataatccgacgggtgtccaacagctaattactgggtttttgtggtggcctttagcaaattcacgttcttgtgagtccaccagctaattatacatattttggatatcctgtagcaaattttgccaagaaggaaaggggcaaagggacaaccttcacttccccttcttgtctgtagtctatagagtcatgcatcttactcgtttcattaacgtggcgcttagtttcttgaaagagaaaagacgcggcactcgcgcttctagcacaaaagataacttgtatgcagggaactggatagagtgacagataacgttatatggtggagtaagggtcctctgcagtactgcaacgaggatttgaattgtataaggtgtgtgcagcacaaaagtatttgtttttatgagcagtatggttggatattatgaagtggaggctatatttttttagagaacgtatagcggtagatatcacccatgggcatcaaagtaggtttaataatatcgtcaacttgctagctgtaaaacatccacatcatctatagtctgttagtataggctgctcatataacaatggtctttattactatcatttacgataacaactgatatatttttttaattgatatgggtctcactaattactgcattcttcactgttgttccaagtatgaaccaatctccatcagacttatttatttcttcattgtacagcgtgctacagccgggcgataattatatcgtcggctcgcattctctctaccattctctcctctagcacagcagtgaagccaacgtgtcgtgctatcgccagcccagttggtctattagacatgctctcacatattgttagacaacgtaagacacgatgacgataacataaatatctgaaaggtttttgaaaccttatctggaagggaaaaattggtgtgctcagtttatgcttctatcatacatgttcaggtagaaggctgttttaaacagaaattatatctaggagacaaggcacacttaaaagatactggatatgaaaggaggggtcacatatcgatatttattgagatgtggtgaggctcgaacctagtcgactaacccacctacttatgatgccaggactcattttattctttctcaagagacactaaaagcagaaaggaaaaatactactttctcctaacaaaacaactcattttattccaaagaaaaaccgataaatgacattgttgtaatctagctcgctcccaactcccaagctccagctacttcacaagcatatcagttcgacgccaccgctctcgagtctttttctgatgtggtcttcaacaactcacgcagctccggctttacatgtatcaggcctagaaagacaaccaatgacacacttgaaagatcagtgtattggagttagataaactcaattttctgaagatgattgtgtgtctgtgttttttactttctgtattttcattggacccaacaaatcactcttcagccaacaatcatcaaatttatgtctttttttttaaaagaaagctagcgtgattttaacaaagctcggcgcacttagccccattattcttttcaggttcttttctgatttttgtcacggattatctgcttcacgcttcttaaaaatacaatttcttttaaaagaaactcttagagcattatttaggtcacttgttttaagttatttacaaagttttttaaaaaatattaatttatcatgttaatcaagtaaagcaaaaattagtttcaaatactatgaattcatacataatgcgacgcgccgagacagagagctaaaagtaaacaatattaattttctatcgttcatacatactatctaaaaaagaatctaggactgtatgtgacacactctagtgcaatgaatttggacttacacactctagtgcaatgaatttggactgaggtatatgtaatattaggatgtgtcacatccaatattaagtaggttggtttttatggtacgaagagagtactagattgccactgaatttgcttgttcttgctcctgccagcctattttcatgtcactagtcaatttattttcaaaggaagccaatttaccaataaatttaaaagggaaactagcattacttttatgacatttgaaagttcttattgtatttcgcgataattccgcatttcagagtaacctggagtacacgtgactacttacaatatagagcgtcatctgcgctcatatacttcattttacttcagattatatcgcatatgattcactattacaattttttttttcttatacaaacttgtctcgcctttaataattaaccacattgctgtaaagcctgtaatagcatcatgcatcatcacttctattgatatgtaacagactacttatttaccacaattgcaaaagtaaatggtttgatcatgtaataaattcacttacacacaaagcagttgatcaatcaatccagacagaagcttagaccctttgcccgtcttcttatcctccttggcactgctggaggtggccacggcagcgacgtcgtcgtcgatgatcttcccggtcaccaccggtggcacgggcaggttctcctctgcgggcccctcgagctgccattccccgttctggccgagcaccatgcctttgttcctctccacccaccatgactccggcacaaggttgctgtccttgaggaagccgctcgacttgttcaccagcgcgacgctgcgcttcacctggagcttgaactcgccgtccttcccgttccagccggccaccgtgtgtaggatcccctgcaggttgtggtagtcgcctgggctggtgtctcgcttcacgtagggcgacttcttggagtcgacctggagggttttgccgacgttggcgtagccgaggaggccgctcgggtagagcgggatgaggtcgggcatgttcctgacgtgcagcgcccgcaggttgggctgctcctcgaactgcttcttgaactccgggttcccgatctgcgggctcccgaacaccacggcggtcaccgggatgtgcgcgccgtcgccgaccttggacacgccgttgacgacgatatcgaacgcgcagagcgtggcgagcgacgcgccgaggctgtgccccgtgcagacgacgccgaggctctcgttcctgtacctcgccaccagctcgcgcacggcggcgagcatctggtcgcgggcgctgtacttggagaaaggggagcgctcgtcggtggagctgtagatgaggtaccaccccttcatgacgcgcgaccggccgcgccccgggtgcccctcggggaggatgtcgtcgtggtcgaccaggtccggcttgagcacgtcgacccactccagcgaccggatggtgccgcgccacgcgacgtagatgacgcgctgg

SEQ ID NO: 68645 - DNA, 4435 bp, Oryza sativa
gcagctccggccacggccgggagccggccccgacgttgctggacagtaggactccctggctcttgtccatgtgcgtagcagcagcgtgctgagccgccgctcggtaaggtgccggggtctgcggggtgtgtgtgtgtgaatgtgtgaggagaagaagattaggtggagtgtgtgtactgggttgagtgagtcgcgcgggagcggatatagcgagcggagactggacaactggaggagagtgaccgcgtgagtggactggtgggcgcgggagaggtgcagcgtgtgattaaaaccattcgtgtaaactgtacgcggcggcatggcattaacgtcggccggtgacagttcgggcccaaggcccgcatagcgctttcattgcaccgatgtaagtatagtaaaattgagtttactataacaaatgtactgacatggacatatttaaactttgtaaatttgatttaactcatgaatataaaatttgagttcatggttcttcttcttcttactgggcacaaaccgcacatacttctaaaacagtgctactgctttctttggccgagtttagttccaaatttttcttcaaacttccaactttttcatcacatcaaaactttcgtacacagacaaacttccaacttttccgtcacatcgtttcaatttcaaccaaacttacaattttgacgtcaactaaacacaccctttgtctggaatcttttggcgatctttcgagttccgacttccaactatagtactccaaatttcctgcaaaaaaaaaatatagtactccaaattaactccaaacaagatgggtcctttactactattcttcggaggcaaaatcctatcaaaaccgatgtgtggcttcccctagttcattatccgaacgcccattatcagccgtaggacagttccaacttgccacagacagcgataaggtaaccccacagacagcgatgaggtaaccccggacgatcgaccaggatcaacgttacacactaacgaccccaggagcactattattaagtctcatccgcactgtcactatggcctaacggacaattatatagagcagttgaaagcaaccaaacaagtgaagtgatcagagacctagaagaatcttgtcctgccgtgtccttcaatgagttcaatcaccaacggagagacctagaagaatcttgtcctgccgtgtccttcaatgagttcaatcaccaacggattaatcggagttggtatgtgagtcccagccggttgacaccagacagacagaatattctgaaaactagctggcaccccgcgcgttgctgcgggtgcaaacatagcccacacgtagacataagcattacatataccatgtataattgcaaatattttgaatcaaatggaccaacattagaaatctgattgaccttctcatacattgatcactgtcccaaatcagactatcttctttttattagccaatgaggatggaaattttaacagagaaagattggtacaaaattctaacatcaaactcaatccaatgtagagcgatccttttaacttaataaagtgcttctcactatgttgcttacaactatattaccaaaattctcttcacccttttcatgtcaggatttggcaataaacactgcatttttttttttgcgataagcaatgatacttatttgaaagaaagatcatgactcccaactgcaagatatgcatcgtagaatgaattgtacaaacctcacctagccctatccaccatactatggtgctctcaccatcacaaccattatactctgatgttctcacccagcttgatctcctgaacctagaaagcaacttgatctaaatgatgtccatatccagttttgattagagtattgaactttaccgaatctgtcagctaccatccagttctgctattcagggaacatcttgaactaaaacagacagtaatcttgataatctactggataataacaatatatgatttcggtctggacaatgtcttgatggcttcaactgaaatgaagcgagaagcgtagaagtaagagtaggaagtaatacctagcaaatattacataattatttccactcgtcctgggcagcctgtccctggcctgaaatgctatgcacaaagaaatatattaatacagatgtacagtaaaacaccgctgaagaatcctctcttttagtacatattaaaggttaaatagatttacaaatggtcagtccaaaacataacaccagtgcttgcccggtaggtagcagcagatcatgcagaaaacagtcatggcctcatgggaaacgtaagacgatattgcgctatattatagttttctatttacctgaggcagtcctgagcaatgtagcacactgtagaacacaagaaaaaattgacagtcactgaaaatctcaatttttgatggccacaagatattgtcaccttgcattttcttggcaactttgtaatgtagtgtagttcttaaccataagcacttgctgaatgccctaaaaacaggaaatcatatacaatactaactttacagagagtcgggtctatttgcttcacactaaatctaactcaactaacaacgaactaaagtacagtgggagaacatagatgtacagaaagaacatcttagttgtcatagcaaggaagattgtccggtatcgaaacttggaaaatcaagcactcttgcaaattgataactgatcagagacctgcaatgcaaacaaaagttaggtaatagtgagaaattgataattgtgattaccctaaggagatgtaggcagacataccaaggaccagatgcagatggaaattggatcaacttgcgcctttgctgatcatagtgtggcagcgagctgacaaattatgtacagccgattcatccatttcatcgagcataacaaaagcatacataaatttgatgttcctgaaaaacacctaaaaatcacagacacgttattacctgcattttcaagaggtaaaactccaggttagaggcttggagcagtgcaaggaatggggaatcgaaccaaaagctaaatgcgaaaggcacaagaggaaagtaacaggtgcaggcaccgtggtacctgtggaagaggaggcagcgaccgttaggcgctgaaccgataggagatgagaggtcaccgctagcgcggatggagtcatctgctaggtgcccaccgtggggttgggccctcttcgccgcagccccgaatggcgctgggggcggcgccccttgccgcttgccgcctcgcccgctcgagctcatcgccggagagggtgagccaaggggaatgcggtgttgaaccgggcgttgtggccggcgtcaatgagatccactggaacgctgctgcctgcccgatggacgctgaacgacaaccagcagcaggcaaccccacagccgtagacaggcagaaattgtgggggaagagcgaaggttggagatgagaaaaggcagtagccggtggagcgatgcgggatcggcggcggctgcaggaagtgcgggatcgatttctccgcagacgggctggctggggaagtgaggattgatcgattggggattggggattggggatcaggagggatggggattggggagacgagtggatgaggatgcacaactgcacaagcaagcaggcggacggccagatcataccagctctcaaagatccaacggctcacgcatggcatggaactgttaccctgtagcagaatgcagcgttctcgcgtagggtgttactgtgggcaggaaaactaaagatttaatatgatatgatatgatatgatatgcacgcacagaaaccgtataaaactcttatgtgcatatgggcctaaggcccaaaatggtggttagcgttgggcttcaagcccaaccaaaagccgaggaggactccgagtctccgactaggccttggccatgctgtagtctggacggcggtgcacgttggccaacgtgcccagacgcttcgacaaggtggggcccacaggaacaaatcacgctgtcacgccgatccgggccgtccgatcccgccacgtggacgacggaaaccccctggtctctcgaacatggcggatcaaatcggggacgagacgacgacgcccaaaacaaaaccgctaatctgactggaaacccagatcgccttcttcgctgggggtggggcgacgaaacttgcgcgatctcccctctcctctcctccgctcgaatctgcggtacgcacgcctccctcctcctcctcctcctcctcctcactccttccggccccgatcctatagctcctccgctcgccgcggggatctgcttacgacgaggcccggcacccccgccgccgccggatcgtggtttggcgcttcagacccgtgcgtagcgtgtaggatcaattggcgctccacgttccccgatgttgccgaattttcagagtttgttgggtagattga

SEQ ID NO: 68646 - DNA, 4074 bp, Oryza sativa
aacatgattttttttttcagagatgtagggttggtttttggactagaaagggttctggtgaagtacatatgattcgattggcgatgttctatcactgccttttatgtttttactgcttactagaatagtagctcatggagctagatccttctagtatttccagaaaattggaacaacataatctttctagagttaatcttttgctaattcgaatagcaggatagtgtttgcctatttggcatatctactaactatacatttcaccttgtagttgatatcagctttagctttgtcagcatctgattgattttagattggcaaagtatctggcctttgttgctggtaatttaggaaatatagaagtgacagttaatgccatgaatttgttgttttaatttctaatctaaatcgcaaaactaaaagagaagataagtatgcggccagtgaagaaagggtttaatggtgatgcataccccatttatctagggaacttgagaaaacagatacacgacagattgtccatagaatattcttctgagtatattttattgactcaaatacttacctacagcaggcttcttctacaatctcaaacatggttgttgcaaatggtaatgtcgacacggaggaaggaactcttgagattgggatgggtacggatcttctgcttgattcacaataaccatatatggactgagtctagcttgtaagtagcctagtattgatattgttgaactactcacactttgtaagtttttcttttaaaaatgcagagtacaggacagtctctggagttgctggtcctctagtcattcttgataaagtgaaggtaatcatatcttgtgatggctaattcaaattgttttacatgcaaatataattttgattatttcagatcacattcacattccatataatgtgttggtatttcagggtcctaaataccaagaaattgtcaatatacgattaggagatggcacaactaggcgtggtcaagtgcttgaagtcgatggggagaaagctgttgttcaggtatgtacatatttgtttcacagtggcaatggataattaagatagcatgcattcttttaacatgttgccaattcattcgtgtggttatattgttattaaaaaaagttgattccttcttcatcacttattaatataactgtttttcaaaattctattagtatattatgacaatttgattggaaagcagatggtgtacattgtttatgcaatcttttaagcattttacagataattagctgaattgcctgtattttgtcagaaccatcttagatggcagtgatacaagtatgactaacacaaatattaagtttacaatttttatatttcttatggtagtataagcatcaccgagcagtggtctttacttttgtcttcaggttgcctcaaacttttgagagtaatgtgaacgtcagtctagatgttattgtgcagttgttacctacctgtctctttcactcatgaaacttttgaaatcactggcaggttttcgaaggaacatctggtattgacaacaaatacacaactgtacaattcaccggtgaggtaatattctttttccccgtgaatttgtgctaatatgtagtggcactgtttaaaatagtgacccggatctctggcattcactaaataaagttgtcaatccttggattagaaaccggctggcccccccaccattagccattggcttgttcccacatacagtgttttagtcattgaaattttcgaagtggttcactcttaattttgttcattctactttcctcgtgaacttttttcaggttctaaaaactccagtgtcactggatatgcttggacgtgtcttcaatggttctgggaaacctatagataatggcccaccgattttaccagaggcttacttggatatttctggtaggtgctagctgcttttgattattcataagatttgattatggtgtaaatcaaatgcttagattttgacatcgggtttgctggtgcaggaagttctatcaatcccagtgaacgaacataccctgaagaaatgattcagactgggatatctacaattgatgttatgaattctattgcccgtggtcagaagatccctctgttttccgctgctggtctcccacacaatgaaattgctgctcagatttgccgtcaggctggtctggtaaagcgtttagagaagagtgacaatatcttggaggtatttttgtctaaactacataatattcatcatacctaactggagtaccatttccatgttgcattctgggtactgtagcaagctataggcattacttcttacttagttcttgcagtaagtagccatagataattgacaataagcttgtgatctttgtttctaatttataagaagtgactaaatatatttgatgcatacttagtttgtcctacatggtgaagctaaccgtgttatggataagtagtcataaatatgtaacactagctacaaaaagattgttatcagtcattgcaatttagtgcagttttctattctgttattgctgtatgctgaataacattttgacattcacacttcttccttaatattatctatctaatataacaatttattatagagttccgaggatgaaaattttgcgattgtctttgctgctatgggagtaaacatggagacagcacaatttttcaagcgtgattttgaggaaaatggttcaatggagagagttaccttatttcttaatctggtatatctgcattacctttgttctttcttttccttcactatgctgctctaaggaatttgcaagatctataacttactccttgattttgtattttttgttcataggcaaatgatccaactatcgagcgtattatcaccccaagaattgctctcaccacagcagaatacttggcatatgagtgcgggaagcatgttcttgtcatcctgactgacatgagctcatatgccgatgcacttcgtgaagtaagggcctttatcttgctatatgttatttcctagtgtttacattagaaacatggtgggaattctctgctatcactttgagctaaaatggacgttttgaaagatgataattctgaaaaatgttgtcttgccttacctgtttgaagggggaaaacgagcacaacataggtttatacagagaacctagatggttagatctaaagcaagttatgatctgttgtttgttgtgctctagactattttgtctgtcatcgatgagacgatgatcggtagctaggtatcgtataattacattaacacagatacagagttattctattcactattgcaggtctgcagctatactagttatatgcttctcgttgtaaatttagattcagaaatattggtttgagctaatttgaataactaaataatattgtatcgaataaatgctttaatattgtttttctacatatgcttgctccttttttttttttgaaatctagtccttttaataccacggtttatgctgatttcttaagtattatatcattcaagtcacctctacttaccttttctctgtctttcctcacatcaggtttctgcagctcgagaggaagtacctggacggcgtggttatcctggttatatgtatactgatttggcaactatctatgagcgtgctggtcgcatagaaggaagaaaaggatcaattacgcagatacccattttaaccatgcctaatgatggttagttatttaaatgtgcttacattttatgataaatctttttgcgaaattgcacttttcctttttttaatttgaagtatgtatgttaattgcacagaaaaacatagtgaatcagttttattaatagaataaatgttacatggataactgatattagatgctgccggcaactttctgactcataagtcgtgctgttgtagatattacacatccaactcctgatcttactggttatatcactgagggacagatctacattgacaggcaactacataatcgacaggtattccacatttccacagtttcctgctaaactttgtttgatgacttctaaaccgaaaatttggattcctg

SEQ ID NO: 68647 - DNA, 2124 bp, Oryza sativa
cttttatgtcatatgttgctacaaaacatctaggtgacaacaataagtttgggctatgtaaaagttacagttttatgaaaatttcctattatattattgtagcaaactgaaataggtcgctaatgttgcagtaaactagtagttttgtcaatgtaaatgcggttttctgaaatttactcaaaaagaaagatcttcgtgtatgaactgtggcgctctatttgccccgaataattccaaacagggactctgtaaggactaagatttgccatgtgcatgctcaatgtttaagttgcagtgtagtcttactacatgttccacaatgcttgatgatcatacagactttaaggtggaccccatatgttgatagaaaaaaatatttaatcatttgtttatattataatttagtatatagaagtataaattaagattgtagattctttaatctctactattataaaaattgaagatgtttttgccggtgttttgatacgtcatccgtgtatgagtcggtttttaagttcgtttgtttttgtaaatacatatccgtatttgagtcggtttttaagatcgttcacttttggtaatacaaaaagaatcatataagaaatctgtttaaaaaaaactcacatgctaacttgagacgatcggactcctaactgcagctcatgattttatatatatatatatatatatatatatatatatatatatatatatatatatccaagcgaactcccacagtgaatttcattttaactaaaccatacaacaataataagattaaaatagacttcacccgttgcaacgcacgggcattttttctagtgataaaaaagtcattaaaataaaatgatatttatgtatttttttaatatctgatattataaaaattgaagatgtttccgcgatctgtcatccgtgtttgagtcggttataaaaattgaaggtgttttcgtggttcgttatatgtgtttgagtcagttttaattttatgttttggttttaatctatatctcttctcttctatatctctatctcttctctactattataaaaattgaagttgtttttgtcgtattttggtacgtcatctgtgtataagtcagtttttaagtttgcttgcttttgaaaatagaaaaggaagcttacaataattctgcaagcatacggcatactgctccgcgtggaacaaatgaaggaaacacacacacaacagaacataagcaagaacaagcaaatcatgggcgaatcacacatacttacgatggagtttgcacacacacaagctagcagtaccaggaatcagtgacaaatggatggaaagatggagaagaatgcagacttcttattagctttgttccttcccttcttttgcttcggtacgtcatccatgtatgagtcggttttcaagtttgtttgtttttgaaaatatatatctgtatttgagtagggtttttaagatcgttcacttttggtaatacagaaagaattatataagaaatctgtttaaaaaaaactcgcatgctaacttgagataattggactgcagcttataattttctaaaaatatatatatccaaacaaactcccgcagtgacttcacccgttgcaatgcacgagtatttttttctagtaagataaatggttaaaccttatatgtgaaaccagagaaaatatatggcaccaacctataaatcctaagtcgtcaagtattggttaaaatagaggtcccaagtcgtctaaaggtcagcaaaaatatgggcaaggaggttgtagtttctaatgaagtcgattttgaacatcgttcttaagtcttacttacgaacgagataccttatttatattttgtttcatctttcttatagtattttggtatatgtagcctacgacgaatcgacgattctttgcttaaaaacagctttgccgaaccaaagcagtaaagcacaaactatgttttcgactctgcttcttttattattactttttattttattttttttaaaaaaagaaactccgttccttctaaacccatcgagactttgatattttcctccgctagctttccgcccttcgcccccttcccccgccgcaagaataatcgggaggagaaacccaaacccccct

SEQ ID NO: 68648 - DNA, 15910 bp, Oryza sativa
cacctcccgcgagcagaccacctacttcgccgatgtgcaggggcgggacgtgcccatcgcgctcgacgtcctaagcgatatcctccagtacccgtgcttccccgcgaatgccctccagcgcgagcgcggcgtcatcctccgcgagatggaggaggtgagctgtcgcacccttttgctgctttgtccccttccttgccgtctaatgcaattccttaatttaatagtcgatgtgaaacttgatatccttgtcgcacgagtgtagaacacccttatttgtaggtggcaaatgtttttcttctgcatttttggtattgttctcggctattgcagcaaaggaagtgcatttggtttggatagtgaccgtaactctcaggttgcacgttatgggtatggatgattgtatatttcactatttcagcattgttttacagtgtacatgtagaggctggtgtctttaggcacaatggatttttttttccttaaagaaaatatgtttcctgctctgatagtgtgatggttggtattgtttatattagccttgtggtgttggccaagatgataagtatgcttgaacactgattgtctgaatgtagcggttcctagtttttaaataacttcctgaatgcatactgtggtttagtgcaattagcttatcaaatccatgctcgatcccgtgcaattagcttatcagatctaatatacaatatatatattgtgtttcgtggatgcttgatctgtgcttacatgtgtttatggttagacaggtgcaaggaatgatggacgaggtgatatttgatcacttgcatgccgcagcattccaaggtcatccgctgggtgacacaatattaggtcctgtagagaatattaaatcgatctctaagaaagatttggagcaatacattacaactcactatacctgtcctcgaatggtacttgtcagccagttctgaaatttacaggcattgatttgttatcaccgagcattctagtgctgaatgttttattttgcctggttggtttaggttgtgtctgctgctggagctgtcaatcatgatgaggttgttgatcaagtgagagaattttttacaggattctctactgacccaactactgtagatcaacttgttgaagcaaatccagctatttttactggatctgaggtccattttcagctgtcaagatgttattagtcatttttagcctttttggattgattttatcttttggacttattccctacttttctatatcatccttaggtccgtgtggagcaaccagagatgcctctaacgcactttgcaattgctttcaagggttcatcatgggctaaccctagctcaattcctcttatggtgatccaaagcatattgggaacttggaataggagcattggggttgggaactgctcagggtgagatgatttgcattgattgattatgcttagttgaccaacaattttcttgccttgttgtgttgttgctaatctgctgcataaggctcatatgatctattggaactgcaaggtctgctttagctcgtggtatcagcaacggtaatttagctgagagcatgattgcattcaacactaactaccgagatacaggattgtttggcatctgcactattgctcaggtaaatttggtttatcaatcttttaaattgttcagctagctggaacattaaattagttttagtaaagtatgctacattttccttacttcttgatgccaatcagtaataatactagctatgttcactattaatttcacatacattataaaaaaactgaggtatgcattggatcaaaaattcccttttataatgttttcttacattttgtgaaatatgattgcagccggattccctatatgacctatcacagttaataatgcaagaatttagaagacttgcatttgaagtgtcggaaacagaggttgctcgtgctcgtaatcaggttgcttatccatctcaagttgctaattcagagtttttacccattgagtcatttctactgtgaatttgtggtgttagacaacatttttctagaaggcaaatcagacagtagattctcctacattattagtaggcaaaattttgcctttttaatattcctaggctctttcctttttgttttgtcaataactcatcttcattttcactagacaataccatgatatctgctatgctcatgttgctctgatgtaggacaatagcaagaaagttgatttcaacctgatgatcagtcgttgtaacttcactagacctgtttcactttcccttaaatgacactgatagtttgtggttagttttatatttatatgtatgatatgtctttatgcagtaccagtaatcattaagtacgaactctgcatagtttcatggctgatacatgtttttttataatatatgccaattaacttgcatctagaaatatttgttatactaattgtgaagtggtgaattatttcctacattttagcaccaacctaaaagtcagttctggtgccttggtagcttttctgttttatctttcttggcctgcctgtaagctatgtattgtatctgttaaggagaactgcattcagtgaagtggatggataacagctaacatttatttaatttcagttgaaatctgctcttttacttcacattgacggatccactgctgtttctgaaaataacggccgtcaggtatggtgaatgaaatattttcttaagtgcccatgttgcagttgctactatttttcctaactatgtatattccctcgaccatctggatcagatgctaacgtatgggcgagtaatgccattcttagagctttttgctcgcattgatgctgttgaccgtgatacagtaatggaaacagctaaggatttcataattgacaaggtaaaactcggcatcttcctagtaataatctggagtgcatctttgctattgctgtctcaacaagctatacggaagattcatgcactcacatgacttgtttgacaatcttcaggatatcgccctagctgcagtgggaccgctcacgaatttgccggagcttagttggtttcgctcacatacatactcggatgatgaatttagttcaagaacgttcttgcaggatgcacagaataattgaagctccggtcctggtagtgttgttgtagtaactcaagctcacccaagaaatattcgatcgtaggaagcatcaagcattttagttatttgttagatgttctctatttatttgcaaataactcccttcgttcggattgtaaactccttccgttcaccttttactttcttagcatacaattgcgtcaaaattctaaatataaaaaagaaaagaaacttgacataaccaaaaggccagacaaaagaggtacagctgaacacaacacatttaagtacacctgcagtgttaactaaaaaatgttctgttctctctcgacctaaaataaaccaattttatataaatatgttgagattcatttatagtttattttagaatagagagtagcatttattttgttgattggtttattttagaataaaaggagtagcaatgtggcattcatttttgctgatgtggacgagagagagagagagagagaagagagaagagagaagagattgaaaaaaaaattacgctgttggttgtttaatatctattcttgaaacctaaattgcaacttcgtttttccacatcattagaaaaatatggatcataggaggcaacaaaacatataatacctgccgttagatataaagaaggcagtaaaactataaaggagtggtcaaagttgattcttccacatatcctcttggatatttactgggccatcgttgtctgaaagccctaacccacatattcgttttccaactaaaaacgtattttagcgctaaattaaagtacgatataacaaatattacacacaacaatgccgcacattgtgaaaatacatgtattctagtgacttgagtagcacctgaagatcttgagttcaaacctttataggaagttcaaatcttcaaaggagtgaatttcatattgggttgttccatgagctaagttcctacattgtagagaccgggttaggaatgcataagggtaacttacgcaattgcaatgtaataacttatacttcctccatacttataaaggaagttgtttaggacaatgtttaagtcaaactttgggaatataaatcatgaataactcttaaattgttgagtttgaatatgtaaaaattatatgaatagatttgtcttgaaaaatactttcataaaagtacacatatatcacttctcaataaataattttatagaaacaagaagtcaaagttgtgttttggagaccgtgtcgctgcccaaaacgacttcctttatgagtacggagggagtacaaaactttcacataattataaaaaatgcataagggtacatgtgattagtgaggcatgtgaatgggacgtcgggggttcaattcccatgcgcgcacggtaaattttactcctcccgcacttcctcttgacaaatatttagcaactatataaatttaattggtttttttactttaaaatgtgaatgaaaagtttgcattaaattaccttaagtgatttttttgtcataataatattgtttattacatatcaaaataaatatacttttggaaaagtgccggtattgtggtggtgggatgcatgactccagttactactactaatcaaatcttggtaccatgaccatgaatattacacacatatggatacgagtacactttgaattgaaaccacctctttaagtgtatcttaagggtgtgtgaatatagagcagtgatatgtgctcacacgtgtttttcatgtaataataaagagaatagatttttcattctatctagacttcctgctgattttattttctaccattgactttccgtctttccttagccatgttctttgtttacattgttattttttattataaattttgtctaataattattatataggtaaacatttatatatttaataaagtgatattctatccataaaaaaatgtcaaccgcgtactatgtccagattcgttgtactatgttacctttttttaagaacggagcgagtagtcatagtcgcgtgaaatgcatgatataatgtactagtattgtatattgaatattaagctatttctctctctacaggtttatgggaatggtatctgtctaagggcccctttgaatcgtagaatgaaaaaaacggaggaataggaaaaacataggattctaataggaatgtaaatgtaaaacagatgattgcaaaacataggaatgatcgtttgattggaccacaggaaaaacacaggaatcggatgagagagatatactcaaagaatttttaccaagaggttggacctctcgctaagtttcctttaaaacctatatgcaacaagccattccataggaattttgtaggatttgaaaaactcaaatcctttaaatcaaagggctacatagtaaaatttcctgtagcatttcaatcctatgaaattcctttataattcctttgactgaagggcccttaatatttgtgcatgccctgaaggctgaagctgctgctcactgcaggaagccaggaaggcccccagctgaaggccagaccaatgagaccagtgagccaacatatggtgacagaaaaaaattactccttttccccaagtaaattaaatatacatggggcagaggcgcagagccatgcagcagcagcatcgcccggccgcccggccatgttctgctcgctcgttcagactgacgctcggataagcaaaacaagcaccgatcacccacacccatctcccggccatttctgctcgctctctcagatactacacgcaaaacaagcaccaataacccagtaggaaacagggtttacgttactgtctcgcgtcgtttctacggttaccagcttactacgggtacgataatataaatactacggtaacctccttaaattcaaataaattaaaaaaataatttaaatttttaataaattttatacggtttttcatggttaccgcggttaacacgtggtaaccgtacttaccgtcgggacgcggtaaccccggtcccggcggtttgggaaacctgactaggaaacgctgaagaattaggtttgcttcgttgctgcaattaatggcagaaaagacacgagcgctaccggctttaagcagaaccatccgtacgcgactccggtgaaggaaactgtgaatgcgtgaaatcctttggctcccgtgaaaaccaagcacgggccggtgcgcacgggtgcgcaaatgggctcacgccgcacgcgacgcgctccgtctcctctcccctctcccgcagtctcttccccacgcagccacgcgcgcgcccattaatcgctcacgcacttgcacgttgcaccatcaactcctctgctcccagcttccttgctggatacacgaacaaagtcccgtttgcttctgggtagaacacaacaatggcgctgcgttcttctgctgcatactactacatgaactaatttgcttctcccttacgttccgtttgcatcatctgccttgcacacacgcacgcactacaaaatggcgttgcgcgtgctcttcttgatgctgtcggcgttccccgcgagctgcctcgccgtcgctgctccgatcagtcccgacgccgtgccattgctcgccttcaagtcggcgtgcgccgaccctgccgccgcgctcgtctcctggacggaggcctccgacccctgctccgacaggtggcgtggcatcacttgccggaagccttcgccttcgccgccgccgtcgtcacctcctcgcgtccgtcgcgttgttctcgaaggcctccgcctcggcggggatgctggagccgtcgccgcgctcgctggcctccctatgctctcgttccttagcctcaagaacaactcgtttacgggctctctcggtgacgtcgacttctccaccttggcgccgcacctcaagctcctctatctctccggcaatggcttctccgggcggtttccggagtccgtgctacggcttcgccatctgcgccgtctcgacctctctggcaatcggcttacctgcacgattccgccggagataggacaccggctcccttctctcctgacgctgcatcttgcgcgcaactcgctcgtcgggcccttgccggcctcgctgggagcaatggccaggcttgccaagctcaacgtctccggtaaccacctccagggccggatccccaagcgcctcgccgccgtcttccccgcgtcttcgttcaccggcaaccccgaactttgcggtgcccctctgcgccgccggtgcaatgagcagctccacatggtgtacggcggcggcggcagcggcgctgacacgtcacaccaaccgaagagagggaggaggaggagcaatgaccggtggatggtggcgatgatcatggcggcggtgggcgcagcagtggcatcgctggtcgccgcggcactctgcggcgtactgtggctgaagaacaagaagccggagaggccgcgcgccagctcacgcaccagctcgatggcgcgggaggagacggtgcgcttcgacggctgctgcgtggagttcgacgtgtgcacgctcatgcggggcgccgcggagatgctgggcaagggcgcgacggcgacgacgtaccgcgtggccatgggaggcgacaacgtcatcgtggacgacgccagcgtcgtcgaggagggcaaggctggcgaggtggtggtggtgaagaggatgcggcggagggaaggcgcgacccgggaggacgagcggcggaagcggaagctcgcgcgggagatgggcacgtggcggcacgccaacgtcgtcagccttcgcgccttctacgcgtcggcagacgagctcctcctcgtcttcgactacgtccccaatggcagcctccacagcctcctccatggtccgtaaccctctctctcctgactcctctcatggcttcttctcatcaatgtctacatgatgacgatggcaacggattctttcagagaaccgaggaccggcgcgtgttccactggagtggcagacgaggctgaagctggcgcaggacgcggcgcaggggctcgcgtacctccacggcgtgtccggcggcaagctcgcccaccggcacctcacctcctccaacatcctcgtcgacgccggcggcaacgcgcgcgtctccgacttcgccctgctgcagctgctcgtcccggccccggcggcggacgaggccgcgcagaagcaggacgtgcacgcgttcggggtcgtcctgcttgagatcctgacggggcggtcgccggaggacggcaacgtggacctggcgctgtgggcgcgcacggtggtgcgcgaggagtggacctcggaggtgttcgacgtggagctgctgccgagcaggggcggcgcggaggacgagatggtggcgctcctccatgtggcgctgctgtgcgtcgccgacgaccccggcgagcggccgaggatggcggtggtggccaagatgatcgaggacatcagggacagggggagcaagaggagcaggtactcggcgtcgccgtcgcaggttggccactcctacgagtcatccccttccatctcggaggacaccactaggtccaccaatgcctcaagctcttgaagctgtggtgacagtttccagctttccttcccaaaaaatccaatggatgttgttaacaagaggtgctgccgtttagatgttagttttctgccatcatgattctgtggcatgtgacatgtcaggtacctgtgatcaatggaaattatcaactccttttgttttctgtccaacgaacgtagacagggccaagtttgtattacaattcaaacatgcagggaataagttccctttaggtccatgaatttgttgccaagtttgaaattcatcctgaactataataacagatataacgtgtccctcaatttacaaaaccggtgtactcgagatcccagacggaataatgtccagtttcagttgatgtggtggctgagttagcagggacccacatgtcaggacaattcaatctattttttaaaaaaaattggtggacctcacatgccagtaacacatcatctccttcttctctcggtttctctccctttttcttggcgggagcagggcgtagacgacgaggcagtaggcactgcatgcagtgcgcgaagacacaaggtgtgggcggcagcgaccggcagtggcacgaaggaggaagtcagcgttagtggtggaggtcgtcatcgcccaatgagcccatggccaccgcgtgcgcgtgcacccgcctacccctccaaaacggccctcttggcggcaacgaggtcaaggacctagccgaagtgctctgtaggagaggcctgccccggtgccgagcgagtggcgagtaggcggaggacctcctgcaagttactttccttgcaatgctaccttagggagggcccgatgttggcaggtgggagcttccaatgagggattggatggaaggggaacaccttgttggctctcaaaggcgagcacccagtcgtggtggaacaacaacatccatcatcggagtgcatccgaccaccaccgacgactgaatctgagcagctggagtcggcccttgttgctcgaggagtcgcgacaaaagagcagcagagagggcatcatcattccgagcatgtgtcacaataaggtcatcatagggaccctcaatgctaggatccccctgcccctccactagaaagggatctctctcgtgatgaaccatgtcagctgcagccgtcatccaaaccgctttaagaccttatttataccggttttggaagtttagaaacatgttatatgtggtattgcggttcagggacaattttaggactcgacgacaaacagagagacctaaagtgaacttgttctattcagccttcttctacggtccatttggccgctccgagtggtgcgtcaaagagagacgattttttttcatttttaatttttttaatatttacaaaaatattatatcggtgaaaatatttgcaaaaatataccctgccacccaagtggagggcagcaaggtgatgtggcacgcgacgctgtttgtgcattttgcacggaggtctctcggtgaaatgcaattttcgccgtatgtaaagttaagccctccgtgaccggcgaagaaaagttgtccgttgaatacttgaatgccttcggcgaaatggtcacctacgtctcgctcccactcccagactcgagtagtctggatgaactgccaatccgcgcggcgcgtctgtgcattagcgaagacaggagtggcaaactggaagcgcgtgcgcgcgagcgattcgtccagagtatcagtttcaaccccggcccaaaagtttattagctgcgtcgctcagggccatgcgcggcagggctgtgagggagagagacgtgacgagaagcccggatccgcctggcacgttttgggcccgaaatttcccctgcctcacactcgtatgtcagtcacacactcacaccacacacctgccggggtccggtgtgacacaggcgcacgtccagccaggcttatcctcctcacggtggcaaccaaacagcctcagaatccctgcaacgattgtgatttatgaacttgcgttttcatagctcgaccgccttgtaatttgttggccactcgagctcaagttagatcaccaactatggccagttgcatgcgtaaccgtgtagcgagcagatccagcggagaagaagagagaatatatgtctcaagatgctgatcatgttgcaacaaaaatttcagcttaatttcttatgatcggttcgatttgtaatatgtgagtatttttcagttgttcctatatcgatcacttgttcatccagtagctgcagactgcaagttctgatgaactcgatgcatttatgcatgtatgagaatattctgtcccccagcgtggaataggattcactcgcattgatcattaatttgatccacatctttgacgattagaccttactgagtacctgaagatacgtatgtgatagttgagctaatgatatttgacacatggaactcaatagaaaatacttgaacctgaaaattcctttttggcacgataagactccaggaaaatctagccaaatatttgtgtaggttctacagatgctaaacgaagaaaaatcttcccacgaagtatggttaccatacatgttgttttcatctcgtccataattatctggggccaagcactatttttcccccttcctcgtttttattgagaatcatatcactccacttggttagtgcaatcttttcctgttattatgtgattttctttagtttttttgtgtgccatggcttctcgctttgtgacaccactaggtacagtggactgggcaaagttgtttgtttgttccataaataactttgtggaagcacttgatactctcagtcccactgaccatattgtttatttgtttgtttgttccattaacaaatggacatgctatgtgcacaaaccacttgcattgcgtagtacatggtctctgcagatacaaggatggacaacggggagtcggggaccatgaaatgaaactaggttataatgtatatttagttttagttgaaaaaatagttcctcaagtggtgtctagatacatttttaaaaaatacataaaaaaattcataggatatgttcaatatataatatcccatactcactccgtcctaaaaaaaaaaagtgaatctattactggatgtgacatactccctccgtcccaaaaaaagacaaaccctgggtttccgtgtccaactttgactgtccgtcttgtatgaaatttttttataattcgtattttcattgttgttagatgataaaacatgattaatattttatgcgtgacttgtctttttaatttttttcataattttttcaaataagacggacggtcaaacattgggcacggaatccagggtttgtctttttttggaacggagggagtattatagtacaatgaatctggacatacctccgtccagattcgtagtactaggatatgtcacatccagtactgtgttggttttttatgggacggagggagtaggtcataaagcagttgctgcaatgaattaggtatatagtactccctccattccataatataaggtgcatatgcatttgaagattcaacctttaaacatttgaccaacacttagtataatatgaaataaactttatttgttaaaaattatatcattaaattgagatttaaatttacttttatatggttataattgtattgctaaaaaccttatagtatatgagaaattataagctaaagattagttttgaagaccgtgccaattttgaccatgtcttatattataggatagagggagtaagagaagacattagctttagtcccactcaattaggaaccaatgaagcaatgagggaggggggcgagagagagagagaaattatcattatttatttcttaaagccaagttttatgtatatgaatagcttatcatatagactattatatgatcacttttataatgatgaggcatgccatattgagttatatggataactttttatagatattgtggatgcccttatattttaaaatggacgaaatattttatattggaaggaatcacacaactatattacacaacattcctgatgaaaaaggtttaaaaatggaggacttttacggtatattgtactgcaagtatatactagcagtatatagaagggtatgtttggtatttgttaaacaactggaaatggctatttagtcatgtgaagttcaaattaatttatttcaatcggaagtacttgtcatggatcttgtcgtccgtgcatttggtagcgtttgttctggagacatctcgtgtggcgacggctcgatcgatgtctaaattacttatgtttggtgtacatgatcccgatatgtagaaataatggtgctttccggtcataatgcaaggttaattcagtcatgaaaaataactaacggttgatcacttgactgtgggaatatcatctcatcataattactgagatagccataatttttttgccagatatatccagttggttctcagtatctactatgttgattacttcaaaatttctcattcaataattagttcatgacgggatgatttgccagttctaatcctgcatggagagacggcgagttgggcttgcctcctcctactgcctgcccatcctggctgtgtgccttgcccggttgcccctggtatatgctgccgccgcccggatgccctacactgttgctgctgcttcttaggtgcgcgggaatgacagaagagaaggaaaggacaggaaatcgaatcaatcccggcttgcggtggcccggggcgcagcgtgctcacggtggctggcggcggcggcggtagcccatgtggtgaaggaaggggaatggagcggatttctctcgattcgccatttctttcgaacgacaaatcgactggatttctctcgatcgggatctgaccaagtaacaaaaacgcgaaaaatacaaaaatacccccacacagaaagatgaaaagacaaatataccccttttgaatttatattgcaaagctaaccgggtggaatatcagattaatcttcaccgttagatcgtttatactgctagtatatacttgtagtataatgtaccgtaaaattcctcttgaaaatgatccacccaacaattgccacgctagacaattatgagcctactagaaaaaagttactaaacaatgccacaaatcatagctcaaattctacacgaatatgaaaaaaaaatttgaatttggttgtgctttttctagggcacctgcgaggcaagtatttttaggtgagaaacataaaagtacttaagcaaatgccaaacagttactgtgctagctataattgaccaatttccatcctacaatagtaagtgtatcctaatatttagatgcgattcatcccatcagggatggaaaacaattgattctattaatgctttccttcagtggcaatgactttttcgtagaatagcttgcttcttaaaccgcgctattgtggtctggttgaattttgctccttttactttgtagccaagggaggaactcaaacggaaagagaaagatcacctacaagtaaggctggcctgaccatagttgtactaaaaaaaatgcacttctatacgcagtattgccaatcaaatttagcaaagaaaaacggtttttctatgtacgagcaactgagcagccggaaggaggtttggtggaacagcgacacccggcctcccaccccacgggttccgagagattctttggcggtaggtgatcccaaccaacgtcgtccaggccccaccccgcagatccaccaaaccacacacggccgtcgctgactcaccgatgcaccatcgccaaccgtactcagcgaccccgcgcgtcagtgggcggatcggaccgacgagccgcgctgctgggtgcactgtgcagcgcccacccccgcgacccacgtgttcccgtccccgcccatgcttgaatctggttacgttagctagatccctcgctccgtccgcggtcgcggtcgctagcgccgcgctgttttggcgactagttccgtcgtaccgggcgtttgccgctgccacaccgaggtgaggtggagtccccgacccccggtggaacggacgccgcaaaaaatgcgtcctcgcgggcgcgctgccgatttcccctgcgcgcacaaattttctgcggggaaagcgataaggctcccgccgcaccggcgtcgcccgcgcgtcgtgcccgcagctctccctctccctcgagtcaccccctgataccgctcctccccgcatgttcccacggtcgccgcgagcgacgtgctcgattctgtggcggggccttatataccggcaccggctcgcctcctcgtccatccaaacgccatccgcttcctccgcctcccgttgcaaataactgtgtcagcgcccacgtcatcaccggtcggaggggaaaaacatctcccgtgttctccacctcactccacaataacttggcggctgctcgtcaccggagaaagaaagaaaaacgcctgtttttttttcccctctctcacaatgcgccgatatatattagccaaccaaatcactccgtaaccgagcacccaaaccacacagccgctcttctcggcaggagtggaggccctcaccgggggacttccatttcctgctcctcgtgttctcccacctccaatctcaggatggagcgcgcacgccgcctcgccaaccgcgccctgctgcgccgcctcctcgcggcggcggcgtccaccacgtccccggccccgtcccgcggcatctcgaccctggccaaggcgcccggggcggggtcgcgcccgcgcgccccgcgcccggcgccccaccagtacaccacggggcggcccgtgtcggcgtcggcgctgcagccgagcgacacgttcccgcggaggcacaactcggccacgccggcggagcaggcggcgatggcgtcggagtgcgggttcaacaccctcgacgcgctcatcgacgccaccgtcccggccgccatccgcgcgccgacgatgcacttctccgggaagttcgacgccgggtttaccgagtcccagatgattgaccacatgcagcgcctggcggccatgaacaaggcctacaagtccttcatcgggatggggtactacaacacccacgtccccgcggtgatactgcgcaacctcatggagaaccccgcgtggtacacgcagtacacgccgtaccaggcggagatcgcgcagggccgtctcgagtcgctgctcaactaccagaccatggtcgccgacctcaccggcctgcccatgtccaacgcctcgctgctt

SEQ ID NO: 68649 - DNA, 9878 bp, Oryza sativa
acgcacgcaacgcacgccacccgttcaccaaattgccagatagcgacagagacgataagagatacgatgaatttagtaaacaagcactttttcgtagaggagtcagtagtgataaagatgcctgtggtttatactctgtaggccttgctcgccaacatggcagcgatgtatgctgtctaccatggtcccgaggggctaaaggcaattgccgaccgtgtacacggcctggctggtacctttgcccatggactgaagaagctcggaacagtgactgtgcaggaactgccgttctttgacactgtcaaggtcaaggtcgctgatgcgaatgcgattgcccaggaggcctgcaagaacgagatgaaccttcgtgttgttgatgcaaccacggttcgctttctgttgacattttccgttctattgcaaccgagttagttgatgttgagtgttgagcattaaattcaagctgtgatgttgcagataaccgtggcctttgatgagaccacaaccttagaggatgtcgacaagctgttcaaggtgttcaatggtggcaagccagtaagtaatcattcaatcggcgcaaaatttgtgtgcttgatgtgaaattggatcatgatattaaaacatcgtgtcgttataatcatttttaggtgaacttcactgctgaatccctcgcatcagaggtgtcaagctcaattccgagtagccttgtgcgcaagagcccctacttaacacacccgatctttaacatgtatgtgatgttaaaaggcatgctgcttttcttcactgatttcttgcggtgttaagattaaactgaacttatgttgtgggcttccaggtaccatacagagcacgagcttctccgatacctgcacaagttgcaatccaaggatctttcactgtgccacagtatgatccctcttggttcttgcactatgaaactaaatgctacagtggagatgatgcccgtcacctaccccagctttgcaaacatgcacccatttgcacctactgaacaagccgcaggatatcatgtgagggaattcaccatttatttagtttctaaatgcaaactgttcatcagatgatctgaaatggcttgttttgtcatgaaggaaatgtttgatgacttgggcgatctgctgtgcaagatcactggctttgattctttctctttgcaaccaaatgctggtgcatcaggggagtatgccggattgatggttatccgtgcttaccacagggtaagtcatcataaataagctggcatagctctcctgttttgtttcacattttatatttacaaaccatgttataaaaactgcaggcaagaggagactaccaccgggacgtctgtatcattcctgtgtcagcccatggtacaaatcctgcaagtgctgctatgtgtggaatgaagatcgttgctgttggaactgattccaaaggtaacattaacatcgaggagttgaggaaagctgctgaagcaaacaaggacaacttggctgctcttatggtactgttccttttgctctgtaaatgttatcatttatcaggtcttcaggtagtaatgtggaatgcctatggtctttctggtcaactattcactgttaaatttagagctagttttctaatactatactatcactgcatcaccttttcgctatatttagtgtgttgcttaaagtcataaggctatttctgtactttttgttgcttctaatatatattaagatagaaaccagatagctgctccataacatggtccctaaagtggctgtgtacattcaataatttgaagttaattgacatatataatagaaacaaatccccggttagtttagtttatctatttccatataggctagagcccgcaggtgatttgtgaataagatttttattatgggcatagaaacataatagttcactcaggatgatttgatttataaaacaagtttttgaaatatgttggccttgtgcgtagagtaacagaatgttgcgtggttgctctgttcgtcaggttacctatccttcgacccatggagtctatgaagaaggcattgatgagatatgcaggataattcatgagaacggtgggcaggtatacatggatggggctaacatgaatgctcaggttagttctttgcagtttatcatgtcatcagactagcacgctctttctgaaattgctctcttcaagtctttttacaattttgatggattggaacgcattgtggtgaggctatataaattgtatagatggctttttgacatggtgttgattaaaaaaaaccaattagttgtgcctatgaattatactaaacatgtttagtaacaagtctattttaattcagttccaaacacaagtataccttgttttgaaacaaacacataagtaccaactttcattttcatgtttatctttcaatgatggtgattgaatgacccttatccaattaattatgctgagctatgttatcttcaataaaatatgataagctttctccaagttcatctgatcccaattgagaacttctgttatagtaatttcaaacaaccccatctgtcgagccaaaaatattcaatacactccctaactaacagaagttgtctttttacaggtcggattgacaagccctggctttattggagcagatgtttgccaccttaaccttcacaagacattctgcattccacatggtgggggtggtcctggaatgggtcctattggtgttaagaagcacttagcaccatttttaccatctcatccagtggtaggtgctctgaattcaatctgctgataatctaaacagactaatgatcaatgcccaactcttaccttgaaatattagacaagattgatatagcacataatgccaggcgaccttagaaaatttccatctttactttcttacagaattaggcaaattatacgtaatcatgttacactcaacaacgagtcttttatatttttcagaggattccacacaaacatacatttccctatgtcatcaacaatgctgtgttgatctttaaaaactagtttctttgtaatcctaactcctgcaactcgagaactattgctggttttattttcttgctttcttggtgccacattagcttagatgggtatgctaagtgccaccttattttcatttcatattaacctaaactcctgaagcaagagttgcctgcatcatttttcatatcaaaagcatagtagggtgatattatgtaaaaactgctgtagaagtttttgttgatgataaaactacaaaaccacatttggtactaaaaccagaagagttcgttcataattccatcattctttttaaccaaaaaagcagatgctgcttcattaaccagactaattctgtaattatcagatcaccactggtggcttccctctccctgagaaaaccgaccctcttggtaccatttctgctgccccatggggatcagcgttgattctgccaatttcctacacatacatagccatgatgggttctaagggtctcactgatgcttcaaagattgcaatcttgaatgcaaactacatggcaaagcgtctggaggtatatttgttactcgtgatcacttacccattgctacctagtttgattgtgtttgaactagttttctaagttttaccatgttacttgtacagaaacactacccagttcttttccgtggagtcaatggaactgttgcccatgaattcatcattgatttaagaggatttaaggtatccaacataggtattttggcatttggacattgagttatgcatttccattttgttaattggatattggaactttttgcagacgactgctggtatagagccagaggatgttgcaaagcgtttgatggactatggattccatgcacctactatgtcatggcctgttccaggcacacttatgattgaacccactgaaagtgaaagcaaggtaaaacactaaaacacctactatattccttgccattgtaccaaccattcttttatatgaacttaatgtcacattatttatttcgcaggccgaactagacaggttctgtgatgctctaatctcaatcagggaagaaattgcagaaatcgaaagtggcaaagcagatgtgaacaacaatgtcctcaaggtaaaataccagtatattgctatctgttttcttatattagattgcaagttcgtaacacctatctatctatatacgggcaattgtattcttacccccaattcttataggttatataagatgttagtagaccctgttcaatcctagtcctcatgctgtttgcaattttggagatgcatacattagcatggtctaaactcaacttcaggtggctgcatagctcttgcatcaccaggatgttgacatgtgattcttgttttgtttcgttgttttgcagagtgctcctcacccgccccaacttctgatgagcgactcatggactaagccgtactccagggagtacgctgcgttccctgcagcgtggcttcggggcgccaagttctggccaacaacatgtacttgcttgcttctgtgtctccaaaagattgctctttgctcaacacaatttgacaccaacctaatctctattctgccgtgtctgtgctcttaccaggtcgcgtggacaatgtgtatggggatcgcaacctcatctgcactctgcaacagggatcccaagtcgcagaagaagctgcagctgctaccgcatgatcttccaataatcacccagatttgtaaaacagcaccaagaagtcataatgcttcctgtaggagggaagcatgctctcttctcgttcagcttctgaacttgtatatagctttgtgagttgtgacagctcctgattctctcctcagctgccaccttctcctgtaattctgtacttcattgcttccccattcccgttcaaaggtgaaattagctttattgactagcattgctacactgctgaatacaagaaaaaaagttatgatccatcttgcgcatgcgctctatccatatagggaaataaaaagaaaaataggaaagaaaatggtggctattactctattagcttttgtatccatccataagaatatttatgaatatttagggatgagtgatgacatttcctattgaacggagaatgagtggcaccagttgaggcagttctgtcatatgggcctacttatgcttcatctttacagaagaagcagaagtgttaaagtactaaacagcaggattgtattactcatcaagatgctactgaatagtcgtgttacagagatagtactgaatagttgtgttacagagatagcactagacgtctcctatcgcctcctacaatctgatttatgcacaactactcgtttgtacttgattccatctgtttcacagtataaatacaagtctaccaaaccagaaattaagaatacaagaatgactctcatttgatgatttctttaagatgttcatatgttttgagacttaaacttggtcatacttgaaaatcgatcagctctacgcattagtactgtttgatccttatttgaaaatattttcatggcagtttttttagacatactaactttgtactccttccaactaagaaaaaagtagttcttccgacatcaaatatatttgactagagggaatagttagtaccaacatattgagaaaacaacaacaacaacaaaaacaaacaaaccctccaaatttgaagtaggaatttctaacggcaatgtgatttatacaaacgctcaaatatttgaaaggaaagaaatatgattctccaaaacgaagtccggataggatgggatacattgggccattttggtttgctactttaccaaattattgatagcgataaatcttggacaaattttggtgctatcaaattttgataggataatgttgtcttatctcaattgatttggcaaatgttggctttaatccaaacaattagaagctattaaggcaagttttggtataaatccaaactggcttcatgtttatctccgggcctgttcactttgatgtcattttcaaccataccatttttcgataaagttgccaaaaaaatatctacgtttagtttgtagctaaatttggtcaatacataagaaattctgccaaaattttgataatattgctatgttgccaaaattttggcattgtcaaaacttggcaagatttattttggcagggccctccattttctcttagttttggccatttgccattgactctgtccttttctagtcttcttaatgcattgatcccctgtcctcttgccaaaaagatggcagtactcccagagtatatttccaaaaagatggcagtactcccagagtatatttattaagagtagatataatagcagactacaaaccagctataaacatattttaatgatataaaataggagagagaagagcaacatgatgtagatttgtagctagctatagcacagactccaagatacatgtgtatgacatgtgggaccagatactaattatgtagtacatgtgtataggtaactattgtataaattagctataaaattgactataaatgatttggagccggtagttggctatactattaaacttgttttaaggctgtgtttagttcacaccaaaattaaaagtttgtaagtagaaaagttttgatgtgatgaaaaagttgaaagtttgaagaaaaactttggaactaaacacggtgtaggcaggtcatgcgtagaccaaccaaccaaattaaaaccggtgagccaatcattttgcagcgaggccggcgtgttgccacggtggatctgtgaatgattgattggatgacgccaagcggcaaatcgtatcgaacccactcacgcatctgcccgaacttgatccatccacagcaatttcacggacaccccagacccgccaatccggaaattccccacttcgacggcattaccgcgcccgccgcgagctgcaacgacgtacgccgaggaggcaggcccccgccactcgatggttcgccgccggcggcacggccgatggactcctcccgctcctccaactctctcgtaagtcgtagtagcgcgccccccgcggcttgccgccgctgcatttcatctgggtcttctgttttcccctcttgtgggtctcgtgctcgttctgacttctgatctgtttacgtcgtcgtctgcggaattgcgggatttggtaggattcggggagctctctgacgctgggggagctcgcgtgcgcggcgctgattccggtgctcgccctggtggacgcggtcgtgttcgcggcggcgcaatgcttccagaagcgcccgccggggctgctgcccgctacactcgccgcccgcgcgcgccgccgcgccggtggccgcctcaccttccgtgagctcgccgacctcgccgacgagtcccgctgctgtaagtacagagccgcccacccctgttcagcttctgcgtttcgtccgtggccttaaatggtaatatggtatcatcgggttgtgatcgccggcagtctcggtgaacgaggtggaggcactgtacgagctctacaagaagatcagctgctccatcgtcgatgacggcctgatccataaggttaatgataaactattcttcttcttcttttacagcacatttggtgagacgtgtactcctttgattctttttagcccattggttcagtttggtcgatccatactgcagaattggaactatggttacgatgctagtagatttcggtttactaaactctgtaactcttctacttgcaaaaaggaaaaggacactggaattcttcattttagttattcaacaaggaaaaaaaataaactaacaagtcttttgaaccaattaggacggggtaaccaggttgcaatccagtagtttagtatggtgccctcatgcatgttgaaaaggacttgctagttagtaatttacggagagcagaaaaggaaaaaatgaccgaaatgtcaaatgtttacatggagagtagacatgtaaacatcagagatagaaagatatgctgcgactagccccaatagaatttctataattgtacgcttgtaactggatgatatcttccaggtgaagattttacagtggaaaatgttatagtgttacctttttttggtcactaactgtgaatgtttgtacttgttttttcaggaagagctgcaattagccttgtttagaacaccggctggaaagaatctttttctagatagagtaagtgaaaaaggcttattctcgaactcctctccgctcaaataccgccgttacctatttgggcatttggccactgaagcattttaagagttgttttgttttgagtttcctaggatgaccaactaattgacagactctcatagtttcatcattttacttgctttgaacacatactttgagctctacgtatgatgcaaagaattaaatagggaatgatgttccttgcaaagtaaagatcttaattcaaacccgttgttcttgttacctactgtattatttgttaggcaatgctttgtggtaatgtcaagacacaagctctgattacatattatgattaaaacaaattcaatttttgattttttttttgctaccatttgagttagcttttcttctccatttaggtttttgatctgtttgatgaaaagaaaaattctgttattgaatttgaagagtttattcacgcaataagtgtatttcatcctaatactcctcttgaagacaaaattgattgtaagtgtgcttcatctcggtgatcatcaagaatttctttatatgttgaattatatatcaaccattaattcttttgggggttttgtgcttctttcagtttcattcagattatatgatttgaggcaaaccggtttcattgaacgtgaagaggtatgctctattgttttgcaaatacatcagtttgacttttgaacagatatgttaagccattgattaatcttgtatgaagtttattgtgtgagaacttttggtactcaagactttgccatatcagtgtcagtctttctatcccccagcttcgaggcagcatcatttgatcatttctgttcgcatgtttgccaattgctaaataattggaatccttcgagtttcttattgaaccttttcacgaattactgaaactggtgacagcttttgtcatcttcaggaaccacgctatcatcttgtaattcttgtagtttccttgtgaaacttgatgagtaaactatataaagtcacgacatgaaataaatcataataagtcttgactcttaaatgtaaggaattctgaaatgtagacaagccagctctgcagcatatgcttccagtgtgaagttaaaactaaccacaaagctccttttttttttctcgttcaggtaaaacaaatggttgttgctaccttattggagtcagaggtgcagctgtctgatgatcttgtggaagccatactagacaaggtattaacattttcttctccttgagcccttttttgtttattcacctagcactaggaatctctaattgagttattctgcagacatttgaggatgctgacactgacaaggataacaggattagcaaagaggagtggaaagcttttgtactgaagcacccgtctgttataaagaagatgaccctgcccaccctgaagtaaggatactgtttttgattcctgctttttcatcaatttatcttattttcatgcaatatggtttgccttgcactattctaaaatagccaacgatgcatcgccatggtataaagaagcattctgatttagttttgcctggcagggacactacagcggcgttccccagcttcattttcaatacacaagttgaagactaggggtgaataaggtgacacacgttggttgttcagcaatactacctc

SEQ ID NO: 68650 - DNA, 3785 bp, Oryza sativa
tttgttagatggacgtgttgctatttatttcaacttgtagcccgaattggctaattcatcgaaggtcacgattttttttctctctaaacaattccagcaagaccactcccatttttaaaggaatagaaccaattccatcatgatcatcagttcatcacaatgcacttgaaatcaaggaaaggttcatcaccgttctaaccatctgaaaattctagacacaatttaaagaacaacagaacaccgaccaaccgtcaacataattgtagatctaaattaaaaaaaattatgaagctaaaattactcaacttctagaaatcttggaactggagttgtgctaaagagagcagcctaaccagctccagcctcaagttgtcggcatggccgtccatctccaccgccgcgcgagcgaacggacggctggatctcccgccacggcaagaaacaagcggctccgcctatcactggcacatggagccctccttgccaagctggatggaaaacggtggaaccactcttccagcagcaacgcagttgcagcaagcaacagcaagaaacgggcaagtccgcaatccggcgtgtgcgcttaccatttgcgccgcccatcgcgtccagctagcgcctggcgcggctgcagatgcagctgctgagctgcaggtgcatgcacctttcccacccccacctccctctctccccttcgtcttcctctatagcccgcgccgcgcctccctgtccccgagtccgaagcccgaatccgaagcgaagtgaccgcaagagctcacccccgagtccccccctcgccggatcgcgcgggccgcctacctcctcccgtcgcaccagctaccgcggtgagttgctcccctctcgatctctgctctgttaggttcggttggttcgtggccgtgctggctgcggcagtgttggggaaggacggggggttttgggggctagtttacgattcgattttccctctgctgtgtttgtgtttttcttttccccagcgaggatgaaactattacatatgactatgtggttatgtggtatcgaagcagatcgaataattgatccggaatgtataggagtagtacttttgttcgaatcgacataggcgtttactagtttgtgcggttgggtacaaacaaattttgtaagaggaagcttaatagtgtacccaactactagcttcaattcatctatagccaatcaaatacatcattcatacaatagttacatactacactattaatacttggtcccacctgtcatacacacacttcgtcttggagtccgtgctacactgccattctttctccttatttttcttcttaaaatatgtttgcagctagcttatagcctgctattgtacataatctaatggctaataaggttctcgccgcggcggtaactctgccccttgcgtgagctgagctcagaagatgatgtcaccaagtgcactaatgactcatgtattcttgatgatctttgttgaagtagtttactatttggggtagtataaagtctaaaactgccatttggtgctaatcagggccgttgtagctgtttcttttttcattttgatgccttgatgctctccttgagaattaagatactacaataattgtactagccaaaaagggattaggagtttgaaagatgatgaactggggaaggactaaagtttgtaatgaatggccgcataggtaatgatttgatctgtggagaatttgtaaaggaagttaacaaagtttgttctattcaagaaattgttttgctctcatctctttttccatattcaacatcttttattagattttattgtgacatgacattttgtttgtgtatttgtcataacagaggtaccaaactggatatatgattgagtcttcatctattactttttgtcctgaagtatgggggcctaaatttttgtcattaatttcagggaatgcgaagatcttgcgatggaagctagtcaaatctgatttcgtttaagtacaagtaacaacaatggcaccaaacaaaatttcctcaatggatgctggagcagcttttgatgacgaagatgctagttccagcaattcactgcaggagttgtggccagttggcgagatagatcctaagagagcaagatttccttgttgcattgtttggactcctcttcctattgtctcgtggcttgctccttacatagggcatgctggaatctgtcgagaggatgggactgtcttggattttgctggttcaaatctggtgagcatggataattttgcatatggttctattgcgagatatctccagcttgacagaaagaaggtatgcatgattcgaatatttttcatttcttcatttggaatggtgtacataattcaacctacttgatagtagtttattcatccaaaatggcaaccctcatagctataggatccatgaaaacccttgttgacttaaaaaaaacacactactagtatgttattttgacatttacttcctgtgtcaatagcttcaaaatgatttgtgctgctgttgcaagaaaacaatctgaacttcctctctacttaagttgcttgaaacaaaattttcatgatcttactgttctttaaagagaacattttccaagctaattcctaaatatagaaatctttaaacagtgggctatttaagtaatgataaaacatattttaaaatttccatgcttgagaaaaaagtgaaagaaatataaaaattatgagttggggacactgaacctggggcttcagccagtgccaggtatcacggactgatcatgacagtacatggctagaacaagggcaattgggcaaaggctgaatattactagcgtttgctcatgaaaatctgttgatcaattccaatatttatttaatgatagcagtgttagtgtgttatttacaaataacttgtcaaaaacgtcaaatatgtgctgaagttgcataagatgtttttgtatcatcttaatccatagataaacttcttgtcaattgtcatttcattaaaaaaaatagtagtgtcatttcaaataggttagttttcttgacactctgtatgttctttttttctcttgactagtgttgctttcctgttaatctcgcgacacatgtatgtgagcggtcctacaagcatgcagaagcaggaacggcgatttcctgggacgacgctctgcaactgggcatgagaagtttcgggcacaagttctataatctgtttacctgcaattgctactcatttgtggcaaactgcttgaatcggcttgcctacaatggctccgtgaagtggaatgtgttgaatgtggctgctcttgtttggttgcgtggccaatgggtggataaaatgtctgttgttcgttcaatctttccttttctaactgtgacatgcgttggcattttaatggctggctggcctttcctaatagggatggcagccttctcttctctcttgattggatggtttgtatttgctgtatgctgcatgaaggatctagtgtgctgactcttttaaagaacattggcactgaatcctgtgatgaaattatggagacgagaccacaagaagacttcagctgcagaaatgagtatcactttctccacatggatgtattcactggcgactgagatcacctttcttgaagaggaagacactctggttaccatacgacatacgcaagtggctcacaatgttatgagtgtaccaatgtttttggtgatcgtagatctagttggttgcatcttgccattggtgcactctccctgttcttattagggtttttttttttt

SEQ ID NO: 68651 - DNA, 5932 bp, Oryza sativa
caacaggtgtctaacaatctaagaagatgtttagtgagaataattaaagcttcaatatcaaatactagaaaattggattttctatatagttttttcaatataataatttttttcgtaatatttactagtgatatttagtaatataatggaggcaaagctaatactcgtgtggaatcatgcgggataaccaattttacatcctcaaattaatcatgcaaaaacgtcacaaactgtaatcatgcatgcatgcatgcaagagatttttctcgatgatgataccatccggtcgaccaggcgggggagcaaaaatcgggcgctccccccacccctgcccccccgtgcaccactgggcctcacaacagtgcctgcccccacctacaacaaatcaaccatatattttggaacccttggtttattttttgttccactaaaaatgtttcaactagtgtactcacaatattttattatgtatagatataatgttgcagtgaactgaaatattccattgcaacaaaaaacccacatattttggaaaccctctattaagggaattcgttttattttttttccaccgaaaaatgtttcacctagtgtacttataatgtttcactatgtatggatcaaatgttgtagtgaactgaagcattctttcgctatttgctgaaacattgtttttatataaggtgaaacaacacccgatttaaacgagtgaaacattttcgatctacatagtgaagcaattccgatatacttggtggaacatcgtgcaacatttaaaaataattcaataataagataattttttttttcatcggaatatatgcatgtgtggtcttgttttgaagatttaattgcaacgaatttaatggtacaatcggatcatgatttagataagtaatttaagagaaaaatcagtttaaagtagttttgcacgtaaatcggacactgacgtcatactgacgtcagcgcccgatttttctccaaatcgatcgggcacccgagccgtagactcgtccgctttttctatatcgatttgttacggttggcttcggaaagttgtgctccctctgcccaggtgccgaaatacgcggtgctaattacatgcacatgcatgtgcagccgagcgagcgacagctatatatatcggaccgcgctcgcgacgagcgaacactcgcgagtcgcaacaactatatatatatatatatatatatgtatatatatatatatatatgtatatatatatatatatatatgtatatatatatgtatgtatgtatgtatgtatgtatatgtgtgtgtggctaatgggcgattcatcgctccccatccccctatacactctcttctcccttcctagctcctccccttcttctcttcctactacaccataaattttaaaaaaaataaaaaaacaaagttaaaaaaaattatgtattgaaatactatatataaaaaatatttgaatttaaatttaaatttgaaactggtatgtaaacttttgacttataaactttgggtctataaactaatatttgaattcaaattcaaatttgaatcgggtatgtaaacttttgacttataaactttgggtctatgaactttaggtgtataaactttatatgcatagaaatactatatataaaaaaatatttgaattcaaattcaaatttgaatcgggtatataaacttttggcttataaactttaggtctataaactttaggtgtataaactttagatgtataaaatactacatatataaaatatttgaattcaaatttaaatttgaatcggatatataaacttttgatttataaactttgggtgtataaatttactaaaatagaaaagtaatacggtgccaagaaagaaaatcgcgtggaggagaggagaggggggcgatcgctaggggcaatcgatcgccccttagcaatctttcgtcacgccggcggctgccaaaaggcgtcagcgacgtgcaacccccagcgccgcaagatctttgtcgttaacctgctttatgaattcaccaattacattttcgtattcgtactacctccatcccaaaataagtgcagccatgagtttccgcgctcaactttaatcgtccgtcttatttgaaatttttttataattaacatttttgttgttataagatgataaaacatgaacaatactttactcgtgacttatgtaaattaaaataagacgaatgatcaaagttggacgcgaaaaatcatggctgcacttattttgagacgaagggagtatcacgtattctacgacttcccatccgagttttccgtccagatcacggccacccgcggcctcgacgacgcggcgccggcggctccgacgatcatctcccctgccatcgacgtcacacttcacgtcaacaaccggcggggcacggcgagatgctaccgcggcggtggtgagctacgagggcttcaccgtcgcgtccggcaccgtgccgggcttctgcgtgccggggaagagggcacgggaggtgccgttcctggcgtcggccgacggcgtgggtctacctcagcggcttcgcgaccgcatggcggtggagaggcgtatcggcgccatgcagctggaggtcgaggtgaagctgttcgggcgcgacgacggcggcacggcgcccaggccgacgtggatgtcgtgcgggctgaggatggatgaagcgcagctgccgaacacggcacattgcacggtgttggctttgcagaattggttctctcaacccttgttcggataacagaagattaggatcaatcttttacagtggtcaaagggaaattaaactcaaaaatctctgccgatctataaagggatcgccaaagggatttcctctggttcatgagaatggtaccgcatgcaggtgttccaattggttagcgtatttcttgtatcagacagtaattgcattaataattacttcagcttggtcgatcggaataattagtaaggcagcttcaacaaagatttggttgtgcacgctatttttctgttatgtgttaattaaaccataatttatacgaaagacaaatgtgtaacaccgatcgtgccgaatatcttcaacactcgtacaaaaataaacaagaaaaaaatgtagcatgcatgacatgtgcagtggtgtatcttagaatttttatatgaataatccaacttttacatgtgcctgtgtgttagatatcctgaatatttttctcggtctcttcgtagccgtatccacgtggccgtatctcagccatcattaaatgattggatggctacggaagggttgtttgttgaagaccaaactgtacatgcgcattggatagattttacccaaagaaaaataagtactctcttcgtatgaattttgagcaagcacctggtcaaactaatgccaggagtacggagtaccgttgtcttaaatattgtgattgattacgtgaaaatcaattttagttacaacagaaataaatgacaataaggtacaaatgcacgagaacaactgacaatttttttcgaggaccgagaacttattattaaggggccccatcgtttggccataggctgataatatgccatatgacatattagataaaaaatatgagtaaaacttttatatgtgtccttagcgagttaaaagtcaatgttaaaaaaataaatttcgatgaaaaaattttacaatcaacttcaaatttaagttttaaaattcaaattttgacattggctgattctatataggggcaaacgaggtggggtgcaagccagggcggatctacccatatgccataggcagggtgggtcgactaacccagctacgacacgtgtcgtcttacccccctcccccaaagaccccctaccccccttatagtaagtcttgggtcatcaaaattaggtatacaaggtgtgaacgtccaacatattagtttatctcttcacaacgcatgcatgccacaaacaatgatcgaggcaattatgcgattgaactataaatacggatatgtgttgtgtttaattgctcttatcgagtgaacatctccattctacgtcccatatatatttggaagctacatccgcctagcaaagattgtacatagtgacaataatgatggcactatagttttgaccagccgagcataatatatggcaacaataggagaaaataaaaaaaacacgtagaaaagtgaatccaccactaataacttaatagaaatcaacttagtagttgcatatccttcagtccacttctgacttctgagaactaagataaaaaaaaagtattgctgcttgcactcccaggtcgctcaccctgcaatctagcaactctgccagccttccgttcaaaatagagggataacaatggatataaaagcatctaacgttctaataccccagtagaacaaacgacacttgaatgccctatgcttcttcatcactatattcatcgtcatcatcctcttcatcatccacccaagaagcaccataatcctcgtcttgaacagcctctccagtgaaccaagaaacaacatgtggtataatcttgtccctgagagtagatctggcaacatgggcaagctaatttataacgagataatatatacaggaagtatgttgtttcataaataatttgaagaattgtgtctttcagtataacgtatcatgcataataacacaatagtaatcacttctcctttagaaaaaaaacaattctaatcggttaagaatgcaatggagcataatagcttacgcaatgtcataatctcgttccatttggttctgcaattcttcagcctgttaagcagcagcagcgaaaaaggccataagtttgggcataatgtttcaggaatcaatgtatgtagaataattacttgttcaacttacggtattttcgtcaatttttgcatcatcctctggaacttgaggggggctgaagaagttaaagaagctctcatattcttcagtctttgttataggtttagtgctctctgaactctcttttgttagcacctcctgtgtcaaacaatttcctggatgccattcgatttcagtcctaagaaaaaaagcggtcagggaatatttcaaataggaaatgcacgagagattttttttcatcataataaaaacacaaatttgcagaaataaaatgatatatacccaattgctttctctaggatgggttcatcatcttcatcaatcatgtggtatgttttagtcagcacttgatttttaaagaagggatttgtatcgaaaaagaattcgaacttaaaaccctttggatcatcaattctgcaccatttgatgtccttaaggtacttcagagcttcctcatcgctctcatggatctggcaatggaaaaggaaaaaaatattcattacaagaatcattggcacttcattatctaaaaaaaatggcactaagcaaatcagcacactgaacaaataaataagctcaagttctaatgagagcatgagaacataaacattgataaattagaaagtgggaatttacaaactagaaaagcctctcacctcctcagcaagaatctcattgttcttcattgctttgagccagaaatctggaacacccttttcctctgcatggaaccatcgtgagattatagaaaaaaactaaaagggtacccaatctatcaataaccccagacgtgcccagaacacctatagtatgaataagaatgatatatcacctctttcttcagtctcgccctctacttcaagaacaccactcacaatttcagaacgctggaaatttgtaagcacaaaaaaggtcaccagaacaacacatcatatttaaaactcagaaacataattcaagatatgtttcttaaagaagagctgcctatacacaaaacagacaactctttttgaaaagaaagataagtggggtaaggctagattgcgttacagggctgcaggaat

SEQ ID NO: 68652 - DNA, 3360 bp, Oryza sativa
aatggacatcgctagcatacgagcataatttgtactttcttagataatagaagcaactaaggataattaaggataaagcatctaatccaaccgttttatacctgtgaacttaacagtactaaaatatgcataagcaagcttctgcaacagagggaattaaccacccaaaaactctagtcaatctcacgtttcattgaggatattgtcattatgtacgtcacaatgggtttgcataataaacagtacgatgaacgaaaatatgccgcgaacatcaccacctcgaagctctctctagtcttagcagttctgtttttacctgaatctctatgagcacatcgacgcgcttcctgaccacgggcgccaggctttcgagcacgtcaacatgttgctccgccaacgcctgcagcttgttctgcacagatgacacacgcacatcaccgaatcaacaaaaaccaccattgcacgatcgctccgattgaaacccaacaaagcacaccgaaaaaaaagcgatcatcacaacgagagaggaagaggttataccttcagcgtctccacgaggatggccttttcctctgacaagagctctgcatcagaaacccgccgccgcaaacagttagccgtaaacccaatcacggaatcacccgaaaaaaaaaacagcaacaacgcaacaaaatgcgaagcaggggagaggtatgctcaccgggattgctcatggcttctgcgatgggagatggcggtgatgaactgatgatgctctccggcgtgaggcggcgagttttcgagcgaggcttcggattaggcgagcgaggcgtgggcggcgtaagccgcggaaggtggtgataaagggtgggggaagtgacagagcggacggcccagatctcgcgggagctgggagacgtggccgaacgggatgcgggttcgcgctcgccgcgctcgtgtggagtttggacttgccgccgcgagttcgattagggccgttcgggcctttttctctggtggattgtgtgccttgtgtgcctaataagcccgcggattttgtgcccgccgcgccacgagactactcgtagcggatgagatcagttaccgtggtattcggccgaggtttcccatgcgtaccggactaccaggccttgcttctcccgtagcttacgtgtaaacgacgaccccctgtgccaaaccaatccccggttgggatgaatgtattacagtagatttgtttttctgggatgcatgccttcttgtctgtcatacgtctcgtgcaatcgtatcgtatcagaaatcctgttctaaccgatatgttcggcactttgcatggattttgctatatctcctgtcaagatctcaatagcttccaccttccctagctcttgatcgaccatcaaactgaatttcggacgaagaaaatcagccagccatggacagcgaggaggaccctttgttgaggttaatgaacaaagtcagcttcctgttctggacgacactgttaccagtttttctgctagggatcttcgtcggcgcccttctttccaaagaatgcgagaaggccaagtacaccatggatctcgccgccgtcgaggggatggacgtcgccgccgtcagcacggttgtctcccccgcgttcaacctcaagctgcgcgccgagaacccgcgcgccttccggccatggtgtctcgaccgcggggacgtggtggtgtcctactccggcgtggcactcgcgtgggggcgcgtcccgggcttctgcgtgaggaggagggcgatggccgagctcacggtggtgccctggggcaaggacgtccggttgtcggaggatctacgcgaccttcttgtctcagagttgcagcagggcacagcgaaggtttccgtcgagatgaagctgcactactacgctaatttcggcatggctgccttcgcgcccagctctgggacgacgtcgatttcacaggagcttctcctggactcctgggaggacaacatgaatagcagtttgctcaagacgaaggctggtctcccgggaagacaagatgaataatatagtttattcaagatgaatcctgacgagttattctttttctttgttgcgttttcttttgtgaactcagcataattttgcttcttctaattaatataataacatttcgtattataagtaattttattttttagtcaaattttattgatcaaatgtataaaaaatatagcaatatttttgactaaaaacaaatgcataaaaaatttattgcaccgccctctgtttgtgttgtgttgagtcagcaagcccgctcctgttctcatccaccacaagggcaatgcagcacccctcctcacatatgccaccaccactaagctcgtcggcaacctccactttcgtagctgccctccttcctagctcggcggtagccaccacctcccatggcctacccgcccttccacccaagctcgtcgagcggatttgagctgttcgacctttgtctcccataagctcctaggttcgtcgcccggattctagctcgccaatgctagaaaatttcacctcttgcgcagccttcctcccaagcttgtaagttggatctgagctaaccgatgaccttcattttcctctaggcccacctcatgagtcatgccggacaaatgcgatgaatggacagaggatgtgattcccatcgcgtgtcatgggaagggaaggacctctccagtctccacaattgcttcaagttattccccatcgtgcccctattaattaaacaattggattttatttggtacatgacaacagtggtacttggtgatacctcctcaagaattgtaaaaattctcggttttctatacaatttatgtgcacgctctctctgtccctctcttttggctggtggttgccaatgaaaataatcgtgtgttcaacgctgagggaaggggggacgacgagtctcatcagcagaggatcccgttagagaggagtggaggaatctgttgctgatggagggataggcagccaagctgagtggagaaattatgagaaattaccaatatggcgaaactaggtataatagaaatctcttttttttaataatggaatataataaaattttctttataaaacaatattaaaatgtcaaattgttgttagcggtcaggtgatggtattttctcgatgccaaagcgtataatttcataaggaacgaggaataactgtggtgcattcatcgataactgttcaattcatcaaaaattgatctcaatagaatataatgatcataatgatgattttccacgtataaggtaacataaacggcatccattttggtcagtggacaatggcacaataatttaatttacataataaatataataaactaaaaaaat

SEQ ID NO: 68653 - DNA, 9200 bp, Oryza sativa
acatacgtcgacgacaccgtaagaatcatcagtttcttcgtgatccttagccggcgccatggcggataggtcggaggtcaaacggtgaaacttgctttagagcctaacgaaaaagttaggcaaattttgctacaggacatcatgactttgcggttttagctataggacaccgcgcgaagtgacttttggaggaagacactcccaaaagttggatatttgctggtggacaccgcagccattaaaataataattttcggttagagaggagagagaaatcgcatgaaatgtcacaaatgcccatggacccacatgtcagctctctcctctctcttcttcctctatcccctcggtgtggcagcacagcgctgtgagaagcgacaggggacacgtgcagaggccggtcccgtcgagcgaaatggcgatggtgcaagcgaagaggattggatggcgagcagccgatctgggtgttttaatttggcgagttcgaggaaggtagaagcgaagaggattggatagcgggcggtccaatttggggaaaatagcggtggtggttgttgggcgccggtgaggggtgaaatggggtcgcggaggggcgtgggacttggtggtggtggcggcttggtcgattacgcactggaggcggtggattagaggttgagcggcggtggtggttgaggcagagctcccatggccgtccatcctcccacactgccatggccggcggtcttctccgccccgctcccctaccccacaacaccgcccagcggcattgcggtggacccgcactccgacgccgccttcctcactgtgggcacacagatctacaaggtgttcgtccaccctgccaagaaggccaccgccgccatgtacaagcgctagtttcagatcgacgacctcacccgcttcctgcaatcgcgggcgcgtgagatgaagcgcagcggtgccaatgttcctcgcatgccttggctggagctccgccgacgtgcctacctcggacggtgcgtttgtggacgacaggctcgagctggtgaggagaaggagcccactggtgctggaccggacggacgacgcgacggaggtcggctccgcgatggcaaacagctgcaaggcatggctatgttcaggaactggggcgcgtgctgtgcgcccgccggaggtggcgccggccatggcagtgtggaagaagggataaagagagggagagaggagagagctgacatatgggcccaagggcatttgtgacatttcatgcgatttctctctcctctttaatcggaaattattattttaatggctgcggtgtccaccagcaaatatccaacttttgggagtgtcttcccccaaaagtcacttcgcgcggtgtcctacagataaaaccgcaaagtcacgatgtcctgtagcaaaatttgccaaaaagttatggttggtatcgtctggccggcgtgaaatttaagccagttgtaaacatgttgcgacttgcgacgggctcaagagtccaaactccagacctacccacccggtcatgtacagggctctataatatcatatcgttggagaaccgatgggcaattggtccgtccaatacatgaatacaacaaaatttaccaaaaaaaaggacgagaaaatagaggcgtggggagatcgtgttgaggtgggatgacttaaaaaatattcgaggcgcctataaattggacgcctgatttttttttcaaaaatcggacgttgttttaccaagcagatcgagtatgtttctataaatagatcggaaatgttttagtcttttgaaaagctgaaacacaaccaaatcacctcatgaaacattttgctacaacgtatgaaacaacggtttccaaaaaatcagacgttgtttcagcctataaaaaacaatgttttagcaaatagcgtaaaaatatttcaattcttaaaaaaagtgaaacacggtcagatcgttagatgaaacaatttgattcaacgtatgcaacaaacgacttgaacctattgcaacacttaaaccctatgtacataacaacacacgtgtccaaaaaacaatgtttcagcaaataacgtaaaaatatttcaattcttaaaaaaagtgaaacacggtcagatcgttagatgaaacaatttgattcaacgtatgcaacaaacgacttgaacctattacaacacttaaaccctgtgtacataacaacccacgtgtccatcaagttgaaattattaaaacaatatcaacatccactacaacatttgatccatgcatagtaaaacatcacgagtacaatagctgaaacactgttagtggaaaaaaaatgaaacaaatccctcttaatagggtgtttcctttatatccgggcaactgttgcaacggggtgcgctgtggtggagacgcgtggaggcgcgggcgcgcgtggtggcggcacgtgggcggcgggcgcgctcgattcccgattttgttggtgcgtgtagggcgcccgatctcggacgttttccaaaaatattttcaatccctttttacatatgttaatttcatgtgtgtcttctttacagattaattaattgtggtttaattaatgcataacaaagaaagtagcgtgcacgaccaaatctttttgaagctgcattactaaatattccgaccaagctggagtaaaattatcaatgccattaatgtctgatacaagaaagagtgctgttgaaaacttgaaatcatgtaactagctaactaattggaacacctgcggtattctcataaaccagacgaaaattaatccctttggcgatcccttaacccgtaaaagattgatctgaatgttctattatccgaacaagggttgagagaaccaattctgcaaagccaacaccgagcaatgcgccgtgttcggcagttgcgcttcatccatcctcagcccgcacgacatccacgtcggcctgggcgccgtgccgccgtcgcgcccgaacagcttcacctcgacctccagctgcatggcgccgatacgccgctccagggccatgcgtccgcaaagccgctgaggcagacccacgccgtcggccgacgccaggaacggcacctccggtgccctcttcccctgcgcgcagaagcccggcacggtgccggacgcgacggtgaagccctcgtagctcaccaccgcctcgccgccgcggtagcatctcgccgtgccgcgccggttgttgacgtgaagtgtgacgtcgatagcaggggagatgatcgtcggagacgccggcgccgcgtcgtccaggccgcggatggccgtaatctggacggagaactcggatgggaagtcgtacaacgcgtgatacaagcataggaatatgaaaatggaattggtgaattcatatagcaggttgacgacgaagatcttgcggcgctggcggttgcacgtctctgacgccttttggcaggcgccggcgttgtcgtcgcaggaggaaggagggtggggctccattgtttcaaatcgtacgtgacgaaaggcctttttctctggtggattgtgtgccttgtgtgcctaataagcccgcggattttgtgcccgccgcgccacgagactactcgtagcggatgagatcagttaccgtggtattcggccgaggtttcccatgcgtaccggactgccaggccttgcatgcttcacccgtagcttacgtgtaaacgacggccccctgtgccaaaccaatccccggtcgaggccgtggatggccgtgatctggacggagaactcggacgggaagtcgtacaacgcgtgatacaagcataggaacatgaaagcgaaaaacatgagttcatatagcaggttcacgatgaggatcttgtggcgctggcggttgcacgccacggacgtcttttggcagctgccggcgtcgtcgtcgcaggatgaaggagggtggagctccatggtttcaaaccgtacgtatcgtgaatacgtacgtgatggcgttttcctttggtggatccttgtgtgcgcgtaatatatgcccgcggtttttgtgcccgctgtgccacgagactggatgagagttgccgtggtattcggccgaggttttcccatgcgtaccgggccgagtcttctcccgtcctacgtgtaaacgacgtcacgacgattgacccccctagcccatgtgcctatatatccctgggttggggggattaatatgttagggtaaccacaatttagtaaaatgtaagccttaaacattaaatgttataactttagctattgtaggggcacacattaagatccatgcaatccaaaagagtcttaagcttaagtgtgatcacatgaaaatataaaattattttttttcactgttgtattcatttctctagctttctgccttgtatgggatggttaggaattgatttttttttcttcggtgggattcaatgggacccatcttatattctaccaaagacttaaccattgtaggcattgccatagctattgctccttatggtgggtctcactcttgttgtcaatgcaaccatagggatgcttactgtaaatttgaaatgcatctcgtttccatttgggatgcatatcttcctttcaagatactagctcgcgcttatagtcgtggaggattcacatactacttggtgacagctttgtgctcacgtttatagtcttggtgtatttatagtgagttttgtgttctctttacactgctttgagtgctaattggcagatccaattacctttttaatggtgtatccaatactattgacattactagatcgttgtgaaaatatgttataataatatgtactaatttttatttaaaataataaatgtaactgtctattattgtattatatagctagatagctccatcacatctgttctagaagctagaaactcttacattaatcgagagaaattttgaccattatattatagtggtctaaattgtagcgatatgaacgataaataaagacatacagttgtatacaaccctaaattaagacataaaccaatagttgtatacgtcaaatccaattctacttagggtatgtacaatggtgcttattaacggctctctccgttttctatgcaagtaactttggaaacatgaaagagagagatgacaacggtttaaagtcgactcttatagcatttattaaagaaatttttgttgcacgtggattgagaaaatgagagtaataaaaaattatttggtgtactaatggttaagagattttgctgtgttaacttttgtagaagctaaggatagtctctaaatgagtatgtattaattaagagctaatattagattctattttgcacatgtcctaaaatgtatggtatacaaaatccagttcaaattctatatttaactctgctgaaaattgcgtataaatgttagctagtttttaactaataaattaataatacatgttttcctatagaagaatcaaagatacaccttattctctctcaacagaaagttaggtcttatcttaggactatatcattgtcctaggcggtgagagatggtatagacgtggaaaattattctacactctcctgaggacgtccaattattatttgcatatcacttaaatattaataattttttttaataagatagatcaatatatgatatgatagatcattgtacaaacatacatgcaatgccaaatttaacttttacatgttacaacagaaaaataaatttgactatgaatatgtgttagttgtagtttaatttgttttttattgcaatttgtgaaagttaaattttaattcatatatttgtggagtgatatattaaagaaaattataactatttgagtgatatgcaaataatgaggggatatcttctcaagagtttaaaatccagtctcttaaagacatagcataggaacattttgaggaacaacagtgacagaaaaggagagaggaaacgaccatttggggaggtgtggccaacaggtggggtaggacttacgatagcaaaggtgttgcataaatattgaagcaagatctctaagtatttttttaagaatgataaaattgccttaaagcaatctacaccacctaaaaacgatggataggtaattaacaaaattgaaaagaaaaacgatggttcacatctagacaattctgtaattggagcattgcaatgatattgtcaaggggcataacacaaccatagaaatctcattaccacgtctatcgagaaccaaaactagtaaaatgaaaatctgatcgagaaagataactatttgccatggcattggcatggccacatagaaaccatataaagttactgcatccaacgaggtgcaatgtctgatgcccaattctgggtagcgaacactctgcacggtgtcacgtctgacggctccgcttcctgcgtcgtcaccttgcaccacatccacgtcggcatctcgctctcgcggtcgaacaacttcacgtcgacctcgagctccacggagcaggcgcgctgctccgccgccatgcgatcgtgtacctcattgggcagcgtcacgccgtccgcccacgccacgaccggcacgtcgagcgcgtccctggcgccgacgcagaagacgcgcgtccggcccgccgcgacggtgaagccggcgtaacgcaccaccgcctcgccgtggcggtagcatcggcccggcgcgcgccggttgctggcgtgcagggtcatgttgacgatggtggagaggggctgcgccgccgctgccgccgccaccgcgtcgaggccctcggcgctgttgatctggagggagaacttgggagggaggtcgaagaagatgtagtacaaaaacggtgtcgaggccagagcgagcaggacgtacaagaccttgagcatctcacgcctggatgccttcgccgccctcgatttcttggcgacgccatctccttggatgggaggaggctgaggcttcatagctgaccggccggtgacgatatgatattgaattattgatgactcgctctcgtgttcaagacgaccccaagcgccgatcaaaatctgtttttttttttttgtgctgatgatcttccatctcgtttctatttgagatacatatatgtcttcccttctgtcgtatgtctcgtacgaacgtatcgtatcctacccaaaatcctgttctaactggtaagtccggcacttgcatgaatacatctcttcggttcgggcgttcggcccttttatcatgcgtgaaacagagtctgcgcgtaggcacgccaaaatccctgtcaagatctctatagcttccacgctcccatcaagctgaatcgatctccgacgaagaaattagccggacatggcgagaacagccctgtacggcagcaaagaggtggaccccttgttggtgctacagaccaaagtcataatcctgttctatggtatggtgacgatagttttagtgctggggatcccggccgctgcccttctttctaacgccgccgagaaggtcaagtacaccttggatctcgccgccgtcgaggggatggacgtcgccgccgccgccacggccggcgccggcggcagtacggtcatctcgcccgcgttcaacctcacgctgcgtgtagagaacccgcgcaccttccggccatggtgtctcgaccgcggggacgtggtggtgtcctactccggcgtagcgctcgcgtgggggcgcgtcccgggattctgcgtgcagaagaggtcgacggccaagctgacggtggtgccctggggaaagaacgtccacttgtcgcaggagctacgcgaacgctttgtctcagagctgcaggaggggacggctaaggtctacgtcgagatgaagctgcactactacgctaatttcggtatggctgccttcgcgcctagcactgggatggtggggatttcacaggagcttacgctgggaggaagagatgaataacagtttggtcaagggaaggctgatggatagttgtttcttcgttgttcacgttttcttgtttggtatcataactttttttcctttttccaaataggaacatatatattaattcatatttttagcatgttatctccaaagtaaatagaatggaaaacattattccttggtaaggatatggagtaataacaatttgatttatagcattgaaggttttcgttttttaattttgttgcatcgaaagtcgtcacttaactttggtaacacacccatatctcgctctccattcaatcgaactcatctcgtcttctttgaacgtgattcacttagccagacattgccaattgaccatcttacctttcatatgaagaacttttacggtacactatactatcagtatatactaccaatatataaaagtgtatatttggaacttaaaaaaattgaataaggggtttttttagtaattcgtcagatctaatggggagtaatcggtcttggatctcatcatgcgtcgcgagcgtgatttggttatggcgcgtgtggcagctccgcggctgcacggtttgatgagcaacgagaagccgaagatacgctggacgcaagccccaagcattcgcggcggcctgccttccggctaagcctcaccggccacggcaagaaactgcaacgagctgattcatagtgtacattgagcgatcttgttagttcagtgtagattctactcaaaattgttggctagtacggacaacgtgaggcaaataaatcaggtactgatttggtactcttggacttgtcttgcgttcagtaccagatcggtagatgaacatggaaattcataaaaccggctgtgtacacataaagacaaagacaggtttgccccttagaattttatactggaatctcattaagtggggaggagaatgaatctacaccattgaattatttatactagcagtatatactggtagtatagtgtaccgtaaaatttctcttcatatgagaatattacgtactccctccgtcccaaaataaacattgcatgagttcccgtgtccaactttgatcgtccgttttatttgattttttttataattagtatttttattgttattagattataaaacattaatagtattttatgcgtgactcatattttttagttttctcaaaaaaaattcaaataagacgaatgatcaaagttggacacgaaaacttatggtgctgcgcttattttaggacggactgagtagtaatcaattgatctccctcccacctagtcacaccttacaaattataaaaaaaattc

SEQ ID NO: 68654 - DNA, 4266 bp, Oryza sativa
  unsure (1)..(4266): unsure at all n locations
ctctaactagtatatgtattttcacagttaaatttgttatttttgttacaatttgtagaatacaaattcgaattcgcatgtttgtctagcgatgtattaaatattaatttatcttctcattatttttcataactatttaggtcacctgagtgcttaaatactaagtatttcatccatccaaaatatcttatattttgggacagagggagtatgtctgatataggcctagtccttttcttcaactacaattacaacttccttatttaccgttagcacgcttttcaagctgttaaatgatatgcttttttgcaaaaactttttatataaaagtttctctaaaaataaaaaaactaattttaaatgtatgaagttaatacttaattaatcatgtgttaatgagctttctcgcggttgaaaagcttctccaacgtgagcaaaggaactgggccttagacttggaattgtgtgaggatttcgaggtaggaggcgcttgttcacatatatcatgtcgcttacagcaagtttaataatgtagccaactattatctttaaaaattagatgtcattcatgatctatggatgaaatagttacgtatgaatatgaactatatcatcattaatatcttacccaactctcataaatacacaatgtttcgagacagtattgtagctccctcttgtcttctattctcctcttatttatctaaacatatgatgtgatgattttaaaagcacgtttacatcacttattatacttgctttttttgaaaatgctggggatcgggcgcccgatgcggcgtaaaaaaaatcaggcactccccacgcgcgcctccgcctcgcctcccaggcgtaaagaaaatgctgggaatttctttcgctatttgctgaaacattgttttatatatggtgaaacggcgtcctattttttggaaactgttctttcatacgttgtagcaaaatgtttcatgaggtgatttggttgtgtttcagctttttacgaaattgaaacatttctgatctacttagtgaaatatgttcgatctacttggtgaaactatttttgaaatttgtaagcgcctcgatgccttctccattatttggcttgtgcgtgtgcggagtaattaccttttttttttatctataaacacccataactttctgcttaaataacagataaccttaactatgagcttaaatatgctttgggaaaaaaagagttcttgctatgaggaaacgctatccataaataaaaaaatttctaggaaatttattcataaaggaactaaattcaaactcaggactttccatcattttcttttttggcaaggatccatcactattagccttttgtaatctaaacactaatcagcctacatatcgtcatcagcaacaacgaacgaccccaacttgcggcccatcgaaatcaaaaatccacactccaggagtacgactcccggcctggcccgcccagctgcatgccgatctccagctgcgccacgcccatcctttgctccgccgccatgagccgaagcagatcctccggcacgcccgccgcctcgctcgtcgcgtccaccgccaccgtcaaggcctccctcgccccgagccggaagctgggtatgctcccgtacgccagtgggacgccggcgtaggagaccttgacgctgccgccctctcggtgccggtcgaggatgtggtcgttgtcgatgcgcacgagtagattgaacgccggccgcgaggcaactcctggacctggagccagggccagcaccggcaccagcccgctgacgccgacaagctcgatggagctctcgatcggcttgtcgatgttaacaacagcgccgaatgcgccgaacgcctggtagattatccaaaaaccaagaaaaaaccagaagctaagcaggaagtaattggacgggaacagcaccgccatggctacctcgtaccatagactcggctcgcattcgtccaccccatgagatgtatcagctgcgtcgtggtccttagccgccatggcaacagatcggggaacttgataaccgaacaaaacggtgtagggcttattactgtctgttctaataacatgcagtttcctttattaaggccaacttttgagatggattcggcccagaactccgtcagatcacacgcgtaaggttccataacaccgtgtatctctctgatagggagatagggagatttacgctgatactacgagacctacgactacgaggaatctatccaatattcatcggttctcttacagcaggtacaatagcagattataagccagctgcaaacatacttagagcaggtacaatagcaggctataagccagctgcaaacatattttaatgagataaataagaagagagaagggcagcgggctacagatttgtagccagctgtagcaaggactccaaaacgcagcgtgtgtatgacaggtgggaccagatattaatagtatagtatgtaactattgtataaatgagctattagattggctataaatgaattggagctagtagttggctatactattaaacttgctcttagagcagatacaatagcagattataagccagctgcaaacatatttaaaggagataaatgagaagagagaagggcagcgggctacaaatttgtagccagctgtagcacagactccaagacgcagcgtgtgtatgacaggtgggaccggatattaatagtgtagtatgtaaatattgcttgaatgagctattagattgtttatagataaattggagctagtagttggctatgctattaaacttgctcttatgttcgctggatgagtactccattcttcatcctggaagggagcatctcgggagtaaattgtcgacaagatgagaaaagtttcaggtgatcttgattcaactacgacggtactgaacaaataaataaatttcataaaactacaaatactttgataaaactatcacaaagctgctatgtattaatgtggtttattgcaaggcaagcagacacacaagcagacaagcggagactctgccagatctgtctacatatttacgtttcgaaagtgaccagtagaaaaattgccatcacgttgtgcattacacaaaatctgtatagaacctatgatgttaatcaagctattctctttctggactggacaacatacatcgggtctgttcgtccaggattaggagatatatcaacagcctgtaaagaaaacaaaaaccgttcatgccatggctctagtttatgcgcagagaatcagcaattatagaactataaatacggttgatggtttatctatcattgaaatgtgaatgcttaacttggtttgcaatgcttagctggccatttcagttcttgctacgaacacacttgttgaaaggacaagtaaatataaggagtacttttggatgcccttttaactattcaagtgtggaaaaatgatttcagtaagtaaatgctttacctcaggaggttcaaaatctccagcataatggaagtaagccccaactatccaagcgtgatcagcatcactggttgacgtccatatagatatagcctttgtccaaaagcagcgatttgaaaaactacacccgaagttaaaaaaaagttcaggattgtttcatataaacatctagtaaagaggattatataaaagaaacaagggatactagtaaatcacattaatcatgataatgaagttactatatgtattacctcattatggccaatccacttggtttaagtattcgtctcatttccttgaaaacatcaattggttttgtcaagtagtctacactaacctataacccacacacacaaactatgctgtcagatcatagaagcaatccgataggcgccaaaatataatattagttggctacttgtgccatatgggctatagcattttgaaataataaaaaattgttcatttatcaaggctgaacttatcatgtaaaagaaatagtaccacgttggttataacatcaaatgtgttatcctcaaaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggctgcagga

SEQ ID NO: 68655 - DNA, 1733 bp, Oryza sativa
cccaaaagtattttcaaatctaaactttttggccacaccagcctgcctgacatggccaaataactctatcacgtcacgcgtagctggtttggtagtgttattctgccacgcaagcctcttgtcacgccaccaccgccagccactcggctgggtggccaaaatgttcaattttcaaaaatattttctaaaaagatctattaataaaattaaaacataaaaagatctaaaaagagagatcgcactccacatatgcaagtgaggatcactgacatgtggacccatagaccctcagacccccatgacatgcaagtgagggtcactgacatgtgggcccctagaccctcatgacagtgagcagtaacaagatcacactaatcaagtactaaaacaaatgtaattcatcggcaaatgatccaaatccacaactggctggagtttcgccatctgaatacaatcgcaacagaacagccggttcggttgccctcgtagtacatcggtatagaagtacagatagatcaagctgcacgagaataacaaaccaaacaatgtaggatgtatatgtgcagaaatcagatatgacagttgagctgagcatgataaatatcaagatacagactgcctcacacaagtttgtactttgtaccgtgtacatcgatatcttctttttacaaatcgctcatgttcatcaacggtaacatgagtcaacctcaaatatttgctttctcagcgtctcccggtacgggtagtttggtattaagttaggtcattctcgtccaaagaatcctcgccgtcatcgtctgccaatttcttgatggtctgcagatcacccgtaggtagtttctttgcaagtcgaattacctgcagtaatattcaccataaatcgaagtgaagaaggatgaacaagcacacgaacaatcgagcagatatcattttagatggaacagactatgttttagctgataatactattatttgtcctatggtatgatgataagtgatggcctgataattgatgaggtatcactgcttaatcaaatgatccaggaatcaatatagtatagagcggtaatgttgactaaaaaagagatcatgagtaacatcttcaacctgtaacgcctcagctcctagcacactgttttacgcatactaactatccaatctgtctaatcgtataaggagattgaaataacagcctggtatatatagttcagatatcggatggccttgtaactaagaaactcaaaatattaccacatggtcaaggtgtttgatggcacttgattgtgcagcctgtttgattccttcagcatcaccttcctcataagcagacagcagtttcattgcacatcgattctggtcactgttaaggaaggcttgaaccctgtaatgtagcagaaggtaataacaatgaaagtgatgtttgggctttggtgcaagaaaatatatcaatggcaatgcacatgtaccaacttttacagtgatagtaactaccatgaatgtacaacttactctgagcagtcattgtaacatttctgagcttgttgaaaatcatgggcataaaggtagatgatgattgcactcaaatagccctgcatattaaaagtaacaattacagaatcagataagtttattgctcaaatttcgataatgcttacatggataatcaatatttattccattcccatttggaattcataaacaaatttacaatttcaaggaagtttcttattatc

SEQ ID NO: 68656 - DNA, 4630 bp, Oryza sativa
caagcttgaaaggttgtagtaagaatggaaatcatcaacaattaaacaatttgataggctctaatcattcaaagggtgaatgtaaaaatctatcaagaaccgtcacagtagtaaggttaaactgttcaggaaaaatggaccggcacagatatgctagtaggtctatgaaaagaacttcctgtaattaatgagaagtgtgagatgggaagtgattatatcaaaacagagacagtccacatataatcgatattaaagcaagtgccacaaaggatcaaatattattggtttacttgacaattccttctacaatgacaacttacccagcaagaaagaaaaagattaaaaactatccgtaaaagaaaaaatggaaagaagaataatataataaacaaatattaagcaggttggaatatgttggaatatccttacttctcgagcttgacatataaacttgcagcagcacgatacaaatcgaaagccatctgttcctttccatcctcttctagaattgaacaggcctcatcatacatttttattgcttcgtctggagtgttatcctccaagaaactgatatcatcaagttagaacaataatccttcacaatgttcacgtaagtttcagatttcttttgaattacctggcaccctttgcaagagcatcagaggcaggttgtgctcttccacattcacgatagaattctgatgctctgcgataaaaatctgaaacttcattccagcgtccaagctctttcgctaaagcaccagcagattccatgtgtttagcagcatcccagggtatattaaactagttaagggtgcattaagtgatagttcaatcatgtgaaaatacaacagctataaattttttttctgaaggatacgaagaaatcatttcctgtccttttgaagccttctcaaaggcatcctttgctttctcattctcctttttgaacctataagcaatagctttaaagtagatatgaaagttctgtcatatacaccacagggaagcaaattgacagaaagaaaatagaacatggcaaaaaaagtaacggaccagcttgctcatacaaggaggtagcactcttccaatcggcattccatctcgtgaagctcaattttgttctgcgaagcaaaaggaatgttcatatttagcatatagctaactctgaagtggatgaactgggagcaatttaagacagagagtacttagaacattttgggtcctccatcactcgtctagattcactaacattcatatgaattttgacatacatatgaagcacatacatggatcatacacgaatctatttaaaacccaaaacgtcttataacgcgaaacagaggaagtacatgaaaacaatgacagtatttaaatcaaaatcaactcaaaagcactggcatgaaaacgagagcaaacaagatatcccaatcagacacattgagaagtaatctttctgtgcgagtgctggaagtgaactctagtttgcatgtctaaacaatggtgcaccacatatatccattctgaacaatactgtaaatgatgacgagtggctgattttccacttctgaagttacacagacaagcacatccactgctgaattgatacaggtagcacaagtatcgtacttgcattctgtattctgaagatatttgaacagaaaatcgaatactacatagtaggagataaagtctgctggtaactcccacacagcacacatatgtaaacaaaattgccgcaaaacaaagcgtccgcgctcgcttctatgacctttccccccaaaacatggcatgaccttgaataaaatctcaccaaatttgcaccaaacaaactaagctaaaactaaactgacaggcaattcctctcctgagaaaatcctaaatcggtaccacgaaattggaaataggaacggtagccctgcccccatctacagatcaggtacagatccacacgagttcccagtccttgatccaaaacgcaaaatctaacattcgccaactacgacgtgatgaatttgacgagggcgcagcttaatacgctcgagtaaggggcctcattcacagaaaatacgccaaaaatccgtaatctaaaaaaacaagggacagaaatcggatggggcgctcgcggatcatctggagttagaaaagcgagagagatggggggatgaagggacttgcagcttgtcggccttggacatgagcttgtcggggtcggacgacgagctcgccatggcggagaccaaccacctcctcctcctcctcctctctcctccgcgcctccgcctcctctcctggactcccacgactcctcttgcgtgtgctgcgttgagtcgagcagccaagctgtctcgtgatctcgtctcggagaagggagaacgaggcatccggttcctcctcgagattcgcgcggcgtcggcccatccccggcccaaccatacatagttcggcccatcagttcagctccaccctaacgtggcccatgagtctcctcgaggaggcccaatttttcccggcgaattcggcccatatcgcgcggatctattcggccctaaccaactaaccaacgccgccgccgcgggcaccgcccacctgcggcggcggcggcggcggcgatggcgatggcgacgagtcgcgcacgcagcgaatcgggcgttgtcacgcgtgcgcgcggtggctgccggaatctgtctgttgtcagcgtggtcaccgaacctgaacctggcagtacgcatgctcggctgctcgctcgcacgcgcgtgcagtcaccggcgcaatctaccattgcagaggagtaggaggagggctagggctaggagttggcctctactagctgctgcattcgggctacgaaagcaaccaaaataatggaggtgactgcctcctttgttcccttcctgcgtcttccacctcatccccccctcgcaacagcggcatgggcgattcttggactctaccctttccgctgacgatgctagctcacccttaattacctcacctcaccacatcatcgtcagaatttcttcacctgaatgtatatatgtaatgatgaaagttatctcttggttttgcagggaatcatcaagatcgatgtcgatcgaattaattaaggagaattgtatgtgtgtaggggttaggggtgaggagaagattgtgttctttgtttctttgctgcttcaatttgcttcaccataccatgcattcttctggttccgagggttttgtgttcagaaataacgcatgggctgcttgctagctagctgctcatcatgttaggtactagcactactagcagcagccagcatcctcactgcacatgtctactcgatgctttttaattgtgatcgtcagtagtcacatctgttcataaaggatgcacatgagcagccaatcagatgctaattaatcttggatcttcaaattttccagaaccagactatcatttttattactagcaattttcttgtcactagttttattcttctatcattatctaaaaataaagtttagcggttttatgagcaaacagtgttggtggttagcagctcaagaatcatgtctaaatttttcagataatacccaagtattaacaaatcctcaatcataattgaaattattgctgaacaatccaaagatgtggatagagtggtgtccggtcatggttgttaggtttgggttttgggcgatctcggttgtagtttctttgttggtctagcgcggtctgtccagtgctagccttctcctgggttgtgtgaaggtgttgtcggcgcgtgggggtggttatttcttcattctttcctggctattgcatcccagggttctagtcttgcaattttttttcctactttattcaatgaatcttcgcaatgtctggtgtaggtcgttcaaaaaaaatattgctgaacaacatatgcatgtaaggattacagattacagtaggacaaacatcatactagtttcacattcatcagtcatgatttctctcaacatttactaatctactgtatatgtctttatgcagaaagccctcactactctgaactctgaagaaacaatctatgcatagtactgtaccttgacgaactctttctttgcaagtcaagttagagccatcacctatagcaaggtaggtgaaatgattgaccttatgggcgcctctccaaaaatcgtaaacaaagtcccatcagagactcagatacatggtagaggctgacgatcgatccaaacaagaaattccacggccggtgagtgaaaaagataaggataactacagtgcgcagaccctgcatgccatggtgcaaaagcttatagaattcagatgccataaatactactatccctggagctaaaggttggtgggtcgaggagaccatcttgtcaccaagaaagctctcagaactctccatctctaggccagcttagggctggaccagctagcagccattggtagcctgtatcagttcataaggggaggaggtgaaggcaaggaggcagctagccaagaagaagagcagacaccaaaactcaggtatgcatgacaaggaagaacatgatcctatctctgctgatgatcttaggagtagttcatacgtttcagacagttttaccattgttcttgtttgtatgttatctt

SEQ ID NO: 68657 - DNA, 1083 bp, Oryza sativa
agtggtttctactgggccgggctttgaatacccaaaaaagtagtttctactggagcgggctctcgtattatcgtgcacgtattgtctagaaaatgtctattttgtttccttcaactatagctcaagtcttatttcgtccctgttcttcatccgtgacggttggctcgatgccaatacgccatcacctctactgtctactgagttctaaacagtccctaggatcggcttcttccttcttcttttttttcgcgggtaggatcggcctcttccttaggccttgttgaacaagttctaaaaaaatttgttaaaaacattacatcgaatctttaacgcatgtattaatattaaatatagataaaaaaactaattgcacagtttacatagaaatcgcgagacaaattttttttagcctaattagtccatgattagctataagtactacagtaatccatatgtactaatgatgtattaattaggcttaataaattcatctcgtggttcccaggtgagttatgaaattagttttatcattcgtgtccgaaaacccctttcgacatccggtcaaacgtccgatgtgacacccaaaaattttcttttcgcgaactaaatacacccttattttccatgagcatgtatcctgaattgccaaatagtgtgcttcgtgaaaaaactttatatataaaagtttcttgaaaaaaagttaaataaattcatgtttcaaaattttaatagtcaatattcaattaattaagtattaattgcccatttcgtcttacgagcgggctgattagctgagtcctactgaacatagccggaagcgaaggacggaggaggtacagctactacctccagccgtccaggcggtccagcgtacgtggaagcaaacaagagcaagaaaacaacggcagacgtctcaaaaagagcaccgactggtaccagacacacacaaccagaaaatggctcgagataagtacaagcgtacagcctgctcgaccatgtgtgctcctcctcgttcatcagcctgtgtagcgtgtactactccctccgtttgacaccgttaactttttagcatatgtttgaccg

SEQ ID NO: 68658 - DNA, 12788 bp, Oryza sativa
gcacaccaggacggacagttttgacgttacctgatcgacgatcttccccagattcccgtacagacaggaggacttgtctcatcaccaaaagaacatgcacggcacagccctggacaactgttcatccactctcggtgaccagaagccattgccacggtagatcgatcgcactggagaagaagatgaattagcagaaacctcatgtctattcttcagactttcagtagatcgacctctggtgaacgtagtttgattgattatccaactaatgcagatcaaccattcatgcaatttccctccatgtcgtagctacatattacataggagtaatatgtatagctggtagtagcacattgttgcagatggtgttaccattgcagtaattagtaacagttcaatcaccatatccaagggcagtcagtacagttaattaccaaagccactgtaactaacctgcctgtcctgatcttgattcatcatgccatattgccatatgatgagtagtacctttatggttttattggggttaggtaggagtgtacaaaaggtgccaactaatcgtcagtcccatgcaggggcaatgcaaccaaccgatgaacttgctgacatctgtcgaaggccaccattttgtgccatttctttcttctggcagtggcaatggaccagggcagcaagaaccctactccctccgtcaaaaaaaagacaaaccctagttttcgtgttcaatgtttgaccgtcggttttatttgaaaaaattataaaaaaaaataaaaagataagtcacgcataaagtattaatcatgttttatcatctaacaacaataaaaatactaattataaaaaaatttcatataagacggacagtcaaacgttagcacgggaatccacggtttgcttttttttttatgacggagggattacaagttagattccctgcctcaccatgccaatccaatattgttaccactccaactactactaaaagcaaagctatcactagcaatgtgctttaatttggttaattagtaggaggggcaccaacttttatctgtctccatgtcctcctccattcatcatcaactccgagatcttggctagctaaaactaattaattaaacgctagtttaacgagctacgactacccaagcatgcatgtgctaccagtacgtactccagtactcgaaaatttgtcacaatcttataattttcatcttttcctttgtcgattgatccaactgacgtacaatgcactgcaaatccggaggcatatggagatgcagcagagagtgagtgcagatctcaacaaagcagggaattgatgagctccgtgattggactgccaaacgccaagaaagcgtgatcgatgatgatgcccagccaaaagaagaggcgactcacgacgcatgatctaatcaatcagaagatagacgagagatgagctgcttctcttcccatgcacgccgctctcacctgattgccattgtccgtgaattacgcttttacggttcaaagcgtgagtgaattgtccgtcttcccttatcagtttaaactgacgtagatacgtacgtaattgtcgatacttatgagccgatgataagcagagagctggagagtacatcacaaattggcacaacatgagagaagagtacatgtgtacagcatcttcacacgggcgaaatacaggcatacagcagtgttagtcagtaagtagatcgaagcaagcagacaaaggttagtaaaaggctcacatgcccacctaatgtgggtctctgtctcttgctctcacgcactgtgttcttcgttttcttttccacaaggccccaagcaaaaaagcatggcggcatcatggcaaacaatgctctcagcctcgcttagctttcactccaccacgcatgaaacagtgagccctactgccacaggatacttactagctagatagatagtagatagatcctcacgagtggtttggttatctgcttctctctcatgcacattgcgtctctctccagccatatatactcacaggctcacagcaattagagggagaggataacaggaggaatctttgatatatatatatatatatatatatcagggtgtgctcctctgaaccttcaagtggcttctgccgaggaagaacaagctctctgatctgctttctctctctccctcgcacacattaggctatcctaggttgcattgcaaaggtatgtgtcacacgcaaaggagaaaacaaaacgaatctttatccaccatgaattttttgctttgtgcaattgggttcattagcttgctgcactgcaaaaagaacagcttcttttggtacttagatctgtggattggaccttttgttttctttctttttcctcccttttgagctcgttttgtcttatcatctgctctcctgggacaattcacataatcgctctgaatttgagcaaaaaaaaatctgaatcttggagtagatctcaacgaggaagaaagagtgcttttgtgtagtgcagaattattgcacgttagcttctgctcaaatcagcttgagattgtagtagcggtttgctaattacgctggtcaactgcgtttgcagcttggaggctgaagcaaatggcgtcccgccggcgagatctcggccgcccgctgctggtcgcgctctgcgtcgtggcgctcttcgccgtcggatcggagtcccacggcctcgaggacttccgcgaggggaacaccgaggcgacgccggcgatggcttccttcttcggcagcaagcccgaggccgccgagctcccggaggcgctcgacgcctccaatgccgccgccgccaccgccaagccggaggccgcgtcggcgatccccagagccaccgccaccatcaccgcgtcggcgtcgtcggcgccgcctcgcagatccgtgtccgtggccgccggcgtggcgtgcgccgtcgcggcggtggcggtggtcggcgtcgcggtcgccgtggcgtacgtggtgcgcgccaggcgcgccgcgcggcgcgagtcggaggtccggctcggctcgccgtgagccgacgcctcggctcgtcggcgttgggtgggcccgcctatcagagggccgttgatgattaattaccagcaccattagggtggtaatttccgttttaattacctcggttgctcctagtttgatgattctttcctctctgtcagtgtgtgtgtgagtgagtgtgcgtgccatggaccattggagaacacaattatcagcacccctctgtaacataaataatgctatggcatgtagtgtgtgacactgtgagacgtgtaatctttaggctttgctactgcatcagaaaattcaggattttgttgatgtctcaagaaagtacctgaatcctgaattcctgatttttgttcatcagaacattttcacaggctgaatgagacaggaagttgcactgaacttccagccctggaacagcatggcagtgagtcagagtgactgtatcaagctgtgctatggcttcttctgtcacaaataatcaggaaaccgacgagagaaatgaagctgcagagctggactacagtggcagaatcaagcggcttctgcatgcggtccctgctgcagcgagtgcaggctgcaggttggtgttgcatgcatgtgatctggttactgttgctatgttgcatctctgatttggggattaaatggggtcgtagaatgatgggggttagagcgattaatgactaaagagatgaaggttgtcggtgatcgatcatgcggtcctgcacaatgtaccggttgccggacagtacagcggtagcaatagtcggtcaccgacaacacatgaccaacagacggtaaaaactgaacaatgacaccaatcaggaaaagagcgagaagacattcagggtctgtttagcacagctccagctccagtttcactctttctagagctggagctcagccaaacagtttcagctttaccaaaactgggagtggagctgggtggagctctctcacaaaatgaactagagttgtggagctgggtttagacagctcactccagacccaactcctgaagctaaatttaggagttagagctgtaccaaacagtctcacaatcagctgtgggatgacgggatccaaagattttcaaagattgggcaaacataagcactaatagaagtcattgaacaccgaaaatacgagacattatattatcgtgatccgtaagcgacttaggacgacatcggggtagtggggattgtttgcacaactgccacctagtagctgccgctaacatgtaggacttagcggcagcattgcaggtgcagtactaccgaggatctctgtccgtagtagagccattggacccggtatacatcacgctgattataactttataagcgacaacgcttatcaacgataacaaataatttatgttgaaacttttatatgtatatcatctcaaattaaagctaatgaaaaagtaaaataaaataacaaaacattaaaaacagcctatgaagttaagttttaaaattttaattttagctacggcttatcagccgaagattaaatgatggagcttgcacgcacgtactcccatgacgtcaaaacattttaacacgtccaccgcaagaaagaaaaaagaagaaagagagaaaaaaaacagttaacgcgtcctcgcaagaaaggagaaaagaaaagaaaacatcggtcgaagtcgaacgcagagaaagagacgctttggttcgaacttgttgtttgacatgattgttccaggccggcccagagtgactgttgcagcagcccacgtacagctcggagtaggccagagtaaatgggccgacaggaagtgagcccatgtaaggtaggagtgtcagtcagcggagtcagccagtgtggtgtggccaacagcaacagtcacctcgtctctctctgttcctttcttcttcttcttcttcttcggaatgactctgttcctttctaaacagggggcatgcatacattacgtacttctccaagcattatgccagatgcatacattacgtacttctctaacaggcaggatgacagcaactggaagaaaccgagcctgaagtttcagactgtcagctaagctaatggacaaatgggcacagcattgtcatatatgcgttgtcaggcaagggccactgctatttgcctgcatccatgcagtccatatccacaaagcttaatttggccttgatcaaggccgttttttgtagctgcagaatggtagctagcagtgtgatcgatgaagtccctagctatcattttgttgccaagcgcccaagctagtgaacaattaatactccttgagcttaagacagtagcagtaaatacattgttcatatccttaagctgatgaagagccgatatattcgatcgatcgaggcgagacaagatgtacggcgccttcgattgggacgacgacgcatgtcgttaagcgtcacatgacgttaccggcaggtgtcacatcgcgcaattaagctcgagggagtgacccgggagaaattaatccctctcttttgcatggaccactcatgtatgcgagcaatataatcgaattaaccatcctagttaatcccagctgctgattgatctacagttctagtacaaatcactgccttgtttagtttagctagcaagctagctatataagcttctcggtattaattacgatctacgtacgtacacttacagatgcatagtcatacaataataatactactgtacactatctcatgtgcatccaggttcctgcagatgcaagcaagctggcatcattaaacagtggttactggttagcgcagtgatcagtgtgatcacccagcagctggtagctgttgtaacagtgagagagagagatcgacaaagttacgatagacaccttgctatcgacgggtatatataacacgtaccactcaaacaatagttaaccgtaaatacaagcacccacaccaagtttagaagtcaaaattaaaaagttagtttcgactacaaggaacctaactaactaagctacgctcagttgtataatctaaaatactttaaccacgctacgtgtaaaaaaagtattataaagagacaaaatatatacgttctaaagaaaatgaatacgtttcttctagatgatggaaaaagtaaatggatacattgacatacatctaactcaaaagattccatatcgattctcgaatatggttgaagatgaattggtctatatatatcttgctacgtcaacgtgtgaagccaaaaatccgtcttactaacatgtcatccaccgtgtgttagccgtgacctagaccgattacgttgaatgcgccaaatgagctcaccgacttaaaataatacacaatacaaaaagtacacgacaccgcctagcctcatggcagtccacgttcttagtatcatacaccatcaattcgtccgatatgcgtcagaaagaaattgataaattaaatcgaatccaacttagcactattaaataacacacatgtaaaatttatatatgtgattagtttaacttgataggttttttaaacacgaacaattatatttttagctaattatttttcaaatgtatagaaagatataaagatatgagcgtagtttaaccggttattcgcgcatataataattacatacgagtgtagttttaacatggttagattatttagacttgatacgaatagtttaaatttttggctaattatttttccagagtaaatatatatacagataatatagcaccattacacctacgaaactgacctaaaaataagtccttagaagaaacctgcgatgtggaaaaacaatttttgactaattattttttcagagtaaacaaatatacagataacatagcaccacttaacctgcggaactgacccgaataaaaagtgatacggcaaaaaccatgaggttttacgtagaccggcgcccatccccggaagcaaatacggcaacgcgaccatgttctctcccgccacggggccgcgcgcccggtggctgcagcgtacatccgccgaaagaaaaccccaccaaatacaaccaatccatcgcctcgtctccatataaaaccggcaaacccaagagagaagaagaagaagaaaaagaaagccaaagacaaagcgatcgatcggagaacgaacgaacgaagcgcgtcgcgtcccactcctcccctcctcctcctccgccgcgagcgcgcgcacgcgcgtgcagcctccgcctcctccctcacgccaccaccaccaccacctcgcgcgcgcgcgcactactgcaccaaaccccccgcactaagtggttgtgttcttgttggcgaggaggagagaggggtggggtttgtggtgtcgtcgtccatggcggcggtgatgcaccggtcgagctcggatggcgggtcgagcagcgggtggtcggaggcggcggcggcgtcggcggccggggacgagagggccgggtgggaggtgcgcccgagcgggatggtcgtgcaggcgcgcgaggagggccccggcggtggcggcggcggaggaggagggatggggatcccgccgaggccgccgccgccggagatcaaggtgcgggtcaagtacggcgccgcgcggcacgaggtcgccgtctcctccattgcctccttcggtgagtgagcgatttctctctctctcgatcctctcgctttcttctcacctttggttaaagtgtgagctttggttaagtaaccgtgcttaattacgccttaaactttttttcttctttttgttcttgatggtgttctttcctccatagacgagacgaaactgaaattttgattagtttttttttctttaatttcatttttttagattatcctgcactgcagcactcatgttttctttttctttctccggaaagtaaacccagcaagttaagcaaaagcagctctgttttatttcggtttaaatcccgcgcgaatgtttattttaacatagccggcataaatttgttttatttttgggtcaaaatttgacctcgagtcacttagctttaaaacccgtgctggctggcaatcgtggcttgtactacgagccagttaaaataaaaaaaaactgagttaagtatatcaaatttaaatacaaaggtggtatttaaaattcaccatgagttccggccgtgccgcgtggaggaattaatgccgccgcgatattaggacagtgagacatcccctttattttttccccctcttttttaaaaaggaaagaaacaaaatccacggaataatttcgtacgagcccgtgaggcgccgagatttctttgctccgtgcagcgcgaaattcccggcttcagaatcattctgtcttgtgcggccatctcgtaatttaaattttgaccgcttttcctcctgaaaataccccgaaataaaacaattttttgctagtaattttactgtcacagttgctgcgttaacttcgaaaacccgtgctctggattagcgacagagaaaaaaattactgacacgacttcatttctcgagccatagcactgctattccttccgtgaaatcccggcattgggcggttcaatgcgacggggaagtacaggcgaatgcagattacgaggctaatgaagtaattaacaaaattaatcacccgatcagtgagctctttgaactgttctctgctttgctttgctttgcttccactttgccggagcagatgctgcctgaattaagcttgcctttccccgacaatggcagcaattgggggggggggggggtggggggcttgggttggatacggtggatctccctctctctagtttctggcgccgcagatgggtccacgtgtacgggcggccgaatcggacggcccaggggcagcctggagtggaggcaggggcacgttgcgatcgtttgtcccgttgcaccgacacctctgggaagtgtgaagttgagtgcttcgtctccggcgctcactgtttgtctactgcagcgagatgtggaaatcgctacgggtcgcccgtcgtgcgcaccacgttgttggctcttcttctcgcctcatctcgcattttatatcgcgcggtgagttttttataaggttcgggtggttttggtcgtgatcagggtaaagtcagctaagaagtaaaccttaaattgaaacaatgttttactagatgatattggaattttgtcgaggtttgttgacccaattaataaggctagctttagccttaattggcgatgtcttgttatattatagtatttgcttcaccacgtgaaaagaaatatgacacggtgtagcatcggaaatatgataggaatttagttttttttttttgtgatttagttggtaactttacctggaggctggagcataaaaaataatggaggaactcttttttttttaaaatattttttcacgatctcagaacggtagagttgaccactgatatctggtccccaaatggccaaacgtgccacagaaaacctcatcactgtcaaacatcaccagccaggcaaagaaagtacagagctaccaccattaccatgtcagtgtattgatcacagattcacacgcggtttcaataacgttggcaaatgttggtgaccagtagctgcagcaatgatccaatccaccatgtcccaagagcatgtaggaagaatttcagaagaataatcagctgttctttggtgttgtggcaggcgagctgaagaagctgctggcggcgaggaccgggctgccggcggcggaccagcggctgacgtacaggggcaaggagcggggcaacgccgactacctcgacgtctgcggcgtcaagaacaggtccaagctctacctcgccgaggacccgaccagcgtcgagcggcgctacatcgagcgccagaagagcgccaagatcgagaccgccaaccgcgccattggcgccatcgccttggaggtcgacaagctcgccgatcaggtgaccaaacttaaaacaaaccctgcttctttctttctttctttctttgtttcttctgttcttcttccatggtcaatgcatcggttatcaccatattctaaaatgtaagtattttcgcatgttgagatacattttcaaaaacacaacacgttgttgaaatgtttatactattttggaatggaggtagtaggatagatagatgaagcttgaacgatttagggggctagttatggtctgaatctgtgctggttcagacaggcaggcatggggaggggaatggtggcatggtgcattgaattggatggccagttgagtaatccgtccaagaaattaggtgaccaaattgatactacattgcacggttgtccatcgattctggccatgaagaagcagcggtgaaatttcttcatccattgcacaaggcaatggtccctgagttcatttagtatgttgcataaaccgggccataccaaagcagggacagaaattcaatccctgacaaggatgtgcccctgcatctcagggcacttccatcattggctgtactaaagcagagttcactcagctttagtttctgaaagactcattttggcagaagtgatatgatatgatctgatcctgatgctgatgctgattagacgagaaaaatgtttccttttcttttcttgtaccaggtaaggagcatcgagaagtcgatcacccgtgggagcaaggtcgccgaggtgcagatcacgacgctgatcgagctgctgatgcggcttgctgtgaagctggacagcatacacgctgaaggggactcgtcttcccagaagaacattcaggtgagcacctgcatcatctcctgtttgcaaagagcctagcattgggcattagaatcaagaacatcattataggtttttggtacagtaccattggtaccaatgagagatgctatggttacatttagagtagcttctgacaactatcgcttctccttgaaatctccagctccccaaacagtttagattctcgtaatagattctaagaatttgtagttatagaatctaggatataaattagaagactgaagataaaaagaacctagtctttttagattctcaccggcttgagcgttcttggggctgtcggtttacctgagtaggattgtagcaagcagtggcatgacaatcagtacaagttttcatgagaaggagctgtagctgtctgtgtcacctatcatgggtgggtgagtgtcctacttgccccccgaaacagtcacaggatcattagcttctttctggaaaacacatggtccaggcacacaagaatgcttatcctgccttttcagcataaaaataaaaggaaaaaagcacacaagaaattctacctagaagcccttttcctgctgaaaatgttaggtgatgccagctatttgcatctagatcgctctttagtgtgagctgagcccttaagcaactgaacttgtaccaagtttgaggaaagttgtgtgcttttgttgtgcaaagagtagatgacaagaaaagaaagatcaagatgcaaaagattgcccatttctggttaggtcacaacaagagtagacggagaccaaaagtgcaggcatcctgggtgttcttgtttgttagagagtaaaaagagaaaatgcttttatcattacctgtgatgatctcctgatgccacctcaagattagaatggaaaaggccattaactttttctttggaaatgatgtgacccactcatgaacagttacttacattccaagtactatctacacactgttttcctttccatttttttcaataattgataatccgacctttacctcaacaaaagctacagtcacgatcctcttattacaaccaagtgcaaataataattacagatgacaagaaaacaatcttaaattacaccaacacaatgcatattagtcctagaaatggatcagataacgagacctttttctttctttttttggcaggcgaagagggtgcagaaatgcgtggagacgctggatgtgctcaagatctccaacgcgcggttgcagaatgtgatagtgacgaccaaatgggagacgttcgatgctcctgcaacgacgcagtgggagctgttcgactgaaggtgaaaaacaaaagaagcccagaaatgcatagcagtacaaaaaacaatggtgttggttttgtttgcgtttggttggttcgtatcttgagttgttcatgtcagtttttgtggcatgcatgcaaaattggttgtaataatggttggtgagctggtagattaaattaggtggtagaggaaccgaaaaccccactgttaattgtctgtaatcatcgtcgtcatacctctcccgactcgatcgattcatggatggatcagtccaataaaaggaaagcagcagcactgttctttctttctgtatcctgtcttgtcgagtgagagccctggtggtgatgatcgattgttcagagaacagctgattcagaaggagaagattgtgcaggtttgtgtctgaagcaacagtttatggctcacagacatggagccctctctttcaagaagaaacgaaaaagagctccctgaatttgatggtggcgaagcgagattgtagtttggcaaactgttctaagttgatactttattcatccaaaaaactcaattatgaagatgtgacataatctaattacaacggatctggataggaccattcatattcgttgtactatattgtattatgtcatcatttagattgtttttttaagatggagggagtaagtcaggagaagaggcagtaaatgtttagcagtggaagaagacaactccacatggatacatgctgaccagaagttaaaagattaattaatt

SEQ ID NO: 68659 - DNA, 32666 bp, Oryza sativa
  unsure (1)..(32666): unsure at all n locations
ttcttatctttgatctggatacctgtagaggagaagggataggatcaatgagaagctgaaggcgctgcaagagctacttccaaattgcaccaaggtatgcaatatgtggtgcatctttggtcatacatatctcgatcttgtagagccattcagttctgaacttctaatcttcttgtttcttcagaccgacaaagtttcgatgctggatgaagcgatcgactacctgaaatcactccaactacaactccaggtacaaatagcatcaaacataagatatgatcaggtttattagaaccaagacctgatctttttatgcaagttatatctgaaactgtggtagagatcaagtgatgcaatttatttcatgtgatttctgatcataatcatgtcatgcacacagatgctggtcatggggaagggaatggcaccggttgttcctcctgagctgcaacaatacatgcactatatcacagctgatccttctcaaattcctcccatacgcccctccgagccgcggccatttcagataacccacgccacccaacagagacagtctaacgtcgagtcggatttcttgagccagatgcagaatttgcacccttcagagccacctcaaaatttcctcagaccaccaaaattgcagttgtacacgccggtacgtagtccatatatactcctttatcgccattattagtacagcttttatcttcctgatatgaggttatgtatgtctatggtgtttgattgttacatgatatgtactaattaacacttcagaaaagtatttacatgtactataagtgcttgagaaaaaggagactttctgcacatgaacaatgctatgcgtcattcttggtagctggcttgctttttatttttagctcagtaggaccttcggtcctgggcctggtttttcttacttgtaaagtttactccttctctattcaatgaaattggcagcttgccgattcgttcaaaaaaaaaagctatgcgtcatggctgatgagtagttgttcatccctaatgcaggagcagcagagaagaggtctagctagtagcagtggccacaacagcggttggatcacggagaggaattcatcgtacaacttcttggagtgatgaccacctgacgagttactaagagatccagaagcagatgcagtctagactctactactctagactgcataaccttcattcagttcatggtgttcctggagatgaaacaagttgctcaatggagtgatgaatctactgcatgcagttaactagttaattttgtacgtcaataaatagtggtgatcctgatcttgcttcctcgtcatgttctgtgcatacaagacctaaagcgtttttgtgatctctgtactgtatattagcagacagtctacttcctgctgctgatgcttatgtgctctgacaagcaaatcaacatggctaatttaatcaagtactccagagaattgcagcaatggatatttcctagctaaatatgtacttgtggtatgaacggattgtaatgacaaaactggcattgattatctgcacctaatcttgagtagtagtaaatgagagttatcaggagacattcttctgcccagcaacaagctactgccggggattcaaaagacacatctacatctgagaagccataattcacgttaacatgtttgtgatgagttcaccacttttgttcgcactcatgcagctcgagtaatatattgttttcagctccgtcgaatctttcaatctttcagcttccattctcacctgcagggcctgcgcatacaggtatgttgcagctctgaaagttttgggagggtcaaaaggcagaaactttggtaccacttcagacccatgctttcaggcagcatgggcgagattgatacctaaccactgcacctgcactgttcctcgcaattaattcagctcagcaaactcacacgaacggatccttgaccatgcacagtagcaaataagtagtacacctcatcaatggagaaagttcgcaatgcaaagaactcgaaaaaccatatcatcatgaactgaactctgaatcttccaagaaatttgcacgttttcactgctgcattgtgcagaattgcagatgatttgacaattgcacagtttacatagaaattttgagacgaatcttttgagccaaattacgccatgatttaacaatatgatgctacaataaatatttgctaatgatgaactaattagtcttaataaatttgtctcacagtttacaggcagaatctgtaatttgttttgttattagtatacatttaatacttcaaatatgtgtctgtataattcaaaagctttactcccgaagaactaacacaccctcagtaagctcacacgaacggctccttgaccatgcacagtagcaacagtacacctcatcaatggagaaagttcgcaatgcaaacaactcgaaaaaccatttgagatcatcatgaactgaactctgaatcttccaagaaatttgcacgttttcgctgctgcattctgcagaattgcagcgagagtttagcttttctcttcttttttttttttgttcagtcttctccgacgagcttgctcatcttgagcaaggacgagagcacggcgcccatgtcgggccggtcggccggctcgaacgcggcgcaggacagggcaacggcgagcacgtccgccgccgtggacaggtcggcctcggtggcgaccttcatgcgggggtccaggacggcgtggacgccgtcgagccccctcgagaccgcgttgtcgacgagctgctgcagcgtcagcggcacgccgtcctcctcgatcgtccccgtcggccgccgcccggtgaagagctccatcgccagcaccccgaagctgaacacgtccaccttcgtcgacaccgtcctcatgtacgcgaactctgaattttttcagcacagagttagacgttttcagttcagagatcactgagacgaaatggttggattggtagtttggtactccctccgattaccagacgttttaattttgatcaaaattaacctgttttaagtttaactaagtttatagacaaactaaattagttttatcaaattaataattgaatatatttttataataattttgtcgtgagttaaaaatattattatttttttttcataaacttcgtcaaacttaaaacgatttaaccttaatcaaagttaaaacgttttataatctgaaatggaggaagtagcttttacctggagccatgtaacccacggtgccccggaacgccgacgaggtggccgtcgactgcgccgcggcgttggcggcggcgggcaggtggacgcccagcatgcgcgcggtgccgaagtcgctgacgcgcgcctcccagtcgccgtcgagcaggacgttggacggcttgacgtcgcagtgcacgacggggaagtcgtacccggagtggaggtacaccagcccgtgcgccaccgacacgcacacccgcagccgctccctgaccgtccaccgcgacggcgccggcggcggcgcggcggcgccgccgtgtatcgcgccgtccaggtcgccgttgaccatgtagtcgaggaccagggccttgatcttgccggcctcccacgcgtacccgaccacacgcgccaggttcttgtgccgcagccggctcagcgtggcgagctcggtgaggaagcacttgtcggacttggacgggaactgctccaggttcagccgcttcacggcgacgaccatgccgccgtcggcgtcgccggcgagcacgcccttgtacaccgtgctcaggttgctgctcccgatgacgttgccttggtcgaacgagttggtggcggccgccagctggccgtaactgaacctcctcagctccggcaccacgacggcggcctccggcgagtcgccggcgatgtcggcggcacgtctcttcctcctgtaccggcggtagctgacgagcaggatcgtcgcgaccatgaggaggagcagcgtcgacagcgcgatgagcacgacgaggatcacgagccccgtccgcgagaacacccgcttcttcccggcggcgtggccgtggcatggcgcgaggagcttcccgccgcagaggccggcgttcccctgcaggctcgacatggtcaggttccggaacacgccgccgtcggggacggggccctcgaaggtgttcgacgaaaggttgagagaccggagcgccgtcaggttcgccagcgccggcggtatggccccggcgaacgcgttcctcgacacgtcgagcgtctgtatgtgcttcagcgcggcgatgtcggcggggatctctccgtcgaggtcgttgccggagatgttcagggtcgtcagaaggtcgagctgggggaagaggttggccgggagttcgccggtgaggctgttgccggagaggtcgagcgagtagaggttcttgcacccggcgagcgtcgccgggacgccgccggacagctggttgttcgacaggtcgatggtctggaccatcacgaggccgccgatctccgccgggatcgcgcccgtgaacgcgttgttcgacaggttgaggtacatctgcacgttgctcatgctcgcgatcaccgcgccggggatggcgccggcgaggcggttgtgcgagaggtccagcgtgaggagctggtcgagcctgcccagcgccgcgggcaccgtgccgttgagcatgttgctcgacaggtccaggaacgagagcgaccggaggttggcgacggcgtcggggatggggccggcgaacctgttcgacccggcgccgaggatggtgagctgccgcagctcgaacacctcagccgggaacacgccgtcgaggcgattgtgccccagatcgagcaactggagggaggacatgttcgagatgctcgccgggacatgtccggcgaaccggttcctgccgagtttcaggctgatgagcttcgtcatgttgccgatctcctccggtatctcacctgacagagcgttcccctgcagctgcagcactgtgaggttaccgagctggccgacaaggcggctcaggccgccggtgaagctgttctctgacaggtcgagcttctggagttggccgcagtcgaacaggtcatcgggtatgtcgccggccaacgagttttggccgagcgacaagaacatgaggctctgtagccggccgagccccgccggcaatggcccggagaacaagttgaagctcatgctcgcgttggccagctgcgtgcagttgctgatgctcgccggaatttggccggagagcgagttgttctggacgatgagccgccggagattccgcagtgacccgatgctcgccggaagcggcccggacaggtggttctcgctcagctccaggatggtcaggttgacgagattcgtcagcgacgccggaaccgtcccggcgagccggttggcatggagcgacaatctctggagcgacgggagctcgccgagctccggcgggatgggcccggcgagctggttcatcgacaggtcgagattcagcagcgacacgcaacgccggagcgaccgggggatctccgacgtgagcgcgttcttgtacaggcgcatgacctccaggttcgtgagctcgccgagctcgccggggatctcgccggtgaacccgttgctgaatatgttgagcaaggtgaggttcttgcaccggccgagctcccgcgggatgtggccggagaaccggttctcgtacagctgaagaatctgcaggttcgacaggtcgccgatctccggcgggatcgagccagacagctggttgcagctgaggtcaacgaccatgatgcctttgagcttcgccatggacggcggcaactccccgtcaagattgttcaggtaggcttcgaagatctcgagattggacagatccccgatgcaagaagggattgcgccggtgaggttgttgacgttcagggcgagagcccacatcgccgagcagttgcagaggctgctcgggatgccgccggcgaagtagttcgaagaaacgactagctgctcgagctcgccgaggcggccgagctgcggcgggatgccgccggcgaaggcgttcgacgtcaggtcgatgacctggagcgtcgagatgttgccgaggaacggggagagcgcgccccggagcttcgactccggcagctggatggacgtcacctggccggcgccgtcgcaggcgacgcccgtccagttgcaatgccgcggcagcgcgccgccgcggacggcgccatcaccggacttccccaccctccagccggccagcacgccgagcgggtcgtcggcgacgccgttcttgaactccagcagcgcctcgagctgcacggacaccgccgcaccggagccggccgccgccgccgacgacaacgagaacagcacggccaccaagacgacggcaatgcaaatcgtcttcgtgtaatgctgcgacattttgcttgcaaatttattcctctccatgcaaccatgggatcaaatcaaaatcaaaatcgcaagtgcatataaagaacttcgaatggtgtggcaatccactgtgaagtcaacgagctccctgatcgcgtcaacgtggtcgcgtcaacgtgtgaagagataggccacagtttgactccaaaagtggcgggaagtagtaggataggaggacaccaggttggcaggttggccgttgcggcgaggacgagatgggggccatacggcccgatgctgcacgcaaccaataaattcagagtttactcctgcatcgaaattcagatatcgtttgcttgccgtgccgacatggtcgtagcctccatgtgaccaaacgatccaagatgccgcgcgcggccgcattctgggcagtaccacggcgaaggcttcatcgtttctgttggctccgaaaaaagttaatcttttcaaactattattccgtacattagatggcttaaccgcgtaagcttattttacaccttcaaactattaaaaacgattgattattccctaacagtatttatcttttatgtttttccatgtataagttatattttgcaatgaaatttggtaggacgataatagtatacatctcacatctcaatactttttgttcataccacagtttatctgagttggaacttggaagtacctaggggattgatttgaacatcgagattatgaagttgaagaaaacagtcgtgaaagaaaatgaatatatttttagaactttgataatggtatcatatgactctaaaaaattatagcttaaaatatactactagcttatataaagagaaacaaaaaagaaaaatgttactactatggagtaaactggactaatttcaatagtttaggagtaaaatgagccaaaagtaatttaggcgttaagtgatctaatgaaattatttaagagagtaaaatggacttcttttttcttctgttgtaaaatcctttgctggttcaaaaaggggtggtcaaacggtagacctgttgaaagtggtatattctgaatccaccgtgctaaatttgtccttgtaccagttgaaagtggtttcttttcagcaatcagttgtgccatcagataggacgaacactttttggactcttcaggaatcaggattaagatcagcgcatgcttaggtataaacgacactctatgtctttgattcgtaccaacttgcccaggacccagggcaaatgttagcctggcttccacaaaggcacctttctaatcaacacaggaccaataataaaccctaacctctcgtacgagcggtttaaagcatgttcatatatctgccagaaagaaaattaagattgcacaatggagaatactagtactgacacacacaaaaaatatatattaaactgcatttcagagtcattttggtacttgatcagttgatcaccgagagaacagtagtataaaattttcggacaagatatcatgctgaaaatattggactgtgcagcgtgcacaagacgaacaagacagaagcaagttcacgtgctttggttaatgttaagaaaggttggcttcaccactaatcagaaatcttagccatatgtccccgcaaaaaagaaaaagaaaaagaaaagaaatcttagccatatggaaaagagacgtgtgttaaatacccttaaaaaaattaaaaatcagacactagtaattgaatacacttccagcataccgtgcatgattcagaaagccaggaaaagattttagttgaatatagttagtttcggttggtttcgctcggccgttagcatggactaatcaaagaacactgtcatcatcattggcaacctgatagtgcgaggagcactctgcttgggctgccccggcaaaagagaggggaaaaaaaagaaagaagctacaaaaccagtagaattcagctgaagtctgaacccaaatcttgcgttagtggatgaagcaacaagatggcgcagccatctcggtgagtggcatctcacatgcgtgacagatgcaaagaatcgatgcgtgcaactaagcgaggtagagtgattttaaagtcattgagaaaatattagaagatacctattttttaatgtaagatttagtatctctcgatgcatccgatactgtaagtaccaaagatttataggatttattggtccaatcttcgaagatacttataggtgtagaatttacgtacatacatctatagggatgagtgtggatgtgttgtaagtgtcagtgttgtactgagaaaacggacgtggcaagcggaggccagcccagcccaccaccacgcgtatgcatggctggcgaattgcgatgcgccatttgctcacaaattttctcccttttacacgcaaacacatgatcaaatctcaattcgcaaatacattatgcatatagagaacagattgcatcagccgtcaacttcggtcagagtccgcggttgacgaaaggtgtcagtttggcgagaggttttgacttgaaatttggcgggaacgatatatgcaggagaagattgagatgggcgtaccatatgcatgcggctttacgttacgggcaagtcaactagcactctagcagaggctactacgggcctacggctagttgcatcgaaattctgagatatggttgccatgccgacataattgtagcatctgtgattgccttattgtcaaggacaatttatcatatatttcaaaaagtacaggaggtaccatattttctactataaaattttggtaactttggatgctaaatattttgaggtactaagatttttaatgaaaaaataaatatcttgaggtactttttaagaaccgtaaaatttctctactgccaaaatgttcagacctgggtcactttactgaccagagaattcttgatttctgaaggttctgttagtctgttcgagtgtaaaagctcaattctgtttgttcattgttgttgccattgagatcaagatttccaagtactttctgaattgtagtagtactttctgaattgctggtctaagagttagggaaggatgttccagaacagcaggcgagttgatactgaaatctgaatactgcagtgtgctaactgcaatgcaccggtttcttttgccaaaaaaactctgtgtatcacttgttggactgctcagatcaacgcatgcttagctaaaaacaagggcaacgactcggaatcatggtgcttagtcgtcgtctgctaccaagtaccaacttgccgaggggaatttttgttggcttcaccgaccaagctgaaaattttgaacgatcttgggaaaataacaagacatagatcgagccgggtactccaataaccattagtagtagttttcaacgaagttcgcttgctgatctgtttgtttggtatattcaaatttaagatcgggtacagcttttctgcaactaccaaggccactttcccaaagggcccatttgaatcgtaggaatgaaaaaacaaaggaatagaaaaaacacaggattctgataggaatacaactgtaaaacacagaggattgcaaaacacaggaaacacacacaggaatggccgtttgattggaccacaggaaaaacgcaggaatcagatgagagagatagactcagaggaaatgttccaagaggttagacctcttgctaattttcctccaaaatgtgcataggattacccattccataggaattttaaagaattggataggattcaatcctttgtttcaaaggccttcataggattttttttccataggattgagatcctccaaaattcctatatttttcctacaaatcaaaggggcccttatccatatttagaagccaaaaggaaggattcaattgaatatacttttgacttatcattagctcaggtaatatcatggaccacggctataactaaagattagaaaactgtcattatcacaaaccatagcatctgattatgagagaatatagcaataatcaagagcactagcagtctagcatcaacgtgagaccctgtttagatggtactaaaacttttaagtccctatcacatcggatgtttaaaaattaattataaatattaaacgtagactattaataaaacccatccataatcttggactaattcgcgagacgaatctattgagcctaattaatccatgattagcctatgtgatgctacagtaaacattctctaattatggattaattaggtttaaaaaattattaagcgaattaggtttcatttatgtaatttgtttcgtaaatagtctatatttaatactctaaattaatatttaaatacagagactaaagttaaagttaagtccctagtttcaaacaccacctgagtggcagtacttgctgaagtctgaacgcaaatgctggccggattactggacgaacaccacgacggcggcgcgcgcgagtgggcgcgacatgcaacaaaccgcaagatgcgaggagggggacatgtccatgcatccacgcatgcgtttttgtctcgatcgaccggcgccaccatcagccgccatgcatgattctgaaggccgagtcagcgagtgatcagtggccaacgaccgattttgactagtactgttgtttcttttacttcttttgtttgagaggacttctgtcgtttccacgagtcgctcttagcccatggaccaattggaccaattgtacaggcatcgagaaccgagcgttgctcggttggctagcatcgctggtgagcgagcagcccgcgcgggttcgatccctgggatcatcatccgcgcgtctcaccgggatttattcccaaataaatttccagctctcctgtgccagcgccacaatagtagagtgacgtcctcgtcacgcacaaggttcttaggtggctttgtgcatctcattagcacgtgtgtgtatagttgataggtctagcatgcgtgtaggggtgtgtgtgtgtgcgtggtggagtgcgtttgcacgtatgttcagatagttgataggtctagcatgcgtgccagcgccacaatagtagagtgacgtcctcgtcacgcacaaggttcttaggtggctttgtgcatctcattagcacgtgtgtgtatagttgataggtctagcatgcgtgtaggggtgtgtgtgcgtggtggagtgcgtttgcacgtatgttcagatagttgataggtttagcatgcgtgtaggggtgtgtgtgtgcgtggtggagtgcgttgcacgtatgttcagatactacagcttgtactctgtactcaaagtggagagctctcaaatgtgcgtggtggagtgcgtttgcacgtatgttcagatagttgataggtctagcatgcgtgccagcgccacaatagtagagtgacgtcctcgtcacgcacaaggttcttaggtggctttgtgcatctcattagcacgtgtgtgtatagttgataggtctagcatgcgtgtaggggtgtgtgtgtgcgtggtggagtgcgtttgcacgtatgttcagatactacagcttgtactcaaagcggagagctctcaaaaaaaaaattgtacaggcatctgttgggctaaattctctctgcaggagctttttgctcttagcccattgtagcttaaaggtccaacaaatgagatataatctaccatttcttcgcttattgttgctatacctcttagttgttatggttgttgttgatgccaagtgtataactcgacgattttgatgctgctatgatatgcctctaggtgttctggacaatattttatttgtactatagtggatgcttggagtggaccgatgtttttactcctcacgctgaggatgttttttcacgtaaatcattttgtcttgcgtgcatgtaaacgttattatttctctgttgttttactagttgaaattatcctcaaactttatggtaggatacagaagttgattgtgtgaaatattttttttctgttggtgaattgatatttgcacattgaagttgtttggtttagcctcaatagcatcagctgccgcataccacacactgcccgagaggagatatagatccaaattatgaagtttctgttaaccggagcgacctttagaattttatgttcgatttttaccaatattaacttttcttaattcttatttaactcactactccttccgtcctataatatagcaatatagaaccggacaaaacatttcataggataatgaatctggacgtatgcatgtccagattcattgttatatgaaatgtctcgtcctatcctatattgctatattatattattataggatggagggaatacttagctattttcaggatgtttagctccaccaacgacatcataggcagaccagtaatgatcctcgtgctgtcgtgaggcaaccaccgggacatgcaggctgccgcagtgagatcggtgaaacatgtactccatccgttctatattacaagtcatatgattttcttcttagtcaaagcttttaaggttaattaaatttatagaaaaaaattagcaacatttataaaaccaaaatagttttattaaatttaacattgaatatattttgatagtttatttattttgtattaaaaatattagtatatttctctatagtttaactgagaaaaagttaaataacttattatatgaaacatactatgtattactccgtgttagaaatgtccaaatacaaaaggatcataaaaacacgaacgcacacacggtgatcgggtgcgtgaaccttttgctggcaccgaattcccggcagtggcaacaccagccaaaaaacctgcggctcctgcaaatctcggcctgtacggcctgatagcccagccaggcctggcccatcacgcaacgtgcgcaattatcagccaggccttcaccttgggccctactggtagtactactgggccagagggtgcgtgccgtcaccgcatgcgccaagaaatccttccacccgccgacgacgacgaggcgacgatccgcacgcgagattcgcagcttcccccacacgccgcgcgaggcccatgcatcctcctgttccgcgacacgaactgcgccgtggcgtggcgggtcgtgtggtggcgccgtgacatgtcgtcgaggcggcgagattccacgcgaattgggacccatcaacaggggcgtccatcccgccgtctcagcagcgtgtactccgatcctattaagaaagcttaaaattatgagaaggaataaataagaatatagagaagctagaaaactattcttctaaattctacaagcttaaaattttgagaggtaataaataaaaatatagagaagctagaaaactaatcttctgaattctacaagagaaaatctatactaatccggatcccctcctcctaccctcactctcctcccacaaatcagatggctcccgaggtgcagccctccccgtcgccgtcgccccaccgattgccggagccaacggccgccgctgtgggggaagcggcaacggcgaggagctcggtggcgggcgcggtgagcgagagggagagcgggagcggggcgcggaggccgaacatgcgaggggagaggtggaggaagtagagcgcgcctcgccgatggagccggagcgggaggcggcgggcgaggtcgaagagcgcgagtggcttggcgggcgacgcacgcagcgcgtccaccagcggtgccgccgccacgagcgggaggtgcgccgacgcgagcttctcgaaggtgtggtctaggtgccacaccaccacgtgctgcgccgccgtggtcttgccccatgcaagcagcagccgctgcggtcggcggtggtgtctctccgcctcaagcgaagccgagatgcctaggtaacagcttgatactaggctatcaggtaccaggaagaagtcacttaaaatatcatgttctaacggaatcatgttctctagtctctctcattctacaagtacagtttcttagaaattgtgtgaaaatctaaaccgtttgaggaaatttctggcagcaggaaatttcaggagaagcgcaaaagctccccaaactttggccctctgtctctcgtctctcgcagggctccgttgccgcaacgggatgccgtcccgtttccatcgccaattcgcgcatgtggacgtacatgtggtggtggtggtggtcagttggtcacggcctcgcgagcggttttgctgcttgccgatccaacgctgaatcaggctgatgctgctgtgatccatccatcagcgtcgcgtgtgagttgtaacgtgacgcggtcgggactcggggcggagtcgttgaccaccggggagagatcatatgatatatcacccaaaaataaggaaaggaaaatatcccttttcctttccgtggagctgaaaagtttcgtcaggtcgcgttgttgttgctgccaatacgggagtagttgttgttgccggcggccgttgcggttttcgcttccgttctctcgggtcacacgcgtcagctcaaccactccgccatcttttcttctccagggcgttggcagcacaaaagctagaaaaacacgtagcggcaatatttgatatagctccaatatctaaatttagctataaaaagtttaaagtggagttattgacctatttaaacttagctccatctttctagttcattttgtgagagtttcacctagttccactcctattttaagtggagctgaaattgtctggagctgaagctggagctgtgccaaagtcccggcgtgtccaaaagcaacgcggggtgtgtgatttcaatcctgatgtctcttgttcaattcttaatagcttataatttttttttaaaaaaaactgtttggaaggatgtctctccaaatcttacttatttttttttctttttttgtgtgttcagcggcggcgccaccaacgccgtcgacctgtgcgcattagcgcatataacacatttaccggcgtgtggcggcgagacagcggcgccggaagccgtcgccatcaacggcagcaaatcctggttaggtagatgagtattctactgcttttgggcgattgaaaaaaatgagtttccagtcgtgctgcctctgcttggcttccgatccgagataatgctaacatcaacgaggatgatggtgacaactggaacttgatccacctcacaagaacacaacttgaacttgtgtgcacatttttcgctttaagaaaaaggcatagattcgtaagaatatgtccctgccggcaccaaagaaagcatcggcaacaagtaccgagagatcctcatgtttgtgtcaaaacacgacgggtgaactttaaaatgatttggaaccaaataaatccaaatacaactggttagttcaaaccatatttttatctttttgaattacaaccgtggggacagagcagcacagagccccaaaacctgcacagatcacgaggctaatcaacccatttctctcactccagcagcagggggaggaggagtcactgcctcctgttctaccgtactgtcgaggacgacgagaaatttcaaaactttggtgtcacattttctccagtggttgtgagcttttgatttgacattgcatctttgatcctatttgcagcttgattgcattttagtaccagtactcattttagtcatttgttttagttgggtttttgtgtactaccgaatgttttatgttcatcaagttcctttctttacataggcatttataatcagagttacagctgacagtgaattcagattcaccaaaagtgtctctgaaattttgcaaattgttgttctaaatctagagtatattacagtgcaagtgtacaacaactgaaagacaaagaagaattagatcaagcagcagcaagaagttacaaaaaaaatccaaagactggaagaatatcatgcattatttccagcatggccaccacctaatcttgcggatctctcagcaccatggccagcttcgccggcctgttcctccggccgccgccgccgccgccgccggcgatgtccctgtccttgtcggccttcttctccttggccggcgaagatggcaggaacagatgcccgaatccgaacacgttgatcaccggatccacgcgcacattggccgagaacgaccgctccatgcctctcggccgcggccgccgcgggccgatgcccgccgtcgccggcgagctcgagcaccgctccaggccgcggaacaccacgcgcccggacgcgctcacccgcgggctctcggcggccaccgccggccgcggccgcgcggggccgggcgggtgccacggcgtgcgggagttcctcccggagtcggaggaggaggaggccgaggacgacgacgacgaggaggcgcgggccaggaaccgctggtgatgatggtctcgccgcttcggcggcgcgtccacggcggcgggcttcttggacatgaggtggaggaggctcgccaccggcgcggagcgcgtccgcggcggccgccgcgcgttcctgatcccggagtcgcacgacgaggccgacgaggaagacgacgaggcccgcgagaggagcggctgggcgtgcgcctcccgccgcctcggactcccacccaccacccgatccttcgcctcgccgtcgctcgtcctcttcgacacgagcgtgagcagatcgcgccaccgatgcccaccacaccgcggggcgcgaggggacgccggctcggaggggggaacctccaggcacggcgggggcgagcacggcggggaagaagaagaagggggacgccgcggtggcggggggagcatcggcacgagcctcccgccggagaacagctcgtcggcggcggacagcacggcggcggccgcggggacgctgaactcgaactcgccatcctcctcgtcgtccagcagcggcgggagcgggggacgggcggggcggaacgcgaacggcggctccggcgacttcactgcggcggcggccattgccggcggcgatggcgcatcaattaagctcagctcgtgaggttggttagcggagtggtggttaactccactgtgtcacggaaagttcgctatatattcgggtgatttcgggttaacgggcgggggtgaaccggatccgataagagagaatacgaggcaaaccggtgtgcataggtcagcttcactgcttcagcaatcagcagcgcagctgaaatggctctagtggaggcgtggacctgccttgcatagtttcaggtttgcaccacagcggctaagaccaatctgattttcccatggaaaacttgtgcaaataatgtatgtgtttttttaataatggagcaaatagtgtatgtagagagctacgaaatgaaacattctaagactaatgatacaataatgaggtgtggtagatgaacatgtcgccaataccgccgccgccgcggtcatcggcggtgccaactcttattgcttttattgtagtcactacttatcttatcttaaggattatggtgttgttatttttctaagtattcattgcttgtcatatcagattattaactcaagaattcatagaactaattgtgcgactagatttagggaattctaagtagattatttgttcagctacttcctgattcatcgtgagcatattttccgaatggctaaacggtgtgcttcacaaaaaatatatatagagaagatttttaataaaataatattttaaatttataatagttaatatgctctaatcgcgcgctttgttttccatgtcactaactaaccaatcctcacctcacattcaaactaagtatcatactgctaaacttttttaaaatatttagacataagttagttgagttcgataaaaaacaatggcagaacatgaaagaaattggcaaattttactacagaatatcacgtattcgaagttttaactgtaagacaccacacaaactcagttttgagggaaaacactctttttacatggttatttacaataaacatcatgctcattaaaataatgtattcatgctgacgagacaatagggggcccgatattttacgcggagtgaccaaactgcccctgcgtgcgggtccagatcatattgagctggtttggcttgaacagacgcgaaccaaactagtctccagcacgccgacgaggcaattttgggtgtgtagtccgacggtggcgaaaactgcttcttccacaacagccaagaggtgaatactgtgtggacccttaggttactcagatccacacgaaccacacagcgaagttcagccttgcatcccggcgatgaggttggtcgaggatggtggggagaatagtggcggcgtcacaacgtgtaaaatatcaggccccttgttacctcgtcagcataaatacattattttaatgagtgctagaaaataacaacggttagagagttttttttttccttcaaaaatgagtttgtacttcatcttatagctaaaaccgcgaggtcgtgatgttctgtagtgaaatttatcaaaacttttagagcccgtaaatccgtcggtgtttataattgctccatttctttacatttccgtatccgttgtttgatttggagcatgtcctggtttccatttacaaaagctcgcgtgttgtgcccttgctaatggtcgaatgattgaaagatatgacaaagaggtcatcgtaccgtgcctatttagcatgtgagctgcatagcatgcagaggacaaacattctaattagttgggatcttcgtaatgaaaccacgatatctctcctctgactatagatgagaatcgcacatgaaactttggtagatcagatgaacgacacgttcactaacaaacacacagaaaatctgccttttttttaatcggatcattgaagaagatttaggttccattttgaacttttttgttcagtttccgttggtccagtaaactgtttcttatatgagatcatgtaatattgtcagccgacatatttcattgaaacttgattgatacatttaccagaaaaccgtgatgcaggagacaggcaataaagatgtacattatgtagatgatatacatagttgtttagttgaactaatccgaattgcggactaattcttttttctatcttattattacaacagagatacgtaagtaggcccctatacgctttcgttaagataaaacataaagaagtaaatgcgaccataagttcagatcagatcaagagaaggcctaaattccaaaatcaaaatcaatcaagaagttgctcacaagttggttagttactcgacatgccacagtaataatatactaatccagctagagatcaattagtctctgtctactgtcttggcagtttggcttactagcttgttgcaactacccttgccaaagacaaaggggaaaaagaatctagctctgcaggacatgcatgtctttattacctgctcatcaatcaaactataccaaacctactgaaatctgtcatgcatgtagaactagcaaagtactcctaccccttctttaatcatctcttctatcatttgatttttttaggtttagcatcccaagagttacataacacaagatgttggatcaatcagactccctgaaaagaagtgtggtgacttaacaccagatgctggattaattgggacaggtctctgaaagaagcttgcaacatttgtactagttgggacaccagtgcttagtatgatcactattatattaaacagtcacaaatgtttcctttaatcctctgtgatctccggcatggggggcaatccatgtgagggctatgagcaaaagatgctctaacacttgggtccctcttcatctggccgcccagaggaagcaaaccattgcttttatttttgaggccgtttggattttggaacatggcctagcttgctgctaatcactttaccaaagctttctgcatttatcaatctattttattaatccatctacctaaagacacaacactatgatacttccatgaagaatgttctctgacaagggcaacagctagcaaggccacaccctgtggcaatcatttcaactagagcatttttgtctctgaaaagtagtgaactgtaatctattagcaactagtatcaggtatgtttgtgaatcatcctctcctgctcttctccctttattttcccttcgatgagaagcataagctcaattataaacatttggtgcaggtatcggttgttaacatttaagaatgcatggttgaaccatgttgattactatagtacttcggtgaggcatagaaacattatgtctgttcttgacatatcagagtctggtcactccggtacaaaactgccttaccatcaagtgtcatcaaccactgcagatgtccgtgatgccgtaatggggaggaatccaacaagtgcagtacatcaacttctgatgaaaaatcacaagaggatcatatgttcagacttcagacagatattcatctaggcaggctgtgatgggcctgccttgattatgggccataattggacttcactggaccatcacaatgcatgctaataaaacttgcagcccataataaagcaaatgttgaacaaaacaaagcatccaaaacagatatctaattgcaccacttttgctaagaggatcattggaagatgagtaacgatcgaatctatttctcttctttagcaaccaatgaactgaatggagcaatcctttgtacatctcaaaagttactgtaaaccaaaccatctccacatttacaaattgtttgtcactacgctgttaactagcagtagcacaactaggattcaaccacgctaattaacaaaggaaaattactgaaacaacgaagataaattacatttacattgtctaagctacacctacaaactttgcctttgtatatcatcaccatttctgaaaaaagttcagaactggatcagcttatatcagctatatatagctctagctctagctctagctaagctagaacgggttccacgcctgcgacgccatggcgctctgctgcacgtagccggaggactcctcctcgctccagccaagatggaacccctccgtcttggcggcggcagcgccgccgccgccgccttgtgccatgttgctcagcaggtccctgaagtccgtcaggtccttgaacggcaatgctgccgacggcggcggccggtggtggtggtggtggtggtacccagctgagctgtcttgctcgtaatagccgccgccggtgtagccgtcgacgacggcgggggcaacgggcggcggcagcggcggcggcaagctgagctcaccggacagtgacacggcagcctcaccggagactactgcccttggtgtagccgttctgctcttgtagaacaccctgcacagcacccagtcctcctgcattttttttttgtcaaaagaaatattcagacaaagtagattaagttgtacttaacttaccattcgtgtttaaaataagatttggtgacctcaggttgggatgaagtttatattatcttgtaaagatagatagatatatatacagttcgtacgatgcttgatattgtggaaacctcaataatctgaatatgcttaggtggtatttagattcagggacttaactttagtccctgtctttagacactaatttagagtattaaatatagactacttacaaaactaattacataaataaaagctaattcacgagacaaattttttaagcctaattaatctataattagagaatgtttactgtagcatcacataggctaatcatggattaattaggctcattagattcgtctcacaaattagtccaagattatggatgggttttattaatagtctacgtttaatatttataattaattttcaaacatccgatgtgatagggacttaaaagttttagtcccatctaaatagggccttaaatcatcatttaacagaacaactaacaacttggaataaagaatctgtgctataaaagcagtcaaatccttttcaaattgttcccctacatatctaggcttgtaatttagtgttgctgatgatgcacagcgatgtagccaatcgaacaaacctcgagtggcaagcattggtgatacgtacaaggtttgggaatgattggatgggactaggtcaagtagaaacaatcattggcaagttgcataactagtttatcacatcagaatgttcagaaaaaggaaaaaaaaacagcattcggctaaagtctgtagagccaaagaaaacaaaactgtgaaagaaacatgttgctactactatcctaattctggctgtcacttaccaagagacgtgcaatcgtgggcatttacaagagtagaactcttctaacactgacgaagcttcctagtacgcactttatataagtattttctcagtacgtaattaatctaggcattagaatcataaatatttgatgcataagacaatatctaatcaacttttgaaattttaaccattcgtaatttctaaaatactagttttaaaagaaaacattggcgtgtgtagatgtgtcaaaaggaatacagctacctctgaattagaatataagcattttttatctatccagattcaaagtaaaaaatacttatattttaatacggaggtactgtggtatgaatttattagatttcataaacttattttgcttgagaactgattatcagaattcaaaatttcaactaaataaatctcgccccaaacacaaaatatttctaactagagggagtaattatttactccatccattctaaaatataggcacatctattttttaaagtagtttcataatataagacgtgcacgcacgcatgtaattaattatcacattctctcccctaagttattattattttaaatcctatactcacaagatctttaattctattggttgcatctcttgtattaattagagtgatttatgacaacgataatgatatattaattatttcttgatctttgagttaagggtagttgtgtcttatattttggaatagagtgagtacttctcatctttctctctctctcttttttcactcttttacctgcgtgatgatagattaatcactaataattactgctgagatcacgcaaaacaaatgctggcatgtagtaccttgagaagattagatgaggaggaggaggtggacgaggaggggtggtcggcaacggcatgtccgtccacgcggaactcgtgcatgacccactccgtcttgctgccccggggggctctcccttggtagaacaccagcgtcttcctcatcccgaccacctcgccgccggcgacggcctctccggcggcggcgcggcggcgggtgacgatggcgcggtccttgccggtggccttccagtagccggagcgggtggcgcggttggtgcgctgccccgtggcgtacttgnnnnnnnnnnnnnnnnnnnnntaccactccgtggcgcccacccgcgcggcgtcttctcgtcgccggcgaccggcggcgcgtgcgcgtgcgcgtgcagggaagatgatcagattgtgcaagaaatatgctaacgattcatggcaagtaaaaaaaaccatatagttcagataggtcaagtgcaactagtgacgtgaagaaatgtgcaaatggaacttgtttcaaaattaaaggaaaatcgaaacgagatctacagagatgcagctggtgctcatagtaattcgtgcaagatgatttctcaaaaatatataatttagtctaaatttcggtaacacaaaggtgtcgtggtgtagttggttatcacgtcagtctaacacactgaaggtctccggttcgagtccgggcgacgccatttttctcttttttttttctttccttcattttctgagtctttttttttggcctgaattcgtcaaagctgcatatgttctgaatatcctttttttaaaaaaaaacattttctgaattgtgcaggctgcggatgttctgtatagcctttctgaaaaaagaaaatcagatattgcagatggatgggtgcaagctgcagatgttaaataatcacacagttctttcttcaggttatgcgactgctatgcaattatgcatgtaccattggatcggtgcagagggtgcaaagctaattaatcacacacagttcgtgctgctcggagctaatcaatatacgcatctgccatcacctttccgaaagaaaattaagctgaagttttgcacgagatgatctgatccgtacctggaagctcccacggctcgcacttgttgaggtcgacgtcgaccatggccacgccgccgtagaactcgccgccgccggagagcttgtggtagaggtagtccacgacgagctcctcgtccctggggtggaaccggaaccccggcggcaggttcgcctccatcatgctgatcaagctcattgtatatattgatttgatggttaattctcccttgagaaagacacaaagagagagagagagaggaattaaaatggagatttagctagatagagaagggcgtcggctgcgtgtgcagaagtttttctaggacacggacacgatggagtattaataggggagatctatgtaggtaggcaaagaccacatatgtttttcttttattgtgccatgaaaagaactgacgcaacgacggctactgtggatgacgcacgccacccaatagaaattgctgtacttgatactatacggagttggaattttaagctcaaggcatatgcgccagtttgttttaagcatctgccatgtttgatgccataaaaaaatgtaatatctaaaatggatgggttatgaatatggtatgtttgaattgtggagcttatagtaattgcaagtatactccattagtctcttgctccatcaaacatattctcatccggattacgaggatacgtagttattatatgataaaaaaaactaatatctacaactctctccgtctaaaaatatagcaatttgaaactagatgagacacatcatagttcaataaatttagacaagtggctgtccagattcgttggactaggatatatcacatcaagtgtaatgtagctatattttaagacggatgtagtagtagttagttggacatttaccaactgtaaatccgaatctatagctccttgaatttaattagagatctaactatatctagactagatttgaatttttttttaattccaagtgtggacttaatttatcctggctcatttatctatataaaaatgatacccctatgtgaaattataatctatatttttttaaaaggaaaaaagatgtttttcccgtacaagggcatgtgcactaggtgatgttttttctccccgaacattattctgttgtagttatcctgatgtacctccaaatgtccaaatctagtaatccctccgtcccataatataaaggattttaagtttttgatcgtagtatttgaccacttattttattcaaaaaaatttatgcaaatataaaaaacgaaaagttatgcgtaaaatattttggataataaagtaagtcaaaaaaagcaaataataattctaaaattttttgaataagacgagtggtcaaaccgtgtaagcaaaaactcaaaatcccttatattatgggacggagggagtatcagtcaaacattaacctagatataacagccaaatcatatgagaatttgaagtcacatatcacatccgatccgttcagccgtcagatatcccttcccgtatactccatccgtcccattattagggtaataatgagttttcgtgtttaatcttgatcgtccatcttattaaatttttttaaaaaataacaaatacataagtcatgcgtagagtactattcgtattttatcatctaataacaattaaaacattaatcataaaaaaagatttaaataagacagacgattaaagtaggacaagaaaactcatggctacgtttaaaatgagacggagggattatatatatatatatatatatatatagtaaatttgtttggtgctccatggtgcccgggcaccattgttgaaattgagtatatacccaattcaaatgagtatgaaactttttcaattacttaggtattaacattaactactttactaactagtttaaagcaagtttgaactgaatttgaacttgtttttgttagattttgattctaggtatatagtatccatacatataattagttaggtatgtaatcatggattgtgaaataaagttaaatttgagttgttttgttgataagtataggtatgaatcaaattattataactaggtatatactcacaatttgaaaattttgaaaaatttgagtgattttgtgccattagataccatggtgcccgggcaccatggtgccccatacgagtgtcctatcgttccatcatgtatctactgagcgtcatcgccggcggtgtcactgcgacggcaacaccgccacacagtgaatctgctgtcgttggagccgacgacgaaaaattaggctgtattcgcgtggtcggcttggcctctcgtactacgatccgtgcgaaatccatgggccaaaaccgcccaagaaatgatacgcaagtacttcaacacagccgctagtaattaatggaacatcaaatcagcgactcgcgtccaaagctataaccttgatccctgaacttaaccctggtttattactagtccaaatccgccgaacaaacactgtctaatggcatcacccagcatgcgtagcaacaggtcgcgcctgttgatcagcagcaggatgttcatgatgcgcatatctccatttcagcagcgcctacctgaagaaaagttttgctaattacgtcaggaacagatggctgctcctgaatttattagcagtattatttatgccttgcattttcatattgttcactactaccgagcaactcctgacctgacggcaaacctgtgacaaaggctgcagctttcctcagtagttctctgctagttttctctgaagatttgtgaagaaaaacttgctggctgctaactattttcggcaaaaggaagaggttaacagtgataactgataagtgagtgatctagtccaagtgctttgttgtacgtctcttgttaccactggcctgcctcgaaggaacttgcacagtgtctgtcactgaattcaggcaatatgtctcactgaaagtttgaacacgaacttctcaaagtctactctgcgaactgctttcgccatctcatcgtcaggtaacaaggcacacggatggaatggactgttctcgtgatgaaatcaaaattaagaacatggggagaagaagaaagaaagaacacaacaccatccactccgtacttggtcttggtgatgactttgacaacttctgaattttctgatcgcctgataagcagttcagtggccagttttgtccagtcctctcattacaagtcatcatgccggtccttttcagggaaggagatcatcaattaaaatcaccagaggcagaatgagccacggagatctaactgagcatcaagtcaaaaattcagaaaatttttaagtacatgggagttggtctgagtaacatactgtgattgatacacctgaacaaactaatgtcatctttggcagtatgggataaaattaaggctatcaaacacgtaagccaaggctctgcaggtttcactctggtcacctcctttaaaatattaacctggtcaaattaatttaccagggaagatcatagccgtcttgcagtagatatatatctactcacatctaatcagtgtgtgattttgacgaaagcagtgaggtctgcagagcagcccgctacctgcagggcggcagcatgatatataattatatgctaagttggtgttaatcataagaacatttcctaacttgccatctcatctgaacatcacactgttactgccccctactccacgctactgaaggttgcataagtttgacagtttgagtatgatgattaaaaatgaattgagctgtaatcagctcctttcatgacatttcagataagattacgagtgtaaattaatcatttaagcacatgctgaaaccacgtgagctggaattcgctgaatctgacccaaatctgtaaattggcatcaccccataattttgtcaaactttccctgcagacaacgtcacacgtgcgcattccgacgagctgtttatcagcggatcggtgaaccaaattgccagccaactcagcaaaatcgtgttaagaaaatcactgtgctgaccatttctgcttgcttacgaataaaatagaattatttcatggatgagatgccttcatgcacgtacatacgcgtacgtgagaaaactattcaaacctaatcatctaggagtatactataaactacatgcatgctcgagtactgatacttaattagattgcttgccttgcatggaattgtcatccccgtgttgattgaacaatataattacgcttagtgcgtgcaaccttgttctttctattaagataacccacaaaccttgtccttcatcatgattgttcggcatgactatttgtcatcacaataaattcaggcaacgacatctgtaaatgactaaatgtaattgggatttttatatgaattaattaatgaacaaagtcctaatcacaattgggaatttggactctctaacctgaagaaggtaagtacatttgaaaaacaatcttactaaaatatgacacgcattttttttattgattccaataaccgttttccttatgtgattgttgtctctatgtacagtatatatatttatacctctcctatcactttacttttaaacataattcacttatatagcttattagaaaatttatgatatacttttgaaatttacataataataattagtgtgcaaatgtagataatttacagtgtaaaaacgaataatttgactgctttttttcttttgaaaatgtggtgccataaattatagcttgtcccctgaaaggctgaaagtctcaaaccttgcagatgacatttgtttttccaaaaaagagctagtgggatggacaatattttttttccatccaaaagataaaaagaaaaaggcataaagtaaatattcgtagtgggcttggagaccattcaaaggcagggaagcccaacaccaccgtggaccacgtgtcgacttgagcatattgggccgtagctctcctcctcgctaaaggcccacagctaatgcttacctagtaaaagcccaaaatgcgcttattacaaaattgccctcgccgtcgtgctctccgcctcacttccttcctccctcgctcgtccggggcggcgccgccgcggccggtggccggcggcgccgacgatctctccttctgcgggttcgcgcgtcctcttcctcggcgttcggagacgcattgcctcttccctcccctaggtaacgcgaggtcctcttccgtctaccattccgattcagtttgtgactaggagttccatacctcgagtgctcagcaaggattagggtttatccaggttccgaacttctgatcggttgtgtttggtgatgcgtggcggtagtttagtgttggatcttctccgattgatcgggaccttagtgggaaagctaccaatgggaaatgggggaacctttacgcaatggactcatcggtccaattttattggaaacatttgaatacccatcagattcaaatgtggtatgtatatgttattagatcaactaattgtttagtgtagttagtgaatgctttgttcggtatcagtttacagatttggatatgacacctgcattctgaccaatgggatcatcggttattactggtagtaattgtttttgtatgtgtacatatttgttccctacttgaccatttttgtaagttaagcaaaaataattttgtagactctgtcaaactggtatgcttgacagtttcagtacattgagatctgttagcagaagcaaagatgcgagggcctcttcggattacagtatttttcaaaggatttttggaggaatactgttcattgggatttttccctttcctatcattcggaaggcacaaacaattcataggataatctaaggaaagattcctttgctgctgattacataggaaaaacacaggaaaaataacacccactccgacctcatttttgttttccttcgcgtaagaccgaggcaatcaagcaatacacaagaacttttacaaacacaagcgaagcaactgagcaagaactatgaaggataggaataagacacaatccaattaaaaagaacaaggggaagaagcaagtcgaggttgccagctgctcgaccttgtgagtggccacagcagcagctcactcctgccacgcgcccgtgcgagctcgtcacccgaccgccgcctcgcttgctccgcctaccaccgagctcgccatccctgttgattttgtctgtttgctgctccccatgcctctggaacattggggaaaaagatgatgcggtgaatgaactgatgaatgaaggggataagataaggctttcctgtctagagagtacttgagagtagtgactagatagaaaatagtattctattgcttaattagattataatctatgaggttacttgattgtaaaattcttgtgttgtatgtattcctgtattctgaatgcttcatgtcatcaaattccttagttttcaatcctctgttttccgtatgtaatcctatactattcctgtgtttttcctgttcttgcatttttcctatcctgtgttctgaataagccgtcaaccttacaagtccacgaaaaacggaataaggaagtaatgcatgatgacaagcaactcactacactcatagctgtgttgttacaaaatgtttcttagattgtactttttgtactattaatttgcatgtcgattgtatgttcagtgatgatccattctcaaggaaacctatactcgtgtttacgatgatccagaggaagaagaggtaaactaagcatgcttttgtgcttcatttgctttatcacatgttgatatttattttaactgtttgctttactcatcagggaacgacacttgatgaagctgggaatttcaatgataacttagaaaataatatcgaagaggtaactgaattttgtccctagaaaccttacatgtgaacattggtattgtgggcaatcctgaaaattctgcagttgttgctttacctggattttcatgttgataacttgatattttcatgttgccagctctgcagaagattggaaggccgttatctccaagaaaaagagcaggaaaccttacttctgcaatgaacatgatatcagacatatgctcctgatgaaatgtttcaattgaaaaaccagggaaagagaaatcccttaggaagaaggaaatacttgatctgatgaactcgaatcagaacttagtgctgctgcatagggagcaggtgatctgctagggaggaagactgatgctgaaaagagaaagctgtctaccatgcagcagtccttgcaaaaggaagaagaggcatacaaagcattgaaaaatacaaccgaagttgaagaaaactagttcttgggtgaagactacgaagatctgcagaaatcactggagcaagcaggaagagactgcagattctggtcctcttgctgtagcaatactagctactgccagcaaagaccaagagctgcaggaggtccacacaaaataactgaggtgggagagtttgtgtggggcctacaaatgaagtttgtgatctcaggtagttccgaataaggtaacctgcctgaagttttatttaaatgaatttggaataagcatgctagagttcactaatatctcggttgtattgatattgactgtgttattatcttttctcagagacatgcgcgccagaagcaagagatgtttttatggatgaacacagtaacggtttccttcaggtcatctagcaaaaggacatgacaagttagcagtgatcaaagaggaaactaacattgaagacctgataaaagatgaaaaggcagaagatgttgaactgaatatgattgtagatgaagttgttctagttggcaatgatttggctggtgctttgcagttctgtatgaagtgctcagtgagggctcagattggggggcacaaccacaaacaataatatatttgcatagaaagaactgatgaatttgatcaagtggtgactggtgagttctcgttagcaccctgtcttacccttctcactcctgggtctcccatgcatataatgaataagtctgatgtactgatctgcatctttgagccactaatgatttagccaatttttatggcctctttcattttttccatacctctagatatgtagagtttagatataccatatttttcttatttcatgat

SEQ ID NO: 68660 - DNA, 802 bp, Oryza sativa
ctgaagccagagtgagtctacctgctgtggcaagttgtcaaaatagtcttcatgatatgccttattaataccccctgccctgacatacacatcatagtcctcagcagctgtcttgttgttgatgtagatcttgaagaccctctggttgggcttgtcatagaaaagctcacagaaatgaaggcggaccaagtaatcaaagttggggtggacatagaatcgccatgaaacattgaaccgcttgtccacaaccatgttgttgctcatgattcttgcagtctcgtatacatcaatgggagaaattgaggagtcattgtttgagagataacttacacttgaagtgttggacacaatctgagcagcattcgcagaaaacatgaatgcttcatcagtgtaccatggtctgtgcagatactgatcgctggaagaattaagtgcatgccctccaacattcaaccggtacattgtctctaggcctctgttgcttaaaccaagaggaagctgcccatttccagcgctgccaactttgtttactgtgtcattgaacaggttatctggagtgagcatcacctcaattgcattcacaaaggcaaatgacccagggcttggatcaaactcaacctgcagaccacgagaaccaactaaaagaaaatactccttgacaactgcattgatggctgaattgctcacagtgctcctccaaacaatctcctctgacacgttgaatttcgagaccagcttgaaatcatttgcagtgacatcaaacaatgaatcattcccactgaaattcccgaatgtgtcaggg

SEQ ID NO: 68661 - DNA, 7314 bp, Oryza sativa
ctgcagatgaatctggctgaaatttgaaaccaacatttggtagagctagaggagctacgaaattgcacagcatagctctgaattagccttatacatgaggaccccccggatgataagcaagattgtcaggttcagaagcaatgaaattccagaatactgtcaggtatggatgcatactgtgtacagtgcagcgtacagctggctcggatgagtggatctggctatcctatatgacctgcatacagtgaaccagtgctcactgatttgtacaacgatacgtcaactaacaggtttacaaacctagtagtacacttgagtcaatcagtgctcactagctggcacaacaatacatcgagtaacaggtttacatacaattattgcagcggagcaaacaggacaggaaaaccagacacaattttgtaagccgtagaaaagagaaacaagttcatccacaggagtataagagaaatccatgcagagaattgcagtaacaaattatagctcgatgaaattagtaggtggtaaaacagcctcaacaggaaactaagataatgagacatacttcagttttacaagcaaaactgtttgggaagtaaattcccaggtaaaactttggtacactcaaggactcgaccatcattgattgacgagaagatggaaacacaacagcagctgtaagcaagtcatccattgtgttaagagacggttatcactggatgactggaaaacatatcatactgagaccaagactgttaaatttctttttttccccttttagataactaagcaggaaccaccgagttgtagtgctcaccaagaccataggcatgtctgtgataggacaacctaatgctagggccatctttaccacctgaatccaatttgtattctttgcccatttccacatctggaaatgagcccgagtatacaacaatgcgcttcttcaggcagtgggttagagcaccaagctcaagttgcccaccccaagcagcagttgactcaacctcctcacagtacctcttgaagctctccaagggatctggtccagactcgaccttgccctctgataggaaaaatgggagaaaatctgccgcatgctctttcatataattggcagtcatttgccgcagctcctggtaattgtattgtgtggtttctctggaatagagtgacagctggttctcaacagcacggtacaggcagtggccatctggctttatctcctgaatggtcagtcccatgggctcaagcttcttctcaagcttttcattttctatcatgcggtcactgacaagattgttttgctcttcttgaatccgctgctctctagcggcctcttcctttgccttcttctctcgacgccgtgcacccttgctaggcttcgcggaatccgcgttgctggtcacagaaacaccagctatagcctttactaaggtgtccatgttccccttttctgagctgcctgaggatttgtaccccaagtagcgagctctgcggcatgtttcgcctctaactcagctgagaggcgtgaaatctcctcctctacctgcttcttcttggccttctgctcagctttgctgcctttagcggctgctttcttgaggctcggttttttttttttggagctttggcatttctctttcctgtttaatacaaagagaaagaggacctcaacttttagaaacaataccatataattgaaaaggatccaacccacaatttgtgaagtcatgaaatcaacaggaaacgaaaattagagaatatatgtgcttcttattgctttaactgaacaaattaactaatggttcacattctacttctaagaaaaaaaatgctctgctgctcttcatatggttaactaaacaacccaaattcttgcaagtacttcactgcaactatttttttcctcctttgaataagcatatgtaagttttaaagaggtgttgcaaatacctatgaactggttgtagctcaaaagtagaatgtgcgtggaacttacaaattaactaatgtatttcaatataaggaaggttctgctatccaagaattgtgtatagtagagataaacaagcaacatgacgttacacctaaaaatgggaactttcctgaatataataagatccttagatcctcatcatatgagaaaaaagatagtaactactacgggcaaatgacatcgataatcagcattgaaaacactcataacatcagtttcagtggaagtcgctctggtggagcaaccctggcactacagtgtatgtggtaaaacgaaaatattatcacaaatgatgaaaatactagtctctgttcctcatctttggtgagcatatccaccatcacagaattttagagtaattttactcatggtaatagaatttctgttcagcaatctggtagcaatttcaatttcaactcatctaagcagtttccccgaataacgccgctttaatggagaactcaatctgacactagttgtataattagagggaaaaaaatgaatatgcgtaatgcagaaacactattgcgaatttagtcactgacaaacctagggcacttttagtcgaaatgcatatttttcttactactaagattccaaggacaaaccactaagacaaatctaagtagccaatcaaaatcatgaacaaaaacccgacgaacaatggaaaattccaaccttttttacagcccagcacaaaactttatccaagtcgcaattgggaccaataaggcagcacttaataataaacagcaagataaaaattttatcccctaatttgccaatgggactaatagcgcaacacttaataatcatcatcatcatcaacaaaaacaataatgggaccaataactcagctcttaataatcaacaacaacaagagtaatcctaaatcctgccgtgccgcagcctccgcccaccagccacgccaccgcgcactgcatcgccgcctccgcctgttgctctgctctgcggctctgctagggttcaacaactcgggggaaccccacagtcagcaagtaaaaggaagcccgatatagcccactggtacgacccagcatcacaaagtccctctccgcctctcctcatcaatcgctcgcagctctccccttcatggcgatacggaggacggcatcgaggttccggttcgggggcaggcggcgagatcgaggtacggcgaggtctccggcacatgagcacacacggcagcagaaaaagaaaaaaaaattgaagggtacaaagccaaagagtaaactaacctatgcctcgagagcacctcctcgagcgtctcttgctgcgattcctgcgctggctccgccgcggctgcctcgccgccgccggcggcggattcgtcggctagggtttcgtccattggcaaacgatgcaaaactcagttcaggcgaaggaaaaagaaaagagaaaaaaaaaaggtagagaggcttttgtgtttgtgggctactcgtgtgctcttgcgggtcttgccccaccttatcggatgcggatctgttactcttgcgggtcgtggattgtcacgatgcttcgcccgtttccttgtctgacagagactgggcgattaatctgttcttcttcagagattctgccccttgtttagatccagattctgccccttatttagatcagggtgtaaagtttcatcgtgtcacatcaaatattatatagagtgttacatggaatgtttggacactagtaaaaaaaataattacagaatccgtcagtaaaccacgggacaaatttattaagtctaattaatccgtcattagcaaatgtttactgtagcattattattatcaaatcatggaacaattaggcttaaaagatttgtctcctaatttagtctcaatctgtgcaattagttattttttagtctatatttaatactttatataaatgttcatacgttcgatgttatagtgtgtaaaatttttacgtgagaaataaacatgaccttagatcgttttcgtgtttgatgtggactgaactcttaccttatacttgtatgatgtgcttagctagatttcaactcctaaaaccacctactccaacgttttgatttcacgcgtctcacgcgaagatttccggctgtttctaaatccgttaatttactgggacgacaaaatggtttttcatgtcgaattgtgtctagaatagtcggagctagttaatttaattcttcctgtaagtgctggtttgaccatgttgaaaacatgcacgagtattttgaaagccggtggagttgaaactatttaaaacatgcacaaaagagcatgggaacgagtaacttgaccaaagttatggaagtcatatgttaagaataatccaatgggttctccatgctcaaagctggctatttttcgtgttcattcctaataaagaggttggcctttttcgtatcaagcaactatgtgatgtgtttcgtaaatacagctgtgtcacggcctggaagaaatcacctctcacgagttgtccgtctcgttatccaatttagcgcgtgcttagttcacgttaaaattaatagtttaattgaaattaaaacgatgtgatggaaaagttaaaaatttgtatgtaggaaatttttaatataatgaaaaagttgaaagttcgaaaaaaaaaagcgctaaaccaggccttaaccaggccttatccttgtgcacctggtgacaacacacttttgtcaacagggagagagacgtacggcagcacgtaacgcgaacacacggcttaacgtgtacagtacggctcagtactcacgtgcacggtggacgtccgtagtacctaagtctgacggatttgatcgatcgaaccggccgtccaacgacgcagcacgcgttcggtttggatacatccttgacgttttaacgacgacgtgccatgcaaaccccgccgtcgcgtatagtcgtacgcccacggctacgtacgcacgcacgcatgcacgcacggcccgcgcgcgcgagaccaaccgagccaacacggccgcgaccgcgaccgcgaggttgtgtgtgttgggagtgaaacgccgagacgtacgcctgatcaccggttcgctctctgctgtgctgcctgccacgcgcgcgcgcgcacggtgacgctgacgcagtgcaccacggtcacacgcagtcacccaccgcagcacgcgtgccgctgttgtttttaccgcgccctgcgttacgtcacgtactcaaatgggtgctcaaagggcataactactccctccgtcccaaagcttacgctgtttgaccatttgtcttatttaaaaaatttatataaatataaaaagcgaaaaattatacttaaaataatttggataataaagtaagtcaaaaaaaataataattctaactttttaataagacgagtgatcaaacagtgcaaacaaaaactcaaaattccttatattatgagacggaggagtagttagtttggttcattcctgataattatttgatccgtgagtagtaccgtcatgtttttttttaaaaaaaccattaccgtcttgtgagtttcgtcaagatataggagtagtatagaactctgtaacacctgagttccaaaggaggcttgagaggggaaaagaaaagttaaacactcctatggtttaaccgtgacacactgacactcctaataaaatctggtcaggcaacgtttggctttacttttaattagaaacacactattcatcatgacgacagacgagaattgccactatcattcaacgactcgtcaggactcaggagagcttcatctcgttttcctactacccgattaacccgtacgcgcagcacctgtccggcaacaattcaatatttctttttttatatatagcacctgtccggcaacaattcaatatttcttttttttatatatagcacctgtccggcaacaattcaatatttctttttttatataaaggagacgactattcaatatttcaacgtgaccacaaacgtctcagaacatgttggaacgcacacgacagttgacagcctgaccgccgaagacatacgtcggcacgcaacgtcgtcgtgcattgggaccagggcacacatccgcaccgccgatggatcggcgcaccgtgcagctagctatagcgtagcgttccactccactcaccatatacacgttacacgtacccaaagaccggtcgaacgaatcggcgtaatacgacgacggcgcccgcacgcacgcgcgcgcgaggggtttggaccctttgacgacgcgacgggccaaagcttagccgccacgcgggacaccgtcacacaccacgcaaacccgtactatgtctatgtacttcatgtcagtatgtgcatcgccgcgctccgccacgttccgcgaccaaccgagccaacacgcgaggctgtgtacgtgtggaaggggaacgtacgctagctgagacgcccgcccgcctttcacccccgggcggcgcaccgccgcgagtacgtacgccggctgcttttccacaccgccgtaggcacgtataagggctggtttggtttgaggcctaaattaggcttaccaatatttagtaattttaatagtgtttagtttctatttggtttgaagctaaattttaacatgcctaagaaaatagaccatttcaatagtaaacttaggctattttgacttcaatccaaatacaacttttccttaccaaaattagtcatgccaaaatttggcattgacaaaatttggtaaggcctatttagccataaaccaaaccaaccctaaatgcgcgggcatgtgggtacgcgctatattaaacgcaaaatctatttccagaggcatctcgatttagacttaacgagcgacgctgacaattacgtgagaagtactagtagcattacagacatgcatataagtagtttttgctattaggttgtgcattttttttcttcttatgaaattttctcttaaattacttatccgatatataatccgattacaccgttgtgttcataacaattaaatctttacaacaagatctcacatgattatattttgatgaaaaatcacaaattacttttatgatatgtctaaattacttttagatttcactaagttacttcttagacatacaaaagtaaattcagtaaagcctaaatataatttatatatattatagaagtaacttagacaaaacgaatgtaactttggcatgtcatttgaagtaaatccgttgtagatataaaaacatggctctatctagaaattaaattaatcagcacatattatggaattaactaaaaacaataataaaagtaatcacctcagagcattatgaatgtatagaaagtattttaatc

SEQ ID NO: 68662 - DNA, 6066 bp, Oryza sativa
tttataagttacttctataatatatgtaaattacttttaaactttactgaatttacttgtgtatgtctaagaagtaacttagtgaaatctaaaagtaatttgtgatttttcatcaaaatataatcatgtgagatcttgttgtaaagatttaattgttacgaacacaacggtgatatcggatcgtaaattggatgagtagtttaagagaaaattgtatttgaattatagatggatgatatttcttatagatggagtggtagctggtttagggggtgtttgggaactagggactaaatttagtccctctcacaaaattataagtccctatggtagggactaatgtttttgtgagagggactaaagtttagctccactttagtccctccaaccaaacaccaccttagacaaaccaactaccactagcagtgtagtcacgtcctatattaaaacatggatataagagaatcattaaaaatagaacagtactatatctaaggccatttccaacccaacacactagacatagtttccataaactccacatcatcaagaaactagtactagacattgctcttccaatacaaacaccactgttccatacttaaatttaatgttatttatctcacatgatgtcttggatgttgtgtagaaaccatgtctcatgcaaaacatggtgtcattctcttttctcatttattcacttgccacatcatttttcattttaggtggtaacttatttaatgttatggacaccatttattaggttaggaatggcctaatccgttcgaacgacttccttgacccaagttttttttggaagtcagatgttaaaaaggaccaaatggttgccaagagctaattaattggtgctcattaacttctggcgaagagatgtgttcaagttcaagttcaacaacgtgtgctgatcggtgagcaactgtcgcgtagagatacgtaacacttgtcgcaataaaaaacgttaaaacactagtacaatactcccttcatctctaaatcaaatatttgacgctattgctttttaaaacacgtttgaccgttcgtattattaaaaaaattaagtaattattaatttttttcatattatttaatttattgttaaatattgccagctctcgtttgttgtcaacttggcactatcattcatcaattttgtaatagggcccgtgcacacctatctgacaaccattcaatattttgggctgttcaaattgtaatcaaaataaatcttattaaattttgacaatttaataatattgttaaaattttagtaggatttcttatatactaaagttttgcaaaaactctaccaaaaaataatatgatttgaaatgacatcaatatgaacaagccattcaacgtattttttttcataaaaactaatctaaaactaaaacatgatgtttttttaatatacattgtactaataaatgtcatatttcatcaatagatcgttctttgggacagtgggaataggagcagcctaaccaccaaccgacgtcccaccacatgttggaatgcatatgacagttgatcacagtctgaccgccggagatgtacgtacggcggcagacaacgttgcgtgggggtcggccactcggctggacatatccgcgccatcgatcgatcgtgtacgtacggcgtcccactactcaccgcgcatagtactgtacacgtacgacgtatactactcctacctaagaccggtcgaactaatcggcaaaatacgacggcggcgccgcacgcacgcgcgcgagcctttgacaacgcgggacgggacgggacgtacacgttcgtcgatcgatcgatcacccacacgccaccacacgtccacgtacgttgttgtgttatgttccaaatttatttacatttaataaaggctagctccacgctaaaatctcgtgtttttatgattgatttattattatttatcgtttgtttgtatatcgtttcctaacatacgtataactgccgagccaacacgctcgggaagaacgctcgcgcgcgccggggagacgacgagaaaattggagaccggtatgtgtgacagcgagacgccttgcccccgcgggcgtacccgtacgtatacggagtacgttcgtacgcgcgatcgcgaccagcgatgcgccgcgactcgcgggaccgatcgagtggaccactacccgtacgtcctgcgcctgcgtgcgtccgcggctcggcggctggctgagctgcgtggatcgctgtagcgatcgatcgatcgatcgcccaggtgaggtggtgggaacgcacgcgctcgagctcggcaagatgtggtattatcagcgactgcggaattttcgttttcgctattcccaagtgggttcttccggtcggatgggcgggcgggtgacgcgccacatcacccacagcaagtataatagaagtactttgtagtgaggataattctatcatacacttatacgaagagtgtgagctcttatgtaaaactagcttaatacatgttacaagacaaatatattaaaattaaagctaatcttataattaatttattacatatatatgttggttttaaaatatgcaaatagctggtagtgagctcttaaacttgctctcagccgcgttcgtcagcaactttgtttattcctctattctcctgcgaacgacacccagactgttcctattgaacaacaagctgacatttttgaacgaacagatagacataacaggcacatgcacgtgcttaattttgtttgctgtgtacgagtagtatctatagcatggatctaccaagcacgagcacatgaggtgggggtgcgaggtgcagctcacctggcatgggtgccggattgcttttgaccataaaatgataacaagctgcatgtgatctgatctgtgttttttctttatgctttacttactccgtgttctgcgtggattttgctggtcagtacgttcgcgctagtatatacttatatcgacaatcagttggttaatctaataatctctcggactttgtatccaaccgtctgaattttggacccttgtcgcacacattgtatttgtatattcagagtaagcatcgggcacctctcaaccataagtacgcggatagagaatagagtagagtacaaaactgatgaccaggtacacgtgatacgctactcctaactaagctaatctagtggccggtgttgtgcctttaaccactttgcacgtcaaaatcacagagactccatcactgatcagctaaaactgcactcaaagaccacatcacagtctctgtctcctcgccctacggcgccggcgagcgagccaaaccgagcgccacgccatcgatcggttttcagaagtaactcggtcccaattactccccgtgagcaacacgaattaaccacgtgatgtttaacgcgcgattaagcaaaggaattagcctgctcattaacaacaacttggttctggagtccatcctctcggtctttagctggcgttaccgcttgtagggatttctcgagagtgtagcgtggctttgccttttcctgctgtttgtagttgtgtttagccgctgtagtttattttttagtttcaatttttgttttgctttttctcccttcttttgacataggccagtctaactgattgtgttgtgtaacaaaactatctttattctaatgtatcgacgtgtaattcttttacgtgaaaaattgctgattaatagcggattcgcgtgagacgtgcccggtggggggccacgtggaagcggacgtggacgctggacccggtcctggctgcttccgcgttgctgctgcacacgtccgcgtacacgcgggaaaacgaacgttaagcagttagctccaatcctcccaaccattttaaccgacttctccttccacgctagctagctcaaaccaccacacgaggcggcctctgatctctatatttgtttagaaatattaggagagaagcaaaaaaaaaaatcggaggaggaggagcttagagagagaagtcaaagactctctccttctcgtcaccttcttcctccccacgccgcgctctcctcccctcttaaaccactagcgccgcctccgcgctctctcctgcctcctctcctcgcctctcctcaccctgtgggttggtcggcgtgtagctgcttgctttgctctcactgccggggctcgatctgcttgctctgcaggtgattcttgcgttcttgttgtctgtgtgtgtggagttctttctttttcttttatttttctggtttggattggttggtggttggtttggttcctaatttgggggcgtttgagtgaggatgaccaagaactcgttaggcttttacatttgtttctatgtggaggagtatgttgctgggttcctcgctctctatttgcttgaaattggggatcgattgcgcctttgcgggagcgacctcctcccgttctacgaaatcgagttccatggatgtgatgcttggtttaggtcagcgggaagtagaaaggggataccttttcttgtgtttgtgatgcatcatctcattttgatgcatgcaagatttggtttctgtagctgcaaatccgatttttgttaggtaaagctatgaggcaaatcctggcttgaaggaaatgctagttactcatcggcgtatgggaatatgcagcttgttgctttcttgtactacaaaagtataaatagttactcaactgctgtgcaattgcggaattagttatagatagttagtattactgaaaattaacaggcttttgctctatatctgaatcgaaattcatttccaacgggtttggttgctgcaaaatttccactcgtcaacggggatagttggtccgttgggtctatcaggcgctattcctttcagaaagacaggattaaggttgcttgtggcaaccgacgtttcattttcttcaaattgctcagcaaatggggtggatgacttctgccttgacttggttttaagtctctttacatcttctttcttgggtggtttcacatttttatttctttccatcgtactaaatgtagactttttgatagtaacttgagccattaatcaaacaagcaaagatgtggtttcagtgcagttggtggttatcgatgcgcaaattgttgtttaaacaataacaactggcatgtggggtcattaacttgctaagagtcctgtacacctcattttacgttagtttattgttgcaatatgaatttacagttgttctgatggctatttacctttgctctgcagaaattctttccaattcattgcttcttgtggcctgtgggcacctctacaatttgatttcagatggattgctgctttatgttcagaaaaaaacaacctgttgaaggtgatgatggtgagcagcgtttgtatattagcacgcttcttacctgtattgttcaaaacaattcatcattcttacatgcttgagtttgttgttttgttgttccaggtgaacatagagtgaagatattttcttacagtgagttgagaaaggctacccatgattttagtggggcaaataagattggagagggtggttttggctctgtgttcagggtaaatatgtcttacattttgttcaccctatcagtgtctcatgcccatagtgtcaaaacaaatcatcttacatttcattttgttaatcagggagtgcttagagatgggacaaccgttgccgtaaaggtgctgtctgctacttcaagacaaggcgtccgagagttcttgactgaacttacagcaatttctgacatcaagcatgaaaacctcgtcacacttattggttgctgtgctgaaggatctcataggatccttgtttacaattatcttgagaacaacagtcttgcacagacattgctaggtaacacattattcttttaaaaaaagcaagtagtaacacattattttcccgaacttgtcctttaccaactccttccttcgctgccatacttacaaatgttctggctgtgatattacaggatctaggggtagcaacatccggttcgattggaggacccgtgtaaaaattgctgtgggtgttgctcgtggaattgcatttt

SEQ ID NO: 68663 - DNA, 923 bp, Oryza sativa
atatgaggcaggctaaaggacatatcggcaaatcccagttcactgcttccaaatgattcacagtccacattattacgcttgtaagcttcatggagctgcagcacatattccagatgccacaagacctcacccatcgatggcctgcttctcccatcatcagcaaggcacttctccgcaatttcaccaaacttcttcaaggattcagatgaaaagtcaccgtccagccgtggatccactattgcatccagcgaacgctggcgctgccatctcattgcccactctgccaagttgatttgatcctttggtagagtggggtctataactggtctgccacaagcgacttcaaagagcaccactccaaaagaatacacatcagatttttgtgtgagttgctgcctccggaagtactcaggatcaaggtacccaaagcttcccttgactgctgtactaacatgggtctggtccagtgttgggccagttttagacagaccaaaatctgctatctttgcaacaaaattctcatccaacaagatgtttgtagtcttcacatccctatggattatacctcggtctgctccagtgtggaggtagtgaagcccacgagctgcaccaatgcaggcatcaactcgttgcttccatgtcagaggtgggaggtcacttccataaagatggcttcgcaatgtccccttggccatgtattcgtagactagaatcatttccttctgctcttcacagtagccaatcattgcaacaaggtgccggtgcctaagcttggagagcatctcaatttctgtttcaaattctttcaagccctggccacataatggatttgcacgcttgattgccactgtagtaccctcatcgacctcacccttgtaaaccttgccaaaaccaccagtacccaataagcaaagcctcatcaa

SEQ ID NO: 68664 - DNA, 1799 bp, Oryza sativa
cgagaaccaactaaaagaaaatactccttgacaactgcattgatggctgaattgctcacagtgctcctccaaacaatctcctctgacacgttgaatttcgagaccagcttgaaatcatttgcagtgacatcaaacaatgaatcattcccactgaaattcccgaatgtgtaagggaagaaatgcagcctgaggcagtagttccccggcagcacgctgaagttataccaagatgccgtgctaaagaaacgcgcggaatggtacaccagtccgaagatttcattgccattgctgctcccagcctgcgacgcagctattccagggctgcttaaggtaaaattcagcccgggggccatgtcgccgatccatctccggccgccagcatccacagtcgcgtttgaaccacagctgagaagcaaatccctcccatgaactcccaacaggtgcaaattagcaagcacgatgcttgcaactgccagcgcaagtagcctcatctgtaacaatcaccactccactgccagattttagctcttgcaggtctcatttagactagagcaagcatctgcaccctagaaatcaaacaaacggaaatcaggattcaaccgctagtgctaccaaaaagtaccgagatcttttgtggctagatccatattatatataaacaccgaatcaaacaaacagaatgaactgtttctgctcaacgattcagtctatgcctagaacacatagcacgaccacgaaccattccaaacagcaatcgagcatctcgaccaaccgacgagagagagagggggagattcgcattaccagcgaacgccgaggaagaagaccgcgcccgccattgcgggagatcagtcccgcccctccgctaccgtcacacgccgcgggagggagaacaccggaggggaagcacagctgcacaggaggcggagccgcgcgccggccaaacagagcggaggagcagccgcccgcggccgccgtctcaagaagcagcagatcggcgcgagttgctggctggcggcggcggcggcttggagaggcggacgcggtagcagcaggcagtggcggcgtggccgcgcgcgggcgcaggcggcgatgggcggctggggtgaggagcaagagaggtgcagtggagtactgcagtgcagcaagcaacagtgttggatgtggatctgcggttcgtgggctcttcttttggtcaatcgaaaggatggttattagatcagtggagcatgtgtgtccatgtagacaaaaataaaattatagaccatctcaaaaagatattgttataaagttatgtagaaactagatggtgctaatttaattggaatgctatgtagcactaggtattcgggaattagaattgtactatcattaagaacgataatatatgttttgttttgttgtttattatgcttttaaatttagtagactgtctaagtaaatgtgagttaaaatgaataatgtgtacttattcggccacattgacatataaatccggccatcctctatttttattatagagtcattcctccgttcatcttttaaaagagaagatggcataaaagttagtacaaaagaagccaccgttaaagctctagtcgattaggatattattacccattcgttcaggttataaaactttttagcattgtttatattcatatagatattaatgaatctaggcatacatgtatatatctagattcattaccatatatatgaatgtgtgcaatgctagaaagtcttataatataaaacggaggaagtagaatataagaatttccattaatcacatgtag

SEQ ID NO: 68665 - DNA, 1649 bp, Oryza sativa
atgtggacaaaaagaaaaaccaattgcacagtttagctataaatcgcgagacgaatcttttgagactaattaggccatgattagccataagtgctacagtaacccacatgtgctaatgacggcttaagtaggctcaaaagattcgtctcgcggtttccaggcgagttctgaaattagttttttcattcgtgtccgaaaaccccttccgacatccggtcaaacgtctgatgtgacacccaaaaatttccttttccccaactaaacacagccttaggagttaggatgcctactgtagttgagtggagtagtagtattgatgtagattttggttttttttattcactctgctggatacttgatgtcgacttgttaacaacactataatggtaacaacatgcaagctttcattgtgatgagggcgataagcaattgcattagctagagtagtgttttatgtgtaaaagtagtataaatgcagatgatggtagggaaaatcaccactgtagagtcaagaaaatgatgtttgctttagtcattaggacaaattagaaaacgaaattcttaccaataaaacaaaattattatcaagtctttcagcaagctttgtacatgtagcgcaaactaacttcattagtaagagttaacatagtttagaacattcttttttcacaattccagcaaaaatcaaatccattcccctgtggaattaatgatttcaagtaactactatgctttactctactcccttcgtcccataaaaaatcaacttctagagatgaatctgtacaaatgcaaaggtaaggttttagaagtcaacaattaccttctccaattcctcacattgggccctactagtacagctaaaggtgctactttccctcctgagaagtggggactggagagagtggtgttctattctcttttgagagagagagagagagagagagagagagaaatttctctgttttttttttttgagagagagaatccagtcacattcccttgggtgtgaggtggtggtgggtcacatgcatggaggacttggagggtgaagcaacacatggccctgttccttccttcccaattcacattttgtgctgaatctgaatgccattgccatgctcacatgaatagctacccgatcactcttcagtctccacattgctggagttcattcaccactggcaatctggcattaggtgatgctgtgattggctgattgatgcgtcaggttaggtttgagagagagattggtggttcaagaagaatatggctttcagtgttgagatttatccttttatctttgatcatgcagtaacaaatgaaagcgatagccgttctgttatctgaaaatcaagtggtgttaggtgttcaaatgctgtcaatgaatttcatttcatggtaaagacagtgtcagttgttcaccgacacaagtaaattcacaaggagagagtgataagtagaggccaaattgctgccgacacatggatttcagagaggggaaaaaaaatgacgccgacgcatagtatggatgccccagaacaagattttccaacctctcccatcaattattactatgcaaattttttaagcatcttaaagcaaagataaagacttgcacctgtcaagtccaaccaaaacgcagtttg

SEQ ID NO: 68666 - DNA, 1238 bp, Oryza sativa
ggtgttttatctagcccagtggatccccaaagttctttcgttctgacttgaaattcacttctgttcagaggatacctggcacctgaatacgctatccgaggccaggtgacaaagaaatccgacatctatagcttcggtgttcttctactggaaatcgttagcggcagatgcaacaccaacacaagattgccttatgaagatcaatttcttctcgaaagggtaagttcccatcatcaaactgtaaacaacaaaatgaactcagtttttttcttctcatataatcaactaaattagaaacttaccaccaaatccaccatacaaagaaacattactgaatgcgagaaaacctgcagacatgggtacgctacgagcaagaacgcctggctgagatcatcgatgctgacctggggaatgacctggacgtcgacgaggcatgccggttcctgaagattggcctgctatgcacacaggacgcaatggcgcgccgccccaacatgagcaccgtcgtcaggatgctcaccggggagaagcacttctcggtgcaccggatcaccaggccggccatgatcaccgacttcgccgacctcaaggtcagcagcagccagcagaaggagaacgagacaacacggtcatccaacatgagatcgttcagcaccactgatgaaacggagcctttctcatcgtcagagacgccgacgcagacgtctatctgaaaaaaaaaaacaagaagaagaactggaaatgtggagacaggactagtgttttttttgtgtttgtatattattgctccgaaaggggataggattacgttcaatttttttttctctttttggagagagtttcgtgtttgtttgatttttgtgacgaggagatgtttaagataggcagcgtattgcttctcgatctgggtgtaaatatctcgaaatgaagatgttcaaagcctcaaagataagctctgcacgattcacatctctgagttgtcatcagtctatcaaatttttctctgcaacgaactaacaaaccacttgaccaaatcatacacaaaaattgtctgaactcaaatatatttcagaaatgagatcttagctcgaagctgtacgtatgccatggcgtctgcagctcatcatgctgatctgtcagtaggaagaaaatgtccaaagggtggcaacatcacacacacaattgcattacatggatggtcaagtggaaacaagtctctacggacactgacgttttgg

SEQ ID NO: 68667 - DNA, 7119 bp, Oryza sativa
ttttgaagttttggtgtgtcatatcgggtattatataaggtgtcatatgagatgttcagacactaataaaaaacgaattataaaatctatcagtaaacaacgatacaatgatacaaatttattaaacataattaatctgtcattagcaaatgtttactgtagcacaacattatcgaatcatggagcaactaggttaaaaatattcatctcgcaaattagtcgcaatctgtataattatttatttattagctcatattgaatacttcatgtagattcactaaacatggtctatatctaccacggatacagtagtatacgtagcacggcagcacggaatcaagtcactctgccagcagcaacagcagctgcagctgcagctgatgagcctcaaccgaatcgtaaagctactccctggcattgccagatatacacagctatacgtgtacacatttatatactgctactgtgtggtgtgtgcatctatggaacagaaacagaaagcttttcttttcttctttgttgttgcaggtgagagagtgttgtgcgagtgtgtgtggtgttgttgttgatgtgtgtttgttgcagtgcaggctacatggggcaatgtgccaccctgtttgtttgggtggggcctccccggccgggctaagctaggctaggcggctcccggatgggcatactagatctgctcatttccatgctacagctagcgttatactcgcctactactactccacgccagcggatgagtacgtaccattcttcttcttgggccatctcgtcgtgcttgcttctcgccttgctacaaccatattccatcatccatgatagttctttgatccattcgtgttatcgtgtcctgttctcttagccaggcatttcgctgcgtgactcaagggttcgctcggcttgaagaacacctacagaatccaaattcctaaggatcctcctctcttatgagtgtctctcggtctataggaacgcgggcccaggaaaagtcaaaggaatgcgggtctattcccctcttccttctattcctttgcgcgaaaacccctccacaactcatacactctaacggtgtgtatatgtgtaggaaagttttttatgtgatgaaaagttgagaacgaggggaaactaaacacagcctaagtatttctggctatatatgtgaatggtgttggttgctgaacgaattttggaagaaagcttcacaaaaattgaggcaaatgctcattgatatcctactagtaataaaagtcacattcattcacaacgtacagtttgtttcccaggagttttgtccgttacctgaagtacgatctctgactttctttttgcgtacgttggcacgagcgatccgggtatacggatgtaaacgtagtaataataataacagatcaaacttttctcttttctttctcttctcctttttatctcatcggttcattgctgacatcacctaactgcactagctcaacccccccgccccaaaaaaaaaaaagtttcagaaaagccggagggtcaaacgctggtgcggtaactttttccgcagtcggggtcaaacgtgtgactgttcagtaaaaaaaaaaaaagggaattggccacttggaagctaatcgatgggggcttgaccagccattagcgagcgcgattagtgcgtaactttcacgtttaccggggcggtaactttacccggttgagaagacagccgtccttatccacaccggacagcctggcaccagattaaacaaatgtaggtggaataaaatacagacctctcggttaataaagtaatgttttcctactaatgagtctatagtttctctcactacaggtaataataaaataaaatactctactatacatttttttggcataaactccaggtactgtatgcccgtgcagttccaatccatctctgatcatgcaccgtcctcttaattttgcgtaaataattcactatattattgccttttgtttggatcaacctctctcatatcaggcactagaaataattgagggataatgcattgttttttatttttatattctattaggtggtataaattttccatccgaaaatataaaaactacgaatctgaacaaacattaaatatctcttccgatgatactatatttttatatttttgggacgatgggagtactgcataacagtaatcccatttccctcttaatataaagcagaaaatcacgaataaataatcacaggataatgcggcgtccttttcatctgtctgccgtttcaacgtgcgtaaattaatttggtcgtgcatggcctacaccaagtggtggctttcggtcaccacctctctctctctctttcattctctctctctctctagagattcttttccattccaacctcgctgccctgaatccaagagaagaaaggaaagtacactgtgaaaaaaaaaacattccattataacaagaagaaaaaaaaaagagttgagaggcaggaaaagaagagcaaagtacagccagcctcctgcaacatgttcagcagctgtgcttgtgcgcatgcatggtcgtgtgtcctcgtcctcatcctgcattcactcaaagattttccattttgtcttggattttacaaaaaaaaagagacatgttgattttacttcagatttaaaaactagtgaaaattacacagaaattagtacttgtattatatatatcagttcatcctcatcctgcattcactcaaagattcttcattgattttacaagaaaaaaaaagtagacatgttgattttacttcagatgtcaaaactagtactagtgaaaattacacagaaatttgtactgctagtatatcagtactgcaaattgtactccaaggcagaagaatgccgccaataggaagagtggaattttttaattagtgggggtggtttcgagataacagtaggatcaagcatgtttaccgaggtggtaaaaaaagaagcattgtttgtgtggtgtgatgaaagagaaggcaagaaaaaataatactgtaataataaagaaagggaaaagaaaagggaaaaaaaaaaagcaaagctttgcaattaatccatttggcacttgagcccttgtgtgggcttaagcacatggggtggggggcacatatatatatgcggctttccccctagccctccaaaacttgctctccatgccctccccgtctcactgacggtggtccccaccgccccacgctccccccccgtgggccccgttcgtcggcgaccgaccgctagctccggcgaccccctccccgccgacgagatccggccgtctccggtgagctccccccccccactctctctcctccccggcgcgcggcgcgttgtcccacgagaaacccgcgtaaccgctctcctctcttgcttccttgtggcccgtgcgccaacgcgcaggttttcttggagccgctcgtcgtggctggggtggcgccggggggaatggaggcggccggcgctcgcgcgggcggtggcggccgggatctcgccggcggcgcgcctcggtgaggtcaggatgtggctcaattctctcgtttggttgcgaaggtctttctgttctttttttctctctttttgtttggtgagtgcttgagctgaagtcgtggctcgtagatttagaggaaagttaattctgttttgttgtgagttagtggttggtgaattagttggggaaaacgtctgcattttttttctgtttggttcagagcgagaaaaattcgagatttttggagagctttgtgtcatggagagcagcaaccagatgtggccgtttcttttgcttgcggatgtttctttttttttgggtgagaatagagaggtttttttgcttgcattctgcaaatcttggggttattttctgttttgctggattttcctttttgttaggatagataattagttgtcgtcttccgtgtgaattggtcaggtcagatagccaccttagaggttatttttttcttgtgttgaatccaaatctagaactagcagatgatagtagtaatgtactagccggtgctttggtacaaagtctaattattcctctgttttagatgaaacttgatggtagaaatgttttggatataatttgtttcttgaggcaaatgcttttttggatcaagttggctaagaagcagaaaccagtttggatgcccaggctagcagaatcagccatgtaggcaaatatttttttgttggtatcaacaataaaaaatgattgcatatgattactaacggaagatttggaatcgttggtcttagtggtacaaaattttagttgtttacttgattctgaatacgccaaagctgggggaaatatatatttttccatcaaatcaactctgaagatttttttagtgaaataaatgtacctattaagacgaacatgcctagatgagtccattgtttaactctgtagtggtatctgagctaaaattatgtatattgtttgctctgttcttgatccagaaatttagtgcatttcaaatacgctgtgctcattttgctatttatctcaaaatattttccagatgtgatctgtgatctgtccaacctttgtgtactcgggctcattccacagttaacaaaaaagatggaagatttacaagattgtgactgcaaaagccttgttgctgttcctggttctgtggttctgcacctctttaggctgtttaatcagcaggataattcctggcagaagtacacattagcctactttcttttggtcaggaatgagtacttctctagggattcaaggaagcattcagatgggaagaaccaacttcttgactgctgtgatgattcagaattagatttggatgtgctgtatgctgatttggatagtaaagaactggagcttaagttgcagaaacctgttgtcaagactcaatcaaaaggtgactcaagtgccagtggatcaaatgattgcttctttcctggccttcacgacgacctggctcaggactgccttgcttgggcgagcagatcagactacccatcgctttcttgtttgaataagaagttcaatttgttaatcaacagcgggtatctgtacagactgagaagaaaatatggcattgttgaacactgggtgtatctagcgtgtagcttgatgccctgggaagcatttgatccttcacgcaagcgatggatgaggctcccaagaatgccatgcgacgagtgcttctcttgtgcagacaaggaatcgcttgccgtcgggacacaactgcttgtgtttggccgtgaatatacaggtcttgctatttggatgtacaatttactggcccgtggttggtcccgatgcactccaatgaacctgcctcgctgcctctttgcctcaggaagctttggtgagattgctattgttgctggtgggtgtgataagaatggacaggtgctgaaatctgccgagctgtacaattcagagactggtcattgggagactttgccagacatgaacttgccgaggaggctctcatctggtttcttcatggatggaaagttttatgtcattgggggtgtgtcaagtcagagggattctttgacttgtggagaggaatacaatcttgaaacaaggacatggagaagaatacatgatatgtaccctggagggactagtgcctctcaatctcctcccctagttgctgttgtgaataatcagctttatgcagctgatcaggcaacaaatgtggtaaagaagtacgacaaaggaaataacacctggaacatagtgaagccattgccagtcagagctgactcttccaatggttggggcctagctttcaaggcatgtggtgatagattgcttgttattggtggccatagagtaccccgtggtgaagtaatattgctgcattcttggtgccctgaagatgggaatggtggtgctgactgggaagtgctctcggtgaaggagcgtgctggtgtattcgtttataactgcgcaataatggggtgctgaattacatttctttcggtataatccgtatatgcctcttgtttagcaacccacccatttcttgctgctgcttagctaccccctataatgacctgtaattcagaaaaatgacaccccccttttcgtggagctctcaatgaaatgtttgggagagagcatagagcattcagttcagtttacctggaacttcttttaactcgttcaaaatttgttcttcttgtccagtatgaaatttatgcagtattctttattcatcatccttgctggaaagtgtgcctgttttattgtcctgagttcaatcacatttctctctttcctgattcatgtctgcaccatgcaatatctgttgttctgagttcaatcccatttctaccatcttaccctgattcatgtctgcactgtgcaaatgtcggtggtttgatgaacccaccttataattgtgcactgtcagatgtttccaatgctcagctgtccttgttattagaaatttcagagtggtacaattggcggtaaaaagctacttttgctaccttaccagtacactctctggaagtgatttctggcaatatgtacaattttcaggttctgtgtacttctataagtcagtggcatgaccaagtttatcagtgtaacagtttgacccgggaccttttctatccttttttttcgtgattcttcggctccaattttttctacttcgtttacttcacggatggttttaatctcatcatcgaacacttttggcttttagggcccacttgcaagcgacagacattgaactgcaactctctctaaaaacatgtccatgtccatgtaaataaatgtgaatgggttatgaatactcctacatattatctgacttgtgctttgttgaaatctcactttaaagagttgacgaagcaaacggtggtagagtacgatccagaaagcatatttgacatattcaggccgggcagtttttttttctgaatacgtcatacgcacagagacggatgatggccacgtacatggcctaacaaacttcagggttcagatatcttttccaggatttcggagctttttgatccgttccaaacttgtccaaaacgtcagtgtccgtagagacttggagccacttgaccatccatgtaatgcaattgtgtgtgt

SEQ ID NO: 68668 - DNA, 889 bp, Oryza sativa
aactaatagtctgttctgtgcttgcgatggttcagtgttcttcgaaggtgatgtccgtgatgagctgttgctgatgaccctcacacgattgtgagttcccagaagcttcatccttagctttgtcggagaaagtgcaccagcctacaggaacaacaaagcagccagtaagtctttctccatggaagttctattaattcaaagtactgtatctcaaattaaacttaaaattggtgattgcagaaagaacttgtagaattctttagaagttagaaccgctaacagaaaacacctgtatcctgccaagattttaatcatttctgagaagttagtagaaggttcaatttgttgctacttttactctggtctggaacaacttgtaacttgtaagggtattttttttttcaaaagtgaataattaagtagtcccatttagcatgtattcaacgataaattcttcagaatgaggttttgcactacctaagtgaagagttgttttttttttctgtagaaacaaacttcgttagcttcgctttcagtgagaatgacctaaaatgtactatccttcaatacttttctcattttatacccaagccgtcttatttcaacactatcttcttagaactttaagacaatagtttgaatcgagatacaacattcctaaatggtgtgcagccgaaatgggcatgccgaaatataatttctgaagaaacaaaaaaaaaaaagtgaattagaaatgagtcaagagtgactatatcaagaaaacgaaatctttcacgaaatcaatgggaaatgtcaattaagggatttaagaagagtcacttgtgagtgactaaaatgaagtgtggaggaatcgagcaaccagtaatgaagagctcggctaaaacgaact

SEQ ID NO: 68669 - DNA, 744 bp, Oryza sativa
aaggtgactatgagtactaacaaaagagtcgttgaacaagaaaagcagagaactatctcaagccagcattggactgtgaccaaaattgtaaaaaccattgtactaattttctctgccaaagacagatgaaaattaactggtacaagaatgattatcaatccaaacatataagttcagaaaatgatatacttcttaacttgtacagaaagtgggaaacttaacaagacataatttacagctttttgcacacctgagttatcagatttggcagcataaaaagtggaaatcttaagacagcaaacagtgaaagtgatgtgaacgcctttgctggtgtcaagtcacctcccagcagagagtatacaccaaatgaaaccacagtgacaataacggggatactgtttaggatgaagctattcagctgcagcagacaaggaaaaatacaaaagataatagtgagccgacaataagggatgcaacaactcattctcatatctattttaagtttgagtaactaagtaaattattgtaaacaaactttataggaccaggaagcaccagtacaatcgatactatagcatgcaactccaaaacttattgtgtaataaggagagttcatggatgcacgattaaaaaagagatcatatatagcagaatgaaattgacacaagtgaaagataacttaaatacaaaatggacataccgcagcaagcaattgagcgctgcggaaccatgaaatttcatcat

SEQ ID NO: 68670 - DNA, 9243 bp, Oryza sativa
gcgattttcttgagccaatcctgacgggtgctatcatggcagacattgatcaattcaataacatggtccataaagaagaacaccagcccaactgttggtattttgcaagtacaaaggttggtggtagttttgtagaagggctcaaggtacgagtgcaatgagttgacggctgacttctctgtggaactcagaacccagtcccttggtccaaataccccttcaaacttcttgatggtgttatccattgcattaggggcctggatgaaaaaggttttgttttcatttaaatgggcattaaagacatagagcatgatggaaaatgaattatacgaagtatgagctgtatggtaccttctttaccacatcaagcatattgtaatcaccactccagtttgatgaatggtcaaatggaagtttccatgagccttcttgataaacttcagtccagtgcataaaatcttccatcatgtcctggtttgaattggtctcaagaacaaattcacggatcttggacaatactggcctcacattttccaggccatcttttatgataatcttgagcatccgagcagcacaggggatgtaacagaaaggaagtttacgggactcaagctcctgcctgagctcatgacaagcatggattgcatgttggctgttgttatgtgtgcaagcaaggatctttgaatcaatgttaaactcgtgcagcacattcattagaacttgcagaatctcagggccagtgcatgggtatgggatacggcggacatcaagcaaaactttccgcaaggcccagccttcatcaatccagtaacacttgacggacaagtacacaatctgttcataagaagtccaaaagtcaagagtaatggagaaccgagagctaacgcactgaagagatgccttaacatcctccttcatgcttctgaacacttgaaggacaatttcatgagccttttcttttggccatagctggacaggcgggttcaaatacctgcaactgtcgataagcatactatcttcgagggtggaagttggaagggaggagctgataagccacctcagaagtaaccagttgacatggtcaatatcaattgctggtttcgctttaggttgatgacgaactttagatacagtttgaggttgaggttgatgttgaacttgggattgaggttgaacttgggactgagattgagcttgtgatcgagttcgcgctaggggttgagatcttttggctcgagaaaccatgctggtaggcgttgtactttgagttgcttcaccctcagaaagttggcagtaaccagggtggcggttattaagatgcttcccaagattccctgcacacaacaatgtagcatattactgaatgtggtgttcagacttgacagttggaaagggtgaaaataaggcaactaatactgacattatctactgactgaaactgaactagagttgtgggcatatgtcagaaagaaagattgaatcttcttggagacagaatttgcaaaacgcccttcattgttacagtaaagtgcttgtattgtattgtattgcagagtataataaagtaaaatcgtttcaattggattggatgggcgttaagagtaacagatgtatatgtataccggtggcagtggtcatgcagtagctcttcttgcagagcttgcagacgcgggacttgccatcgggggcagtatcgaagaactggaggtagagggacttcatggtcttcttcttgggcttggctcctgggcaggggcagaggaggtggccgccatcccggacagcgcgtcgtcagggtctacgctgggcaagagagtcatatcagtgagagttgcgttccccatatcgatcctctctgtggcgttgcaagttacagtagagagtgtcagcaagaattgaaacaaacatacttgtgcaaatccaatctgatgatggtgcaaatcttttgacaaggtggtgtgttgatttagcagagagatcagtgtgagcatgtgattcgcgtattgattgattgtttggttctttctactactcctaattgcggtgcagatcggagaaagcagcagcgggtgtggggtgtaccttggggagcgagccgaaggagtcgccggagagccgagccgcggcgagagctgacgcagcgcagactgcacgtgcccaccgccacaggcagcacaggggggagcgagccgcggcgccggcgccgatgggagattgggatccagccagccagccagcgagctagggtttggttttctccctgaatcggagcggctcacccagccggctcgtctctgccttactactccttccactactggttttggttgggttgggccgagtcgagtcgcttttacctttggacggctcggctaattcaagaccattttccttttttctgatttctcttaataaatactccttagtatcttttttgtgattaaagatgccaaaatactgttcgcgcataggaagagtaatactgtacatgttttgtgatgaatcttttgcaaacaaaaaaaactaaggactcctccgtttcgattatggacggaacaagcgaaacgacatatttgtaaatagaaaataatttgtaaataaaatttatatatatatatatatatgttctagcaatctaaaagtaaatgctgaaaaataaactacgatgaaaaaacctcaaaatcaactccaaatttaaaattgaaaattcaaattttgacttataagtataaccataagccaaaagatgaggctataagcttaattggccaatatccattttaatctcatcaactgaggttactgaattcttaacactactgtgctagacaagaaacaggtcaggaatacaagtgtaaaactttgacaaagtaaaacaaaaatcatttactactacatgtgttccttggtgtctgtcaatccaacaacatagatcatctctgtacaagtacaaccaaatggcacaaatccaggtgagaaaccgtgcccctccctgcttcacttgatgttcatgtcttcttgtgagtgtgtttgtgtcgcacaaattttgacaatttaaccctttgtaaaaactaattttacaaatgaaccgctgccaaaacttatttcaaatctgacctttttgctcaacgctaaatcatgtggcgcggaacttagacacctcagcgccacgtcagctggcgctgaatgccgtgccacggcggatgggagactaagtcagcgtgccaacgtacattcagcgccatactatttggcgctgaggtgtctaaattcagcgccacacgatttggcgttaagcaaaagggtcagatttgaaataagttttggtagctgttcatttgtaaaaatattttttgcaaagggttaaattgtcaaaatttgtgtttgtgtcgtgtgtatatgtacccagacagctagccagctcaatctgtcagttgctcctttggtaaaacaaattcatcggattgatccaatcagtgagctcctaactcgcactgcagcctgcatcatcacaaattaatttgtgatgcatggtgacttcattttctcttctttgcctttgatctttttctccatagcacgcccagcggaagggtgaacattgggaaggggattttaggcggtggtacgctgcaaaatggggaaaaaaaaggatttgatcttccatcggcagcaatatgtaagaagtgtaaagagtactatgcaggtaatggcagagttcaactgaaccattttgggcgtgttttgttgctcgcatccccctagtattaactactccatccttttgggtaaactagagtctgaattcatttttttctgaaagggtgaagctttagctgcaggatttcgccttctgaaaaccgttcctccctgagctgaaaatggtgaggaggatttgtttcttctatctaactattctagttgtatctcagataattgggagttgattaggtgattgctgattgagaagagaattaacaggtggtagtacaggatagtacttactgcaaattgatggtctcgatttgggtgagctcggcgttgaaggaaccgtcccgtgccgtggcgtgctgcctgatgccaagaaccctgcacccaaccctcctcattcgctcgtacgggttcgtcgacctgacgcaaaagcaaaatttcaattcagttcagttcaagttcagtatatctcaagagaattcagttgagttgagttgagttgagttgaggaatcattttgatgttacagttagagttagagtagaggtacctgtagaggaagctcttgtcgtggaggccgacgacgagcgtggtggcggcgagctggttcaccgtcgccaccaccgtctccccgacctccccctcccgaaccactatctccaccttcgcctgcataccatttcacaattcaacaagatgattaattgcttctttctttctttgttttgagttgacccaactaccaccattgattgattgattggttgattggtttacctccgcgatgccgttgcagagctccctgaaggcgagggcgagctggaagccgccgaggcgtaggctgcgccgcctccgccgcgacctcgccggcgggcagacgtgcagcagcgtgatgcagtcgccggcgcggatgaagttgcgcacggcccactgcagcgccgcgcgggcggcgcccacgtcctccaccaccaccaccaccctctggctctccattactttctctgtcacacaaacacacgctacctacctctatcctctagcctgagattatccatccatccatccatgaaagcatcatcaagaagaactcgccatgaaagctagctcctcaagaagcctctcttcttgaaagagacccggtgaagtgtgtggaaacacaaacaagagtagtagatgacaacagaacggactaatactagcagtggcacagtgctaattagtactggtacgtagttaacttaagtgtgtgatgtgctaagctactgtgcgtgtgtggtgatgagtagctgagctagatacaatggtgactgatggaggattagagtagtagagaatcatcagctgtagatggaggactaaaacaaatgatgaggtggccatgccatgacacagacacatttgacatgggaccatatacctgaggaggaagaagaggaaatttaagggtcccctactgtttctctcaacatgatactcctcctctctcatcctaaccactacttctacaattcaattgaaattgattggatccctagataatatactagtttaacttccgtctatgtcatgactcgaaccatacatgtatatatggcttggctgctggtttttgcttgccattagcaacaacatctagctccatgcgtgcatacaacatggctcttgtttttgtatggttttgtcacgcaatttggaggttaggagtggattagttcattggtttagggaatcttgttaacccgtcttaacaaatttcctatcaatacaaatcgatggactgcgacgtgtcctacctgctgcctatgtatgcgcattagtttagtttagagaggacaatgtttagagattgtgattgtgagacgatcaaacgagaccgggtgcagacccctctaatttcgtgtctggttctattttttatctctttttttattgctggattggatgggtttacaactggaagaacttatgtcgtcgtcgtcttagctagtgtagcagttgatcgattaattaggtgtaaccgcttaaaaaacgtccggtgatggcagcggattatatatgtcatgctagtgcttacggatcagtaattattagtggcatctttttttttgtttgttagctaccctatgctttacatctaaatatactgttgtgatgtatacccattaacactgattgagaagctaattaagcagctgctgttgtttgaaagaaataattattacagtattaagctgtgttcagaagcaaagcagtgcttcctcacgaaacacgaagcagcaaacacacgacgcatacaaggctacagcactagatatgtcggaggtaggaacaaaagggccatatgcaatataatgcagcttttgcctaagcttgttcatagttttggttgcaagtgttgtcttctctccttggcttggcacgcgactgaactggagtagtatttttctttcctggggcaccgtctgcatcatctatagcttccttgtgtacaagaaaataatgctgctcgtttggtgcagcagtatcgccgtgtttagttctaaaatttttctttaaactttcaactttttcatcgtatcaaaactttcctatacacacaaacttttaacttttccgtcacatcgttccaatttcaaccaaactttcaattttagcatgaactaaacacagtctataacatcatgtgaagtttggtctaccttttgaaagcagcactgaaaagggagaatcgccattgtgcactgcgtgctttctcgtgcctaatgtgttgatgcacgtgtgcctgttgccatggtattggccggtatgcaaagtcaagccataggcaaactgaaccacacaccaaggaaaagaagaaaaaaaaaggatacacttgaaaaacggataagccaccgacggacggagtgcaaccccacagccacaccggcggccgaccaggctcactgtttgtacttcactgtgctctcaagtctcaacacaaaagaaaccgccacactggtacctataccacccaccagtttgcagttttgcacaactctgcattctgtctctgttcagcaaaatcaaacaagagcggatcgcaagaacaataggcataaaaaccgttgttcaaattcaacagtccatattaatatgataaacttgatgattaagcacttcaaattcaaagtcaaagcaatctctttagcatataaaggtacaaaaacaaacaacacagctaagtctagaaaagagacaaaagagtcaccgagtgagttaagcccagcatggtgtaccaggaatgagatccgcctatacaaactaaatcccactcgcatggtaacaccctaaagagtaagaggcacactttgcacctactatatatgatgatagagcatcagctgcccccatctactgacaactctaggggtataaaccaccggacatcaaacctatacggcccctgccaacacaaggggcacgctaagttccatttatttggacaacagtaagagctggtgcatcatggtgaaggatacagcaccagccggtatgactgacagtacatatctgctatcatcatcagccccttcagtaggaaccacggtgagggtaagaattaccctgcccaccccttgctcccatgcttccataccctctgccaccgtagtatgacccacgggcgcgaccgccgccacggtaaccacgccccccaccacgatagggctggcgatgccttgggaaatcaccaaaagtctgcacaaaacaacaatcagcaaaacagtgatggtacaacatcaagaaagcaggtggaccttgtacctctgtatctagtttgcgctgttcggaaaatcttgacctcccgttttgccctccacgtccaaatgttccactagtgagggaatcaaaaaagtcatccttgacataaacaggctgcattgaggttgaaagacatgttttagttattgctgaaacaaacaaaaccaaatctatgtccaacaaaatgttatcattaaaccttagcagctagctcaggattttctgtttcctcatcctccaggtcttcatcaaacacatcatcgcccagctcaccatctttgtcccttgaatgggatttcttaccaagatgaccccagacttcatctttgttaaacttctcattcatggccatgaaatcaaattcttcagtaaaatttgttactgactgcgaaaactgcaaaacaacagactcaaaagtattaatacttcaatcaataccagatgctctttaataagcagcatcataatcatataaaaacatgaaacatgatcaagatattcccttacaaggaaacaacatgaatcattccaaggtttgtggagtgtcattttcttaagggcatcttcggctaagtttaaaattaatttggttgctctataaactgcagagcctcaaacacatgtgccttagacttttactcaaatcactaaaccaaagagagaggcattatggcattgccttgagttcagcaaaaaatattcaatattcctccattccaacggaggcctcaagtccaagcctttggaaaaataggaaccatagatttagatgcatcatgttttcagttccttcacaagtttgtagatgctagcatgacacacattgttacagccaacagttttttgaaggtattgcataaaaagatgtgtgcttggagttctttttacaagttttaccaggtcatctttaaaaaggaaaatagtttgatttcacaataaaatagttttagttatttaagtgttgtctgtgggggaggaatagaatctgttaaagatagaattactattataattaaatgcgtagcatacaatagcaaggggagctgcaaacaccagggataacaaaaattgtaagacaatagttaaagacctacaaataagagcacaaaagttaaagagatactcaaaaggtataaagtgtcactcataccgcgctgcctctacctcttccacggcccctgtagtggtgattgctgtgtgaaccagctccattgtactgaaaaagaaaacagagaaataacatactgaagggcatgcgtactaactacaaacaaaggaacactgaaggatacaagagataatcaagacatttactactagcacatttgtgatgttaatatgacaaaatggtgttccaaaatcaagcttgacacaagaaaagatgtaaaggatagcaagtgaactttcagtacggatacagaaattatacgattaggaaggcgtatccaagttttcaagatcagggtagatattgcctacttttctttcagaaggaaaattttcacctcaccttgacccatagatcataatttcaaaattgatccgtgctattataaactcgacgaggatatgcactgaaatactatgtatcactaatttatgtttgagcatatgtttgcagacgagtaatgactggttccttgtcttagaagtagaagaaaagaactaagaccagcatgttgattttatcaagccaaaatagggaagctcagctcactaactcaaaagggcact

SEQ ID NO: 68671 - DNA, 1432 bp, Oryza sativa
tggttatacacataatgagcaggattagaaaaaaaaaaggaaaatattttcttgtaaagcacaacacgggtgtagaaatgctgatgtaccttttgaggtgtttgtttcggcaatggcaatataggctcattattttcaggaagagcacgtgacggtggatcaggtagcaatggttctacaaccctagtttttgattcaactgccttgaaatctttgctgctcatctgtaaaggtgtctgcatggactgagatgatgaaagcatcgatggagcattctgcagtagttgacctgatgatgccaacaaaggtacgggcatatccatatgggctgagctagatgaagcaacagtcgaagaaactgcctgtgacactgattggtatgccaatgttgaacctggaatatccgcagtcttattgctcacaagcgaactaaaattatgtggggccattgcactactttcagcaatggatgttggcaggctagctaaaggaagggtggcgcccacagatggaactggaggagtaaacaaaggacccatgttcggcagaaggggctttgaagtttctggagatagtaagttagcagaagaaggtgctgttgtagtgggcaggatacctgaggaagggccttgggtagtaccaggtggttgcagcaaggggggctgcagttctgacagtttttgtggccctgacgatagagtgggattcaatcctgcatattggagaccctggggaactgataatcctggctggagcaaaggaggttgctgcaaatgaggtggaagcccaccaggtggataatatccctgccaatacattgggggaactgaaaggcctgatgcatttccagcagaaggtggagcagaggatccccatggaacactcccaggttgatatagaggaatattgctctgaaaacttggcctctgaagcccatattgagctgcctgggagctgaggtctggcaatactgcacttccagcagaaggcaaacttgaagaagccgatgctggctgagagtagtgcgactgcagaacagaattgcatgagttgtgcggctctaagaagtatttttcaatgtttttgtttcattgcggtacctgtattatggcaggatcattgtgcggggcagctggttgtggtggtggcggtggaggtggtgatgacttaacttgcaaatcctggagaaacaaataaattggccttaggtagagatatggtgcaaaagcatgttaaatcaaatagatagaagatagtgaaaaggacattttacaggaaacatgtccttgaatctagatacaaattggatatatgcaaccgcgaaactgaccaaacaaaaacacttcacagactggttaatgctaccatagcctaatatgatgttactatcagctaacttaacattttgacgcagtaaacagatggcataaat

SEQ ID NO: 68672 - DNA, 20545 bp, Oryza sativa
  unsure (1)..(20545): unsure at all n locations
tggtgctagcaggaatttgcactccatctttcttgcgcccttcggttccaaatgatcgaactagagaacaacaaatggacagacaggtgtaaaacaaacattgggatgaacaaagcgtctaacagtgctggaagtaaagcaaagcgtagtcaacacttgagttgtacggatacgagaataagcatcaggtggcttaaaaaatcttttaagaaaaactagtcgcgaaggtcaacattgttgcatcccagaaatttcaaattgaataacacgtagctaggttgggggctgagattcacctcacgggggaaccaaatctagcgctgaatcaagcgaatctgaggaaatgagagggggagcgggcgcggggggcgggatggaattaataccattgcgnnnnnnnnnnnnnnnnnnnncggtgttgatgttgtagaggatgccctcgtacctgatctcgctcttggatgtcaaactgatgaggctcccgatgtacgagtccggcgaggccgccgccccgccgccgctggagccggccgcggcggggggccccgcggaggaggaggtcgacgacgacggtggggcttccgccgccatggccgccgcgggcgcgggtgtgggcgagggccgggagctagggttagggatgcgatgcgatgcgaaagagggagaaacgaaaccctaagcggctgatccgtttgggatgtgcgctttggtttggatggtgttttagcctattaaacgggtcgtttgggttagtttgggaattggacaggacgtggcttccatcggaggcccatatgttgccgttttcttgctaccaatgcaagaagatgcctgatcaaatttacctctacttcgatttagtttagtcccttttaaatggcttagactttagagagcccaaattacaaaacaacgaatgaatagtttgctttttcatgatttaatggtaggccacaatgaaaaataatgcccccaactgataacctctctaaaactctatctgacagcttcccatgtagccaatattttttttctcaatcatttcttatcattattattattgttgttgttgttcgttatgatagtgatataaataataattactatttgttgccttcttttccttgatcctttatttgatatttgtttagatatataattgtgcaattactcgtgtttttaaattaaaatattaggttgaaacgtgcaagcccttataaatgtcatgtcttattcaatggactatctttttttccctgattacacggtaggtacacatacaacaccgccctcacgcactccgctaatgtgtcctctaacatatagaagagacagaaaccaataatacatggttgagtttactaaagttgtattgaaagctcgttctactgcctatcttttatgttgttatccttgcacattaaaatttcggaggatcaaccgtcgtgtgtccaaacttcctaggcagttttatcccacttcgattctccaaccaggatgaaatatatgtgcgcactcaaaacgagatagtaagtcattagcatatgattaattaaaattttatcatttagaacttgaaaaatgaatttatttgatttctcatagcaacttctatataaaaactgttcgtacaaaataaatcgtttggcagtttggttcattcagccattatgtttagcagtagattgattatcttgtcaagttgcagaaaatcccaggtacgtcgtcctacgtagcaagcagatggattatcttatccaatccagccacgcctcgtcactcgccacccacactgcgcaagcgcaacgcatatgccaaatcgccatccttgcgatgtgatgcgatgcgatgcagctctcacctctcgtctcgccagcaatgtcgcaccagattctccacacctccaaccccacgctgccgacgccacctcagccgcacaaccaccacccgccggtgccgccaccgcccaagctcggtcgccgcgctgcgctcgccatcgcggccgctccggccatcctcagcgccacacccgcaccatccagagcgcaggaagcagcagccgccgccgcggcgccctgcatcgccgacctgcccgtcaccgccaaggccttcctggacgtgtccatcggcggcgagccggcgggccgcatcaccatcggcctcttcggcgacgcggcccccgccggcgcgtcgcgcttcctgtcgctcgtcacgggcgtcggctaccggcgcaaggagttcgtcaagatcgtgccgggctacgtgcagcacggcggcgtggtgtcgtacccggccatcccggcggtgaccgagcggctggcggcggagatgggcgccgtgcgggcgcaatgcggcggggagaggagcccgcacgcggcggcgggggcggtgtcgatcgtggtgagggacccgagcctgccgccgcccaagcccaagctggtggcgcgcggcgggaagctggaggtcgaccaggagcaggtgggcgtggtgcccaacggcaccgagttcgtcatcaccaccggcgacgcgccggagctggacgcgtcggcgctggtggtcgggagggtcgtggacggcatggacgtcctcggcaagatcgcagccgtgcccaccgtcaaggataacactgcctctccatacttcaggtcgatcactctcactccagctagctgcttgaactgcattttgttgcatcaatcaaactgaatagtacttgcatctcagctaattaagtctggattagactgaacatgtattaatatcactgtgattgtgcagagtagccaagttgatcggggacaagagagcagtggttgcagagcgagggttcaaccgcccatacaccaagatcctaatcaccaattgtggagtcattgaacagcagcaggagcagtagagtgctttgtttctgccttgcctttcatgtctctagtttgtgcaaagggtaattattattggaactctgtttgcaagaggattttgattactcatggactgatataggcgatggagaggattaaaaaggattgtgaagagatgagagtctttgtaaaacgcatgtcacactgtgcttacagaacaccaacttatgttattaaaaagagatggaggatatattgactaattatcacttggggggaatttaatgagaaggttgatgagatcacgggcgacgccgcatctgtctttcatcttctggtcgacgtcgaccatcaccgagctcaccttggcggcggcgaacgccgcgtcgcacgtgtcagcggcgccactcgccccggacaccaggcgcgacgcggcggcgtagtcgccggagccgaggctgtcgtgcgcgtcgatgtcgaggtcgttggcggcgtcgaagtaggcgccgctgcaggcgcgcagcgcttccccctccggcgcgccgccgccgtacctgctggacctgtcgttgatgagggccccggcgtcgctggctgcggcgacggcgaggtcgagcgcgacgccggcgaggtcggagacggtggaggcgtcggcgctgtccgggttggcggtgagcacggcgacgcacttggcgttgtgggttttgttgcaggtggtggcgatgaagccggcgtcggccatggccacggggacgatggtcgaaatggacagcacgacgacgagcaccatagtcgtcgtcgtcgtcgttgcgtaggtcgccactgccattgctacggcatcagtgtcacttccatggtgcagtgcatatatagtaagtaaggtcaagaatggtgatggcgcggtaattaatcccgttgattttgtagaacgcgatcaacctttccgtccgttgatgggaattggggaattccatttgtttgggccggaagtggattgtggcttacgtgcagcccatatgggaataagatcactttgactccctcgactgaccaccgaatctaaatcatatccctcaaccgcaataccagaaatctcgacccccggaacttgcaaaaccggtgcaatttgactccctcgccggttttgggaggtggtttcgctgacgtggcgcgtggcgcctatgtggcgatattgaccgagtcttcggtccacgtggcgttgacgcggcacttacgtggcagtagaattaaaaaatatgcgtaggacctattagtcattcacacaaaaagaaatgtgggcccactgacatatggggcccacatgtcagtcctcttcctcctccctctctcccttctctctctttctctccatctctccccttcttcccattcggccggtgggcgagagggcagcgagagcgagcggccagcccagctcaacctcggtgggtaggcgacggcgcaccgctggggtccaccgacgatcgcaacggcgcacggacgaggggagcggcggcggccattggggcgcagtggaaccagagcggcggcggccatcggagcttcttgggcgccgccagcaccgagttggcggcggtcaagcagtggagcgacgcggcgcacatgagcaggacgaccctcggccttctccagcggcctcctcatcaccccccgtgccagtcgcttcgtcactaacgacgaccccgcgagccgtcagagaccacgccggtaaccgcgaggacggggatgacgagcggcggcaagtcgccgctgccgttcccctcgtcctcccactaccgcgagccaccgccgtcctagccgccgattgcctcccccgatccggttccgatgccgttagccgccctcttgcccgtcggccgaaggggaagaaggggaaagaaagagagagaagggagatagagaggaggaagaggactgacatgtgggccccacatgtcagtgggcccacatttctttttgtgtgaatgactaatgggtccacgcatattttttaattctactaccacgtaagtgccacgtcaacgccacgtggaccgaagactcggtcaatatcgccacataggcgccacgtggcgccacgtcagcgaaactacctcccaaaaccggtgagggagtcaaattgcaccggttttgcaagtttggggggtcgagatttctggcggttgagggatacaatttagattcggtggtcagttgagggagtcaaagtgatcttattccgcccatatgagttccgtaatctgcattggcaatccgggccctaaggccgacttatatgggccgcccggtgaagaaaaagcggaggaattagggattgtgatcagagtccacattggatcccttttaatggtagaactccggggcggcggcgacgcggatggctgccgttggttgtcaacgacagcggcggcatctgcagctactcctagctagcagatgattaaaaaggtaattatgcttggtattgtgatcatcaattgtactcatgtgggggatcgatggccatggctatgatctatacttactattctagatgggttggttggaaccatgtcaccctaattttgtaaaatttaagactagatatattggaccgcacgaccatttcatctcttctcatccatcgccagcccagctgcatctacaaatcgctagacgccatacacactccctgtatatactagtatcttttttgcattgacatctgataaatcgccagctatttgcacttattgattaataattaatttgtcctttccttcccaatccaaaacggcatcatccacgtagtacatactcctacacggtacgcccagatgatgaagatccatatatacccaacaatacctacctagtgccatcgatcggtcaatccttccttgttatcctactagatgatctgtagtagtagtagcagttcacttaattacgctgaatgtgaatgtactagcaccactgggacctagtaccaccaataattaccttagcttgggtctaacatccccaaaaggcagtcaagttctcattaccagtacctcatcatcgtcttaatctcactacccgtaccctacgtacgtacgtgcatgaatactgccagatatgcatccatgatccagccatggagaaatcaagctatcagactagtatcagcaaagcaaagcaaagaagcataatggcaacaatggaacgttccaaagctccatccatcaatgcaatgcaatgcatcatcatataggactcactctgtaactctgggctagcaggttgctcacttcagagcagtatactgtatactccatgatcagtgagcagtgtatactgatgatatactagtattaccaagttacatacctgtactgaatggaatgatgcatgtatgggccaatgcaactcggaaagagaggtccggtccccaacccaaagaaaatcattgtaaatctgggatccccacacatgacatgacatgggtgcatctcatatcgatcgcccaatcgcaagcaccgctcatgttttcgcatgcatatggtcccctagctagcttgctgctctccactccaacactctctactgctcaaccaaaagcacctcatccgatcccatctgctctcttcgcctgcatttcctctcaccatctaccgtcctactgctctgttattactcctgctaaacaccaccacgtcttactgtcctctttacctggagtactcctccttaatgattcttgagtcttcggcaaattctgctgcttatcgttggcttcatcaatgtggatggatgttaatagtagtaatacgtatcatcctttttggctgttgaggcaaagcagatttctacccatctgatcctgatattcttttggcgtttcaaaagagagaacaactaggaatggtctggatatggaacagtagtagtacacaaaggactgcatcacttaaattcagaagcatccaccaccactaatgtcttccctaggccagttaactgtctaacagtcaactgacaagtcagtaaagaaattactcctcctacaccattgcagtgcaggcatggcatgtggttagttaccgaaaaacagtgagaactactggtgctggtgctaattcagggagccagaactaacagtaacctgcatttgcacactgatcagaattcagaaaagaaagacggttaaagcactctctaatcatgatgagtactctcctcctagatcgtctttggttttgtttctctctttctttctcagccttttgggggtggttttgtttgcagttgcagaggtatcgatggcactagtacaattgcaggagtaataataaaagaccagccgatgggtggcccatcatcctccatcgtcttttgcagaaagagcagtgcaccaaaattcagacagatccatacaatacagatactcctactacaggggtactagtcgtaatgacgagctgattgatccatcatcacgagtcaatcatacacttaaaaggagtcgtacaggaatcatggctcgatcaagctgacactgattggtttgcttaatgatagctgctgctaattgaaaagccctaattgcacgggctctttttttccttcctttcattcttcagatgcagtggctgctgccgtgccggttactactactgttgagcaccagtagcattgcgtttgcaaggctttcagctgctggatgcacaacaatatgatactgttctgcctgtgcataatccagacatgtctggcgctcgttggcaaggaggatcatcatagatttctgggttatttggttggttgccttacttgactgatgggcatgtgttgctgggatatccatgtagtactatacttgaggcaaatatgaggtttgactcaagtgtccgaaatggcttttggtggactggagaggaatcgaactgttgcaactcgatgctgagcgaaaggagaagaagatgaaagaaggcggcaggcatcgcgtcgaccgtgccatgccgtctgccgctgccgatgcccccaccaccaaaatgttcgtgcaatttctgcaatgctccgtgcaatggactggaggaagcaaagcaaagcaagatctctgtttgcctcacctcgatcagtgcctggctggatggatggctgcctatgctatctcgtgcatgcatgtctctgtgctgtccttgctcctcgatcagtttgcttgctcatccatcctctgtcaactgtgattttgtgatttgggccccgtttagttcctcaaatttttttcccaaaaacatcacatcaaatctttggatacatgcatgaagcattagatgtagataaataaaaaaactaattacacagttagggaggaaatcgcgagacgaatattttgagtctaattagtccatgattagctataagtgctacagtaacccacatgtactaatgacaggttaattaggctcaaaagattcgtctcgcggtttccagccgagttatgaaattagttttttcattcgtgtccgaaaaccctttccgacattcggtcaaacgtccgatgtgacatccaaaaatttccatttcctcaactaaacacacccttgcatttggtcgccatctcgacctgttaatttctcaacgaatgggtttttgccctcgtctccgatctctcgccggtatagcacgcttcgctagcacaacaaggagtggtagctcgagtagtcagcctgcagtgtcgttacgcgtagctgtgggcatcagatctccattttttactcctccactactcatcaccatctagtgataggagtatgtgtaggatcgataggatagcagcagccagcgttgcatattgcattgggcactgtgattgatgtgtgatgcgcgcccacaccgcaggcacagccacagcccacagcagccgccctaaaaaccaacgattcacatgccccctacccctactatacttttctctgcaaagcggagtaaagccgagtagctctcctctcttcttctcctcttttactctctgctttctttcaccatgggcggctgaagcttaacataagcatacaaacaatttttttgagaaaatgaacacaagcatgaacagttaaacacacatggtgttcatgtgccacaatgttaggagtacaattgaacccacgtcatggcaggtttataggctgccggtgtttcgccttcacagatcgattctaaactcttgaggcatcctcattatttacatattatttaaacagttaaaaaaatatttaaaaaacaataaaatgaattaataataaaatccaataaatcactctacatcaggtcataattaacttatacaagttgcaaaaagaaatttaactgtaactatagatatacgttacctaactatagtttaattggtttttcataacttgtagaagttaaacctctatgtttgtagagtaaggatgtgttcgaatgcccctcttcccaacccctctcattcgttttccatgtgcacgcttttcaaacggctaaatgatgcggtttttgcaaaaagtttctacacgaaatttgcttaaaaaatcaaattaatccattattgaaaaaaaaagctaatacttaattaatcacgcgctaatagaccgctccgttttccgtgcggaggcactatgttcccaacctgaacatgtgaacacagcctaaatctatcttcttttttttaattactatttaaataatatgcaaacaataaggggatatcttttctagagattaaaatcaactcctgattataagtataccgtttattagcgacaaaaataatttatatatacaacttttacttctatatataggagttcttagcaacttaaagacaatgctgaaaaataaacaacaatgataaaaatatcaaaattaactttaaaattatgttttaaaattttaaaactgggttgctgctgataagccgaagaccaaacaatgagaacgtcgatgtattatacaaaaatgccccatacatttctgattgctcccatacgatttgggcgggggccaatctagttgtcaacttctactactgctaggaggagtagtcacatgatccaatctctcctctcctcgcctacaaaaccaaagccacactccttccttccttgggatccccagacccagtgcagggttgcagcgctttgcataggaatgtctcgccttcctcctcctcctcctcttcttcttgcagctcatcgaaagccacatagtataatattcgccacctaaaagcccaccacatccatccatcttgcttgccacacacccaacactccacacaagtcagctcagtgaccgccatggctgctgctgcctgagctgagcgaggagtactatattgcagcgtccagaccagtccaggtctgcttgctcggcagagtgcttgttgcgccaaacaatgaggcaaccacagagcagaaagctcctgcagctgcaggctctttctctgctgctcttcatcatcgccctgcacagccgcctccatggctgctcgggccaaggtgaggcggcggacggctcggcgtccacggcggcggctccaatggaggagaaggagaagagggctctctacgcggccatcgagggattcgtcggcaagggctggaatggctccgccctctatcctgacccctgcggctggtctcccattcaggtttcctttctctctgcacacaccactactacacagttcttgatactagtcgctttgagcaaatttctgttctttctgtgaggcaaattcatggttcaaaggatcttgggagggcagggtgatctgcactagagatttcttcattaagttatgcaccaagagtgcagcttgagatatttgtgcaattatttttgtttgaaagatccaaattttagcagtatccttgtagtatgttccttctttgtttcaatttcatcttcttgtgtgtagcctctgtgttggtgaagtgtttctgcattttgcggctgccctgtttctcaactgtggctgagtgagacctctgaaaacattgggtctccgatgttactcgatataggagattctcttggacaagaactttccactcacatgaaaagaatctctctgatttgaaatctccatgttttcttaacatacaggtactacaggagtattctcatgtcttctcttttcatctcatgatattctcatcccttggttcttttgctgtggagatgctccctcttttttccactacatttcaccgctctgtcttcctttttcccatccctgcactttgagctgctgttactcactcataagcaacagttgctcacgactcgctccttttatggcatggatctaattaacacattagtatttgccctcccagaataccataattacttacattttgatgctgatatataaaactgacgaggaaattggagctgctataaaaaggagcaaatctctgttactacattaatcaaattctgtcaaccatgtgatccttccatgtctgttactaccagtagtgtactacccaaaaattctgtttactggcccgtcatttggtacctttccatgtgtgtgaaagtggtgacagctaacatttgtactgtaaattccaaaattcaggaaaagaaaagctttagctccttttattaaaaagtgtgtttgtgaattcaaattgaatggagaaaagcaattaacaggatgcctctgaattttgttgcagggagtgtcatgtgatctgttcaatgggctgtggtacccaacagtgatgagcattggcccagttcttgacaactcactgcggtgctctgctgatgccaagttcagtccccagctgttcgacctcaagcgcctcaagaccctctccttctacagctgcttcccggcgaccaacccgactcccattccggccaccagctgggacaagctcgccggcagcctggagacgctcgagttccgcaccaaccctggcctgacggggcccataccggcgtcgctcggccgcctgtcgagcctccagtcgctggtgttcgtcgagaacaacctcaccggtgccgtgcccgccgagctcgggtctctggtgcggctgcgtcggctcgtcctgtccgggaacgggctgtccgggcagatcccggcgtcacttggtaatgggcatttcgccgagcagctgctgatcatggacgtcagcaacaactctctaaccggctctctgccttcgtcgctaggtggcctcaagggactcctcaagatggacctcagcaacaacctgctgcagggtagcttgccgccggagctcgccgggctcgggagcctgacattgcttgacctcaggaacaacagcttcaccggcggtttgccgtccttcttgcaaggcatggcgtcgctgcaggacctgctcctgtcgaacaacccgctgggaggcagcctggggcagctcgggtgggagaggctgcgcggcctcgcgacgctggacctgtccaacctcggcctcgtcggagccataccggaatccatggcggcactgaccaggctgaggttcttggcgctcgaccacaaccggctcaccggcgacgtgccggccaggctcgccgagctgcccaacatcggcgcgctgtacctgaacgggaacaacctgacggggacgctgcagttctcgccggcgttctaccagaggatggggaggaggttcgcgtcgtgggacaacccgggcttgtgctacagcaatgccgcggtggacgcggcgcacgcgccgccgggggtgacggtgtgcaaggtggccggcggcgtgggggacgggaggaagccggaggcgagctccagcctcatggccacctcgtctgcttccaacctcatcaatggcttctgcttcttcttgtggatggtggccacgtctctcttgtagccaaagacagacaccaactttcagaatcttcagatagatggaacaacatgaaatgaagaaactgattctctcttagtttagcttggctagtgactagtagtgctgttcttacttttggctctcttttttgggtgtttttctgatgatggaaaaggaagaaatcctggtggtcacagtaaacactagtctgaaactgtgtagtgacgagtactagcttggttgttttttttgggtgtaattagcatgtttctcatgtgatgtttaattacgggaagtggataatggatataaggtaaactgctctccttgtctgaaaatattttgctctgatgtgagagtatatatttactagcttggtaatcatgcatgagtcggtagctagatagatcttgacagccgtatatatgagttggattagctgaggtctgagattgggctcacatatgcatacgtatatcatttatcattgtatttcggtattgctatatatatggcacatatttttttaagaaaaaaacagtcgttttcctggcggtaggatctcccttgattttcatgattttcatgattagcttcccacgctgattgccgatttttgtcgaggtgtatatcaaggatgacttgatgacttgattactttgttattaatactcaaagggacatgtgattttgtgagtaattattttctactttgctagcttctttcttttctccaaacggacatgtgatttgtgagcttccctcttctttttatcgtgattacatcctaaacatattaaaattatatatgtaatttagacacttacatatgtaatttttgtacttacatcctaaatacactgaaattacatatgtaatttagacacttacatatataattttgggacttacatactctatacaataaaattacatatgtaatttagagacttacaatataaaaacataccgactattttttagtgaaaaatatggcgccataaatatagctactctcttgtatttttgttttgcaatactagcattttagcttgacccaagtgctagataactagacttaaaagaaatctgtatatgaaaatttgagcaagtaaagttgccttggtagcatcaaggaatagcttgagcttgatgctgatgctgcacataatatgcctgaatgtattacctccgtcctagaacagtaatgtggtagtagtggtttggattgaagtagctcaagagatcaattaactgaaggagagcaataggaagaaggaaagaaaaagaaagagaagtgctcctagaaacaacacatgcagggagaatagagggatgatgatgatgatgttgctgttgctatcgaagaagctgttggctgatgagcagagcacggaggggatgaacgatgaacgatgatgatccatggtactgtatggtggtcggatccgatccacagcaccgattgatggacagtgtttcttcactgcgttcaaaatctgacaggcaccattgaaaggctcaagactggagcagccggtactactccagtagcctgcacaccctgccactgccgccatctactggtactagtggtagagtagatacagtactcatgctactctgcttgccagtagtcttggctgacatcttggatgacatattgggctgtgtgtttagatccaaattttttgattcaaacttcagtacttttccatcatattaacctgtcatacacatataatttttcagtcacatcatctctaattttaactaaaatccaaattttacgctgaactaaacacaaccttgactgtcatcctatggagtgtcaggagtagtttttgatcaataattgtcctaggcccttgttttagttccaaactttttctttaaacttttaattttttcatcacatcaaaactttcctacacacataaacttctaacttttctgtcagattgttccaattttaaccaaaattctaattgtggcgtgaactaaacacactaatgacaatggcaggaaagaaaatttggtattgcaatggcaacgtccgtatagtgtatcgacattgctattggtattggtattggcatcgtcattgcaagcggtacattggtattggtattgcagggaagggaggagcaatgaagcaactacgagtagctaggatgcaatgcaaagcctagaatagctagaggatggatcagctcgatctcctcttcctctcttctctcgccggctcgtccgtgcctcccggcatgttctcactgtacactatgctacagtgctaaccataggctacaggctttttgggcgtgactgatcaattatcaacagcaaccagtaaatctgtttaggctgagtttagttgttttggtaaaaaaaaacatatacaaacacacatttcaaatattaaacgtaaactaataacaaaacaaattatagattccacatgtaaactgagacgaatctattaaacctaattaattcgtcattaccaaatgtttactgtaacaccacattgtcaaatcatggcgtaattaggtttaaaagattcgtcttaacatttacatgcaaactgtgcaattgattttttttcgtctacatttaatgcttcatatatgtgtctaaatatttgatgagagggaaaaaatgaaagttttttttcgtgtacatttaaaatctgcagtttgcaatgcaaccatacgtgcaatgttacggacgggagagtgtgaatgaaaacgttcaaggcgcaagtcatgccagacgtcgactcactgtcactcactgctctgcccgatgatgtgtacttatggcttgcttgtactacaccctgctctctgctggcactgagcacaagcgtactgtacactactgggagtattttcgtttcatttcaatcgtatcttattcacatccatccatccatctgatgagagccggccggcaggccgggacgccccccaacagaacctatctagttagtgaaataaaagattttggtgtcacatcgaacgtttcaccatatattgaaagtagtttttggacatgtgagttactatagtatttatggctagtcatggattaattaggctaaaaagataggtctcgtgatttacatacaaactgtgtaattagtttttttatctatatttaatacacatctatgtccaaaatattcgatgtgaagtttttggaaaagtttttgggaactaaacagccccaaaatgtctgtccatatcatatgcttgctgctcggctgactgaaacctgtttcctcatgcgaagtgagagtaacgaattgattccattgaagccgccattttttgttttatcaaaattttgttaacttttaacagtattatatgctcctaggtgtttgatttgttattatttttttacatacgattagttcaaaacttcaaattctatgctgctaaaattttagtgccaaaactttcatgtggttttagcacaaccagttttcctttttgatatgacaaataaaaaactccaaaccaaactaaaagggtgtttggcttgtatactgacattgtctattgttatcatagttttcttaccaagcttaccaaagcttaaggttaagttaacaaaattaacaccacactttagtaagcaaagccactactagtaccttgcacaatttttgagacaatggcatgtaagatcaaggtgttagaaaaagaaacttatcacaaatgtgacataaaccaaacacgttactaactcaatcaaagctgcctaagttgttgacgtatagcaaagtatggtagcatgtgaccatgaactaaacaacccctaaacgcgtaattatgctatggttcttgaactgcctctagtatgagaaatttttttttttatcatttgagtgaacggctacccgtttattacatgtcaactaaatatttaagaaaaaaatcaatttataatttttttactggttacaaaatttattttaatattttgttacaagttgtataagttgattttgaacttacaatgatattctctggtagtagtacatattaaggttgtgttcatgtgtgttgggaactaatctttcacacacacataaaacggagctgcggattagtgctgatgccatggttttgtagcggcagacgccagtccaaagcaatccttgctggactggttgatgaacggacactgcagtttctgatgccaaaattccaacacactttactgccacttttgttgcaaaggaacggagtttgttttacaagagaaaagcaaagcaacaaaattttagctggcttataaagtggaaatgcaaaatctgtgtgccaagcaaatgctcctccacgtgagcgatgataatgaacggactataatttccgaatgaaagggcccatcttttaacttaggcttatatttatcagccaaaatttaaaatttaacataaaatctgaagctaattttgaggtttttaatcgaagtttattttccagtcgtcgtttttagattgctaaaaatatgtatatgataattttatccgcaaattacttacggctccgggagaaaacattgtgagagatgaaaataaaacaaaaatgcagggggttgtttgtaatttggtattgtaactcctcgcgtggcgtgcttgaggctgtccgcgctctccgccttggtctcctctcctctcctcgctttccattccattcaaccatctcaatcaatctcaatcccaatcccaatcaatccctctctccatctggtgctctctatctgaggaatccgaatccgatcaggggaggcgaggcgcggcggtgatcggcgatgacggacacgacggatgacatcgcggaggggatatcattccaggcgttcgaggacgactgccggctgctgggcagcctcctccacgacgtcctcctccgcgagctcggcccccgcttcatccacctcctcgagcgcatcaccatcctcgcccaggtatcgtatccatccatatatgatgatgatgatgatggtgattcgatccaattaacacggtgcgtgcagagcgccgtcaacatgcgctccgccggggtggaggacaccgccgtcgtcgtcgagaagcagctcggcgccgagctggccgccatgtcgctcgaggactcgctctgcctcgcccgcgccttctcccaccacctcaacctcatgaccatcgccgacacttaccacaggtgcttgccctacacattcacattctcaaattgttttattaattaattggaggatcacctcttccgccgccattagaatctgcaaactcacttcataaatcatcataatgtgtttatcttaattactccctattaacctgaatttatcatgcatgtacggccctcaacacatttgttgtaccactccattttcagaatgtgctacataccattttttttgtctgaatatgtgttactacaacttactgctagtgatagtgaggactgcattatcatatttggcgcgaacaatttgaaagccaaacactgaatttacagtttgtttgtcacacttcaattaaagaatactgataacaacacgggagttgtcttctgtttggggtacctatttgtcatatttgggaaatataagtatacctgttcgtgatagggatgctacattacagtagcacagatgaatctttgattgcaatatggaatccaagaattccggtacatatgtgtacggcattacaaagtcggtccaccggttagttgtttccatgtgaccctcctcagacagaattgattgaaggaaccttacgctcgcacatggtagcttcattgtggtttcctcagatgttttgtcgtcagttgtccgactgtttttggaacctagcaaggccattgagcatcgcacttattgtcgcaattacctcttattatggtagtatgtcaagttttagaacagctgagacttcatgcatatgcttaagaaataattaccatcagcatgttgcagacttgcagtacatctttttcatttcaggaaaatgttagtgttgctacgttttttatcacctgaactagaatgtttaccaattttgaaaatcacccaaatctagagcttggcatttttatgtcttttagggttcgtaaagcacgcaatttcgccgacctgtcgaaatcatgtgatgatacatttgccaaattgattcaaagtggtgttagcccggaagaactctatgacactgtatgcaagcaggtaatttctcacattaagcacacatttttcatacattgtatattatgaaagttgcacatcatcaaatttatctgtgtatcttgtaagaaagtcacacatgatcaaatttatcagatattcgacctttacaggaggttgaaattgttctgacagctcatccaactcaaatcaatcggcggactttgcagtacaaacaccttagaatagctgtgagttaatttcaatagtttcatacttcaaccttgatattgctattttgttgtttcaattaccgatgaaactgtgctgcagcaccttttggaattcaacgaacgtgctgatcttagcctcgaggataaagaaattctaattgaagatctggtataacttcaaaggatcttcatagttttatttttccttttcctaatgtgttccaatctttctaactttgaattatgtaggtaagagaaatcacggcaatatggcagactgatgagttgaggcgccataaacctacacctgttgacgaagctagagctggttagtaaccatctattttctgtttttgttactgccagtattctcatgattccatcttttcttttgtaggccttcatattgttgagcaatcgctctggaaagcaataccacactatcttcgccgtgttagcaatgctctaaagaaggtataaatacattgattggcatttgttgaattccacttccgtttgactcattcacgagcggatataaaccctcctacaatgcttttcttatagaacactggcaagccacttccgctcacctgcacaccaatcaaattcggttcatggatgggtggtgaccgtgatgggaatcctaatgtcacagcaaaagtaagatccacacatttgaatttggtcgttttattatgccttctcagtattcactagtatttcctgtacattcttatggtgtgttgcgtttttctaccttttgcttatgttaatttcgacatgatcaccattctgaaagactacaatgtttcatttctgagctgcaggttactagggatgtttccattttgtcccaatggatggcaattgatctgtacatccgggaactagacactctaagctttgagctatcaattaacagatgcagcgagaagcttgcaaacttagcaaatgacatcctgctcaaaggttatttcatgatatatccaagcttaatccatttcaatctcaacagaagctcgcctgccaccatgaattgtggcgcttttcgaatgcctagttagttagttagttcattagctagtataatgcatattattggttgtggtactgttccttaaacagtaaggtgcactgtaacagcactcttattatagggattgtaattttagtttatatattagatatttcctttcagtttataactatcttataggtccccttttattagttcctaccctttgggctctagcacctttttttttttttgacgctgaaaggtagagagactataccttataaccattttatttatggtgggtggggtactagcacctttatatgaagggacattgctctaattatcgggaagcaa

SEQ ID NO: 68673 - DNA, 5342 bp, Oryza sativa
ggactgacatgctgtagcattatgttaatataaaaaggtctaatgtttttgtaccaaatgcataatagtccaaggggagcagtcagcattatgttgttaggtctagtttttttgtaacaaaatccaaaatcctaatagcccaaggaagttttgtagttgcataaaatattttacaccaatttgtttggttactttcggcttcctgattttctatcacaatttatgtgttaaataagcaatacctaagttataatctggaaataataaaaacttattttatatttagaaccagtaggcttcattaatgaaactgaaaatgaatatagaggtgttcaagtcttacagtaacaaacttatttacttcttcacataagcgcattcatgacaccacatcgataaattttggggggaaaagtgctggatcattatttccgtattatgtctgacacaaatacctcatgctgtcatccttgtaatcaatgtaagacttgtgtcatcaactgctggattaaaccatgaaatttacattgcaacagcttcctctgttccccaaactggatctgaggaaaatttgtgcatactgcataggacaaaaaaattggacatgctattttgaaaattatttcagaatgccaatcaccatgtaaaatagtttcatcaatattaattaaagaacatcttttgtaacatggatttaacatcatgtatcatcaagttcatctgaaatagttcagatgtatgtaacatcttttgtaacatggatttaacatcatgtatcatcaggttcatcttttgtaactggtgtgtgtttgtacatatgtatgtaaatttattgtcacacctattaatgcattgctactattaatgtgatgtctatgtcttcccatgatttgctaatactgagagtagagcttgtatttgatgcagaatgcaacgatggggaatctcaaatcagaatgtcaaaacttccagggaatccaaagcataaggttaggacagctagaattttgtgatgtctcacacgttcgacttctttgttgtacagagatcattggaagcacaaactgtccataaaaatgcattggcacaactattccaatatgcgctacattttttttcaacgaacattgaaatgacatggagtgaaaaatgctatggagaagctatggcatcgccggtagaaatagcaaagaataaacaaacaaacaaacaaataaagaactagctgacactaactggatagtgtagataaatttcaatatatatttcttaacatttcatgagaattaatgcatgctgtgtctcctagttggctctaaacataacagaaaaacgtgaagacagtccattgccgtctcctagtcatcgcccgatgggtcgaactccaagtggaggtcaactaaggaagatgttcacagaatcccaaattggtcgatcgagcttccggaaacttctagaaccaagcatatcagagagaccagggagtactccttatagagttgtccttggtgatgtgaaagaaaaggttagagccatactttatcatttattatacgtctcatgttttcttctccggaagtaggcaaacaattgcctagtctactaatagaggttggattaagggatgcttgattaccaaatttgtacaatattctttaggattaaattaatctcactaataaattcccagagactctactcctgttctttggcaataaagtttgggataaattttatgtggcattttactattaaaaacatatatgccaaagatacccaaatagttggacataggtactctcaatctttggtaggaagacaaacctcaatgagaacaagaagagattatgctatgtataaacagtacccatctgttatatttttcttgacctgttatattttttttaacatggcaaaattttttccttttgattgtgcttaccactctgttttcagctgatgaacacacggagacgactcgagcttcttcttgaggatctaccatgtgatcgtgatacttcagaatattatgatacatcggataaacttttggagcccttgcttttgtgttatcaatcactggttagtctaattagctgatgtagggtcgatcactcatccctttagtgctgtactaccatgatcaactatattctatccgtgcaagtgtgtctgtgtgtgtgctagaaaaaaaaacatttgacacaaacattctcagcattcttcaaaattgccctttaccatctccacattcttactggctaggctttgattagtcgtgacttgtgagaacaatcgttgatgatggagtgggtggaggtttcttttcatcacataatttcctttttgtactgactgtgttcacatcttcaactattttatgaagcaatcatgtggatctagtgtgcttgcggatggccggttagcagatttgattcgacgggttgcaacctttggtatggtgttaatgaagcttgatgtacggcaggtgggcacattgatcactactgtttttatgcttactcacacttaaattttcctgatgtaacttcagaatagcttcaagcgaagtccagtagtccattaatgaatagaatggcgttatattactgtaggaatcaggccggcatacggaaacacttgatgccatcacatcttacctggatcttggtgtttatagtgagtgggatgaacaaaagaaactggatttcttgactagagagctgaaagggaagcgccctcttgtccccccatacatacaggtcagttgttgaatgtagacatcaaatttcctatcctagtggctaatgataacttatattttagttgtgataaatgttcgtttacatggaaaccagaagtgtcaattgagtttcatcgtgtggaacagtacaatataaatccttccatgcaaacaaacatttatcacaaactaaaaaatgctaccaatcttaccacaaattgaaacttatactacacaatcattttgtggtaagattggtagcattttttagtttgtgatgaatgtttgtttacatggaaacaggaagtgccaattgagtttcaatgtgtagaacagtatgatagaatccttcagaaacagatatagttcctttccatatagtcattttgtggtaagattggtatcacctccgccaacgccaaaatggttaatactatgctaacttctgatgaataagcaatgttttatacagaatttgatgaggcatcagatataacatcactgttcattcaacatggattttagtttttttgggaatacgcataagacttacatatctttttattaagattgaggggtggacttacaaacgcaaccgataaaggaagcaaaaacaagaacaccaggaaaagaaaaaaaaagaaagaaagaaagcacagcagagggtgttatttcgcaattaaccaattgtgcgactgaaacctagacgaggaggcttagatcggcacccccgcgcgccataggcttgcttcttcagcagccaagtttgccacttctccccaggatcggcgttggttgttgaaagcctggctattccgttccttccaaattgaccaggcgaccagaataatgatggtgtcaaagccgcgcctcttttggacatccaaccaaaatcccttatattttgggatggagtattttcttttacaagaaagatataggaaaagggattgcagtgttggtacataagaatatttgaatggcaactttatggttgcatacttcattgtagaagagaaaaagggaatggagattcaccttgaagtggaaagacttacatttgcatttcctttgtattcctttcaggttactgctgatgtgcaagaagttcttgatacattccgtgttgctgcagagttaggaagcgatgcacttggagcatatgtgatttcaatggcctcaaatgtatgtagatacgcaagtcttatgtagcactaaataataagaaaaatctgaatatccatcctgcactttagcgttcttgttaaccctcacctgtaaccggccggtggttccaagcattttgccatgtcatgccttgtaccatcttgatcgcatggatcaaatgacaatcgtggcacattatatttatcactctacattaaatatgatgtgttcctctggttgcaggcaagcgatgtcctagcggttgaactgttgcagaaggacgcaagacttacagtcagcggggacctaggaaggccatgtcctggtggaacgtaagtatgattatatatatatatatatatatatatatatatatatatatatatatatatatctcatatgttcagtgtgctactcgatcaattgaacttatgaactcccaattggttggtttagtagttacacaaaactaagaacaaagttgattgtgcaaactaagtagaaatggaaaagaaggaattgcgcactgtgtctctgagctagcaaggaaaattcgactgcgatcttttactttgccagtggctaagccaactgaacttgtttttgcaccatatagatcgtatattatgttttgtaccatggccagtgtttgattgaatagtgtgttatattgtttgtgaataggttgagagttgttccactgtttgagacggtgaatgatctgcgagaagccggcccagcgatcagaaagttactgtccatcgactggtacagagaccacatcatcaagaaccataacgggcaccaagaggtagaatgatcgatgggtttagtttcgaatatctcaaactcattttgcttttgtttcggatatctcaaactcgatcgggaggagtttgcaggtgatggtgggctactctgattccggcaaggacgccggccgtttcaccgcggcatgggagctatacaaggctcaggaagatgtggtggccgcgtgcaacgcgttcggcatcaaggttacgctcttccatggccgcggcgggagcatcggccgcggcggcgggccgacctatctcgccattcagtcgcagccacccggctcagtgatggtgagcactggcaggcactgattaatcagtccattccatgtgtatgtgtttgcgagctaataatgaattgaatggtgcatggtgcagggaactcttcggtcgacggagcaaggggagatggtgcaggccaagttcgggctgccgcagacgtctgtccggcagctggagatatacacgacggcggtgctgctggcgacgctgcggccgccgcagccgcgcgggacgacaagtggcggggggtgatggaggagatatcgcgggtgagctgcgcgcagtaccggagcacggtgtacgagaacccggagttcatcaagtacttccag

SEQ ID NO: 68674 - DNA, 2356 bp, Oryza sativa
tgctcccggcgtggctcggcgtggggcgcggcctccagaacgcttgcgacaagggccacacccacgagctccgcgccatgtacgaggagtggcccttcttccagtccacggtggacctcatcgagatggtggtggccaaggcggacgcgcccatggccaagcactacgacgacgtgctggtgcacgacgcggggcggcggacgctcggggcggagctccggcaggagctggcgcggacggagaactgcgtgctggcggtgagcggtcacaagaagctgtccgccaacaaccgcagcctgcggaagctgatcgacagcaggctcacgtacctcaaccccatgaacatgctccaggtcgaggtcctccgtcgcctccgccaggacgacgacaaccgcaagctccgcgacgcgctgctcatcaccatcaacggcattgccgccggcatgcgcaacaccggctgactcctcttccctcctctcctctgcaaattaacttatatttcttgcaactatatttccgtctgaactaattaccggagttttttttctcgttcaattttccctcaaaataagaaagaaaccttgcatgtagcattttcacattggattggatatgtacattgcatggagaatgaaatagcattatagactatagtggtgtggattgatgtatgtagttaaaagatgagaccattggtttggttcccttcttcatgggccgcaactgtatcgcgaccaacgatcggcccatattgaattgccccaacgggattgctgggtacgtgcggcccatcttaaccggaccggaacggaaatgtgggtacgtgcggcccacgtttgttggaccgtcggggggattgtgagggtactgaggcccatattaattcggccgtaaagtgtgggatacatgtggcccacatggttgggccgaaatctgacgttgcgtgtatggtctgaaaaggcccagctctcttagcctcgacgaatattggactcccatcatattttctctcggcaggcaccagaaaatcgaaactgaataaatgaagggatctttacaacctctatgttcatcagcagatgagcagatcacaagtcaggaaaagataaatctctctttcgatctactactacattacattatctaaaaaatctactcgaactgtagtagtactgggctctgttcgtattcgtatgtgaaggttcccaactctcatttctcgtttttcacgcgcatacttttgaaattgttaaacggtacgttttttttgaaaaaaaaagtttatatatgaaagtagcttaaaatacatattgatctattttttaaaaataataaaatattaatcaatcaagcactaatgaactgtttcgttttccgtgctggagggatggttcccaatccatgcatatgaacagagccatacgcgatgttcctatgacctgaaagaatctcaggattaatagaagagattgaatgatgaagagctgcatctgcaagcatgtcggtgtcggtgcccgtccgtccgccaatcgagcattgccttgcatatttgcattgcatacgcgcatttctcgattgactgcgtctgtcttcctccctcgcgccccgcccatttcatataaaattcataaaattgatgtgagctaatctcatatcgtagctgccaattgcagcaacacttcatataaaattattcttctgctacgtccaaggaagtttcttgcctcaaatcttgcccacacaattgcttggagtactaccttttctccgctgaaactgttctttcctgtgtccttaattatatgtactaaaagtgaaagaaaacattgtagtacctcaattattgtttatcatgcattccattctctaatcaaacacaattgggtatctaaagcaaatgcataaatggattggtcacacgggatttttaaggacaacacgcttacatgtttgtttgctccatccattgtctcctcgttggatcaacgtcaaccttgatcatatctagctgtttactactcctacatgcaaagtttgcattgcatggaaagcgaaagatgcaggaatatcacgacagaaacaaaatgcttgtttaggtgagcggcagccaggggcgcatctacccattaggcagggtgggtcgaccgacttagctacgactcgtgtcgccccacaccctcaagaccccccttaccccattatagtagttatgtgtcatcaaaattaagtataacaaagtgtgaatacttaacaaattgagtcagttatgcgaatgaactattaatatgatatgtgttgtgtctgaattctcttaacgagtgaacattttcgttctccgccccatctatattttaaa

SEQ ID NO: 68675 - DNA, 12107 bp, Oryza sativa
atcatcgaaacatttaaatcaaattctgcactactattgaacgaagaacacactattattttgaagcaacgtgctgcaatttgcatgaggcgatccccaggtccattctactactctgcttgggaaaatgaaattagaatctgtttagtatttgatgcgtacctacaacattgaccgtagcattgaaaacattgaccatagcaacaaggcccatccttaatcataaccattttttatgaagtaagaagagtttgtttaggagtgtaccagaaaccagctagtccacgctacaaagatgtttaagcaatctcctcagttagttcttgcacttagtcggtgcaaaaaaaaatgcaaatatttattttagagccagatcatcaaatttttgttgcaaagccgaagctgccgaatccaacttaattttttttcctttgggtcaaacattttgtcaagtcagatgggcaatccagattcataactaagccatgtgcacagatgtgttctacacagctaaattccaaagttttttcccttctctattacgcaaatactagtataattgcttcaggcaaatgagactttgtttgtttatttgctatctttcgtgtagggaagcatatgaaaacttttaaacttgtgcttttgaactgctccaaggtaaaccaaaagtttctactctggatgatagaattgtttatcagagagagcaaaatcacacatgtactgtacagaagaagggagggaccatgctgaatagtacttcgtcttatgttggtgtaaattaatccatgagttgctttaaatacatagcttaggtgctgtgccagattaagcacttgctagttgctactagagcaacttttctcactatggttgcaccagaaagcttctgcttccttcttcgtcagagaatcagtcagtccttaagatatttcttttgattcatagtctcatcagttgtacaagacctaattataagccaaaacagcttaataacggtaaaaaaataatttatagataaaaaattatatctatgttcatatagactaaaaagataacgatggaaaaaaacacgatgaaaatattgtaaaattaattccaaaattaaaaaaaataaaaattcaaattttagcggccgatttttttaaagacaaatgagactgtcccagatgaaaactgaacctgtaacactactttaaagtgtgaattaggtggtgttcttttcttctgaagataaagatgaagtttaattttttttacacaaaatgaggtgttattaatgtatgattgattaaattttaattactacaaacttgaaaaatagattaatatgatattttagagcaacttttatatagaaagttttcacacgaaacacactgtttagcagtttgaaaagcgtggcatgaaaatctatatctcatccaactatttgatggtgttgttgtaatttgtaactagcgatacggtgagaatgaaggtactgatacagaaagtttattagatatggtatggaggtgctactcctaataaaacacaaatacgaaggggtggaactggaaaagtagagaatttcacacgtcaagcattctacacaacgctagtgtactgactttttcaaacccccccagcatggcactggcagaccagacactgcgcaatagtagtagcacactagcatgtactactacactcctaatctctctctctttctcgagtggaatccattgatccattgtgtagtgggagagagacttctctacgcggtcacgggttccccagcggaggagaaagatagatagagagagcaaagagcaaaaaaatctctcttttttcttcttgttgtttctgcagttacctttgtcttgccttcaatgccaccgctttactgccggatctgaggaaagctcccatccttgctgagttcttgtgctgcttcttccacaattcttccttttgttgagaattttgccttccatctgcttaatcggtgacaaaggtggtgggatcttgcttctcttcctgcaagaaaaggctcgtttttttgtttcgccgtttgctgcttgctcaggcaggaggaaggcgatgctgttcttgctgatttcagtcttcttcttccggtggtcgaggtgaggtttgttgctacttcaccttcgcttcgttgcgctctgcggagagaaagaaagcaaaggtggtggaaaagaagcgaaaattttgcttgcttcctctgcaaatctgaggaattttctcgcagaaagcctgaattccctctgaattccggtgcatggaaagatcgtcccctccatttccaagaagaagaagatactagtagcagctgcagctacactctagtagtagtggctactagtactagctagcctccaatggcgtcctcaccgtctccctccccgggcaccgcaactcccgccaccgccgccgccgcgccttccaccgcgaccccaacacccgcgacgcagcccaatgccacgccggccgacccctccatcactcccccggccgcgtcccctccccttccctccgccgccacgccacccccacagcccgattccccgccgccctctccgccaccagctcctccggtcgcagtgccaccgccggccaccgtgccaccgccgcctgtacccgttgcgtctccaccaccaaccccgtcagccacattgccgccgccgtcgccaccggcttcagtgccggtgccacctacacctgctactacccctccaaagccgtcgcctgtgcagcaacccccagtggctgcatcaccacctccatcgtctccggctgatttgccgccgcctaatccgccggctcgctcagacacgccgccggtagtgcagtcacctccaccgccgcaccggagatcgccgagaacgccatgggctccaccgatggcgccgtcgccttctggaagtcctaccaagccttctccagctagtccatcaccaattgctggagatccaatcatccctacacccaataacccttcgtcgcctctggcgacgccatcagcaccaggctctggtactcctgtggtgacgccatctgcaccagtctctggccctccatcgccaggcacggctccagccacggcagctgatcgatccaacaagtcattaagtcccaacacgcaggacggcagcgtctcgtcgagcgatggtggaatgagctcaagtgcaaaggcgggcatcggtgtagtcgtcgctattcttgtgcttagcttggtaggagctgcattttggtacaagaagaaacggaggagagcaaccggttaccatgcaggatttgtgatgccatcgcctgcctcgtctccacaagtgttaggtaatctgatgaaatgcattttcagaaatcgcgcacctggaaaattaaaatcagtttaagttgtattactagtaggtgatgaactgagcaagtacaactcattttttgcccagggtattcaggtaaaactaactacagtgctggcagtcctgattacaaagaaacaatgtcagagttcagcatgggcaattgtcgattcttcacttacgaggaattgcaccagatcacaaatggttttgcagcgaagaacctgctaggggaaggtgggtttgggtctgtttacaagggttgcttggctgatggaagagaggttgccgttaagaaactgaaaggtggtggtgggcagggggaacgtgagttccaggctgaggtggagataatcagtcgtgtgcaccaccgccatctagtttctcttgttgggtattgcatttcgggggaccagaggttgcttgtctatgattttgtgcccaatgacacactgcaccatcatcttcatggtatggtggtaaccttcagcatattgccgcatgagagctctgcatagttctagttctgtctgaaaactgtttaattgatctgcccttgtaggacgtggaatgccggttttggagtggtcagctagggttaaaattgcagctggctcagctcgagggatagcatatcttcatgaagattgtaatattctttctggttctgtaccttattaatgtgatcatttgcacttcattttcattacatttatttcccttttgcaggccatccccgaattatccaccgagatattaaatcctccaacattttactggataataactttgaagcccaggtaacaacattatttagataaattgggagaggcgttataatgtgaccattgttactaattggctgctattcgtgtgttaggttgctgattttggccttgcaagactagctatggatgcagtcacgcatgtaactacacgggtgatgggaacttttgggtaagtaaattactgcctgccttactgagggcacaagagaacatcgtacattttcatatgatctaatgattatttgttatgcagttatctggctccggagtatgcttcgagtggcaagttgactgagagatctgatgtattctcttttggcgttgttctcttagagcttattaccggtagaaagcctgttgacgcatcaaaaccattgggtgatgagagccttgttgagtgggtaagctatatcagtaactagaaatcatttttttttagataatggaagatgagtatattgaaattagtatgttcaataagatttttgcccctgtatgatcaaatgaaagcaaatggagaaatatattttatcaactgtatttgaatagccaacttgactcatttcaaagattctaataacgtaggaattcacattgagctgttgatctctgcagttcacattttttaactgtgtttttattaggagtcaatccatatagttagccactggttgaaaagcgttctgatataaaatgtggactggtcaactatgaacatctgctgaaatcgtgttgtaaatcagtctaaagaggggatccttgtgtaacttacacaatcacttgcaggctaggccattgctcacagaagcaattgagactggcaacgttggggagctgattgactccaggctggacaagaacttcaatgaagctgaaatgtttcgaatgatcgaagctgcggcagcttgcattcgacattcagcatctaggagaccccggatgagccaggtataggactgaacataatctcatcacatctgattgaacctgaacctgttcattttaatcacatctctcctttcaggtggtgcgtgttcttgatagcttagctgacgtcgatctaagcaatggtattcagcctggtaagagcgaaatgttcaatgtggcaaacacggcagaaatcaggctgtttcagcggatggcttttggtagccaagatttcacaactgatttcacccaatctagctgggatagtcgtagtagagatgttgatgcctctggttcgaggcccttgtaatcatagtctaatactcctctaattagctagggtattgttgcattggatttgtttcatctgattttgttttcttcttttttgtggccatctctgtcaactaggagtaatgtatatcatgcgtcccactaagaaaagtgtatattgattgcactgagcgtgcctgattctacaaaatctgacagacagaagatttactagtactagcccttgaaggaaccaatgaattgcctctgttggtggtgactgaacctgcatattccactctatatttcctcaaatttgtcctttctgaaccagttggtcttcaaatatgtgcctcccgaagcggccattgcctaggaattgatttggtgcccatctaatctctttggaatcctgagcaaaatgcatctctagaactgagctgagctgacatgacaaatggagtaaatggaattatgcgtgatagctgcatcagcactgagctttgagtggagccagtgcgctttgcacatgagagaacatgcgaaatggaatatatttctgatgacgacacacaagtgggctcctaactctaagcctgaagccctgaacacgacacgggcaatcaaccctgaattgatttgaattggattcagtagagaagatgagagaaatttgaggtctggtctgggcttggtttggtgtcctttacagacagaagggcaaggagccaaatttgacccgtggatataactgactggacaccaccgacaactactaatcgtgtgcaccattaattgacctcaagaaaaatgttgagagcaacgcggcaaaagcaatactaccacctgacttttgtgtgatgcgatgtgtgccatgactggcacggcaaaattcactgtagatcatacaaaatttctgtccaagataaggtagataatttacagcagattgatggttcctgtaaacaaagggaaaaggagcaaaatttcgccacgcagtacagtagagggcatgtgatgtctgaactctgaacctaacatgctcgctcaccgcactgctgacttagtacgattaagatctcaagttattttcccattcataaattgccagattggagtagggccaggttctgaaccatcccagtgattctgcgatgcttcggttgcacgtatatgccaatttgtgtccagggctattaatcattgtaaagagttgcacacttcgacacttcacattgggatggcagatggctcatgcctctctaatctttgtctgaactactaggagagtctcataattaggcatcagagattcagaatcacccttcacaattttccccattggatgactcaatttaccaaatcgaaaagatgacaagaagacaatgttattgctccagaagtccagatcgggtcattattccaattgctagctagtggccatggagttttctatcccggcgcataggtggcgttctaggctacggttagagggctcttgaagttctttttgtccctgctattttggataatgagtttattttttgtttctttcttgttggctgtgtgcactctttgggtgcagaagctggaggtgctctcagaataattgtatcacttgatagaatttattgagattaataaagcttccattatctaaaaattagaaaattattccaattgttcattgcagattttagtggcatgagatgattactgttgaagagttatcaagcatcaagagaatgcaaagtattcctctggccttcttttcccttattattgctatggccgctatacaagttatacaagactcgtgcggtagtgcacagccatcttatttttacaacgttccttctatcattgtacatcatggatgaacgcccagtaaaattaagtaatataagatgaaaacatagagctactgtactttacagttcagctttgtgctatttttgctcgcgccaacttcacaacgaggaacgtgtaaatagtgatggttgcctgcatcaagtcagatactttaacaaattagtctaggtggctattgtatttcctttcaatgaacacaatgaccgcagattgaaaatgcagaagtctctgatgatacattgcaacttacacaaaactatacatgaataatcagtacaacaaataactgcatttttttttggttctcagacatttccagagaagaacaaacatgggagggacttacatgagttccacaacaagggcataagcaccaccacctccattgcaaactccagcaaccccaatctttccatttttatgtctaagaatctgtggagcaaaacgtgttgatgtttaacaaagaggaagattgcaacattttgcatgctaaaggtgcagattaaagagagaaaatggcgctgacagataattaacatgaagtaactaaatccaaacttcagtacagccatgaagtattttgcatttgagaacaacacgtaatattttgatctgattttgaatggcctggtagcataccccgagcaaagtgactatgattctcgcaccactgcaaccaataggatggcccagagaaacaccaccaccacttaggttaagctttccctgaaatttacatgaatgttaatgagatcttctggggatacctatttgctgaatgtatagttacatagaatctaacaacataccgaaggaataccaagaagcttctggttggctaaagcaacgacctgtcaaagtccagaagtatgcagttcagtctagattcacgcttcaggtgtaagtactgtctaaattgaagaagacaagaacatacggagaaagcttcgtttatctcataataatctatttgtgaagtttggagacccgcatttgatacagcctttggaatagcaagagctggagtagttgtaaataattcaggtgcctgtgcttgaaaggagttagtataatgagtataacagataaagagcactgtataacaagaggcaaggttagaagataaggttgagagatttgatacatgaacgccactatttgttagcatgaataaataatgggtaaagttcctttcagcatggatttgtttgataatcccagtaaaataattgttcaacagataacaagtcatgtaagagttacctgagcagcatccgcataccctctgatccttgcaataacttgaaggccaagactcttggctttctgtccactgactagcacgattgcagcagcaccatcactgcgaattttggaaggtaaacgagaaggaagagaggtgcactacagtcacacatcaagtaaacatgcatatagcataatttgactttaaactagagaaaataaagtttaactttgaaagtagtctagatttattaaatcattcaagatggaagtgctgttctactaaataaaaaaaatcgaatgatagaattcaataaacaaaggattaactgcaaatgcgttacttcagaatatggtaatgcactgacatttggttgcatgttaatactactctgcaaagttttctgttaataagtcacttagagaattgttatcaaataagtaaaccttatactagaagaattgccggcagttacagaaccattcttcttgaaagtcggcccaagtttcctcagcttcgctgaattgaactgtgcaaatagacacacccaaagaaacatgtcaggtctgggaaaaaagtttaattgttgttgtttgcactaattcaatttttatttttatttttttggtttgtgctgttgccttccttttttatactatatagaataatttcttgagaatatgtaaatggtgaaaatgtcatgctacacatcggcataaatgaactacttccattaggagaaatcattagtagactacctttgcaagactctcatccttgtcaacaataagtggtggtttccctctaccggaagaaatttcaacctgaaaaatccagaatgttttatgaaatctgtgccagtgactgaagtgttgatatgtcatgtagaaaaccaattttaggtcggtccaaattatatacccaccggagcaatttcccaagaaaatgtgccgctatcacgagctgctattgcacgttcattgctctggatagcataaagatcctagaagaaagaggtgttctttagtccaatgttagctcctagatataaacaaatatgcaagcgcagatgcaggaacattgacaacctgctcctcccttgaaatggagtgttgatccgcacacaactcggcacacattcccattgggaaatcattatacacatcccacagcccatccttgagcatcccatcgatgaggacgtcgtgcccaaaccgtgacccccgtctgcataacatgttgacattataccataagcaagcaagaacaatggatgatggcttagttcgccgaaatttacagcatcacttgaggatggtaacgaaccttgctgccgcgacatatttgggggcattggacatgctctccatcccaccagcgacaacaacatcatgcatcccaagctgaatagtctgcgccgcaagcatgacagctgcaagacccatttttaagtagcactagatagcaaagcaaaagccgatcctcgagtagcagaaacaagtaacaactgaaaaagagagagagagagagagagagagagagagagaggttaaaatagcgaaattacccttcatccccgaggagcaaactttgttgacggtggtgcagggcacagtgtcgggcaagccggcgcctagggcggcttgcctcgccggggcttggccaaggttggcgctgagaacgttccccatgaagacctcctgcacgagcgccggctccacatttgctctcctgagagcggctggttgtggggaagcatggccaaatcggattcagagaggaagaggagaagaaaactgagaggagcactggagtttaccctggatggcgacggagccgagcttggtggcggggagggaggagagggagccgagcagggcgccgatgggcgtgcgggcgacgcccacgatgcagacgtctctcggcttgagcaggtcagagtccgagtgcggaggaggagccatgatgtgatgtgcttctccgccgcgccgccgccggagtaggtgggggtagggaggcagccgccggtgaggtcgacgacgacggcgtggagacgtggagaggtgaagcggcgtgtcagccttcttagttaaagcaacaaacaagatgccgtattgggcttcgattctactaccatatgtggggccttctattctcctattagaattttttttttaatttttttattaaaagttttacaaaaataattttctatttcaaaaattgacaaaagtagtcgcccgccgctctctgggagggctatttttaaaaatcgccctcccagagggcggcgaatgtgacgtggcagacggccgtttgctctcgggcgacggccgtcaatgaaatttgcaggcggcccccttgccgccctgggggagggcgattttacactgtgcggggggccgcctgcaaatgggcggcggggggcctggaattttgcagacggcccccttgccaccctaggggagggcgattttacattgtgttttatttgagaaatagatatttttataaatagaaaattgttatcaaatcttttatattgaaaactatacaagattaaaatctcccagattggtaaaatacaattttattatttttttagtcttacgcatacaaaaattcaccaccataattaaacattgtaatgataagatagataagaagtgccatcaatacacggtacaaatttattgatcccgacaaatctagcctgcggtaacctatcggccccttctaggtcggtcaatatgcattgtattctcgtggtccttcaatcgttgatactctacttgtgtttctgactctgttatattttggccatgatatgatggagtgacattgtcgatccatcgagtaaatccacacatcgttggattgccctgaaaaaaatagtaatgttattcagtttgggtagaaattttgtgcaaatcatagcggattttggaaacggttagacatataacgaaatcgttgtctacattgtggcagacaaaatatctccttccaaatgtttgttctgcaaaggaggtagccacctggcagcgatctctgcacccacactttggacgctcggaccatttaggtaaccctaatggattgttcctccagtctaagcttgcaatttccacccgacgttcgtactccatccaagcatgaatgaactgtatggtcggttacattctccagatcaaactaaactacatcttacaattaacactattgtctatgtctcaattcatactattatattatgtgctctggatctacacatatgtgctgtgtgctacagatctgctaaaatatatggaactaaaactaaaacgcaacatatagtactcaaacataacatattagtacaaatgcaaaagaggtatgagagcaaacctgtgatgaagtgagcgaaccagcagggcttcgccgctccccttctgctgccctcccctctctctctttcgttttttttttggatttttagagattataatgaaattttagagaggggggacatggttatactgggggaggcaaaaatcgccctcccccagggcggcaagggggccgcctgcaaaattccaggccccccgccgcccatttgcaggcggccccccggacgccgtggaggcgggctacccc

SEQ ID NO: 68676 - DNA, 3840 bp, Oryza sativa
taatatccttttcatagggcagcaggcatcaaatcaatggctcgaatgggaggcctgtatacgatcatgggccaggaattatagtcggaatagcatttagctgtccatggtctctggacctggaatagcatgatagttggacatgcccaaataaaacggagataaaatttaggacacttatggcaggctttttaacctgatacacggtgtgtttggtgtaaaaactttctatatgagagttggtgtaaaatgttatattaattcatgttgcaagtttgtaataaataaaaatgaggtggtcacacgttttgtcttataggttgggcgtacagcatatcctttttattttcatgttcattttcaggagattcagacaccatcaaagactagtgcccatgttcctccgcatagtgtaagcgggccttctctcagggcgggaagggggcagcctgcaaaattccaggccccccgccgcctatttgcaggcggccccccgcacagtgtaaaatcgccctcccccagggcggcaagggagccgcctgcaaatttccatgcccccctcgccgcccatttgcaggcggccccccgcacagtgtaaaatcgccctagcggagggcggcaagggggccgcctgcaaatttcattgagagcgaacggccgtctgccacgtcacatttgccgctctctgggagggcgatttttaaaaatagccctcccagagggcggcgccctcccagagagaatagccctcccagagggcggcgccctcccagagagcggcgggcgactacttctgtcaaattttgaaatagaaaattatttttgtaaaacttttaataaaaaaaattaaaaataaaaaaattcctcctattagagaccggcctgtcatattatgggcccttctaatatccttttcattagcccacaggcctcaaatccatggcctcaatgggaggcccgtatacgatcatgggccagtaattttagttcgattcgcattttgctgtccatggtccctggacctggactagcctgatatttggacatgaccaaataaaacggagataaaattttggatacttatggcacgctttttaaactgctacacggtgtgtttcgtgtaaaaactttttatatgaaagttgctctaaaatgtcagattaattcatttttcaagtttgtaataattaaaactcaagtaatcacacgttattaccatctcgttttgcgtaaaacacttaatttttattttcatcttcattttcaggagattcaaacaccatcaaagactagtgaccttttttttcctcttcttaattgcggccattttctctgatccgaaatatttctaaaaacatgaccctataaatcaacaaaaaaacaaaatcataattcaattaggactccatccaaaataataattgtgaactcttttaaaaatatataaaaaatccacatattattctgtgcacctcctccccgccccggcgatcggtgcatccccaagccccccgaaatattcatgcaaacaagaccctataatcaacaaaatacagaatcataatttgattaggaatccatccaaaataataacagggaactcttttaaaaagacaagaaaaaactcaaattattcacaacataaattcagactatttcaattgggaaatccaaactttcagcttcgaacttaattgaatgttcaacatgagaatgactgaatgagggggtacctcaccttaactacccagttaaattttacaaattccgactagtctaaaaaaaagtttacaaatttcagaacgatctcgagtggatagcaaggaactctatgcatgtgttgcttgactgagttagcgattaaaatgtgattgtcactatcccaatcatcattacttaatgatttcacaatcgatcgatcaatttttttttattttgagtactagcagatcatagtcacgtatcgtaaacgacacaaaattttgacactatttacatttgtttcataaaaaaacccacaaataaaaattaaatgtgcatgcataagttttttgaaaggagaaactctgaggaaaatgcaacgtgttactaagtttatatgtgttgttttcgtgcagaccaagcgacgagagaagcgtgtgtatattgtcatgagcttagttgcagggtgagtgacatgtcaccttacgtttcaccaaaccaccagactaacctaacagaagattactctatcattcaaccgacgcgtataacaaaagaaaaaacattttctacttttggtttatgttagttttagtgttgcctaatcttgaaacgcaagtaattaataaagctgctcgtcactgtcggatcttcttaattggctgagcaactgggactgcagatcgatcgatcttctgctttgtgccgcagcaaccaccgatcgactgttgatcaccctcacgtcaaattcaccaattatgcgtatgaaattgacagcttaattcgatttcattatttcaccacgaagcgagttgaaatttggtttggtctccatcacaagatctgtgcatgattagctgatagagctagccagctggagcagtagctcgatctgagtgatcgacgtacctgcaaaaccatgagatcagattgtgttggtacagtatccgagtctcacacctaattgaagttgaagtctctatagttccaactcatgttggtacatccatcgtccaatgcatgaatgttggtatatgaacaaatcaacacgtttgacacatcataaaaaatgaacaatttttaatagccatcttgtcaatttaaattcactgtaatttcaagaaagcagcaggataatacagtgatatatactacttcacttttttgatgcgtttgatcattcgttttattaaaaaattacatacttatagtttattttgttgtgagttattttagcacttaaagtactttaaacatgatttatatatatcttatacatttatataaaacttttaaataagattaatgataaatatgtgtttaaagttaacggtgtaatatatttaaaaaggagggagtacttggtttcatttaatatccgatgtgataatttggaccttcaagtcctgtttgttcagtgaacgcgtggaggacgaagctattggtagtatgtccatcttcttctttttttgccggttaatttgatttggctcggagaaaattaaggagaatggcaatgtggtgcggtagaaaaggcagtggatcgtcttctcttggaggagatggatcaaacgggttggttgtcgtgtcacctccattctcacccaacttccttacctagcaagcttccattgccatggcgatggcggcaccagcatacgcagagagcgagctctatatactagcaactcgtgtgggagagcagagcagaagcagaagcagagccgaaccgagctagacgacgaaagaggagagggagaccacgagatcatcgacaatggcgctgctccggcaatggcgccgcggcctcgccctcgccgctctgctcgcgctccacctcgccctcgccgcggcacagtcgcctgcggccgcgccggcgcagcccaccccaaccccagtgcccacggcgccggccaagtcaccgcccgcgccggccacgcctgctcccaccgccactcccactcctcccgttgcaccggccaaggcgccgccggtcgcgcccgccgtcgcgcctgtcacgccgccgccaccgacaccgaagaaagcaccaccaccgccggtgacgcccccgccggtgacacctcccccggtgacacccccgccggtgtcgcccccgcccgcgaccccgcctccggctct

SEQ ID NO: 68677 - DNA, 5934 bp, Oryza sativa
atcgcacgaaaccaaagacaatgaaatggtgccaaacaaaagtaacctcatgtcatttgcgatactgcgatgcgtattttatacatgttaatgcatctaggaacggatcactgtcttcagttgcatacaattgccattccctgaaggctgaaccctgaaggtatttcagtgaaagtattttagtcactgaactgaactctccaccattcttgagactttctcttttgaaaaaaaaaattgagtggtgaggaaacaagtattagatctagtcatggtcacttggtcagatgatcattcagcagttgtgtagcacgtatcagtcctcctcgtcagcttcgtgaaaaggcagcggaactgtttttaccgccctgaatttgcctgcattgttcagatgctcgttctccagcctgatataaaaaaaaaaagaagcatatgccacaggtctcaggatctcatttttcttgcctaaatcctgctactgctttttctgttttattttttaggataagtggttgttcagaactctgaaacttcagttacctatagaaattccaatgccctctccggatcacctcgagagcagctagaaagaatgaagtgaccctggagtccaaactcccaaagtttggatggatcacggtttgtagccatgcaagccttagcacaaggttcagaccctgcaaaagttcagacaacacttgagtgtttggttcacttctccccggaacagattcattgcaaattcagatcaaattgcgtttccatttcaatactatagtgtggtttaaatagtaggttggatatcggttgagcattatcgatgatctgtgattgagagattgagagtcgggtttgtcgattggacagtgtgtgtttgagcgtgcagcttgtactgaactactgcaaatgaactcgttttggctgtgcttatacacctgtctgaatggggatagactgacgaacatgcataccattgacaagtagtatatggacttgctcttaaggatgaggtcattcctcagccatggattcttggagttgggctggagcaagccccagtccttgacaaagtcccagtagagctgatacattgttgcagagctggagacgatgacgaggagtgagagtgatccaaggctcctgtccttctcgtaggccactttggcgccggcggcgagcatcgccgagacgtacttgcccaggtttaccaggtggcccgtgtcgctctcatcgaaccaccgtcttgcacactgattaacatacacaaacattttcagaaagttcagaaatattcaggaagttcagagagtttttcttttcagctgaacagagtgcattttgttttgtgtgtgtgtttattccattttatcaataaatgtgtattccaaactgctgatatatggaacataaaatttgcatggttcattttctttttttattgaaagagcatggttgaaaattgagaattgtgaaggacataaggggcttgacctgcatggctctccagtagtagggcaggaaggaaactgcataggccaaatctctgatatgcttggtgttgatgcagtatccgtactcctgtgttctgtagcttccactgatgtagtagcaagcgacgtactcgaggcttcttagcataggcacctgcattttttattttgttctttcagaaagttaattatctgtttatccccattgttttttcaggtttcagttgaatgcaggacatggattgagtggtttaagtagagcatattcagtagtacctggctgcagagctgatctgccatgaagaagtctaccattacaacctgcagacattcagaaaccatcatgatatataagaacatatgtagtaatttggactaatttggcaacattattctccatgaagagattagcaaaagaaaaaaaaagaaaagatgtactgtggtaccttgtagagtggtgagaaaacgatgttcctcagtatcctgaggaactgaaaccgagtggagcgatacaccatgttgaatgggcagaacagcagcagcaggaacccctacattcagacatgcagcaccaacagattccattactactatgattattctcattctgaaacgatccagttgcaggagaacaactcaagatcaacgtgtccatccaatgagcaagaaaagcatgttcttaatttggttccttgttgacagtgacagtgtgacactgacgacagtctgacaggagggagcaagaaagaagagttcaccaggagcaagaatccggggatggcctgggcgtggaatcccctgacggcgagggagaggtgcgcgaacatgacgccgacgatgacggccatggatgcggtgcagacgaggaagacgtcccggtacttgagctctcttccggccgcgaactcgaagatgaagctgtagttgatccgggccttcctccacgccaccatgttgcacccgtacatgaacaggtgcaggaacattaggctgaacatgctgcaaaattatccattgccattcatgtcagaattcagatacagtattcgatcaacgcagaatttcagaaaatgcagagtctacatgcgtgtacctgaaaacagggtagacggtctccatgtagatggagtcgcgccgctgcgtgtacattccggcgatgtgcgccatgatgcagtagcccaagaacagcgccacgaagcatcccgtcatgagccctgcatatacatacattcagagtggtacaaagattgtcattgcaaagtggaaactgcatgcagattcttgttttgggtttaccgatgaagaatgtgacagtgtgtgactccttccgttgcgtgggcttgaggtacttcatggccttgcgcctgttgccggcggcgaagtgcctgacgaacacgtcctccacctcgtccatcagcttcagagcctcgccggagctgttgaagtaggagctctccaccgccctgaggtatacggacagcacctgcttcccgctaaccttctcgaacttcttcaggatcttcacgaacgccatcatgttcaggttcctgcatgcatttcacatcacacaaacagttctgaacttctgaatctgaactgaacacacatggatttcctagaggatgacagattagcagttgattaaattaccggtaggttgtgaggtatccaagacctttgtagagctcgatgaaggcgcccttgatcatcttctcggcgtgccggagcttcgtcttgttgatggtcgtgaacgtgatgccggcgtcagagtcgcatttgttcttgggctggctgacgagatcgtcccggaggaggtcggtgagtgcagagattgtcctgcatggcgtcgtcagggggatgttgatcttcaggttcttcctctggcagctgctcactgtcctccctaggctctgccttgacaagcttccagaatcttctagaccctgctcagccgaaagctcttcagggtctctcatcaccgcggtttcgtgttggctctcgtccgtgtctgttgctgacgtcacgtacctcgtggactcatcctctgttttgagttttttttataaaaaaaatcagtaattaatattgagtgaactatatagaactgtagatttttttgcatgagggaataaatgccattattttagatagctgtcataatttggcatatattcatgtatggatgtcatctgcatgttattcttctcgaattaatgaggggatagcattgacataaaaaagaatctccatatataaagtaacttttgcaaaaatacaaatactttgaccttagtatagaaaaactacttcacattttcaaaatgttactacctagtatgatattagatatttcataatacaataaatttgaatactagaaaatgtctaatcgcatactagttagtactcattctgtttcatattataatttgttttggctttttaaatttgaccaagtttaaaaaaaaatagagcaacacttatagcatcatattagtttcattacatataacattgaacatatttagatagtttctttgttttgagttgaaaatattgttatatttttctatgggatcaaacttaaaaaaatttgacttaaaaatcaaaatgacttatgatatgtaacattatgatatgtaacaaagaggaagtacatatctaaaccacaccatggaaaggccacaagggtttagcattaagcttatcaccaaaattagactatgtttataactccatcagaataatattgctagaaatataaactctaaaatatgtagttttatgataacttcattactaagtcgatatgtagttttatgatacttcatattaaatccatgcatggttttgtgatatattaatttggtatttaaatatagttttatgatagtttggtcaaagtatatatagttttttaaactcgacctacacaattatatatgcttgtaattgtcaaggtgttaactgtacgcggcatatatacctatgcaaaagtactctttagaaaaagaagaatatataaatactactataccaggtattatcaggagggacaggatgcgacactaagtaaagtaggatgttgaggttgatatgatggtcgtgccaaatgcagacaaaaacgcaagtcattaaagacatccacacaattgatcaggggaggatattccattattcccgggcaagctgctcacgcacgtaccaataccatacgtaccatgaaatgaaatgaaatgaaatggggttgggtaattaagctaagctaagctagttgctgcgaatgcgatcctacgtgcatgacaatacctgctagctcatctccatcctctctcaccaccagcttcccactaaccatggtcactacaggagagagagaaagagagaggtagctcaccggcgccggaggtggcggaagaagaagaaatggaggggtcgtcgccggcggcggcgcggtggtggccggagagagacgacgacgaccgcgacttgagtcgaggagtatgtccatctgcttccggagggagtgacctctgtggaggaactcctcctccttggccttgtagaagtggttcaccttgttcagctgcgcgtccagcctcgcgaagaactccctcgccgccgtcgccgccgtcgtctccatctccggcgtcacctccgtctcgtaaacctcccccctgcccactctccggcgcacctattttccatttatatatatatgtgcacacacagtacatgcaaaagattcagtacacatgcatggctatggcttaattgcaaaactgataaaaatggtagcacaaggatttactgtcaattacttgtatggctccagcatgatcagcattattggagccaaagaaggccgccgggagcttgtgcaacaggagcctgcagtgagacaaattataacttgatggcgccgcaactgattgctgctgctgatgatgatcatgaggtgttgaggtggtaattatggtcccttggggagaataatcatgctgcatcctcttaagatctttcttgagcaagctatagtccacaaaggcatgcttccactcagggacaagctgcccttcaaattgcttcgagaacttcaccatggttaattctatatgatcaacttaattaacgagcaatacgcatgcagctgctaattaattatattgttgtgtgctgtgctgtgcagggggagccatggaggttgttatatagcagctagctgatctgatgggatggaatggaataataatctctctctctctctatctttgcaggtgttgcgagacaacgcattatattctcagatatactacactacgcgtacgtgttatatctaggccagctaggctatatatctagcttagcttaaagcttgttggtgatggttgtgctggattggattccaggagagaagagagacagaatcaagagaaatagtact

SEQ ID NO: 68678 - DNA, 1763 bp, Oryza sativa
  unsure (1)..(1763): unsure at all n locations
aattatcctaatatatataagattttttaaaaggaaaaattgataaaaaataacttaatatgtgatatatcatgcatattccacaaacgtacaattataaatttgaccaagacgaattaaaaaaaataaggttgtgaatatagtacatgtagttatagtttaatttattatttttttacaactttgaggggttgatttagaattttgcatgtttgttaagtgatatatcatacattgatctatattttattttttaaaaaaaatatataacggaatatactatcgacggaaaaaaactatccctatcaattctgaactatggacaccagtatagcttaagttgtctagtcttgcttcaaaaattcagatataaatagctagctaggatgcatcagcgatttcaccccgttcaaatccactaaaaaaatggataaacttttagataaaaatggtacgcttttcaaactgctaaacggtgtgtttcgtgtgaaaactttatatatgaaagttgttctaaaataccagattaatccatttttcaagtttgtaataattaaaactcaattaatcatatattattaccacatcattttatgtgaaacacttaatctttaccttcatcttcgtcaaaagagattcaaacaccacctatgcctctccatgcacctgttactatccaagtactacatattgtcatctttcttatattgggcgtaacggtagtagattctgttactaatctctgcagccatgcaacagttctgtaaataatgcaaactcagttactatcacacattttatctcaataattattaatgtgtacatgactatcctagtactgatatatatgatacaaaaacataaaagtaagggcatgtatatatatagtaccgggaaacaagatcatcaggtagtaaagagagaaaatcaacaagatgccatatgggtatatatcttcactactcatgcagagcatatattcgagaattaacacgcaagctagctaggctattgatcgatggaatagttactttgttaatgtgcatggttcattctcgatggacgagagcattttgaaatataataattggaagtccaatatatatatntttagttctgcccgacaaagatagaaaatactgcccagattcccttaggatttgatgttcatgctctattcgagcatatatgtacaatatatagccagtaataataacagttatatatatgatcaatatatccctgcagattatgttttacgcgatggtctttaattttaggagtttgtaacgtacggggccgggaattggcaggcaaaacacaacacacagacatgatcgatcaggatagaaattaaagatggtatgaaaccgtacccccattattgtttctgcctcaagagttaattgattgcaaaaagtataatatcttagagagacaaagagatcaaagaaagaaactcgcactagctaattgaaaaggaaaaggctcatggcctttgatttgagccttttagaagaaaaggttatcttgcatgcattgaaagagaaggggaaaactaaaacagaccaataagatcgtgagagcaaataattactacctccgtttcaggttataagactttctaacattgtccacatttatataaatgttaatgaatctagaaagtgggtaacatctatatgaatgtgggtaatgctagaaagtcttataatatgatccaaattactgatatactacctccatcccaaaatgtttgacgc

SEQ ID NO: 68679 - DNA, 15110 bp, Oryza sativa
ctggataagctgtgctcttttagtctctgtgctgaatacttcatttctgttcatattatggtgtttactgaccaaatgtcttctctttggcctaacaaggtaatcagtgacctttttcttgtcagggtaataagcttctgactatgactaccaaatttctgacttcagagtaggcatgctgttggcctaactgtttagtgtttttggactagatattagactgaacattgaacaattacttgcacgtcgtttgtacttgatattggtgtgccatttcttgattttgtcaggctgcaatcaaggccttgacttagccaaaacaaaaaatttcacgctgtcacatcgaatgtttgggcacatgcatgaagtattaaatgtaggaaaaaaaaattacacatattgcgtgtaaattgcgagatgaatctttttagcctattgcgccatgatttgacaatgtggtgctacagtaaacatttgttaataatggattaattaggcttaataaattcgtcttgcagtttctttggcggaatctgtaatttattttgttattggactacgtttaatacttcaaatatatgtccatatatccgatgtgacaacgaaacctaaaaaggcttaacctcactggacattcagaaaattcatcatctactactataaatcactttgaccatctatctggaagattgtttcagacagtacagctttggaagcatccgtgctaatgatgatagatccttttcgttgtgtgtaaaaagccttttgactctcattggccggcctgattaggagttgatgatgactaatctgaccataataaagactgcccaattatggctgcttcctttgcgtctcaaagggagatgtctcccatcatagcttgatcatgcacaacctttgtttgttacgttatccattgcaaaatcgtacaccggaaatatttcttttttgcgttcgattcttctgcacgcctcatttggcatcgcatctgattgccctgtagattttgcaccgacgacgtttttatcggagagagaatatgccagtgtccgacagtaatcagacactcacgcagcttgaagaagacgaatgctaggctgctacctgatgttctcaacaggagaaacagagtttctttcagacattatcaaagcaggataaattagatgatctttaattatgttctgcggtagagatgacaaactttgagcaagatataattaaaactggtagaagtctgaattttgtacttcacagaaaacggagattggactaactgaatgatcaaccgcttatggtttgatgaaacaagaagtgggggagcacacaaagcgagtcaactcgaatagttcagttgattcagtaacaagagcagtttcccattcagttttgacacgccaagagtgtgcaggtgattgcagttaacacaaccagtcgagcgcattacatatggtccaagaagattaaccgcccggtcagaatgagatactaattaatactgaaatgacaacggatcatgccgggaagaaagtcgacgtcgtcgtggttggcaacgttgacggcgagcacgtcggagtagagcaagctcgccatgatctgcacgaggaggcggcggcggcggcggcggctgaccatcatgccaccagaggcctagccattggctttctcatacgagaggtaggtacatataatgtctgcaaatttatgattaattgatacacataaaaccctttgcatgaattgaattgaaccgatgaatggatggcaatggcgatggagcaggtgatggtggaggggttggcgtcgttcttggtggtgttctggtcgtgcgtggcggcgctgatgcaggagatgtacgggacgctgacgttcccgatggtgtgcctggtggtggcgatgacggtggcgttcgttctcagctggctcggcccggcgcacttcaacccggccgtcaccatcaccttcgccgcctaccgccgcttcccggtctggcccaagctgccgctctacgtcgccgcccagctcgccggctcgctcctcgcctgcctctccgtcaacgccgtcatgaggccgcgccacgaccacttctacggcacggcgcccgtcgtcgtccacggcacccgcctccccttcctcatggagttcctcgcctccgccgtcctcatgatcgtcatcgccaccgtcgccaccgacggcacagcggggaagacggtgggagggatcgccatcggagcggcggtgggagggctggggctggtgatcgggccggtgtcgggagggtcgatgaacccggcgaggacgctggggccggcgatcgtgctgggcaggtacgacggcgtgtggatctacgtggtggcgcccgtcgccgggatgctggtcggcgcgctctgcaaccgcgccgtcaggctctcccaccgcatcgtcgccttcctctgcggcacctctgttgggatcgccggctcgccctagctaccacactagagcttagccctccatatatatatccacagaataattcgcctccattatgatagctgcatgaacacgacgagcatcgctgcactgaaattgttttggaccaaccaatagagattttccatcccaatacggcccaattttgcatcgcacgtttattcacagaataagtctaatttatatcccttatatttacgtctcattacgagtgggcccggagacgatcggaattgtgttaacatggccaaaactaccgtccgcaaataatatgggccttcgcagaggcccaagttctcgtcttggcccagtggacgcaccatatttcaacggcccagattgcatcgaacatacaaataggactctcttgtccatttccacatttgaacagtgatttcgtcttcgcccaaaaccctaatccctctttctcttctcgcaccggcgccatgacgctccatgatttgataatgttgtgctacattaaacatttactaatgacggattaattagactcaataaatttatctcgcaatttaccgacggaatttgtaatttgttttgttattaatctacgttttatacttcaaatgtgtgccgacatattcgatgcgacacttcaaaactttacactactaaatctaaagagccccttagtacaagtccaagaggcgaccatctcagatgagaataacgagagattgatatctcccctttgcctcccccgtaaagatgaaaatggtacggaaattttccggatttcggacttgtttttggaaacagaacccgttggtcggaattttttggaaacggaaacaaattcggaaatatttcctcggaaatggaatcgaatatgataagggcagtttccgtcggaactcggaatccttcggaatctttctagaaacgaattcggaaattttccggaaacaaattcaggtttttttctcggaatcggaaacaaaaaatttctcatatacaactgattagcttaagcctttaatattctaaatgtttagatttatctattgaggtgtttaattaaataaagatatttttagtccaatactttagattttattttcctaattacttttttttatttatagatgaatatagctctttttctcaagaaagtaaagtgcacaactagttatattattattaattgataaaatatagaaatattgatttattgttttagaaaaaatatttagctgcatcttttcattaagggctttttatattagacaaatatccgttaccgtatttgcttcgattcatattcgtttcgtttttgtattcgataatatttgattgtgttttcatatctgaggttttcaattttgattcctactccgattccgaaaaagcaatatgaaaaaaaataacaaatgtggtttccgtaccattttcatccttacaaatccaccgttaataagtagctagcgcaacaattattctaggaaagtagtagtacgaaaataaactcgatcgatcgagaggtttaatctgtccttcctctcgccggccccgtctcctcttcccccgccgccaccgccgccgccgccgcctctagattaaagcagagctacagccaggaggggcgcgcgccgccatggggcttggcaacgtcgccatcctcgtcggctccggtgagtccccctcccccccccttccgccgtctgctccctcctcctgaggtccacccgcgcacgcgcagccctagcttctcgtcgcccagccggttgactttcgagttcgagattgatactagatagatagatagatgctacttgcaaccatggcgcaggcgccaaaccaatcccactgccaaatcccatcttcttttttttttttgagaaatcccatcttcttgtattatttgctttagcagattccaatacatagattgatttagccttttagggccgggtttgtttagttcaactaagctttctcttcaaaccaggtggtttcataggaacttattaggtatcccactgctacatctgtcaaatccccccaacttattgcccatctaatatcatagggtgtatatacttaccggcttccccagtacataggcccttccactaaagaactaagtactagttttactcggtaccaatgtttatgctgtttgctgccctgcaggaattcttggatcagttcttgtaggtggtgatgcaaactccctagtgctggcgaggtactttctggtgctgccaaggtatggtaccttattgcccccatgccctaactatcaacccaaaatactactgctatatatgttataactcaccgtcacatgattcttttccccctcttagtttgtcaagaagcatggaaacgaagggaaagatacatcgtctaacaccgatgcacacaccgctcagctattatctcaggtcaaccatctcagacaggagatacaatctctaggctcaaggcctgttacagttgtcaccaatgctgctagatcaggtaagttcctgctgactagttactatgttttagttattgacttatgcgtgagacacagatcatacaaacataaattttcacatgacactatactttgtatacgccccaatgtcgacatctttgctaagaattaatgcgattttagagtgttagatatttctattaccttttgatttttttcagacttggtctgttgtttttatatctacatgttcgacagagctacaattgcattgtctgttcatatatagagtataccattttgcgattcagatgttcacatgttcttttctttttctttccttattattatttgtcatggtcttggctgggatactatgcactgctgattatcattatgttgttcactgcattataaaggttcttggacatgtgaaagtttttatagttattgctaataaactttcatcatgctcttttgcctttaaacatacacaattacatatggttacacacattctttctcaaatttccttaaacgacattcatgtaaatcctttttctgtaggacctggtacatttactataacagtggtggctgttgctggggctgttggctacgcctacattaagtggaaggtaatgtttgattctttcacctcaatgggagtacagaatgaggaggacataatctttgattattctagttgctattttgatgtttattgttctgtcattctagatcatggatgcaagtgcatattattacaatcctatctgcttgccatttcttgtttcgccgttctagctagtttctaaagttacattgatttgcagggctggaaactttctgatttgatgtttgtcacgaagcgtggcttatccgatgcttgcaatgtagttggcagccaattggacaaggtttcagatgatgtcactgtaagtttttaacttctttcagcaacgctgcactcaaacgtgttacttgtaattccatgttttcattgttccaaccaaaacatcttactggcctttgattttcactattcagtctgcaaggaaacatctcgctggaaggattgatcgtgtggatatcagtttagatgaaacacaagaaattattgaagggacaagggatgaggttggaactgtttttccttttattttttgggtttacttttatagtttttgatgcattttcagcgacctaatggcatttcatgactgacttgtaggtcacagtcatccatggggatcttagtgctttccaagaggatttacaatcagttaaccttgtagttcggagtctggtatgtacctcatactggaacagattctaccttatttactgaatatccagatttctaccttattaactgatgaatattactcatgtacttttattgtatcttgtatcatgcaggaatcaaagctcgtgagtctggaatacacccaggtgagtagaaagctctttttttaaaggaaaagtagaagctcatattaccactacaccaactaactcgtcgacatgctcctaatgctatcttcttgaaatcctgttaggatcgtacggctaatggaatatctgacttggttgagttcacccagaaagccactattcgtcaggcaagtttgaatgatctagtgattcattaatgccatgcttcttcaatactttatttaacaaaaccagttgcacctcaactatttgcatattctcttcctatatgcttattctgaagagatgttttgattttcaggtcccagcagcatccgttcctccagctattggatcttcagagctagttgttaggagggtaaaggcttgcacctttcccagctttgtcatggtcgggacatgccccagtttgttgactttggtacctgtgtttccggttgcaggtttcttcgttgcctcaatctactgctcttccagttctgccgacaaccacacctgcagctgaaccatcacctagggcagaggcaccacaggtgtggtttcagtttgatgttgcactttgttgtttgcaatttcagtttcctcttgcgctttccatgattgaaacgagctgttgctggacttttgcaggaggaacagtggggttttgtgagcagaacatcatcttgtagggaaggatcaggtcgttttcaggagcagcggagtgttgtgaccagaacgtcgtctattagggaaggatctcctgaatcttcaaatggagcctcatcctcaactggagcaagcacaggaacgaacacaagcacgagcagatttggtgggctgaggctgcctggacttgggtttcttgcaagttcgacgagatagttgatgaggtgtttttatttaagttaaaagatggtgctgccaggagctctccattgctttacttgtagttttaggttgtactagtaggagagaagagataacactagcagtgatgtgatggaacaacacatatgcgtgcggggctgggctcctttgttcttgaggaggccaaatttttgtagaaaaaaaagagaggaaaacatgtgctcctatctatctatctatctatctatctatagctatgaatgcatcatccagggcaacaccttggtctttgatgtcgtgatttttaacttgaagtgccaagattactagtacttggttaattaaatttatgacgaggagtcaactggttggttgcctttgttactagtatcttgtatgacatgttgatatttcatccatcttaggaccatgatttgtttcggatttcttgattttgtttgggatttctgttaagatcccgctaccgtatctcgtatgatatatatgatttgtttgggatttctgttaagactagcaaaaaaaatacccgtgcgttacaatggacgagagaattttaattttacatgtgtgcatcccttgtaaaatgctttctttttcttccaaaaggccataaataaatttagatgatttattcagtcgaagttgtgaaggaagtgttctgcatatggttcatagtttggtggtcggatttaattctttggcgttgtgatactttatgctctggtaatttggtttgtttgaaggagctctccgaaatgagcttagtcaagtcacattatctactggtctccatctattagctaattgaccaccttctcacacatatcatcgtcaaaccattatacttgttcagaaataatactcgagatgtacccatctctattaaagaaagcatttcacattgtaagatgaagaagaacaatgatatttcaaaggagaagaaggaacaaaaaaaaaaaggatgtacaagagggtaataagtgattagctgcgcattcctattaagaggttttttactgtccttcaggttatatagtaccaaatcctgaccgttaatctgacttcatcgaacagtgagaaatcgtcggtacctcatgtaccgcacctcctcatcctgtaatttcgcgcgcggcatctctttctttcgcgttttctcttccgccagataggcaattcgtggtggtcaacggcaggagaccggcgataggtggtggtcattagtgggatcgatgcgatggcggccgcattgcggcgggctcgatgcgacggcggccgcggcgggctcgatgcgacggttcgaggcgtatgaccagccagcacaacggttcgatgacggcctcgattcgatctgcatctctgccccagttcgtgcgtagtatgtcacgctcacgcacacgtccgcgcgacgcttcggtttccgctttccatgccgcgatcgccatttgttttttttttctgatatatggtagggccggaccactcggatcctgctgccggcctcctctccactcgtcggccggcctgccgaaacaagaagaatgtgagagaggagaaagagagatgaggggaaagaaagaggagactgacgttgacatgtcagctgacatgtaagcccgtgtgggtccaatgctgactcagccgtcacgtcggataaaacccgagtcaaaaccatcgaagaactggttttgattagttaagagatgccggatgtttggtttttcggtcggggacaattttgtaactcgatgacaagctgagggaccttcggtgtacttttccccagaatttaccatccgcaattaatacgggcttcgtattggcccaattgttcgtctcgggccagtaaacacactaaacgaaccgcggcccatgatatttcaacggtccagattgatcgaacatactagtagtaataagtcgatgccatttgaatagtcatctcctccaaaaccctaacccctccactttctcttctcgcgccggcgccatgacgctcctcgccgccatcaccaatccctccgccgccgccgccgccgccgccgtcgcggcgaaccccatcgtcctcactcccggcgccgctccgccaccgccgacctcctccgcgctccccacccagatcccgccctccgactggtccctctcccccgccgaccccgccctcgccaccgccgcctccttcctctccacctccctctcctccacctccgtctccctcccgcgcttccgctccctcctcgcctccttcctcaccaccctctccaactccctctccctccccgccccctcccccaacctcccacaagccatccgctccgtctccccctacttccccgccgccctcgcctcccccgtcgcctcccgagcggcgagcctcgctgagtacgacgtcctcctcgccctcgccgagtgcggcatcttccgccaccccccgccgagcctcctttcctcgctctccgaggccgaccgccccgagctcgtctgcgccgtggtccgacaggccgccgacctccgctcctccgagctgctcgcgacgctccgctgcttcctctcgccggcctccgatgccgcctacgacgccatgatgagtgtcaagaaccggtggaaggaagccgcggtgctagcggtcaacaggtgcaaggagaagggcgcggggaagaaggtcgatgccatggcgaggcaggcggcgctgctgctcatgatgggatacgatgggttacctcaccggaggtgtgcctgcattacctgtttgcgtctgagaatgtggactctgtggtcttcggcgcagccgtatcggagctggatggtggggaggtggtcaggctgatgaagtacctcaccaagtggatagggaaataccagaggttcccagaggcgcaggcatgcccagaggctgtgggaatgccagggctggagctgtgtgacattgtgccctcatttcgggtggtggctggggcgctaggattggtgtttgaccagcacttctcgcacctagcgctgaatgcagagttgaaggaggatttgaaggccgcggagatgatggtgaaacagctggccacagaagctgaatctgcagggcctatcctggacttgcttcgacgtatgcagcaagatgtgtgagacactaaaatgtgcccctcaattttttttactgatcttagctgttatgctcatgtccgagaattttgattgttttactgcattgcagtgatgagttatgtgctctattatctaatatcatagtatgataatggtacatgttctgtttggaacccgacatgtctttgagtggtattactacactgctagctagattgtcactcccttagttggtatgccctgcgatgtgctaatgcccgctggccactgctagttaaattgatgtgtaaaagcaccatttacaaatgcaaattcaaatgtgtcgtggtagttaactttctgatattatgtgggaagagaagcttcaaaatgctgccatttctcatatgagtaactaaattcgtcattcataacccaagccaattgaaatacaaaattgttcaaatagtttagaacttccgacaacaaacattttcatacataactactttaacattactgaaaactcatatatttgcttctttcgtttaattcatttccattgttgggtctgactgaggtgataaagcttaattcgttgacaaatttacttcttgtacataaaactgaatagtccttagaaccaattgtatctgtgacttcaatggttgaaggagagagaaattgattggctgttctgcatattctttgtgaaaatcaaataaggctgaacttgttgacaatctttcttcttgtgtgtaaagctgaacaatcctcacaatcaattgtttctgggacttcaaagggttgaatgagggtgaaattaattggctcttctgcatatgttttgtgaaaatgactctgtttatcagtactcagtagtcagtacaaatagttcagttgaaaacgtaaagatgacagcctaaatatataaagtttttcctagtctatgctgtttctgggaattcagaacataatcaattctacatgactttatgcaataattggtcttgatgctttccaatatgcttcttttttctgtaagagggatctacttgtagtcttaatagtgtccaaggaaatcgattctcactgatctgatcttataatctgaattcttgtttcttagatcagtgttcaaataaggaagcccttgatgtgcttcaccttactgcttgaaggaactaaatattttttcctaaatatatttgagaatgctgatcatacctcatcatttcaaatgctgaccaagtattccatcagacaaaatgatagagctacctaccaggtagttacttgtatgatcctcactaagtcactaatttgtttccaaattgctgaattttagattctggtatcctgtgttcgatccagttttgtgatttaagattattcattactacttgatcttttgacaggtttaagcttgacagtattacctctggtatctttttagtgtaaaatggtgcccatttttaattatgaggttacatgtcttaagtaatgctcaaatattctgaccttcttgtaaatttactttgaattggacacacccatgtgtaagatgtgaaatgctggattcacattttttgaagtacaaaagaaaaaggtgcatgcactgggagcctgcctcatgcctattgaccaatttaaacgacagtgaagacgagagtgcaacagatgactggtgccataggcagtagaaaaaggaagagaaatggagcataccagccaaagttgaagacgttctcaaccaagcgggctatcttgggatagcagaatagctgccaaagttgaagacgttgtcaaaacaagcggctatctttgtgttttctggtcccaaggtatgatactccagctctcctgtttaccccatcttagaaaaaggaaaaatgtcatcttttgcatattgaaagtggtaggtaaggcagttcaatcttcaatcttcccaaaacgagctcaagcttcctaaaagtttctttttattaaagaagtaaactttccatttatgttcatctgagaaaattctatacaattagttagtgcctcgagtacattttagtttgatgcgtcacttcttttgcttcagttagcaactaagctcgctgatattatctaggtctcatggattattaaattgtttttggttgttggctagctgggtttgcaatcgtccccttccccagtttagatatatggggtatactttgtgagattttctctcatcctttgagatgtatgtacctcatccttgagatatacctctccataaaaagaggtaccaaaattaatctaacaggttggaaaaggattgaaaacttatctttataaatatttcagactttttttttttacattttctagcggtatagatatttgattaagaggtatatacctcaggactaacactataacactatgaggtatatgtacctctctatacctcagaacgactagaaaagtcttgccagtgctaatcataaacttgttttctaatcagttaaaccggtataattttttacctctcaaattgtgaggtatatacctctcccagaatgaaagaaaacctcatattttgttggatgatgtgctctgaatcctgaagatctcctcgttgacgaattttgaagtgatgcttgcatcttaggcaaagtaatgtttgacaacatgagtcgtgcccaagccactatagtctaatgcactgtcctgcgtccacacttatgccatgactgacatactgaatgctagtattgcacattctagtattgttattgtgtcatagtagtgctatggtgctgaaatttaaagccacttatcttagcaagaactcagtgtatcaacattaacaaaaaaagagagctatattccatcctctaaaaaaaaaaaatgcctgatggaatacttggtaggtagctctgccgtgtgccaactcttgtgtgtggagtagttttgaccatttcttgcattcttggatggcaagtttgtcgcatcatccaagggtatcttgaagtgcgcaaagtgaagctgtgattcaagtatgccttggatctgatgagaatgcatcgacacgtgtgcctggtgcttccattattctctgtgcagcttcattcgctgaatgtggctgactagttgctcatgagtactcatgacatggtctcatagtatgagataaaagcctcttcaaagtcactaatggcccattaatcatgctgtttgcaagaggttgcggcagataagtacattgtagaaatgtttttgtagtggcatggaaaaggcattgcattcttttcttccccttttgattaaaagaatatttgaaagcaattggagtattggacattgctggtgagccagaaggacacctttaccaattaccaccacccaaaatgagcttcttttttttgtaagtagcctttattccttcttcccctcttgatgaatgcttcccttctgttcttttagacctcctcctgctgctgcagcagcagcaatggcgtgaaacttcgcggcaacggcactgcacggccaccgaatctgatcactgaacagtgccagtgagctgcatagtagcttggtgatcttgcttgttcaccttttatcatctcaacgaatctgagcagaagtgctttctgagttactgtcatgcatcctatcctcaggttaaataaaagggagatcgcatgatgattcttgtttgtgccggtagaaagttgttcgtttaatttccaagatttgtaggtggtgaagtgtgaaccaaggccaccgcaatttcggtcctagccgttggcatgcatgtaactatatgtaacaaactatcaatgtgcttttgctcatatttcctactcaattggcttctagcctatctagctgcctggctgccaacgtaaccttgtcctgactcctgaacatagaacaccattttttttctctgattttggattttcgcttgcatgcttcctaggctcgtaaacggtttgttttatatgaaaaatttctatataaattttttaatagttttcaaaagtaacttttcaacttttagttgtcaattcattcgtttatacacttaaatagcttaaaatatcagataatttatcaatttcagctatcttagatgggccaaagaataatgtgtaattttttttgcgtgctcgtgaaaaaatagatgggccgaagaaggctaaatgagtgagctagctgattttcatagaggagaaatcaagtgtactcccaacctcctggacccattattgaactccaaccttttcccctccacctcccatccatcctttatattttcgtcaatcattcatacttaccttttcgccaacaatttaattatagacaatactctaagcaaaccttttggggggtagttaattaagatcgcgagaattttgtacatatattccccttccacgtgtagttgatttgtggctgaactagctccactagacactagacacatgcataaaggatatacatactttaaaaaaaaaaactcgaggggaaataatgagcacatgaattaaattcttatatacaatggacacggaggatctatctttgaagcttgaaagactattccaaggatgtatatatgcttggagtagtcttgtagttgtagggactggttattcgtactagccgcgaattaatcaaaattgcattcaagttgatgcaactaaatgcggattatgaatgtacgtctggtgtatgcgtccatctaatcaatttactgctgaatttaataagcttaaattaaatatgaatgccaattttaaaa

SEQ ID NO: 68680 - DNA, 3492 bp, Oryza sativa
aaattaaaactagagaaaagaagaaaaagagagctacattaaaacacggtaattaaagcagcagcagcagctgttaccacggccaccgaggcaagcagcgaacgcccccgcgccgtcaccgccgtcgccggcgacgacggcggcgacctgtagtaccaagggtaccacggcacgatggggttgggcggaggcggcgccgggtagttgaaaccgccgccgccgccgccaccgccggcgggaggctggtagtagggaatgtagccgcctcctccgccctgcggcggtgggtagttccagtacgacgacgacgacggcggcgtgttggaagacgaggacgacggcggcgggtacgagtagccggaagacggcgtggagggcggtggcggacagtcggtggtgaccggcgtgggcggcggcagcaggcatgggtaggggcagtccgccgggtaggtgtcgccggcggccaaggcgacgagcgcggagaagacgaggatgacgagcaacctgtacgacgccatggccgcgagagagagcgagagagaggtggtagtgtagtccagtgaagtggtcgcgaggtagaagaagaggagaggggacgaaggggttatagctggcgcgccttttgtcagctcagctgtcgacatggccgggagcgtctcgttaactacactttttttactttactgaataaacaagtttatcatcgatcatttgaccaaggtttattcgaatatcataaatcttatgcaaatcttactaaacaaaagagaattatagaatttgaagggtggaaattgatcaaactgggagaaaagaaaagtaagccgtgatctactttggttttctgaatcattgatatgattcattcatgcaaaatctaatcgatttagtgaaacaccggagaagaaaccgccttgagctttcgttgattgacatgattagcagaaatggcgtgttgcatggatggatgccctgttccagattgtttcttttgttggtatgcaatgcatgcatcatagggtccagctgtaagtgcgaaacaatttatgcggttgcatatatgatccgtcgtatcactcgcgcgttcatcggatctatgtcaccatgcatatgccctctgctgtcacattctctctctctctctctcttttctcttaattcttgagtcgtaaaaaggagaaagaatttcagacttgatggatgtacagaaatgtgttttggaggcaaacaataatgggttcattgcctgatcgatcgtcaacacaattgataaattcctttaattaccttcacaacatccagacttaattctgacgaactatatatacagggtacagctgtagtagcattagtatgcagcttgatgatctcatacgtactctacatgggtctctttcagttccatcggcatcagagatttcagtagatccaatcggtttcgaactgcacgtcctacaccaccacatgacatgccgtgctttcaggcaccaaacaattgcctttcattcccgatatctccctgtatatatatgtttattcggatgtgattcagcactcagcatatgtactgaaactgattaagcatttcagctgagcttcccttcacatcacatcgaaccagatcaggggattggttaacgcaaattaactaaatctgccccctttttatttcctgcttcatctcagtttggatgcttaggacatccgcaatagttatttataggctctctacaagagatctatatcagcatatttttctacttggaagagattaaatgaagagagagagcaaagctatctactaacctggagatagtctatagagaaaaacgaggcaatggattagacagctatagatacccatgtagacataccattgaagtggtttactattaatctagtctattgctgagatgtacatgttttatagatagcaccttactttaacattgcgggtgctcttagtttaacttgttgaaggcaaaggctcaaactgatggggcaccgccctcaatggttgattcttttttatctttttggacaagaaaatgtgctttctttctgatagacttttctagctagctactaagagaaaagggaattgagctgtgccctacagctctatactcgctggccggccgcatggatcatcagaagatggatgcatgcagtatctgttcttctaacgtgtataacttccccttttcttctctctcacatgcatacaagtgattaaaattagtagttcatgaaagtacactgacttggctactcaaatgcacgggctaaaatcatctaattagatgcaaaggacaacgagtaagagtataataatgttcattatcattctgggttgtactaatattctcctgttgtctgaaaaaatgtgggtgcattttttgcgtgtgatcacaagcagagtcatgagcaaaacaggatcaagattccccacgccgttcatgtctgctatctgaatgcaccacctcttgagtattggcatgctagcttgttgatgattgattgactcatctgatcacaagagtggcaaaggaaactgacaataaatcaataatcaatggaaggaaggaactaatctgatttgagtatgtggatggatcttgcctgtcagaaaatctgcaggatgagaagcttctctgaaccactccagttccagcccaatattccaaactgatcagtggctgctactgttaaggattttgacaatttgaccacatacttcgctgcccaataaagtactaacaccgattgttccatttctactgtagccactatcattcatttgcataccagaccctgcatcagttgattatcattacaatggaactagtttatctcttcactgtaaacgccactatggtaattggtggcattattcaagcaatatactagtatccaacaaatctagcattgatagctgttcatctgaatgggcagaaagaacgggcatcaaagagaggatatatacaaggatctttcatttcatcacgtcatttgtctctacccatttgtccatagcgactgcagatgcttatcttcggacttcagacttctctgagagattgcgtatcctcagatctgtagtgtggcctagaatgttaggttgggccaagccaacctaattgagaaaggcctagaaataaagctaggaaggctttgcagttagattggcccattcacatcatatagtagctcttggtttcttgacaaacgaacgatcgaattcgaatgggttgtttttgtttgcttctgttcagcatctgcacttgcaactgaccaatactccctccgttttttaatagatgacgccattgactttttctcacatatttgaccattcgtcttattcaaaaattttatgcaaatatataagatataaatcacacttaaagtactatgagtgataaaacaattcataacaaaataaattataattccgcgaatattttgaataagacgaatggtcaaacatgt

SEQ ID NO: 68681 - DNA, 5148 bp, Oryza sativa
aacaggatggcatgttgaaactctcactgtaagtacacgtagctagctcttctgataatgcaactcttaattacatatttacatatctggcttagcttaattaccagtactgccatctaaaggagaagagcaaataaattgtcaattcccttgagcgtgccaactgccaagcaactattcagcacgtactgcaatgatgacagaacagatatgtgtaaccaggccaattcaacctaatcatcttgccaaaccacctaacattcttctctcctctctcactcgtttggtggcacaaagaatggcatacatgtgtgcctttgctttctgttacgaaggcagcaaattaagggcaccagtgctactgctacacatcaaaattaaatgtgtgcaaaaagtgaacatagtgtagtccaagatttgcaagtgattccatctatgctactgttaaagagagggaagagcattcattattcaacagggatcatgaaatcttgacttgctctgctctgagtttatcaggtcgaaatctaatccagcttgttaaccatatctctggattgccatgtgtaagtaggctgagttttctatttgctttgtgatttttgacagatttttgtaataatttggttctagcttcagtgaaagcaaaggcgccgggattttctcattatgttaaaaaatgttgtaagtacgtgcatacctgcgtatctggatgtcctagcactgtgagtaaacactactagtagattatttggactttgtgagcaaattggatgcagttcagtaggatgtctcttccaagtccaaaggagcagtagtactagtacaagaacaagtcaaattggtactagctgccagtaaagtagaacgactagactggactggtttaggtatcatggaagcatcagcaactgttctttctgaactctacccatcttagcagctctcctgataattttctttaaaagctaataaaataaattaataatacaagcaggcatggaattaaaacacggttcaatcgttgacagcaacgcggcaaccaccgaccggtcgatcgagtgcgactccatcgtcattttggatgtcctcttggacatggacgcatatgtgttcatggctatgctaattgatgatatcttcaatacactacttcactccagctaacactggaactgtgtagtacacactgaatttatgtttatataccatgccagtgcagtgcaccgatataaaaactcaagtttttggaacagagaataaaataagataaaattcttccgacaaatattcgcataaatgaccatttttgaactttgaatggaagattatggttcctctcttctttttagtttatagctccacaaatggatgtgcattcatttatttctagttaagggttatctgattataggtgtggcaataagctttgctttgtagactggttttgcagccatgttaaccgtggacccctaattatgccggtcaaattggttcgatctgtcacaaactcacaaatcacaatgacattgttctttttaagattaaaagaatattaattctatataggttatatttacgtgtattagccggttgtatttgtactaatgtaatataatagcgatggaagaatcagaatggtatagtcattggacctatctgcttggagttgattgttgatggtttatggaaacataattttttgatgagttgtttggtctctattagtgttgttgctttgaagtgggactgggtcccacatttatttttttcccatcttgtaataaaaacctaaggctgtgttaagatgcagaggaggtgtaatattcccacttcttaaaaaacacagagatttttgcattttctctcttatataagagaaatctttcataattttctctaagtttaagtacctcacttatccatgtaggggtaaaaacaacacgagcattgtaccattctgagagttgatcaagatatatgagctaattgccacatgtaattgaaatttgattagacatatatatggattattacagagtctgatgtacatctttcctatcaccaaaagggatcgatcaacaaacattacatgacaagaacaattaatttgccgacgacgatgacgacaacaacaacaacgtgaacatgaaccgtaaaaacgaaaaaaaaaagagattatcttaccggaatatatctcctctaatcttattatgaacacataataaagggaattaaaaacgccgtgtaattaattaccatacgtcgccgatcacaaggccaaggctccggccaccgccgccgccgcgagcaccaccgcgcgccacgacgcggcgccgcccgccgccgcgttgggccggaagccggggtcctgcgggtagagcgtccccggcggcgtgaggtaggacggcatgttcggcggcgtgaaccaccccgacggcgtcgggttgtagccgggcgtcgggttgtagctcggcgtcgggttgtagcctccgcctccgtacggcggcggcgggcagttggtcgacggcgtggtcggcggagggtaggccaccggcggcggggacggcggggggtagtagacgggcggcggcggcgggtagtagaccggagtcggcagcacgtcgggcggcggcgggctggcgtacgtgcacgtcgtgccgcaggggctgggcaggccgcacgcggcgcacttctcgtcgtcgcggacgacgacgtcggcggcggcggccgtggcggcgacgagcatgatgacgagcaggaggctgcacggcagctgtagccaccgtgccatggccgagagatcgatggaagaagctcagagcttttcttggaactgtgtgctctctcctaaagaagaagagagtagtgctatgctatagtgtgtgtgcactctcactttctcctctcttcttcttcttgttgcttcttttttggttgggggattcgattttgggtggttataatggttggcttctgctttcgcttttggaattggccaatgccagtggaggtcttcttctctgctcctttttatctctccgtttatgtctctcttttttggtagtgcctactaatcagataaacatttaatggttggtcttctcaaacagctgtatcggctaaattgtactatataagagcaaatagctagaccctttttcaaatagctataaccgagatttaaaacctcacttttaattttattcttaaaaaataaacctgaattttaatttgatcctgtggctaagtgtactatatactgtggcagcctgacgtaatttaaacgtctccattattatggctgtgttatttcctcactctgttgtccatttttgtgagagtgattggaatatttttcttctttctttctgtatctattctcaatatcatgatatgggtccccacagatcaaggggttgtcacaaatttgcaagtagtggcattttaacttttgttttgtttttaggaatcagggttaagaaatggggagatgctactaaccatgttgtgtagaataagttacagatatgctaataatttgtttttcatcagaacgttggggcctaaccttttgatcatctttttccttggtgacagtgatggaattggattagaccttggcgctccagtgatgtcatttgtgaaatgcacatactactaactcgtggactctctgtagattgacaagtggcagattacctctagtaccttttcaccatcaacaaatgcactttcaaagaccaggcctttgcaaataaaccaacttattgtgtcaagtttagtggtaattgctactgtactagcagatcagatcagaaatgtatgcagatgtgcacatcacaccagtcttgttatagcactcaactaaaacatgctaataggcatgactcatgaggcaccctatcttgctcacgaaaattttagtgctttaatcccatattatacaagggtgcagacaactgaaatatgatgagaattttgttataaaagataaacacaaacaagtcagtaatattgacatcagaaaataatgagtatgtaaggacatgcaattctgttaggcaacattaaactactgaatgattggcttattgcctcctgaacttatcttcctcatgatttcaggcttctagttaatgccgcttgaaacattaagccatgaagctactgcttaccatacacacaaaaatcaaatttgagtaacaatttcatgtacaaagaatttttctacactttgaaactaagttcctggttggatttaagctgaaatagtgcaaatatcaagtacatatgtatctttcctttcctttcctcatgaacaagaaacagagtgactagcacagcgagagagaaaaagaggaactccttttgacatagtgtttgcaactatatatctgatacaatacaaaggctatcaaattaccatgttacatggcatcacaccagctgcaatattcagaaacatcatggaatctgaattcaactcatacatacaacatcaatggcagtgagtacgattcactgcaaaaacaccaagaaagcagaaaacacaaacaccaccggaatccatgccagcgccgccgtcctcgcatggcatgccgccgatgcaagaaaccctggatcctgcgggaacatggtggtcgtcgtcgtcggagacggctccgcccagggaaacggctgcgtggagatccccgccggcgtcgtcgggcagaacgggaacggcgaggtggtcgcaggtggcgacggcatcccagacgacggatcgatgtcggccaccacgcgggcagccggccacagagacacgacggcgacggcggcggcggcggcgagcaagatcggccgcagagacggcatattcgctctccttctcgagagaatttgtgccaaaaggaggagcgagctcactaatccaccaagctaatggctaaaagtagtaagaaagatggagatgttcgccgccttgagagacgtcggtgaccgtccgatgccgatcggacggctgcccgttcttgcagttgacggcggcagaatgataggcttcatttcgtcttctccttctcttctgaacatgatccactatgttcttattgcaatcttattactgcgtaagtgtgaggtttgtgataagtttctaaattaagctct

SEQ ID NO: 68682 - DNA, 3801 bp, Oryza sativa
tgcgtagctcgcttgaaaaccaagtaactgacaactgaatattgttcagaaaactctcaatcatgtgtagtggagtactagtgtgtatggtcactgaaatggcacttttaagaagatgttgctattgccttttgcttcactactcggctccatttatctgaaaagattaactaaagtcccttttctaatcatggctttcatgagccttaaacccaagtttttacagacaagtgacaggtcgatgaatcaggtcactgtaagagcccgtcaatgcattgtgcagagcgtgcagcatcagtgcaccttcagctgaggacattgtgttggttgtgatgtcaagcatgctgatttgaacctaatacacaaaaaagaagaattgttagaaagtttggagcatttgcaagagatggtacaaaggagggcaggcctaggatggtgaccggccaccagcaacgatgatctgtttgggagcacacacacacacattgagacatatggctgagaaagagaggtctggaaggggaggactccaagagtccaagtaacaggagggcactgatgataatgcaggcttggaaaatggaaagccatagccaagtgggtagcaaacaaccacctcttgttccactggaaaggcaaggcctgcagtgcagcagcagcatatctttgctactgaatactcatcctctcctaccctatccttcctagtgtccattatcttcactcacagaaatgcatattctttctacttctttttggccatgtatcccaactacttttcaatcatacatggaatcagaaatgtatggtaaatactaatatagactcatgaaatttgtgatgagtgaaatggtagaactgcagaaatgaggagaggcaggtcttgttgactgtgacaagagcgattgatatataaaccatgaaagataagctatatctgccaattttgttgtatccctgtgttttttttaactgactgactgacatatgaaagaaacagttaaacttccagctccaggcgatgcccatagctttgttcttgtcatgatcagttgaaaagatcggagcatctggtatctatcactctctctttctgtgaaacagttcctaattttgcactgaatcagcgccactgatgcatcttagtgaagatacttctgtctgcaaatcaacttcacagcacattccccatccaccaactctgccattagtatcccgtctctagtttcagaagagtagtatctttctttccacagaatggaaaagattacaagtggttgctgttcggacggtggttgatgacttgtcggtcgtgacatcatacacgagcgaaaaggaggatccaatactctggattctgaaattccaacgataaaagatgaggaaaagataatagtagggctcttttttacagaagttcagacttcagagtgtttcatgcatggggatgttcagagaaatgacatggattaacccataaataactttgacgatccaaaaaggtctcaaagaatcgctatccgctggttacggatgttgatagtcgtctttaactcattattaggtaaaatacaagtctacttttggtgcatgcatgggcatggcgatggagacttgctgttcttcgttttcttcagaagttgcagtgtaataaaaccgacaaatgacaagcaaaatacccagctagtcaacctgatccagcccagtatatttagcccacgcatgttgtttacaggcccaaaatttttcagcccaagatgaatttgaagagagcccagcccagcctaatctcctctgttcgaacagaacagagtatatagccatccatccggtcaaagcagccggccacgtggcgtgtccccgttggctgtactggacgcgcgcgtgcagcctgcagcggagaccgacttgaccgctggtctccggcgacgacttgtcagccggtcaacatgaagtgtgtagcacggcgacgatttccggtgcacacatgctcactactgtcgcaatggcaagctcatatactgtctgaccagcattaattccggccagccgcgagccatggcgagggcaatcctcctccatctccactccgacgaaaccgtgcctctcctcgtcgtcatcgtcgccgcggtggccgccgtcgcgctggtcatcgtgtcgctctgcacgagcagcaagcacggcaagctgtggaagcagcagcagcagagaagtgggtcgtcgttgccgcagctgaaggcggaggaatcagcaggcggcggcggcggcgccagccggaagcagctgctggccaccctcagcggcatcggcggaaaggcggcggccatggcgaagatggtgtcgtggaacaggcggtcgtcgcggcagggatgcagcagcgacgacgacgacgaggccggcggcggcggcttggcggtggaggaggaggaggcattgtggaggaagaccatcatgatgggagacaagtgccggccgctgcagttctccggccacatcgcctatgactccgacggcaaccagctgccggcgacgaccatcagcaaggaagcagccaatgcggatgcggtcaacaatatttatgtttaacaatcatatgcatcgagaggaaaaataaataatagtaattgtgtacatgagatgcagtgatgtacagaatgacaacctgctgcgaaaacgtcgaaaaggtccatattctagtggttacaacttacaagtgtcatagtagcaccttaagtcttaggttggactcaaatttttcaggatttaacgactttatgcttcagtggtagacgatgtacccatcaatagcgagatgcctataatgactttgtcaatttacagtatttactggtccagccagtgtctttataggagtgagtgtgtgtgcattgtgagtgtctattgtactgtgtaatttaaaaaaaatgacaacgtgctagctacggagggaggaagaagtgtaagtgggacatgtggtatgtatgtatctatctattatattattaaaacagctttgaaacgaggcaccacgttcgctgtgggggctagaaattcccacgttaatcggagaaaaaagaaaaatctagaccgttagattatactaggactagactttgatggtgtagattaactttgataatagaagtctgaatagaaaacaactgctagatcaaacggacaacactgatcaagtactagaatacaagtccaaataggtggacgtactcctgctttgattctttccttatcctagatggatactaaggatcaatcaacagatcaggtgattaggattcaaacacagtgcgtacatatatattttggagccagtataattagaattaaaatgtgattttttttttacctatggatgaaaaaaagaataaatagaccagaaaacttatgcattggtagagatacatctctccgtccaactagctaaggcgtgttcaaatttagtacgatcttaaaaactaaagtttaactttaaatttttcattgtagcaacaaaatcataatcatataaaattaaatttaaatgaatatccaatgatattatttttaacaactaaaatttaatttataataaaatacagctttgaaagaaggcaccacgttcgctgtgggggctagaaattcccacattaataggagaaaaagaaaaaacgaaaaggagagtccaagtagaaatacaatctaaaaatagctaaaattcggaattaaaaataagcaatattgaaagaagtttccatataagaacccaatacaagattaatcgaaattcgaaataaaaataaaata

SEQ ID NO: 68683 - DNA, 3657 bp, Oryza sativa
  unsure (1)..(3657): unsure at all n locations
aatacaattttaaaatagctgaaaattggaattaaaataaggaatattaaaaaaagagtccatataagaacccaattacgagattaattaaaattgggaataaaaaaataaaatccgaaattagaaaaaaaagaagagatcaagtaggaatacaatttaaaattagctgaaatttggaattaaaaataagcaatattgaaataataatccatataagaacccaatacgagattaattaaaattcagaatgaaaaataaaataatattcaaaattagaaaaattaaaagagagttcaagtaggaatacaattttcaaaaaactgaacttgacaataaaaaataaaaataaaattcttaaaagacnnccatcngatattaattaaaatttgaaaaaataattcttaaatttagaaaaagaaaaatagattttcatttaggaatccattttataaatacctaaaatttgtgataaaaataatnactattgaaagaaaagatcatctaaaacacatgacgagataaattaagtaagaggcctataaaggagtagagtggtggcggttgatacgacatataaaaattgttaataaaacaccaaatagaatcctaatgacgattaaaaggagggacgacagacaagccgtaacgcaaacgagcaatgcgattgctgggactactagaaagtaaaaaaaaaaaccccattgataatcatattcaattttaaaaatctcaatgacaataaaaagtagaagcagtgggcggggtgtatagtagtatagtttcagagccgctgatgtttgacgtgacttctagaaaataaaaaatgaatttcaacgatagttatgctcaatttttagaatcacaatgataataaagaaagagtaggcggcggacgggccatagaggagcatagcatagtggcatcgtttgacgagacttctaaaaaattataaaaaatgaaacccaacaagacaataaactctaaaaactacaaggttcaatttttaaaggttctgaactttgaaaaagtaaaaaaacaatgattatcatgttcgattttaaaatctcaatgacaataaagaagggacgcagcaggcgagccgtagagaaagtaaaaatgaaccgaaacgataattatgttcgatttttaaaatctcaatgacaaaaaagaaaagagacagtggacagaccatagaggagtataatggcaacgtttgacgggacgtctagaaattataaaaacgaaacccaacgtgacaataaactctaaaaactataagatccaatttttaaaggtttcaaggagaatgaatagaaatagtggtagatcgagcatgcaaataaagaaggatatgtcataaggggtagcaagtggtgtgacttttaaaaaatgtatataattagaaacacggggatgataaggtttaatctttcaaactcttaagacatgatatagctatttaataaattttaagtaaaatcatactaaaaaatatatgattttgtttgggtgctagccgcgcaattgcgcgggccacccagctagtttctgtaaagaaagaaaaagaaaaaaaagaaatcactaactatgcggctcataaataaaccgtccgatttagtccggacggatcggatctgtgcgaaattgcagtggggcgctcaacatattacaggaaaccgctggatgtgtattattggttcgtcaatatatatactcatccattcccttgcggaacttgtaaatgtttggcatcgaattgaattagatgacgcatcatccttttggacgaatttgatatatttttgcctcgatcgatccggaatccccacactgagctgagctctcccatttcactggagaaatattgtacgccacgttattgcctcgatcgattgttaattttgggataatgaggcccatatgtattgacttgcggtcgccagtggcccactaagtgtggccatcgtgcggtttgaataggcccaccactatgtaagcatacagtattcggtagtgtagatcccccggttgcgcgcggacacgggggatcctaatgggcgatcgatcacctggagacgggggtagcgatcgatcccctcctgcctccctccctccacccctccaactggtttccttttttggcaccatattacttttctattttagtaaatttatacacctaaagtttatacacctcaagtttacacatctaaagtttagagaccaaaagtttacaagtcaaaagtttatatatccgattcaaatttgaatttgaattcaaatattttatatatatatagtatttctatacatctaaagtttatagacctaaagtttataagtcaaaagtttacatatccgtttcaaatttgaatttgaattatatccgattcataagtcaaaagtttacatacccgtttcaaatttgaattcaaatgtttctatatatagtatttctatacatctaaagtttatagacccaaagtttataagtcaaaagtttacatacccgattcaaatttgaatttgaattcaaactttttatatatagtatttctatacataaatttttttgactttttgttttttaaaaaaattttgtgtggtgtactgtaatagaagaaggggaggaggaagaaggggaggaggaaggagggagaggagggaggagtgtatcgtacaggggaggggacgggcgggcgggtgatcgctcattctcgcgcggacgcaagtaggcaaccccgacgatcaccggagaagcaccgcgtgcggtggcgagtttcatcgatctccgtgatacattatcacacacacagaaacagttagtagttcaatatatatatatatatatttggtggaggccagtggaaagagcggaaaaacgatggatggatcggggcggtggcctcgcggcgctagcgctctggacattaagggcggtgtgggcgcgggattgcggcggccgccatggccatgggaggataggcgagagctttgtgtagtttgggattcttcttcgagacgagcgatggagacggaagccaaattcggttctgctgtcttgtctagtcaggccgtcagggttgggccacttgttggatcgatgaatcccaacacggcccactagctgcttgcttttttatttttctttttggaaacaggagcttttcttggctcttgctagctagtgtaaacagcatgtacgttttaacgtgggctgcagggctggggcacaccacaaacaactcgatcgaacagatcgagcaaaatgagtgcaagttccgacaagagatcgacgagtctctctatatagttacatatatactccctccgttttaaaatgtttgacactgttgactttttagcacgtgtttaaccgtttgtcttattaaaaataattgtgaaatatgtaaaaatatgtgtacatgaaagtatatttaacaattaataaaatgatatgaaaagaataaataattacttaaattttttgaataagacgaatggtcaaacacataatttttaaaaagtgtcaaatattttaaaacgaaaagagtatatgcatagctagctgtatatacatatgaacataccacttgatcagacgatcgagcaaccacgcaagtatatactacctccatcccaaaatgtttgacgcc

SEQ ID NO: 68684 - DNA, 2242 bp, Oryza sativa
actcgtattccagtagtacaactcatctcaagtctcgactcgatggagatatgcatgcgtatatgcatatggaactttattagaactacgaatgcatgcatgcacgcatacacgtgtcgcgccacctaagcaaacgcttggttgtgcatggctggcacagctagcgctagctgctgccgtgacacgtgtggctgcctcccttcttcacatgtgtacatgcgcccagggtggccatccatccatatgcatgcctcacagtttgtgccatccacaaactgtgtcgatatgcatgcatgcgccgcaacaacaatgaagcggtaatttcacaccaaaataagtacatttcgatctacttctagctactttcttcatcttaaaatgtagctgcctaatactagatgtgatattacctaatactatgaatctgaaaatgtcacatctaatactagatagctatattttaggacggaggtagtagcagtataagagtatatatatatatatatatatatatatatatatgggggaaatatttcctatatgggcacagctagctatccggcccggtcgttaagatcgatcgatcgcgccatgcatatgatatgcactgccattatactgcatatgctaccattcgatgccatcgtacgtaatgggttacgtaatatctacagatgcattgcacccagtcatgacatatatattacaccatctagcctaatattttaattatatgtatgtacacacagccaaatattcatacgtaagcgtgctgagtatatatgattgattgtgcactagttgtactttgcaccatagatctagaaaggtgtgatgtgtacatgtatcctgctagctacttcttcctaagatgatcaacaaaaacaatatatgtaattaactaccaatctagttatattagctactctctggtatatatacatcttaattagcaaataaagcaataatataattaatgacggcaaatatattatttatgtcataataagggtaactaattaattggcttaatttggccgtgcatgctaacagaacaaatattattagttataactccttagaatggattaattaaccagcagagtattaaaactgaagattaaattaacatgatatatagtttgcaggtaatgcatagacaggcaacaaaacataaggtagctagctaggaacatatctaaattaattaatatactgatgatcgatgaggtaggtaattggtacacgagagaacgcacctttagatgcatctgttccccccggtatgttaaccacgatcctgtgcaagaaaaaagatgcagatatatatgcatatatatatatatatatatatatatatatatatatatatatatatatatatatatatatatatatatcaaattaaggaaactaacttgaagagagctacaagctagtgctagcatatgatcagtaatatatagatcatgcgcatatatatcctatgcaatcatgtatatggaggagtgatggagacctgagagatccgatccctaggtaggcatacgatgaatcatatcatatcatatatatgcatgcaagtgtcaagctagtgtacttgtggagaattgacacttgttggtgtgccacatcccatgggatggatggatggatcgatcagtgtgcatacataccagtggagaaactccctcatggatgggtcgctagggctaggtgcgtccgggtccgtcatgatctgcaagcatgcgttggcgagcgagcaaattgatcgatggtcagtaaattgctagatagataggtgatgatgcatatatatatatatatatatatatacagataccagggtgtagaggtcgttgcggcggccggagatgcggacgaggggagggtagtcggcggcggatgggcggacgaggcagccgttgctgatgtccctgtcgccgtaggcggcggtcatggagatggatggaacgaacaaatccaccacctccccgatcacccgtcccaccaccagcggatccacgaaacgggccatcgatctctggagatctcgacttgagctcagctagccgcggccggcaactgtctgcgggcactgctatagtgcggcgccggcgccttctcagctgctggtggctacttaattctagcggcagcacgcacgcgcccactcactcgatcatgctatagctaagctctatctaggactaggagtatatagctacaaatacggtatgcg

SEQ ID NO: 68685 - DNA, 9273 bp, Oryza sativa
tcagttttaaaaatttgggttaaaacttttgaattttgatatggaagttttcaactagatatgaaattttttgaattttgagttgaaatttttgaattccaatatgaaattttccaattttgagatgaaaatttttaattgagttggaagtttttgaaatttgagttgaaatttttcaaaatttgacttgaaagtttttaaatctgggttgaaaatttttcaaatttgagatgataagttgaaagttttcaaaatttgacttaaaaaattcaaatttcgagttaaaagttttcaaaatttgactttacatatagatttttctttttcaatctagcacttaaaaaaaattcggcaaaaagacaaatcttactttaattatcgtcattatctaaaactaaccgtattagttagcgtgtatgtgtaaaaaaatcccggaaaaacaaaaagaaagctcacgggtgacaagggcccgccacgtgcatgcgcgcgacttagagaagtcgcgcgtacgctaaattagcaaaaaccgctttttccctctatctatttctagaatcaacaaataaagttattttgaaatagaagagagctccatagatagtctctcaactcaaagttcaaactatgaaactatgagtacgtgtacatgttggggttcatattcgtatttcatacttgatctcaggctctcagcaagatagatagatatatggtcgtagggaagaaactgcgcaaatgctaatccgcggtgatatatcttttattgggctcaaattgcctttggcttatgaatcaattaagccttgtttcgtcggcgacgagggagcaactgaatagagaaataattaaagaagctgcatgagagatcgatcaaattaagaagctgcaatttaataaagaattctgcaaacggatcgagatgctgccggtcgacagagatgatctacgtagagtaacttggccggccggaaatcgtggtttacatgcagagtctcgacgtttgtgagccggccgccgacgttaattatgccttatttctgccggtgaatcgcccggttagaagaacaaaactccgaacccttcggagaagaaatccccaaatttggcccataggcccagtcggaataaacactccatcagccatttagccaaggaattgcgtacggcccataggcccagtcggattagttgaatactctgcatcatcagggtcacacacccaaatgaattttcctgaaccagagacagagtgcggatggatgttggtaaaatggtactaggaactactactgtccacgtcgcatcctcctcgggggcaccgctttggaaaaacctcttcgtgcaaggatattgtcattagtctatgcattggcttcgaacttcagtcctaagcctaaaggaggctttatagctccacattttgttttacttttctcagtttgagtcctctcttctcttatttggtgtgttcaacttgtcttgaactacactctcttctgaagtggatctttgtaataattggctgtagttctttttaaacaaaggccaagatattatattccactatctaaaaaaaactactactgtatatctaatctgtttttgatatgtactgtatatcgtcagtaagtatcgtcgattaattgaaagctgaagattgcgcatcgatcgtactgtgttagccttactgacgagtacagtactgatatttcagctagtgttgccctgcccagctgctactaaggcttccatcggatggcctaataagccaaagaaaaggtcaaattttaaatttttaaacttaattttgagattgattttgagatatttttaacgttgtttctttttcaacattggcttttaaatcaccaagaacacatatataaaagttttacctacaaattcatttttattctctaataaaccattttggcttattagggaataagccaaacaatggggacctccatccgtactgttagccatagtagtgctctcgccaactgaaattctgaacatctgtctatatatgtacaccatctgaactctgaatttatcacaacaaattaaagagaagcatggtgggtggatacgcgtgcttagtcagtagtatcatactcatactgctagtaatctgccgttgcactgcaattaattagagaactaatatactagttaactgagatatactatatataagctagcaagactcggagtgcatgcatgctataatcaatgaaatccgatctgcagatgcgtagctgcatgaagccaagaaaggattatccactgatcagcaaggaatagtacagggatgcactagttgttgtttactctaacccagtattatcaacacataactatataattagtgtggtggactggtagttagtatgtcttgatacagaatttgtacatataatatataattaattaagctgtattaataacagcgagatgcacggagaggggccatcggtcgagtgagacttagcttagctatactatgcgggctgaacgactactgcgtcgcacgtccgtcgtcaagactgaattaaactaatgaacatataactaactaattaatttaaggcggttgcagatgatagcatgtgtgctgtgagctagctgagctacttggccatgtgaagctctgaactgaaaagcttcattagcactggctagctaagctatagtagtagatcaatgcatgggtcgcaaaaatgtagtaactgtcgtggaagcacgtcgaagttgcagatcgcacacacacggtaagcacacgggtttaattaattaatttgtacatatgtatgtatatatacctacattaattaatgcaagacgtgcatgtccatcgagtttgtcgaccgatcatcatgcatctacgagtagtacaaattagttgagtattactctgttttagttgtataccgtacgcctactaaacaaaataataaaaataatatgctgcatgtgcactctagctagccttcccaatccagtaacactccaatatatatgtaccgggacacacgcatggcctttctaggattaaattaaccagtagatgtgtagaaaaaaatttgggtcgaattgaaatggcctttctaggattaattaaattaaccagtattatagaaggacgagaaattaaccaggttttaaggttgcggttcaagaggaaaaagtacttagaaaattcttatccaagggcaaaagcggcagctgaaagtctgaaacaaccatgtaagatcgtatgacaaaagggagagactactatagcaaaactggaacaatgtttcaccctaaatgtatgctctgtctctgtctgtactctgtagatgccataattaatcctaacaacatgttgagtgcttgctcatctagtcatctgacaattctcttgttcttcctcacctcacatacatgttccgttgctaattaatattgcctaatgtttgggtttcttactctgattttttttgcgcagggatatcttactctgacagtcttatcttttcacttatacttatagttattagccaaaatttaaattttcaactttaaatttggaggtgattttaatgtttttttcatcgaagtctaattttcagcattttgtaaatatgtcgtttggcttatttgagaccgtgaatttgttaagccatattgatctccccattcttgcaagccatcgaaggtccaatgtgtatagtcatgttgtttcatagaacccataccaggactgggcttgtaccatgcttcttggaacaagcagtataagttgccattttggaaattaggcattgacattcaatatctgcatgatattctgacaggagcaattttcattttccacaaaatgtatgttacacatgtgtgactggtaattaattaacagcctggattttttttacattttgacactttctaaaaatttattttataaatatacccttagacaaacttctaaaaatagactcttttttctaagctagtaaccctaatgtcaaggtccaacgttattgacgccaacgacgatggcgccgacaactttgccgctagcaaccgagatgtacatcctatttgtaaaataaattttatgaaaaaatttaaaatgtaaataattttcttacaaataggaccttgttgtcgagggtctagttgtaagaaaaaattttacattctaatccttttataaaaaaatttacatctctttgacaccgatcctcttcacatctgcaagacttaactgctacgagggctgagattcgcattgaaacattgaacctcggcgtcaagaaaaagggttcatttatagaataagtttttctaaatttctgtttgtaaaataagttttaaaaagctaaaatataaaaatccagaattaatggttgtatacagtacaatagccattacatctccagcagttacttttaattttgtcactacgtgcactcgcgacatgatgtgtatgatgcttaaaaaagggtgcttaacaaagagaggggctatgttatgaagcttgtgtcattagcatagtcctagctaactagctagcctagcatgcatgtcaaatatcttaaactagcatcaacttgatttcaatgccatgtgaagagaggatatgatgccaaggagtgtctctcgatcttgagctagctagctggaacatgcatgtgatcgagtggcttgatctctagttaattacctcctcccatatatgatcctagctagctaacaagtgtttatctcaccatgcataattgcaagtatattccgttcattgccagctcaaaacctctctaaaataccacaccgtcttaacaagaatcctcttctcaactctctctatataagtagctagaagctaggtatacctacatatgtttcatgcatactgagatcgatcgatccatcaggttgctactaccaagaacagaaaccctagctagctagttaaacatcatcgatcaccattagactaatttagagctcttgctcgatcttacgatacgcaacgtagtgatcacactgctgtgctgcatcgtatagtagctagctagctaaacacagagcttaattagctgattaattaaggtagatgatggcagctcaggcaagcagcaagcgcggcatgctgctgccacgggaggcggtgctctacgacgacgagccctccatgccgctggagatcttgggctaccacggcaatggcgtcggcggcggtggctgcgttgacgccgattactactacagctggtcggggtccagctccagctccagctcgtcggtgctcagctttgaccaggcggcggtcggcggcagcggcggcggctgcgcccggcagctggctttccatcccggcggcgacgacgacgactgcgccatgtggatggacgccgccgccggcgccatggtcgagaacacgtctgtcgtcgccggcggcggcaacaactactgtcatcgcctgcagttccacggcggcgccgccggtttcggactcgcgagcccaggctcgtcggtcgttgacaacggcctcgaaatccacgagagcaacgtcagcaagccgccaccgccggcagccaagaagcgcgcatgcccggtatgtcactgaatattaatcagatcactgtgtcaaagattaatttcacaaattaaaccagtagtgaatttcgagtgaaccaacagtataatttgtgtgtaccgcagagcggcgaggcgagagcagcggggaagaagcagtgcaggaaagggagcaagccaaacaaggctgcttctgcttcttctccttctccttctcttctccttctccttctcctaacaaggaacaacctcaaagcgccgctgcaaaggtacaataattacttttctgactatgtttaatttgtaattaacacggttgtgttttgatcaaattaaactggattattattcaagtgagtagtattcaatcttgttatatgtatatgtatgtgtaggtaagaagagagcggatcagtgagaggctcaaagttcttcaggatctcgtgcctaatggcacaaaggtgcgattagttctcagtataattcttttgttttaagttaattgcatggctcctagtctattatctcttgattttttttttcttcatgagaataactatatattcatgttcgtgcccgcaggtagacttggtcaccatgctagaaaaggcgatcaactacgtcaaattcctccagctgcaagtgaaggtatattgcaatactatgcatggatagagaccatccatagaatatatagtagtagctctttcagttcagttcaccgtaattgatagttcttcacttcagctcttatgtttcacgcaagtttagtgtctatgattaattagctgaccataatgatctgattctgatgatgcaggttttggctactgatgagttctggccggcacaaggagggaaagcaccagagctctctcaagtcaaggacgccttggacgccatcctatcttctcagcatccaaacaaatgatgttgtgctgctgacacaaaatgcatcaaatttcacaaagctaatattaagtttgatgcatgtaagatctttagaacagaggcaatgtaacagggcttctgctctgaaaagatgagagaattgttctattggactttcagagttggaaatcagtcgtgcatctagatgttttttttcactcttttttcctagatcaattctttcttgttttgttgccaaagcctgagtaatgtacttcagtcatcagagttctttcactttatagcaaggatgtagtgtaggtatcagttagaaaacaagaatctgagcactgcaaattcgcttgctactgtaaattacactgcaaattccaataaatgaatcctaaatagatgcagttaaatctgcgccctctgctatttattttctcttgtcagcatctgcatcttgttcattgaagcaaccaagcaagacagggtaaaaacagagagaaagctctagacagatcaaagcatgatgcaagtaaactggattttttttttaactttctcacggtcgtgtgcaagtaaactggattttattattagagcatgagaataatactccatatcatcctaaatcgtgaattgatcgagggaaccttcctgagacagatcagagtgattaatattttttatcatttgggcggtcggagaagcctgaatgaatgcatgcatgatcgtggaaatgttataattttctcactcgaagatcagcattgacctctacctgatctacacgaactgatgaaccatgtaaattattagtagtgactctacaataattttgttagaggccttaattggagaatgtgataaaatttgtattggctcctacagagcatgtattctgcccactgacaattttctgctacaacattgatagcatggcatcatcagctacttgtgtttttctccaagtcaaacaattgtgtaatgcaactagaactaatttggcaattggagcgtgattagaggagctctaggaggaatctggccagacttggctaattctaggatgttctttaacatagcataatatatatttccggtgtgtatgcatgatcaactttgcccaatcaaatgaagaactaaacaagtttaacttcatcaagtttatctaactctagtggacaattcaattgttattatgtgaggtagaggcaaagaaggcgccattttctctaattttcttgcaaataatacagaaaccagtccaaaaagtgattaaattgctagatgaagaactgcttttctggagaacagaaaaaaaaaacaatgacgaacatgctatagaaaaactggcaagagaagctatcctctgaaaccttgggtcatcatcaatgagatcaattctaatgatagcacttaaattttagctgtccaacacacggcatgatgatacatgaatcatgatcagatgcttgacatgtggtactgactgtcatttacatcttcattgaatcattatcacgagataattggtaagaatgcaataaacaacgaagttgaaatgctactaatccctaaataataaatgagataatggcaaagaaatgagagagatgccgtgttatgctaatagtcggtggctagagcacataaacagttctgtttgtcataaaaagggagtgaaaaaatagtgtgtggtcctaagatctacaggtttctaggtggtatcaatcgtgcaatgcttggagtcccagcagaagtttgagtcatgtgattgtgtgacaactccattagtttactggtttgacaatgggatgcaatgcaatatattgtagaagtcaaacaaatcactcaatgaggatacgtatgtgtgcttgtttccacatcaacatgcaggaaatgataccattgccattttaatttgtggctttagatccctagatgtttcccaggggaaaattataaaacatctgatgcttcaagcatttacaactgatggccatgaagcttgaaatacccctcaagaatttatattggttaacattttgaaaacctttcaaaaggtttcaaatatttgaaattttgtgtttattatggctttaaaccttcctattgtgttattggtgaatccagatggaaaagggaaacatgggggtgctattctgtgagcacatcatcctgtcctttgaggtcacattccagcagaataaaatctacagattcttcagaaccatctagtaatgtattgtattctcaattctcagtttcattcccatgtgacttttgagtgcacaccttaaattaaaactgcataagactatggattcatggcatcacatgtcattaaaaattggattcaactaaaccaaggacgtgggaggcattacctgcgtcgcaaacttcaagttgctttctcttccatctgaaacagaaaatggacaagaaaatcacaagaatttaatgcacatacgtgtgaagatgcccatcctgttcttttcttcccttctcttgttctcttgaattcagacacccatccttttcagtggcagaagccaacagggtagcaaagcaaaagatctgacaaataatttctggacaaactacaatcaatattacctgatacatttagctttagttttggtcacccacggaagtaccaacataataacgctacaatattaaaacaactgcccggagacattgagttaaattcattaatgtcatgattctaacacaagctactctccatggttctcactctgggattttgttagagaccactac

SEQ ID NO: 68686 - DNA, 1980 bp, Oryza sativa
aaataaaatttagactcgcatgtgtgtatagttgtgtctcatattaacataatctatcttattatattaacaagatctatcttgtcaaattttatgaatttttcatttaataataactatttaaaccacatgcatacacctagatactatggttatggtttattaaaaaacctagtacatataaaattaacattggcgccgttgtttttaaaaccggaacatattgagaaaatcatcgagccgagcggggatgctaaatcccctcatcttgtcctctctcacgccactcatctctccatccttccatctcccctcctcctcatcctcttcttcttcgctcttcctctcccgggcatggcgtggcatggcggtcgccacccatttggccttcctctcccgggcatggcagtgacggcctcttcctctcttgggcccctttgatttggaggaaaaacataggaattttagaggatttcaatcctatagaaaaatttcctatgaagccctttgaaataaaggattgaatcctatccaatcctttgaaattcctatggaatggacaatcctatagagattttggaggaaatttagcaagagcttcaacctcttgctaactttcctttgagtctatctctctcatccaatttctgtgtttttcctatggttcaatcaaacggtcattcctgtgtgttttcttgcgttttacaatcctctgttttcttacattcctatcaaaatcctacgtttttcctattcctacgttttctcaatcctgcgattcaaaggggtccttatgtgtggcgccgcaatggtggctacctcttcctctcccccagaccggggtgtgaactaccggatccggttgccacaagtttggggtggccatatcctggctcgattgtggcctcttcctctcctctacccgatggctatggcgggtgcctctcttccactcccctccctggtgcgacggctaccggatctggccaccgcgagctcaggtgatccacgtgaggtcgcctcttcctctccccggctctacaatggcctcttcctctcctctatgtggcggcggcagtggcggctgcctattccattccctagcccggtgcagtggccaccagatccgaccagtagcgtgtctaattcgagtgatttgtgaatatttttttgtgatttgtggagggggttgatgaatcgacggtggtatgtgcatgttgatgaataaggaaggtgttcttggatgtgagatgctctggagggtgatagggagttgttcgaatcgagcatatgcatcgagccaagtttttatttttattcctggaaccaacacctttgaaatttgaattctcctcatcagtatcgcctgcacgggatgtcggttgtcaaatttggcacctttcaaccagcactaatccctgtttttgtgtatgtatatcgacacaagacatatctagaacaattaagtaaagcaataaaaataaggaagtccctcataattcacatagaaaaggttagaaaagatatagcagaagacaaggtggaaatatgaccaatatcacacattcacacttagtaggtactagctactagctggctagctcgatccccttcctatagctttataccccctgtcagctatatatgcgaagatcgaatcgtaatttgatactaagtgggatgtgatctcaaaaggttaatttgaagcgagagattgcatatgcgcatgcatggcactgagggaagagacggatcgaagtgaaagaagaaactaaaggcaactgctagtagtaagagagcaatatgtcacgcgacaggcagacatactattgtactagagatgaaaattcacttcaaagatcgatctcaatgaagaatcgacccaaagtcatacacatccccaacttgaagtcttgagcaatactaatatactccctccttccctaaatgtttgacgccgttgacttttttaaatatgtt

SEQ ID NO: 68687 - DNA, 8600 bp, Oryza sativa
tccctcctcattggatcgttttgtaggttgaattcgttctttatgtacataatagcacctaaataaaataattcaacaaaacaataaatatatacaagataagatgtaaaaaatcaataaacatatttaagatatatgtaaatagtacatatttattgtcaatgcaggatatggtaatgtgtggatatgatgttgcattgtgtgatttctgtaatagtggaagaatgagatgacgtgagaataataatcacaacaatcacttacatgtaaatcaaagtaggtgtgaagtatttaatcaaaattaaaggtgagcactagatagaatgcgaacttgttaaattttgacaccaagctaaaaataaataaagttgcatatgcacttccttgatagattatatacagttagtttaataatagtgtagtgcacaattttatgggtgtgccatacaataataaattgtagcatatcatcgatcttgttaaataaagatgatattttttattgtttatgtaatactccctccttccctaaatgtttgataccgttgacttttttagacatgtttgaccgttcgttttattcaaaaacttttgtgatatgtgtaaaactgtatgtatacataaaaatatatttaacaataaatcaaatgatagaaaaagaataataattacttaaattttttgaataagacgaacggtcaaacatttttaaaaaagtcaacggcgtcaacattttgggatgggggtagatatactacatggcctagacaaaaaaaaaaagccatttcctttagatgactattaaagtggggtatgatcatgcctaatcatagggcaatatttaatcatcttataaagaaattatattattggatgtagttttttggaactccacaaacgccttacatttaaactatatctttacctgcaatggctgcattgtcccatccttgtagtagattgccaatagatgccacaatagcagcgagcactgcattagccgtcgagccatccgctacaaagtcaaacaataaaagataatattttcttgaagataatatatatttacttataaagaggctattctagacttctgtacaaagttaatctgacacctctgaataattgatggaaaagagaaaagataagataagaggaggttgcatgggcttcctttgtcttgggccaaagtaagctatcgtgcagcaacagtagtagttggccggcccatttaacaagcagcagtcaacatggcagcatttagcagtggtaggttggcagctacaagtagtactccctttgtctaaaaaaaaaaaaagacacccagtactagattgattttttttttacggagggagtagttcatcaacacagtagcaggcaatgcaagctagtaccaaggcgtcgttcggattaagctggcttttttagcacgaaaaacgagccactaacacaagactaatagagtaattactgttataaatttgaaaataaatttatttgactttttgaaaaaaaaacttaccatatagatagttttattaaaaaaacataggagtatcgtttaagcatgcttagggaaaacaagatagtagccaaactaagaagctattcaaactcacctattcagaacggatctccttgtgctctgtgagcatgcttctcaaactatgaaatgatgtatttcgtgcaaagttttctatatggaagtttcttataaaaataaataaatttattttttaagtttgtaataattaatactcaattaaccatatgctaataacttgtctcattcacgtgccgctaaaagtgctagcataaagttggttcgaaaaagcttaatctagcatcgggagttagaggttaggagtaatcgttatacaatagaagcctgattattgtaacacgggtttaaactttttgccgaagataagacgaaaatgtaaagagttactccctctgtttcaggttataagacgttttaactttggttaaagtcaaactacttcaagtttaactaagtttatagataaatatagtaatatttaggatgaatagctaaagtggtcctccaagtatcagcggagttcttgatgtttcaatctatccatattagtccttcaagtttttattttagttcaaacttatccttcaacccacttagaagccacatggccaaacataaccaacaactctcttgataaatgacatttttaccccctcattcacatatataagagaaaaaaattgaatgcaatgaattttttatatagataatgcatagtaatttatgtaaaacgaaaataattatgtacttgcaagtgcatacgatagacattgcttaagtttgatgtgcacatgttgaaataatgggaagtacttctgcaatgttatttatttatcttggttttctcttttctagtgtatagttgtatataaattatgggcgaaagggacatttttttttaacagaaatattgactagaaatagccatatggcatattaagtgggcctaaggatgattttaaaccaaaacaaatacttagaggacctacgtggacaaaatgaaacctgaaggacctaattgagccttcggtgaaacttgagggattaaattagctattcactctaatatttataataccaaataagtttcattaaatcaataattgaatatattttcataataaatttgtcttgggttgaaaatgttattattattttctacaaatttagttaaacttgaagcagtttgactttgaccaaaattaaaacgtctagtatagtataagcgtggcacaacaaattgagatgggtatagaatcgtttcagggccaaggcgctagatttaaaagctaaaatttctaacattaatagtgagaaaataataaaatctagaaatattcacgttaattacagaacagggaaacatctcacacatcaattcatatgcaacattataatggatgtgtgtttgatcaaacaggcaataaatacataatttgatttcagcttgatatgtaagtgtagatacaatatgcccaaatcaaatactagtaagttctttcatgttggacaaatctaccaaggatagtataatggattgttccattctagcaataggcgaatcttacttgccatatgattaatgcaattaaataaacacaaacatacatttttgaaaattttgtgttatgcatatatatatgattcctaacggaagcattatttttgcactaaaaataattcctcttagtattttctcaacctttcgatgataaaaataaaaatacattaattgaactaacacaaatttctaaaatgaagtgtatttgtatttcctttttttaacaaatatatgtattttctgacaacactaaccgatgtggatgcttggatctatgactagtttttagtaaagaaactctcctgtttttgaagtggtgctgataagtttgatacatctacctctcaccatacctcacgcgacctacataagaatcgtaaaatctagacttgtaagtaaagttctaacctgttgttgtcgaaagttccagacttgattcggagaagacggaagaccctaagctgatcggcgaggatggagagtattgttgccgcgtgttcttccaggcacccaagtccgctgctgcataccctcgtaaataaaaacgaatcaaacacaacatgcttaccaatttcttacagaagaacaaaaataataatggtttaaacatacttacccatcctcaggccagaaaccaaacgtaacaggaatagaagaaaaagtgtagccggtttaacctaaaccacatgtgaatttcttcttatgtattccttcccttctgccgtactgtttcaaatctcaaccatttgtagtttgtatcggcgttggtgtggtatcactgcaccacacgtcaaaacgtcgctccctccaatatccagtccgtgtttatacagtaggaggtaaatagagatggagttatgtaagggggagtcggaggctatttaatcagttcgttgagttggtttaggggtggactgatttgcctttgcccttgccggcgcagtccaaccacaccctccggatcaacctcgatcgctcgtttctgagccacgactgaaaagagagagtaccgccacgcaccgcgaataacgctaacggtaaaacagcgatgaccatgcatcttctctccggccaacggctgctcctcccgatcccatgcggcgcctgctatcgctcgccgccatccccggcgatcaagccgtccccgcttggactacgcccattcaccaagtcatcgtcgtcgttgcccctgcatctgcatgcagtctcgcccgccaccgttgcaaccgacggctcctccacctccgcgcagccaggttagtaacagaatttgttgtgatcaagtttacttggatgattgaactgaattcacgtggctggctacgtgtgtagatagttgggcagagttcgcgtcgcgggtgtccggcgagtgggacggatttggcgcggagttcacggcggccggcgacgccgtcgagctaccggagaacgtggtccccgaggcctaccgcgactggggcgtgcaggtgttcgactggcaaacgcagtgccccactctcgccgacccggccgcgccgtgcgacctccactacaggctcgtccgcctgctccccactgtcggctgcgaggccgacgccgccaccgtccacacctcgcaccagcgccacgcctcctccgcctccgcgttcgcctactccgccgccgggtcgtacgtcgccgcctggcccaggggccccgcgccggtgctcgaggtggagcactgcgtcgtgcacccggacaaccgggaggtgagggtccgcctcgtgcagacagtggcgctcgccaaggaggcgcggctccgcggcgtcaaggtgttctccgagcagtggtacggcccctaccggaacggcgaccagctcggcggctgcgccctccgcgaggccgcgttcgccgccggggagaagctcgccgcctccgacgtgaccgggcagtggcagagcgacgccgcctccgccgcgaggttctccggcgagctggaccccgagacggtaagcatttctccacgcgccattgctgcacacggacagcatcaagtgcttaatcagcaatgaacaacagggcaagttcgccgggttgacgcctgatgagcccggtgagagattgagccgagacgacggcgatggaatcgtgacgctgccgaagcagctgtggagctcgttcaaggagaatggcaaggacgagttcgtgtgcgaggtagggtgggtgctgggccatggcagcgccatcacgtcgaggtgtgttctctccagagatggagatgtcaaggcaagtatttctctctctcttatctttttctttcttcctgattctcctctggtttcaggctttcaacagagtacacagccaagaaatgaaatacactgaaagcagagtttggttttgtttgcaggagatagtcgtttcgcgcgagtcgcgtgtgtcggagggaacctgatcaggatatcaaaattgtcaggttcgatgatttttatgtagaatagaattatagccatacacaaatgtcttacacgcccgggtgtatactaatcaaattggcctcccgaaaggagtatacatgagtacatatactgacgctgttgtctgcatgatctagctaaaagtaatacagcacgccgctttctgaatttatagggacactacggtatactacctccgtattttaatgtattttaatagaggacgccgttgacttttttttacatgtttgaccattgtcttatttaaaaaatttaagtaattataatttattttgttatgagttgttttatcactcatagtactttaagtgtgatttatatcttatatatttgcataaaaattttaaataagacgaatggtcaaacatgtgagaaaaagttaactgcgtcatctattaaaaaacggagtgaatagtttttctccaggttttgcaaattgcaactttggctcaaacttgacgtcgccgcctcctaatctggtttgagcacttcaccttcaccttcaccttcaccttcgcccacggttttttttggtagccgaattgtaattcgattcatccatcggaggcagctggatcttaatgtaccggttcatctgttgcttcagctgcctgacactgcagaacaaagcagagcagagttgcaacagcagagtagcgtctagttttgttcatgggccaacagaacaacgaccacagtttgtgactgtcaacgaacacaaacgtccaacaatcagaatacaaacgtccaaccagtacaagaggtggctggtagtgcaactcaatctcatatgacatggaaatgtaatattataatctttaaagatattataggaacgcaagcattgagattagagttacgcaaacatgacgactttcattgcgtaatacaggtcgttgaaagaacaaccaacaaagcgaatgcacctcttttgggttcttttttaattgctaggcggccttgcaactacatcaaccaatataccaccactatatgctcatgctattgtctccatagagactacgctacttatcaactcacacttgcttggaataaataccaactaaatgaattgacttgatctcttctcatacaagtcacagacccgaattgggtagtgaagaatgaatggacaagagaagagaacaaaatctatacattcgtgcatcaatgtacttgaggtgcgtctcttaatgctacattcaaactgctttccattgtttgccaccctagtccaacgttgctgccttgcatcatggctacaaattcggcgtagtcaatttggccgtcctgaaaaagaatgacaagaccagttcattagattcaactcgagaaagattttcagggttgacgaatcaaaatcatcgccttcttttttcttttgaaatactatccctggaaaaaaaaacatgctaatgctaagttctaaagcatgaggacccaggacaaatggatctgtagaagagactgccctcaaccgtgtacatgttatcgttctgttgttgaacaagtttggtgttagatgtgacgctgacagatgccagtaaaatcaaataaataattttacagggaatgtcattaggattaaagactacaacgcaaactaccgatgtaccagctgaccagcagagacactagaagtctaaaaaaatcctaacatgtccaagagtgtatgctttcgtttaaagcgcagagtgttatgctgaaattattctcaatacggtggttacaagtcaatagtcactaaaaaataaatcttggatattgtatagtgaaatcaacttacattgttttgatcaacctctgaaataatctcttcaaggagtgaatcctccatgttatgttctccacaagctcgttgaagcttgtcaactgtgatataaccactcccatctttgtcaaaatatgtaaaagctgccagcaggtgctcctcacgttctatcttgttaagaggtagagttgcagcaataaattcttcataatggattgttacattattgtcgttgtgtgcctgaagaagtttcagagtttaaatcaagatctcaaagaaagagagcaccatctaaccaacaatttgtggtcttgcacctacttaccgcttccattatatcaccaatctctgtatccttaaattcagcgccaaatcttcttaaaccttctctaagctcaccgaaagtgattacacctctattttttgtgtccactgccttgaacatttctcttaacccagcaatctcctcctctgaaagacgctcagctatcacctggaagcacgtaagtgtcagaaaaaagaaatggcatatggttcacagatgtagccagcagtaggacatgcaacgaaatagtgctacaggctgaattgcggcatgttaatgtgcataccacataattgaatatcgcaacctaaaaacttgttttccatattgccacaaaatcagatgatcagcctagagcagctcccaaagttgacatttaccaaaaaaataacttattttactatcatagggatccaaagaatgacaatatggcatggcatgcgaatggatatagtgaagggctgaaggccaattggggatactcgattaagatgatatgatagcaaatatcatagcagcaatatggaagcatgcaagaatatgaagcactcactctcagagccaacttctttaacttgttcattgcagagaattgtttgagccgagagataacactgggatccagagcttgatcagtggcaactccattttcacagatccaaggatgccctgacaataagatatatatatcagtcaacatatcaaaaggtttgtagctcttagataattagtgaaaactaaaaccatgcgtcaaactatgttatgaacaaaatgcagagctattcgcgatgaaacaaaagggcaactaatttatgtgaagaaataggtcaaatatacttacttagcacttcatgggccttcaaacgctccgaagggcaatgagagagcatttttcttataagatcctttgcactgtcaga

SEQ ID NO: 68688 - DNA, 723 bp, Oryza sativa
tttaacatattgatagctactatgcccataaccaaccctgttggaacacacaggcagtttatttctgtagcggagacttgaccttttctgagtattaccattatggccttgctgcttctctttacacacatttcacctcccctattcgcagatatgcaggttagttcctatcgcccttagatgaacttatgcttaaagattttatttgaattgcgcatatagtcgttgggtgtttaaaccaatggatgtggtttgctatattaagttatttctttgtcttgcttctgagcagtgaatttatatttttctgcatgaaccttttacacaaagtgaatgttactcaatgtggctatgtgcatttaaatgtgtgaaatagcatcatgtccacaaatatggcattttctttagattgcctattactccagcacatgaagcctctgagcagtgaagttccaagatggcacgttcatgaattatgcagttccaagttgtaagaaagcattttgaaggactaacaatatccttttcttccagatgttattgttcataggttgttagctgctgccctagaaattgccaaacttccacccctctttcaggatggtccacaacttacaggcgtagctgacagtaagaaaatgaatgcactctgaagtacatctttctatgtttcacttcttggtactgaactactgataccttttgatgtcagacttgaattat

SEQ ID NO: 68689 - DNA, 843 bp, Oryza sativa
atgttcgattttatttgagcatagattactacccctgtataacacaaatttgctgataacaattattaatttgagatgatatttgccagattacattgagcgcaattttcctatgatgctatacagtaatacagatctccggaccaggatcctctgacttcatatgtggatcttgatccatagtaggtcctcatgtgttccgttcggtgcacaactgtcctatgctagccattgtacaatttggatgattgctgaaagacctgtaattatgatgttccaaagtttgtttaatcgactcttttgcattcggtggcatctccatctttatccgttcagtggctcagaacatgagtaacatgaacacggtcgaccaaagcgtgagagcaaaggaggcaatcaggtgcgtccaccctccacaagatgatggagcataatactcttctccgacgtcaaacaactgagccaatcatccctgcattgcagaaacgatgatcaccatacagctgaaacaaaagagagaatgtcactggagtcgatgggtgaacatcggtagactggcatgccgatgctcatggcgggggcaccgttgattgcatcaggagtacgtagcggtagagagatcttggaaggaacccaagcttcctgctgctgtgactctgatcactccaattccaattccacaggcaggcagaacgatgaagcgtatcatcgttcatcacgaccgatatgactatcagaggtttcatagccgtcctttctttgcctagcactagtagtgaagcaattgcaagtctttgcctgtgcatatcaataggccgtattctatctaatattaaaaaagaa

SEQ ID NO: 68690 - DNA, 7555 bp, Oryza sativa
  unsure (1)..(7555): unsure at all n locations
cctccaaaaattatgaaaacaaaacccaacaagacaatgaactctaaaaactattggcctaatttttttaaagttttaatgatgatgaatagtagtggtaaatcgtgtaagcaaataaaaatgtgacaaagaagtaaggggtagcgactgacgtggcttttaaaaactacaaaattattagaatcattggaatgataattttaaataaaattatttgtaaaaagtagataattttaaattgatgctagctgcgcaattgcgcgggctgtccagctagttgcttgaatttttaccatgcatatgatttttaccatccattttatccaatctaatcgtctttatcctctacgacaagtcgacaactaggtaaataaaagggcccatttatactattaaacaaatttctttatcacagtaggcgtctattcgatatatctaatttaatgatcgcccccaactttctcgtttaagaaccagcacgccatctgcgaaaagttcaacgccaggagaagaccaagaaaataggaaatcaacacgaaatcgatcgatgtgcagctccgtctaaaactaggcagtccacagaagaaagtgatgtgcagtagccactagtatctgacaagaaccccatacgcgaccctagtcgaatagcaacagatattgctgcacttttagaacacgtgatatgatagacgtgactatcattttcgcttttggctgtgtttttggatccaaacttcagtcctttttcatcacatcaacctgtcgtacacacacaacttttcagtcacatcatcttcaatttcaaccaaaatccaaactttgcactgaactaaacacagcctttattcgtaccattcactcgtaaattaaaagataatttatacaacatgtcatatataatacacaaatactaatatttctaatattttcatatttctttttaaagtttatgcgaaagttgtctcttaatttatggatggctcatcatcnctcttcacttttctttttcatcttgttacttaattcaatgtggtagttttggaggtggtatatgatgcattatagtactgtacctctcaagcaattactccctccgcttcgaaatgtttgacaccgctgactttttagtgcatgtgggaccgggcgggttgttaaacaaagtgaaggaaggataaatctctttgggctatcatccgattcattggtgaaagtatggcatgtctgcatatagatctcactctctgatagcagttggtgaataagacaagcggtagaatatatgctggaaagtcaaccgtgtcaaacatttaggaacggagggaggacttattagcttgattagtggtgtacctctcaagcaatcactgctactgctattatgctaactaactgattatataggctcgaccgggacgtgatcgcgtcacacaagaattccacagatgctaattacttcttctcgtcacactacgatatgcacgaaccacatgtcatagtttgagtacagtaactggagtaattcacaagaaaaatttacttatattcactttattcttttcgtcagaacgtgcggtagagtgaaacccacatcattggcatgagccacgtatcataaagtttgacagtaacttcacaaccgtaattaacccggtcaacaagatccatcattcatacagttggctctcttgattgtatcagattaattagctcggcctgatgatcagatccgtcctagatcaatgcaaaatagtccccgcttggaccaagcccaagttcataaagctttatactagctactccatccgtcccataatataaaagattttaagtttttacttgtaacgtttgaccactcgtcttattcaaattattttaaaattattatttatcttatttgtgacttactttattatctacaatactttaagcacaacttttcgttttttatatttgaaaaaaatttgaataagatgagtggtcaaacattgtaaataaaaactcaaaattccttatattgtgggatggagggattatatatctagcttccttccaggaaccaagaaatgttcagttctaaacgaagggctgacgaatcgtcacgaggtcaaccagtcaacagcaaatggtccttggtgtcctctttcgacctgtggtccataaccatgtgtacaattattcagaagtggtagtataccgttggcaacgtcctctagtttcacatttttcagggtgttttacttttctgaacttccgatcaacgtggagtttaattagcagtcagtcagcgcctgaagatagattgcaggctgcacgtgggggcgtagctacgtagccgcgtcagggtcaacgacactactttaatacatatacgtacgtatgtacgtacgtccagttctactatttgtctacccaagatgattggagccacacgtcggtcagttcgtcacccacacgctacagtcgaccaagctgttcagatacgcactctatatatcgtagtaaaacactaatgaatcgattgatctcgtctcaccagttaattaactttagtgtaatactatatactcctaccgtttttaatacatgacaccgttaactttcgaacacatgtttaatcatttatcttattaaaaaattttatttaaatgtataagatagtataaattacactttaagtactttaagtgataaaacaactcataacaaaataaattataattatataattttttttaatataacgattaattaaatgtgagaaaaatcaactctgtttatctattaaaaaaacgaaggtggcatgtgtcgcttttcatagcggccgtaaagaaggaaatggatacgccccgtgaagccgggcactgtcgtgtcgcagtctctctcccatccctcgtctatattggagtactccagtatattttgccggccgagcagtaaactagtactactagtaaaatagtgggcgcacaagactacagcagggaagccaagcaccaacggccgcacggcccgcaccgcgcgcaccagctagtagaaaacaccgttttcctacgtaattccgagccaaaaccacgtaacaatcgcccgcccacgtcccgtgtccccccatcccttcgccattggccggcacgcgctttgacgcagccgccgcagccgcgcgggtaacaataaaaacgcccccgtgcaccgcctgcctggcgaaaaaccggatcaacgcgagcaagcgctcacctcaccacctcaccctgcagcgacagaaagagtctgtagtagcgtacgatcgcggctagctatcgagctccagcgagaggcgtacgtgagtgcgtgcgtacgtgcgggagggaggaggaggggagatggcagggggaggaggggggagggcgttgccggagacgccgacgtgggcggtggccgtggtctgcgccgtcatcgtgctcgtctccgtcgccatggagcacggcctccacaagctcggccatgtacgtgccgttgcatccatcgtttgttaatttgttcgtttgtttttggctggctctccacaaaaccgaccttgataacaccattcctggtggcctggtgcttgattgattgatattgcagtggttccataagcgggagaagaaggccatgggcgaagcgctcgagaagatcaaagcaggtcagctttagtttcaccaacctgttcgatttcttgtcaaagcaaatttcactctctctctttttgaacaaaaggcaggagctagctttgcctcttaatcttccatttttcgtcaaaacggtaccatgtttgaagtttgaagtacaaatacttagcctcttatatcgtcaaacagtcaccggagtacataaatgaccacttagttttcctcttcaaacatagaacactcgtattctaatttctaaacataaacataaaggtcgcacttatataattccaaacaggaaaacaatagccgccgcaccagttcatcacaggaagtcaagactcatcatctacatgcttccattccagtgcccatatcctgatccctgattggctctgtccatttaccttttctctctctttttttccctgtttcttccacttgcagagttgatgctgctgggcttcatatcgctgctcctcactgtggcacaaacgcccatctccaagatatgcatcccggagtcagctgccaacatcatgctgccgtgcaaggcagggcaagatatcgtcaagggcctgaagggaaaaaaggaccatcgccggaggcttctctggtacaccggagaagaagagagccatcgccggtcactggccggcgccgccggcgaggattactgcgcgcaatcggtgagcaaaaacgctgcttaatctgttgcaacgtcacacgatgatttcgagggaaattcaagtgcgaatttaacgatgatgatttttcttcgtttttgcagggcaaggtggcgctgatgtcatcgggcggcatgcaccagctgcacatattcattttcgtgctcgcggtgttccacgtcacctactgcgtcatcaccatggctctagggcgtctcaaagtgagtggctaattaaccacctggcactctgttgtcaagcacggtttttttagtagaatttgtcagtctttgatttggattgcgatgagaaaatctattaatttgcccatgcatatgttgttccttggtgtagatgaagaaatggaagaaatgggaattagagaccaactcgttggagtatcagttcgcaaacggtaattaaagaatctaactaatactaaccttcttacctgaaacttgaaacatgacagcaaagaactgataactcgtatcatccttgcagatccttcacgattccggttcacgcatcagacatcgttcgtgaaacggcatctgggactgtcaagcacacctgggctcagatggattgtgagttcttgcacctaatcgatctctacctgcctaatctttgcagctacctggttattgttcgtatccaacattttttttaaagaaaaaaaactaccatgtttgttgttaggtggcgttcttcaggcagttcttcgggtctgtcaccaaggtggactacctgaccatgcggcaaggcttcatcaatgtactactactaattaacctgacccattcgccattgttgcaatggaccaagcttttgggagtgtgcactaattaactaatgtatctttaattctttgcaggcgcatttgtcgcagaatagcaagttcgacttccacaaatacatcaagaggtcattagaggacgatttcaaagttgtcgttggcatcaggtgaatccctctctccagtacttctctcttttttttttttaagaaagaaagacaagtattcagtcttgtgttcgtccttcgatcttgacacatttggcctgtttttgcagcctcccattgtggtttgtcgcgatccttgtgctcttccttgatatccaaggtaatcttttgtcctatcctgttcgttcttttgtttgctctgaataattggtcttgtaatcaccatgttttttatctgtgtgtggtgcagggttcggcacgcttatctggatctcttttgttccactcgtcgtaagtgcgaattatatatatttcttgacttcttgtgcaaatgaatagtcaacagaatcatgattttatcctacaaggtatgcaaaacatttgacaaaaaaaatgcatgccgttgtctttagatcctcatgttggttgggacaaagctggagatggttatcatggagatggcacaggagatacaggacagggcaactgtgatcaagggagcaccggtcgttgaaccaagcaacaagtacttctggtttaaccggcctgattgggtcttgttcttcatacacttgatactgttccagaacgcatttcagatggcacatttcgtgtggactctggtatgctacttgctaattggcatcaaccttcaaaagccagtgttatgcactcactaatgagccactaatgattgacatggtttggttatttttgtctgacaggcaacccctggcctgaagaaatgcttccatgaaaacatgggcttgagtatcatgaaagttgtagtggggatattcattcagttcctatgcagctacagcaccttccctctctacgcactcgtcacacaggtgaaaccatttagacaaaaatcacttgtaaatgctcttggaggtctcaattccaacgtcctcaacctttccgtgtgtttgcagatgggatcaaacatgaagaagaccatcttcgaggagcagacgatgaaggccctgatgaactggaggaagacggcgagggagaagaagaagctccgggacgccgacgagttcctagcacagatgagcggcgacacgacgccgagccgcggctcgtcgccggtgcacctgctgcacaagcaaagggtgaggtcggaagatccgccgagcgcaccggcatcgccggggttcgccggagaggccagggacatgtacccggtgcccgtggcgccggtggtgcggccgcatgggtttaaccggatggacccggataagaggagggcggcgtcctcgtcggccatccaagttgacatcgccgattctgatttctccttcagtgtacaacggtgatggccgaaaggtttctctgtacttaagttgtatagcagcaaatataggagtacaatgtatagttggtacactacatatagagattagaaaagtacagtcgatttttttaagaaacaataaaagcataactttgtataacatattctttcggaagaaagatgcggcagcattggggaacatccaaataatctccatcctctttcgtcttactataaaactacatggaaaattcttgttaattcaaaataaaaatgatagtaatagttagctgcaaagggttcgagctgaaggagtcaacaaagtagaagctggacgatcctatcgtaagccatcactgcttatattcaatatatgaaagctaaatgacataaatctggatttagctgcaaaaggttccagatgaacgagtcaacaacgtagaacttggatgatcctatcgtaagccatcactccttatattcaatatgaaagctctctggtcccaaaaaaagaatacttgtacactatcgggaaaaatcactgatggccaggaaaaagcaagggcacttgtcatccataggctagctagtcagctttggcacgacctcttctcttatgagtaactactagggccagtgatattgccattccaatcaaatgcccagcgactgagccataagtaacagagattggccattcctacgaaaaatcatgacagaacattagcaagtggcagaatggaggtgcaggcaacgatagaagcaatgtgtaaggctcagcaagggaattatcagccttgtgcactacatagtccactgaaagcaggatgcacgacgagaacacaagattatttcagataaaagagatgataataatgagtagtcccaaaagcaacagacaacagaagtacagaatatgaggcaagctacagaaactcatgtcagctccaaaaagt

SEQ ID NO: 68691 - DNA, 2813 bp, Oryza sativa
gttcttttaaatggccgatataactgtagaacttcaaacaaattactataatccatgtaaacccaactaaattagttaatgaggtagcggttagtgaacatgcatgaacatttccatttataattctgacttcccaagcctaggcagatgacagcagacagtaaagattcacagtggtatttttacctgccaaggtctttcccagtcgagaggcataggccaagcaccaagccatgctcctattacagctccatgagcaggtgcagatatcatgtagtccactgaatcagttgatccgcaataactgatgcaaaagcacacaacaaaccacaatgtcaggcagttgctggacagtaaatttagaaggaagatatccattaaatgaacccctagcattctattttcatttaagagtaagcgatgtacatggaatgagagagcacagcctgccaattcactttggatgctccaaatacgcatgctgcaggaacaaactgcaaaatcatggatttagcttgatatgacttgatatgtaacaattatataaatataaaggcacagtattggcacaagaaaaaaagtaatagttgtccggttgccaatattgttaatctcagatgtggtatttttacatacttgctgctccaaaaatggcactcacatttagtaccacctgccagtgacagcatttccaggaatgctactttttggagtggtgaaaatctaactgaatctaactggcagtgacacataagtaaatcaggggaaatggcacttactgtgaacaaggacatgagaagtgaccaataagttgttgctgcccagtacctacagatatgcaaccccgtgaaaggaccattgatatgtattatccatgaaagaaatatcctggtgcattctggtaaaatcagatgaaaaatatgtaggaagcagtatatatgacagtactagacatctatttagcattgacataaaggttaacaacaaccattgacgtccttgttgatctatactcacttgattccaatgggtgcaccaagaacaattgctccaaatgcatttaggaacgcacctatcagaaaacattgtgtacaataagggaaaaaaaaggtaagtaggtcctaaataattcaatagttcaactattattgtgtcacaagaatgaactaagccatgagtactgaacaatatatcctgtgtccagctattttggtcgtagtaacgaagctaagttaactcacgaaactagaagctaatatgaatgttaaaacacagaagagagagaactaaccaatggggaggccaagcaatcctcgcgcagctgccttaagaaactgaaattatagaacccaattatcctatcattgaacataacattggcatagaaatcagaagaagcaattgaccgaacaggtcacaagtgcacgccataccgagcagcgcttgggatttcgacggagcaaactgaacactgcgatgacaagaggcgcttcgaagacctagaaaaagtcttacttcgaatcagaagacatgagggaacaggggagcacaagatacgtcggacaatgtgacgaggtgaggggacggatgcataccacgaggaggcggagggcgtaggcgggattggagacgagcatgccgcggccagacaattgatgggctgccacgatcccagcgaagcacagagcatggaccgctactgcgcttgaggcgctgacctgcgtggcctcgtcgcccatgacaggggcaccgtgggggagtcaataggtggcagtggagccaacacctgccaagtcgggaggtcaattcccaggttgcggttcagcgacctctcgcagtggcatgatcctactttggaagttcacattacatacaaaaattttttaacaccacaaatcccatatacaacgacaaattagctaaaaagatgatacaaatatagcaaataatttaacaagcaagttcagaatgtgcaaaaaatcttacatataaatagaagattacaatggcactaccttgctctaagcttgctcttagccatgaaagtatttattactccctatgtaactaataccaatcctaagataacaacaacgatctattcacatccagtcattcacaaatcccaaattggctgcctaccggtggcggatctaacattggacatgggggttcagttgaatacccaaactacaaacaaaatgttattagtatgatatttaaggcaaatttctagaacagaagctagggttaactcaaattcgagaaatagtgcgtgggtagagagatgggaaagagcatgcgcgtaacggatgcggcggaagcaacagaacaaacgacggcgaccctacttgctcgcacgatggatggggatcgccgcaggcgcaggcggcggtggcggaggatgtgctcaccaggatggatgcggcggaagcaacaggacgagcgacggcgaccctgctcgctcgcgggatggatgggggtcggcggcggcggaggaagcagcaggacgagctacggcgactctgctcgctcgcgggatggatggggatcgatggcggcggcgaaggcggaggcggcggtgggcaaactgacgaggaggggatggatacgtaatcgtattacgaaggagtagtaatttcgcccatcactcacggtgtgttcggaaaatgggaaacgagggaatgggattggaattgggattaggaaatgaacgaagggttatgattaaatgaaagagagaataaacggttaggatttaaaaatgtctcttggtgggtaggaaatcattttcctttctgatttgccaaaca

SEQ ID NO: 68692 - DNA, 13062 bp, Oryza sativa
  unsure (1)..(13062): unsure at all n locations
ttgctcattctgatactgtattttacatccggtttgccagtaactagtaattagtgacactagttctgtttgtatgtttataaaccaacgaccgtgtagtatttaacttttagtggttcgctttcttaaaaaaatggccagtaaattgcacaaagcaccatattacaactaaataaaacatcaaatcaagattttgggaaagacttcttgatctccattgctaggtcactaataccaatgccatcaaatcacaggtctaccaaacaattgtcagctgtcaaggcagcactctgtaaatgagaatagaaacaggggaaatcatagaataaagcaaataaatgcacacaactgattggagatgcatcaaatgagaggactttattctcaaataagagatgtataaacaaccaggtcacgttctttaaaaaggataccccattgatatcaacccagaggccagaggtcaatttcaaataaactttagctcatgagagaaaggacaaagtaaaattgaaaaaaaaaaggttggctaacaacaaagctttatgtataagtagacatgaatacaactaatgctggtcatacaaggtaaagtgtgccagcatagctaagaagggggaaggcaaaagcatggggaaacataatttctgtataaattttaatcaaagaagagcttttacttgtcctaaatgaaataaagaaaagtaccctgttaagggacagagagaagtcaaaacgttagagatcactgagtgactgagagcaactatcagcttaaaacagaaaaaaaacctgaaatgctccattgctacaaggctccaggctaaacagcaggaattctgactatgtgtttcccaagtctacatagttttcccgtgaacttcagcaccaccaagagggatttgcatcctctgacatgcagtagttaagtcagagacgtgcagtacccctctatatcaactgcccgttttaatccaatgatccttatttggtcttcgttctccccttttcttcctgccttcttcgcagttcgcacatactcctaagtcattacatgcctacggccacaaaatccacgatgctgtggtatggcgctgtggtcatcgagtacccatgaaacaaagcagagcttgtggaagtgttgttcaggttggggtcacctgtggctgcggagtggcgggtgagctctgtggtggccagaaacatggcattggtggtgtcctgctccggtgggctgaggcagataatttgctctggaaagcgaaaggggctatagaacatgtgaaaaataatttcaacctcgatttgagaaaattagccttgaggtggcaaattttagagttgatctttggagcggtcagaaacggttcagcccaattttgtggccgtccaacggcacgcgccgccacacggacactacgaagaaaagggaggctaacttaaggagctccgcttggtattggccaaagcaatcactaatgaaacaaattcgcttctcagcagcattctcctcattaacatcaagcattttggtcgttgacgtgctcagacgagaggtcctagtggatgggaacagcgtgtccttaacaatgcaaccttgcaagcagtggagaagaactggctaataagcaggagccatcggatggttttggacagcggatagatgggtactaccacgtcttcgacttgactactgcgtgtcagaggatccgaatcccaccaccaagagcacagctagtggaaattcaaagtgcataccagtgcaggatatcaggcaagtgttgggatcgaaacattcagcaagttggtgacaacaaaactaaattcagatctccaaataaattgggttactgatgcaggattcaggcatgtattgttctcccacgaattagtgttggacttatatctcccaatcataaccagctagtgaaaaccagtagtgttaggattcataaccaactagtgaaaaccctagctaacattgtagcaccggtataagaaattcagtaggttgaactgatggcgccgctaaaacagccgaaatggaaactcaagtttcaatacctctacagcctaaaggttcatcagtagtgctcgtcgaattccgaagggtaaaatttgcgttgaaatcgcaatcacgaagccaatcacagcaatcgagccaaatctagaggggccaaaatgacaaggcggggcgggggatcacctgaatagagcagatcgaagcggagcggggatcaggagagcttggcggtggaagggatgagggggacgccaatggtggcggcgcccttggacttggcctcctgcgcctcgcggatcttctgcatctggatcatccgctccatgacgagctcgtactggcacttctcgtaggcgtggcgctcgggctcgcacttccaggggaggtagtactcggcgacgcggcacttgttgagggggatgaggaggtgggcgcactggtcgcggtagggcagtgggaggcgcgcctccgacatctccgcctgggtcgcgatctgcggcttcgaggtgcccagctgcacgccggccgccgccgccgcctccatctcgcgctcttcctttctctctcctctccggcgaggcggtcgatggttggtggtgcggtgtgtggatgcgggtggttggatcggtcgctttgggctcgggttcgggctccagctagaccaagaagtttctcgcttccccaatgccccaagtaaacttccgtaaaaaataaaaaaaatggccccaagtaaactgggattaaaagttgaacgtagtcataagtcatagtaacacatagctgatgtttgagatagatttagaataaaatcagcgcagagaaagttatcagagtataattaattaagttttaattgttccaaacataaaaaaattattatttaatattttaaagtaatgcttatataaaaagccctattcttttctgattaagatttaaattttatatgggttttcgataacgggtttctcgaactgctaaacggtgtgtttttcttttaaaaaaacttctaagatctttagatttgttttacatagacggaacaacgaaataacatacggcaatagataacgatggtgcttgtggtgaagcgacaagggtgccatggcacccaccctagctagatctgcagcgaggagtcgagctgcgatggtccgatgagagatggtggcggcgagttagaggagaagcagatgatgcttgcaggcgagaggcaacaacagcgaggactagtggtgacgaatgaggatgaggttaacatgattgcgacgggactagagttagcatcacaatcgaggattattgacgtgggtggcgacaacgtaggtagcggtgagtcctacatgaagtagagaaggtcaaccctacccaggcctcagcgggtcccacatatcatcattgctaagatgtggttggggtgtggtttactggaagagaagtatcaaaataactctagatatctggatagactaaaatctccatggttattttgaaactcagaccataatactagaggttttgtgatatttactttaattttttttagaaaaacattggcaatcaaaaacttgtttcttaataaaattttgccggcctcaaccttaatctttatccgttttatgcccaactagagtactacaatatgttagctgtgttgtggtgggcttagccagactcattttggtaccaagccatacaaatccatgctttagccaggtatgtcataaatgataataacaagttagcttttcttatatatatatatgtgtgtgtgtgtgtgtgtgtgtgacttataagctaatggattttaaagttctaactttaaatgtagagtcatattttttttaccttatataagcttaaaaaaaagcttctgacttagcttttggcttaatagcacaagagtagcttacgactttaaaaaggcgaaacgaaaaaaccgcttgtttaatagcataagattttttgcacataaattagtttataatcctaaacaaagaggattgaaagtttggatatttagctacgttgagctacggattgaatgggctacattttatttgggtcacttttgtgttacatcatggatgccctgataagagcactaccctcagagcacttctgtcgtgtatcgataaatctgctaacaacaaaatgcagtactagtacgcacgattttttttagaaatgagggagtcaaaatatacttatttaaagctaaggacggtgggttgatcatgccttcgacacgacacggtccgagtttattgggccgtgccagggccatagtgcagcccatgagcgggcacggcctgtcacagtgagtttgttggtccgtgacggcccgactgccctcagaccaggcaggcagccccttcggccatttatagtgtagattctgattgtctcctccaaggctccaatgcgaatgctcgtgtaagttctgaatgtttctcctccaatgcaaatgcagaactgtccaggctctgaatgctaacggcgagtgatatcgggtattgcagttgcctagcagactgtcaccaagcaaccacatgtccacatttacgggtgacatggaaaatttgtcagcaatttgacaaataactaatatttgtgattcattcttctcatttttttaagtatctctaattgaaagcacatacaatttatagttggatattcgttgataatttttccactctgtatttggtgatgtgtactcgcgtatgccatttgctgtcttctttcttaaatggaaggatttgtccgttcttcacttcttcgtgctgcctcattgtttcccttctgaaaaataaaagaccgaaacaacaaagaacggaccaaaactatataaaaaaatggatcagaattctggcttggaatcctcctcgaagaggggtcacttgtgcgcactgtataatcatagtcgatcatctggggaaaggatcgtcacttccattcaaacaaacaattggacgagcaaaaactgtacagaaaaaaaaattacaaaaccacaaaaagtaaagttaaatattgcattctgtatggatcagatttctggcttgaatcctccgaaaagggattacatttgcgcacagtataatcgtagtcgatcatctggggaaaggatcttcacttccattcaaacaaacaaacaaacaaaaaagggtcgcgcaaaaaaacactgcaaaacaaaaatacaaagctgaaattgtgttgagaatagcagatggatcagatttctggcttgaatcctctgaagagggattacatttgcgcacagtataatcatagtcgatcagctggggaaaggatcctcacttccatcaagattatataatatctcaaccaaaacaacaggcgaaaatcagaacaccgcggatgaataactcagaaacagatctagtggatgaactcccagagaaacgaaaccaaatcagatgcaaatcaaatgtagcggtttgatcagaactactggcttagaagccttctccgaagagaagagcttgcaaaaatcgcacagtacaatcatagtcgataatttggggaaaggatcatcacttcaaaactgcatcagatttgcaaccgcgtaaaaccaatctgaaaaccaaacgcaacagatctatctagaaagaagagagaacagaaaagaaactcaaattaagattgaacaaacgcgagaagcgaaaaccacatattaccggtgcggcggaagggaacgatgagtgggtttcggaagaacaggatgccgcttatatagggttgacgggtcggcggcgaggaaaccctagctcgtattagcatcagattgtggtaacaggccgacgtgtaaccaaattgggccggtaaaatatgggcctaatctatagttttggcccaaactctatacaccttgtccttttctattactttcttttttgtctactgggaatcagggatgaatagcagaagaacacaaatgtcgtttttgtttattactaaataaaattcagaaaacatgagtaaaaatttaagttgtggtaacaaagagatcgttcccttcttgcagtcaagagaatggagatacataggacagaaaaaagagaaggattttatggagtgaattgtgaacagattctacatatccctaccggagctgtgtaggtacagtgttgctgtgttagtatcacacattcacaccgcacacaattaataacagattaaaagtttaaagctagatttacccaatatttttcagggaaaggccgaacgaactaaattaagactgattaatgatcatctcgtgatatgggccgtattctcccactgggctcaccacaacaaaaagttctggcccatctcattctcaatccttccccccaacgataaaaccgagaaaactatgctaactgcatctaggttgaattcagatcctctgcatttagaggtatatatatacaaaggatataaatagacatgtgctttagaaaaaacttccaaccacaccatcatattttaacgtttcatattatatcactatagtaatgtgctaaaatacatgagaggctactagggtaggcaacaaaatcagtcaccgttgttccaagacttttgccacaatgccatgtagtagttactgtaatagactcctattccctccgtaaaaaaaaaaaaaacctaagagagatatgacctcttcgagtacaacgaatctggacaacattatctagattcattatactaggcctcctaagttagttttttttttggacggagggaaaactcaacctaagagggatatccctcctatgataacgaatttagataaatggtagttgtattagaaggggtcggttgagtttatttgggatggaggagccctatcgtggatttagatcggatgcaatcgatagtgtcaccgcaacttatgcagtccaccgctatccgttagattcaaaaccgaggatcaagatgcatccagtaccgtagatcactactatgacaagatttgtgaagtacttgtatatcgataccggagctatcgacctgatccgttcaattattttttttaaaaaaagggatggttgttattgtgtacagtagcttaacttatggttgctattttaaactgcagatgatatgcatccacctgggttacatttacggggattgctaactaggacagcttcgcacatgtatacagtactagtacacaaaaaacacatgtaccgtagatatatgtactcgcagcaacgaccagaccagagcgatggtgccgaggagccattttcggctgaactttgtacgggcgtgacacggacctgtactgtacgatgtaaagtgtgtcttctgggcttgtacgacgacgcagtttgttccaaacggcagctacgtacccaaaccaaaccagactgacgaaaagtcttgctccacttgaccgttgaccgccgcaggaagcgcgcgttgcatgtgcaagtgcaacggcgcccaaagtatgaacaccacgagcgtgaccgtcgatcgtatgaacagcgtcgacgatagctcgatccattggtcaagcgtcggtcagcagattttttttcttcttcttcttctttttttttttcatatgaatgtcactagcaaatctcgcgcacaacagggggtgccacgtcactcaaacaatattacaaataataccactaccttctacctagcaggtctattatatataactctatatacaaactcttctaaatggtcaataccgtttggcaaggtagtcagggcctagaatattgcccccctcaaatcctaattaattaagtactgtactcaattagaaaaaaaaatctcatgtagaacaagaggtcggtttattgcctgagtactaattttgcatttttaaacattactatgcgatatattcctatgtagtatggtaaaatcataatgtattgaagttgtatatataattgagtgaaaacatgctttgtttatatgaattacgagattaccctgcacaactttacgcgaagctcgataattgaagcatatttagacatgatatataactctaagttctatttccacaaatacagctgtaaaatgtttatatcaaccgttctacaccattataatctggacccattctgatctaacggtttaatttttttttactttctttaattaatgtgagaatatatgacctctagagtaaatctattgccctgttttcgagctatctttatatatataatctactcactacccccgaatttcaaactccttgtaattctgcgtacaccccaattactactttccaaaggtaatatgaaattaagggaataaaagtattttctaattgtagggtcgtatttgaatttcgtcccaagacctcaatttttttagagacagccatgccgtatagtagtcaggtctcttaggagaatattcactggtaagaatttttgtatatgtagtcatatacttaaaaaaatactacgaatattaggaaatggtctcgtagagctagccgaaaaatctctggacatttctctatggagttgtatactttaaatacctaaaaatgaataagtgagtaatgaagtctatacctattaatgtcctatattccctaaaaaaatgtcatatattaattgttctctcgtacctttcgtctacactggtggagaaatgctatttactcccggtttagaaccctttgtagtctcagttttccaactgggactacgaatccgggactaaagatcgctatctttagtcccggttcaaataaccggatctttagtcccggttggtaacaccaaccgggagtaaagaggatgaatctttagtaagaggggaagcgacagtttctcgagatcttttttttattttattgttgatttgctaatggctagtgttaatccctgtattttctcccgaatcgaatgggatgcacatccccaaatcaacatcctaaatattaagttacttatagacacagatcaaatacatcataaatcctacacacagatcaaatacatcacaaatcctaaaaaactatacacaaattaaatacatcacagattatacaagattatacatctcagatccatgcgatgcaatgaatcacaaaatataaaaaattatacatccagtgaaacacaaattatataaaaaaaagaaaagcaaacgaaccagcgctcggccgcccgcctgcccaccgccgccggcctcctgcccgccgccgcctccccccacgcggctgcgccgccgccggccggctgatggaagagggagtagaggggtggaggaggaagggcggctgatgggagggaggagaagaggaaggggaggagggggaggaagagaggggatgttccaatcttatctaaatatatgtctgggacttaaccgattagaagtgtgagagaaatatttactcccggttgataactccaaccgggactaaagatcgatctttactcccagttagtattaccaacagggactaaagtggtaatctttagtcccgattggtagtatcaaccggcactaaagatcctcggtcccctgacatacatctaacaggggatgaactgggactaaaaatcatctttagtcccggttggtgttagatcaattttttttaaccgggaataaaaatcgttttttgtcccggtttttaatagaaccgggattattgtggaatttggtcgaccgaccaaatattgtttctccacctgtgctacttagactacactttaatacttcatacgcgcgacacaggaagagggaaacagaaggaaagactgcgagcggagtctttagtcgttgaataatcgtgcttaatttcttgcgcaaactgaacatatattttagccaaagagtgatgagagtttgatgcgtcgtccaccctccaatctatcacgcttaactataaactgctcgctttcgcaacctgtcgatcactggatggatctgtgtccaacttgaacgtaattaggttaactgtgcgtatccaatatgaatatagatagtactactattgtgcaaagccacataatgccggcacacgcacacatatgacagttattagacattgacgaaaattgacttacctaaactacctacgcgacacagcaatattatacagaatcagttgcccagttgtatgtattgcctaagcttaattgggaggggagagatagagtgaataatcagcacgctgacgaactctccatgaggtcttattatggtaccagtcatcaacccgaacgatggacgggtttttatggactgatactatatgtatttgaattttaatattatattaaacatgttggttatcttcaaaatcaaaattataatgcttatattaaaagcaatctatattggctacaactgattaacaattaattttaagttttaaaattaaactaataaaatactcacttcatcctaaaatatagagattttggttggataagacatatctaaataatagaattgagagttcaagctggtacgattaaatatgactttttgattttctatattgaagtcaatgatattttcagttcatgatttatttaagatcaggtaatttattctaagttaacatgaaagctcactttaaagtgttcaattactacaagtataggtacatcgatcctagagaatttcctcacactgatactgaaccacaaaagttagcacaaatagctttccaggaaataggaaaagaaaggcaaaagaaaacacaatgattcaatgaagtcgcaactcgcaagtcaagaagacaatcacacctacccagcaagcaacaggtagctgtaagtgcacgaaaaacaccagcaactgcaagtgattttacaagaaaatagccgaggatttgcgggtcgctgcactatcaacaatggtcctaactaaagcttctcaaccttttacacgaaaaggagtcacagattttgcacgaaagagtgcagatctgggccactgggaagcgaaaaccgcagataatttcggccaaattcctgtccttgtttttgaattggtttccgaaatgaccgaccgtccgggacagcgacatggcgatcgacttggaccggagactgaagattgatgcagggccctgtgcgtgtaaattgtctgagcatcagatgactgaaggctctacagctgaagttagtaataatcttgactagaatcgagttcgtctagtctttaaaattttagagcagtttggaacaacgcggacaatgtttaaatttgggtcggtgcaggcaaatcgacaaaaacatgcagggtcggtttcgttttcttttggtctgtcaacttgaatcaaaatctagagcgaagtgctcaggtcaagtgaagggcatctacacttggggcgcaacaaaagctttgtttagagaactccagaagtcctctagaggaatctctaaagctttttgtttccttttcttgcacagggcatctctgtacctttaaaaatcattcaggcattcagcacatggagcagtggaggtagtacacacctacattatatatatttatattgtaattatatatttatattgtaacttgtgcgccgtgctgttgtgacattatcgtactgtgctaagcaagcaacaacagtatatgccacgcttttgcaatttcagcatgtggaacgggccagcacacacctactcctttcgctttaaaatatacttcatttaaaatatttaaaatttatatcacaatacatgtatttatgcgacattgattttaatgcatgtaaatctatacattttcaaacaatgagatacttagaaaaacaataatggtcaaaaattgcacttaaaggacaaatgaaataaaaagaactccatatatttattacatacaaaagtagttgtagggcttgtttgatttagtggtagtgccaaaacttagtcatattttgaaactaacaatattttggtagggtagcattttaagtgagtggatttgaattgataccaattgaaagccaaatctcatgttatggtcaagaaagttatagaattatgccaaattaaccatgggcattaccattcaattggctctaaaccaaacaattacattcactatataaactaccaaaaaattggtatggtaatattttggaatcaatccaaaatgacccgtacttacaaacagttgacattgacaacttggaaaattgtaagttacgttctgcaatttcgctagctgttgcttcagaagcatggttagatatatcggttggcaacggctgcagccgccaatttgcaaactgcggcggcaggacatatgctgagctctaaagcactcaagcagcaagctattgaatggacatggctgtcaaaaacacattgtttaaggaagacgactcggtttggggcttagcattggactactacttgaactggcgattcatgcgagtatgcaactatagcttgaaaatttagttcaccttagtcaacgatacgatggttgcatgttgcatacttgcataatgcatagggagaaattgcctgcggattacagacttaattaacaaggtgctctggaactctgaatccatgggccatctccggtagtataattctcccatcggaagaagctgtgacatccgttgacaattgcaaggcaattccttatttgtcactaaaaatttacacgaatatttatttatcgctaatgtttcgttgacatgtatcaatattacaatcttcatctggttgacattttcgtaagctttgctgcattgtggtggcatgaaatgatcggaaggatcgtcgggtttgcacgctatatatgtcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 68693 - DNA, 7385 bp, Oryza sativa
aatttaatcgtccgtcttatttaattttttttttgaaaaaaataataaaaaaacataaatcatgtagtataaagtattatttatgttttatcatcaaataataataaaaatactaatcataacaaaaattcaaataagacggatgattaaagttggataaaaaaacttatggctgtgcttaaaataggacggagagagtagaaactagtgtaaggctttgtttgggagagtttaagctgcttgcatgcttctgagaattttgaaaatttgggtttcgcgagtttgagcttctacggttagtttattttataaattctatagctacagatactgaggatgtggactgaaaattctgggaaaattggcttttgctaaaagctcccgtaaacgtatgctaagtctctacaattccaagtctctcactaacattactaattcaatatgataattaatcattatttctctcacattatgtcttgagctacgcctagtagaaactactccgtactacaagatcggtttctttatcattcctcatttaatagttagattgtcacattatattattttaaatagaattgtctaaatacaatagaactttatttttctaaaaaaaacttgtagtgggtttatagctttacaaaattctgggtggcgcttgtggatggttgatgactctaaaagacgctatcatactggagtatctcctatgtatgcggcgctggtgttacaaattctcccctcgttgctgttgacaaggagataatgacattggattcttcctgttggcaataattacaatgccaaattgccaacatctcatctcaagtactcaaccggcgttcgtcctttgacatgggaacagcggtcgactacaatacgtgccaccctcgacgacggccgcggcggggacggtgacccgttgcaatcagagaaggacgcggcagctgcctgcggcgagggaggcaagcggcagcggagggtaggacaagacgcgtgcagcagcagcagcaagcaggcagcgagatgtgcgattgtgcatgcatgcatgcgtgcaattttgagtagtctgttgtagttgtagcgtttagccatggcccaggcaggggaatgatgatgacaaggagaaaacacgcaccacaacatattattccattccaagggcccggccatccagtcaggctagccagctacagtaactcatcccgacgtttaccctacatcctccatcctacaataacctctcatttatcctaaaataagtttattttttaaataattattttattagaacatgaaaataaagaataaatacatttggggtagattattttataaaaattaattgtattaggatttgataaaatgtaagtattctagtctctttttttgtgtgtgtttgtatatgtgagatgcgtaaaaaaataaatttattttaggatagagggatagggggagtattactctttctgtccttgataagttcattcttattagagctcctaactgatatttaaatcagtatggaagaaacatagtactaaatatctatcatcctcgtgtagaaaagaaatattgttggagagataggtaagaagtattaaaatgataaaattcttcgatgacaaagggatgatactatataaggagataaaacttactactctgggataaatattaaaaatgagtttattttgaaacggcggaaatagacattttgggaggagatagacggaaaagcaattttgaggggagacagaatcatcatgctcgtgggggcagcgcgggaaacaaaccggagtgtgcagtagtatccccccctcctcactggccccgtgcaatgatgccagccagccctctgcgctgcatctgcatgcatgcccacattgcaactactctctgcatctcatctcatctccggttgttgaatctactgttgattgggctgagatgacaaatgtacagtttgtctcacggagaccacttcgctagccttgtcattatcaagcgacacactagtatatttcaggatgtaattaacccatctctcttatgattgtttcttctcttcttgccggaatttccacagcaaaggccaagggccaatgacccaattaatgtccaaacaaatgatgcatccttggtaaaggcttttgtggactatccaaattttgctgcaatatccagccctgatactttcctagctagcaccatgcattgtcacgggtttgtcacagtgggcagcgtcttctccgtcgatgtttttcaagggtcggccaaaggggtgcgtcgtgaacgcctttgccggccgagcttgcagctgctgctggtccagactccatagagacagagagaaagagaaatcaaattatgtgctcatccaccgcatgcgccggtcaatcccagctctatttgcaaacacctccgggcatgcagatgcccccaccgctgcactcactcaactctcccctttttccccggccgtccgtacacccatccagatcctctacagcctacacgatgctacacatatataccacagacatatatatactgcacgtatacaatctactactattaacatatccatgaggatgcacgaaactgtctactcctactaggagggtatgaagttagctaacaatcggtttcgcgaaacttgactagctacatagaccgacttaagaaacacaaactgctcggtttttttctaatcaagttaaaaataatcaaactaaattttaacaaaaatttaatccgattttacgggagcaaacagttttaaaatggttttaagaaaaacgacaaaccgttgacccccagatttcaactcgggaatggtgtggtgacccgttgctctactagtagtagggagtacttgaagtgatatggcaaagctatagacagttgacaactaagatatatctcctccgtcctaaaataaatcaatctagtatcttatatgtaatacgggtgtctagatttatcgtattaaaatagcatatcatatcactagtccagtggtatataaattggcatgcattggcattgggtgaggatgcgtaaaggatcaaaagccccgggttgaagggggcatgatgagccgtatgatccgcttggtttcccctgcatgcaatgatggcggcgctgaggctgagcctgaggctgagctgagctcctcctctcacccacagtagctggctgcctcctgtatctcagtatctgtacatgttccctggccgcctcctccgtcttgcactagctgctactgtgcccgcgtgtgtatgcgcgctcctttggaacacatcactgcataaggacatgcccactttactcaaatacgcaacactctttgtcctgtttagtttgaaaagccggagtacaattcaattgttgagatcgatcggatcgagtagtattaattcgagggtggatatcatgccacgttattatagagtatgagaattgttggtactgggatatacgcgagattaagataaagagacgagagacaggttttatacaggttccgaccccttaactgacagataaccttatttctgttggccgaagccggtattgtttttatatttcagtatcacataagcataatattttagatgacctaatctactttctatcggcttgacgtcatggagctctcgcacgtagtagatggctagcgtagtcttcttcctagaatatgaactcaacaagattggagatgtctctaagctagatccctttatggcttctacattgggtttggctgggtctatattggcttgtattctgacttggcgtgttgcctctctgacttggcatgtcccctcctcataaggcgtattgtattgatacccttggatgcccccttcaagtataactagggagacaagtatatattaatatgaagtaatccttgtagtgcccgagtagaactatgttttttctttcttattcagcggtccagattattagctagattctgaaaatctgattatatattcacaaaatgaaattgaagctagaagttgataacctaattttttttcgatcagattctcacgggatggctatctatcaattgtttcccagaatctcgagttacctcaaataaccttaaaatctgaagtaagaatctaaaatgcttgagaaaaaaatagagattgttagctgaagaaccgtaagtagctgtagctaatgaaaatcatccttaaatttaggttctcgaaaattatagtatgtttatatctatgccaatacgtacgttgtaatatgtttaggatctcttcacatcaatttttttttcgattttctctctttctacaccattgatttgggctagaactagaacttttttccggctccgataagcgttccatgacaataatggctacctcaaaaagctatacttcgtaacaatgatatggacatgattttccagccaataaggatttcatatttcacttgattggtatggcaatttttttacatggccagtccgtcactacttaagtagatgggtgggtatatttggtatagttctagttttcagaacacatataaactcttgttttatatgacccatagttttacgaatgaccctgcgtgcttaggacatccacaacatggatgaaaagtggatagtaaggtcactcactatttatttttatcattgtggaggtaggtagtagaggaggtagtaactataacaaacaatagcactactacctagtaataggaataaaaaacattgaactctctcctctgtctcttttctacccaaccattgttttacatgttgtgagcggtacaaacaactataacctagtagtttattgatcccaccttattattcacttaataaatatatattgaggatgtccttaattattgtgacatatatatggtgccctattaggtagcttgatggaagatttttcaaaggctatcatgcttccattcctgatgccttatggctgatctgtttatgattgttcctttgtcgactgcatgcatgtatgattcatctgttggtaccagtcaataaattcattttgaagctttctagcgagctcgattcatcaccgatattaccgatccatccatcgatcgatctccttggattggatcagcaggcatgcatgcagcacctgccatctctgattctctgcacccgggattattaattaacctcgcctttaagtacgggagatcccggtcagaacgctgaaagagataagaatatatcgtgatcactatgctgcatgactgcatcgtacggcccatgcagtcgttagatttggttagttgcgtcttaattcgaggtaatgatcgatcgtctgatcctacctgatctccatcatgttcctgttgatataagttgcatgcaaaggaaaaaaatttcaaacaaaaacttttaagaaaaattcgcactttatttgatagtagcttgtactccgtctgtctccgaaagatcactagcctttttgttttcccgagatgaaaaagggaaagaaaaatctacgattagcttttcttgcaatagattggcaactttttgaatccaaattcaaagcccaatccttgaagccacgcactgcacagcgtcctacagacacctttattttggtagggtctgaagaattcttcagagagtacagtatatagtccatgcatgcagggagagctagctaggaatttttcacatcccattcaacacaactcatatctcgtacacgtatgggacgtccggtgacaagattgagcctttattccttttttcccaggattggacacatgctttcctatttatgcacatgctatctgatttctcctggcaaatatactgaaaaagaacagctacaagctcctttgaaatgtaaaattgaaaagatgtaggactagaaaaaaacactggatttcatcgtaaatgcaagtgcaaaacatagaaaaaaaatataataattaccgtttgattattccgcatgaaaaatcactataggattgactattacatggaaaatttagaagaaaggacataattcaattaatcaattgtttcaaacaattaaaacacaaacaactaaaaagatgacatattactccctccagcccaaattataaggcttatatttttacacgatttttaattatatactttgaccgttaatttattctattttatgttccaaatgaatacgaaattagcatcatacgaaagtactttaaaatataaatctagtgatataatatgtataatacttagcgtagatatgtttgctatgattattaatcaaaagttatcgactttaattttcctaaaaataagaacgtcttataatttgggacggagggagtactatagtgcaatacctattagacataagcataaaaattccgtacatcctaatctaaccattttatggtagtaaccgatgatatcaaatatttaaaaacggatggaagtattggttattaactattaagccactattcaaaactgaattactctcaagtggttaaattagtaattctcaagtgagaggggaactgacccatgataggaagaaaacaaggctggctggggtgagggtgagggatcagaaatattcagaatggtggtgcaatgaaatgaaatgaattcaaggtgctcgtgcctacaggtagcaaaagcaggcaggaaggcaggcagaggggggagagaagccaggtgcatacagtacatatgtcagtggcaatacaggcggaaaacttggcatgctttgctccccggtgtcttcatctcggctcgggtcaacagccctgctccaatctcattattatcccctcctacggggaggcatatgccctgaccgcatctgaacaccttctttgtctccaaccttttgtctcttcctgctcttctctcccctctccccaccattgcccctgcaacctcctctacacctcattcaatttaacactagcttctctctctctatagctctacaagttgatgagaagctgcagcgttatataagccgggctagctagctgtctgtttgcaggtcactcgtgtgtgtgtacaacaactatatacacagttatacattcgtgtgtgaagtgatatatatatgtgcgaagtgactggttagcttaattagctgcctggatgatgatgacgatgatgagcatatagctggttttgtttgtttgtttgatcgatcgctgcaagtcgatcttgacattgtgctgttgatcgaacgatcgatcgagaggttgtgagagatgaccatggtgagggcggcaatggtgggcggcggcagggagaggaacggcggcgtcaggcagtacaaccgatccaaggtgccgcggctacgctggacgcctgacctgcaccactg

SEQ ID NO: 68694 - DNA, 5022 bp, Oryza sativa
  unsure (1)..(5022): unsure at all n locations
gcaaggtactttgctttgaatgatcttggaatgtttatatatgtattataaacattacgtacatacttttatacacgtacattcttttgtttttttcttttaactttgctttgcaatgtgttggctttgactagctacttctataggtatttttgcctgccaggaatggttcaggcagagctctgcttttttcaacaaacaaaagtttgaagtaaaaaggatatattccccgagacgtgtctatcttgttggtcctgaactgcagagtctccaaatatagctactacagtactctacattcctcactgctaaaactgtgaagaatatacagaccccagttagtcacaattcttattaaccaccgatgcatacataatgcaggaagatgcattttcttgtcgatgctactagtcttgaaggttgttaatcacaggctagtcagagtagtgttaaggtcttaagcaccttatttcgccattaaagaagaactgttgggcacacttgcttgtatgcagatgcatgtgtgcatggatggcacacttctcaaaatataacaattctttgaaattttttatactaattctttgggctatacagtgttagttcctttatcctaatgctgcatgcagctgctactagtaactccagtactccatgagaggaggaaagctaaggaaagaaaaacctaaggccctgtttagatgggactaaaacttttaagtccctatcacatcggatgtttgaaaattaattataaatattaaacgtagactattaataaaactcatccataatcttggactaatttgcgagacgaatctaatgagcctaattaatccatgattagcctatgtgatgctacagtaaacattctctaattatagattaattaggtttaaaaaatttgtctcgtgaattagcttttatttatgtaattagttttgtaagtagtctatatttaatactctaaattagtgtctaaaaacatggactaaagttaagtccctgatctaaacaccacctaaaaccattcttcttttgccaatcttgtgatcagggatacaggtgcaacaggtggatcaggagcacacatatggaggtggtgtggaagtttggactgatatgcagcagtgtgatcatgatgagtgtgatgtcccttgctgcagctgccactccccaaagcctagaaaggagccactgcttcacctccaactgaaaaggtcattgccctttatttggagcaatcagtttatgctctgtcaatctatgagccatcagtcacatcatgagcaattcttatcacgaataatgtcaacagtttaaaaccatcattttgcattcactttaccctctaattcaaatattcaattagattgtgtttagttcctaaaattagggagaagtttgaggaaagttgatagtttggaaaaaaaagttaggagtttatgtgagtagaaaaattttagatgtgatgtgatgtgatgtgatggaaagttaagtttggggaaagtttggtgtgaattaaactatcacatcgaatgtttgaacacttgcatgaagtattaaatataggctaaaaatataactaattacacagattgcgactaatttacgagatgaatcttttaagcctagttgctccatgatttaacaatgtggtgctacagtaaacatttgctaatgacaagttatttaggcttaataaattcgtctcgcggtttactgacggattctataattagtttttttaccagtgcccaaataccccatgcgagaccctatataatacccgatgtgatacgccaaaactttacacccctagatgtaaacaccccctaaatatctaactatatacgttgttagaagttgattttttataggatgcaacatcttgaggcatcccatcaatatttctagataagtgaaaaacttgaaaaaaaaaaggctactagtaataagcaaagggatgtcttacttgtatccatttgtgtagccacaaattcttgtattattttagaatggacatagtaatacttacttgatgtggggcctgttcagatttatgtcattttaactcatatcattatttgataaaattgacaactgtgtgacaaaatttagtttgttataaaatatttgtcatgcctagataattgactacattatattagcctatcctactaaatcttggtaattaatgtttctaacttgttgaaattttggcaatgataaattttggaaagattgaaaatgactataaagtgaacaaagccgtgatgtttgcatggctataacaagcaattcgtattatatccacgggtatgttttgagaagaatatagtggtactagttcttttattagaatgttttgacaaactttgttctgttataggagcatttatagttgtggaccccattagtacaatttaaaataactagaaaccttaaaacacaatgattatttagatggagcttaaaattcatagatacagctgatgaaaatatgagaagggcttagttttttagcttatagattctagtgcattttgtagatcttgtagctattggttactcagaatctgagtatctatactgtttggaaagatataggtttttataagacaaattacaactgtcagaagcctctcaaacagggcctaacgtattattgttttattgaacgagcttcttatattcttcttttcctttggtgaattttacataactaaaatgcactaggtattatagaacttcttgacaccctagaatatgtccaccaatctaatttaaagcatcaagattttctttttgagaattatgtcgtcagatttgttatttgaagtacttccacatatactactatatcccaatacaaattaagttgcagaaagtaatggacaaagtggcatctcaaacaccatagaaagttaaaaacatctcgaacacacaaagtcagtcacactgaaactagatctgcatgcatagttagccccatttgtcactagtgcgacactagttttgcacgctggcacgctgcacacacgcatgcatgtttcccatttctattccctttttcctctatctctctctctctcctgcagcagtggcatgaatattgacgaaccaggcacgcgcgcacgcattgccgcgcccaatgtacgcagctgcagggacgacgccgcagcatctgcgacggagacgcgacgacgacgtggtgggaggccggaggaggtagacgacgacgcgaacgcgagcacgagccccagaattagccagctgcagctgctgcgtctcagaggccatggaatacgtgagagcgacatgtcaccgtcgacgagcctgcagtgctactatgtacgcagccagaggacgacgacgatgccgccgggcgctgctgctgcagcagccggcggcgatggcggatcacagtgctacgccgcacctcggtacagctcttcctccaagctgaaattcttggggttcgtggtgacatcggggcctcctcctcctcgtcttcctcctcctgctgcctgctgctgcggcagcgatgacaacatcccttttcaggtactccggcctcctcatatcctactcccagtaatagtactagtagtagtctttctcggctatccatggatgtgattcactagtgatcgatcagagattcagagggacaaatcgtatggatggatggattggatcatcaatccactactctgtctcagtctgtccaaacacagtagctagcccgttcccctgcaaattaaagtgtttgtgtgcgtcgacgttcgtgcagtgcatacatgcagccatgcacaaacccatggtgaattggtgatgcatggtagtgcctttttcttttctttttttttcatgtctagtctctgcagctttgcgacacataaaacattcacagtagcttgcttccctccaatcactccaaaaagtcacaaaagctcgaagtgaacagccggatagtccctacctttccctttttgtcgtaaggaaaaaaaaatcaacagtaaaagttcactttaaccgctgattaattaccacgtggcgctgttcatgcaggtcggcacgtttgccccacaccgcgtcgcgccgccaacggcgagctgcggcggcggcgcgccgcgnngnnnnncnnnnnnnnncnccncnncnnnnnnctccnncccncnnnccncccccccccccccccccccccccccccccccccccncccccccccccccccccccccccccnccccccccccccccctcccccccccccccccccccccccccccccccccccccccccccccccccccccccccccccccccccccccccccccccccccccccccccccccccccccccccccccccccccccccccccccccccccccccccccccccccccccccccccccccccccncccccccnccccccccccccccccccccccccccccccccccccccccccccccccccccccccccccccccccccccccccccccccccccccccccccgcccgccccccgccccccccccccccccccccgccccccccccccccccccccccccccccccccccccccccccgccccccgcccccccccccccccccgccggcccgggcgcgcgcccggcgcgccccggccccgccgccgccgggcgcnccgcccgcggccccgccccaagncgccccgccgcccgngngnnggcgagnnggnccnncgnngcnagcnnnnactcnnaatcccttatatttatggatggagggagtaggagtattaacctaaagattacatattgatgccgataacctactcattttacttccgatgtatcatggtatgagacatacattggtagttatggtggctaaatgataaaattatatgtcaatataaaaaggtaaaattattctaggttatatatgaaggaaatactggactgacaggccacatgcacagtagcacaattaccacacttgtcaagaagggggatccactagt

SEQ ID NO: 68695 - DNA, 15356 bp, Oryza sativa
  unsure (1)..(15356): unsure at all n locations
gcgagcaacaacggcgtggcgccggacggcgagcacgacgacggctgctcgctctcgctctcgctggcgttggacacgggatgcgccggcgccggcggcagcctggtctcgtcgacgacgtcgtcgtcgtcgggaagccggatcagcctcgacttgtcgctctccacgcttgactcgtagagcgtgcgtgcgtgcgtggcagcgtgagatgtttgggcctttgtgggctttgtgggccgttttgtcgcctgattttgatgtagttttaggcccaacaaggcagctcatatatgggcctcttattcaggcagctcatatagtttttctcttgggccgcgagctgctttcacatatgggcctcttattcagattagctattcaccaatcctggagaaagcacgaatctcgatgccccgaatttctgcacctcatgcggttatacgtacagagatcaggcagaaatttccccgcaaaaaaaaaaaaagagatcaggcagaaataacacaccttaactttcttcaatggaagcaaccaaggcaccaagcaacagcttagcctttttgaagtggcaaattcaagcttcagtaccgtaggtctgtggctagcttttatgagcccaaatttagtgggcatgttcttctccattctcttcatgtgtactgtaaatacaggggaaatttgtaccaggttcaaggttgtacgtttctcttctgttgaaatggagtagtagcatgcatgaattgtcagcttctacacggacatatgtcacagtgcttcacgcggattgaacagtaaagtgcagacaaaatcaaactaagctcattggtgcacatgggcaacaaatgcagtataaagcctaacccaagttacctttttgtagtaggagtatatctgagaaaaagtcatgcagttggtacttttacggcgtctacaactacaagccagttcaggaatacatgtagttgatctgaactttagacagaattgcaacaatcggtgtcaccaccagataaagtaatctgaattcagatcgactagcttgcttcccgaacatgttgagcaatatttgctcttcgtcagaggcactaaaagcccacagtttagtcgtacaacattggctcaacaagggaaaacgaaggttcaaaacttagaacttcacacggcgggcggctagtggcggagctcctaatttcattcttaccctgaaagtaatctagctcccagataggaaaaagcaaaaaacaagtggaagtaaatgcgacggaaatttgggggggatttggttccgtttgacggtttcggaagccccggtccatgttttggttggagcaatttgatcaccgcgccacgctgttccggatgaccgaccgaaccagtggaaggaattccaccgtgacagactcgatcgatcgggcgcgattttttttccgggaaatccaagccatccatgcctacaaatacgcgcgaaacggccattgggtcgcgcacgctggagccgccgcgagccattccccccgcgaacacgttaaaacccttttccggtggccggtgtaacgcgcgcatacgtctgatctcgcatggccacggcggatgaggtcggcggcggcggcggcggtggtggcgccggagttggagcgggcgatcaggtgaggagggcgaagacggcggcgctgttcctggcggccgtcgcgctcccgtgcctcgtgctgtaccgcgccgccgtgtcgccggcggggctgttcctccggccggccgccctgccggcgccgccgcgcggcgacgtcgacccggtggtgagttgttcgcccgccttcttcctctaggatgatcaaggtgtgtatacgtaaacgatgaacacgtctgtcagtcacgtacggctgaactgaaggctgtttttgttggcaaaaattatttttctttaatcagcttgtgattcatgttcatgatcaccagaaaatgcaggaacacctctttgcatctcattgattttttttttgggtgcaaaaatggtggacggttaaaattcctcattgttagcagtagtaaatagttaaatactccactgtagaggaagaatagtaaaactgatgagagcgatggtgaattcgggagatccaccaatttgagataagatcagtgccttcgcaaattgcaaattgttttttttcgcgaacgcttttatttccgcgaacgcgcaaattgttttcaaatggtaaggctttagtctaaactgtaaattatgttgacaatgtgagtgctgttaacctcctcatttggcttctttctagaaacactattattcaattgcaacgtgccagaaatttgctcccaggttagtatgtaattcaaccctgtgatgcatgcacccgagaattcactcccagaaatgaaattttactcgtcctgtagcaggcctacagcgtttgattggccacggcacttaaaaacttttttttgacagtcgacatccatgccaaaatgccagattactggcatggttggcattcttagaaagcaacatgaaaaactgtctgccaatcaaattaacagactagtacatctcttctattggcaaaggcatcttttgaaatagaggattttttaaagagaatttcacgggaattggactgattcatgtgaaaatccggcaaacttcattcatttcaaactagtcgtaaaaaacacaggaatggtagttacatttgaacatctatttttttttcttaaaaaaacctgccacaatagtaacagcacactattcatctgaaatttttttatttatatttctcttaaactaaggcagcgttcgagagggtgagagagtgagtttgtttgtttcgttttctgcgcgcacgtttcccaaactactaaacagttatgggtgagggcaagggcaccaaggctttgcgctcagcctcgagcgccgtcatccgagcctgcagagaggcgttagcctctgacgcccgccgctcttgggcggcagctgcgtcgaggatgccgcgcgcgtcctggatcctcctctccaggtcctcggcatgagcctcatattggaggcagatgtcgcccagcgcctcgtccaggacgctcgaggcgatcagtgccgcctgccgctcctcctccgtatcccgcatgagggagtccaggacctcctcgcgcgcctggatttcggctagttgggcttggcgcattttgcgctccaccctcaccatgtcatccacggcgcgtcgctcctcttcgacccgcgcgcggtccgcggcgagctaggcccactctgcatccaggcctaatttttctataatcaacatgttctcttttttgcgttttttgtaaaaattttctataggaaaattgctttaaaaaatcatattaatccatttttgaaatttaaaatagttaatactcaattaatcataagctaatagctcatctcgttttgcgtatcttcccaatctcctcaatccccttctcctcaaacacaccttaagttgagtttagatttaagatttgtgagagtgtatttcatatctacgcatatctctagtagttttttcataaatttacaaaatttttagatatgattttcatgagttttcacatttagcttgttttcaccaaatatgtcttctttttatacaccatatttccggcaggtaacagttaatcaatgtgacatatatgaggttgtgcttgtgcacgcagaacagtgaggacgcgaggctggaacgcgtcctgagggcggcggcgatggcgaacggcacggtgatcctgacgacgctgaactcggcgtgggcggagcccgggtcggtggtggacgtcttcctcgagagcttccggatcggcgacgaaacgaggtggctcctcgaccacctcgtcatggtctccctcgacctcacggcgcaccgccgctgcctgcagatccaccgccactgcttcgccctcaccaccgacgatggcttcgacttctccggcgagaagaacttcatgaccgacggctacctcaagatgatgtggcgacgcatcgatttcctcggccacgttcttgccaagggctacagcttcatcttcacggtaaaaagagaagaaaaacaataaaacttaattttaaaattgattttaaggttttcatgtagtttatttttatatggttatgaacatagatataaaagttttatctatatattatattttttatcacttataagttgtgttccttatgatccatagtaagcaattgtaagcgaaacaatggcttttctaatcaaatcttttgctcaaagaacatactattctttttgttcaaagtctgaactttgtgaaggtttgtttcgtcaggacacggacatcgtgtggttcaggaacccgctgccgcacctgcaccacgacggcgacttccagatcgcctgcgaccacttcaccggcgacccggacgacctcagcaacagccccaacggcgggttcgcgtacgtgcgctcgacctcggcgacggcggcgttctaccggtactggtacgcggcgagggagaggcacccgggtctccacgaccaggacgtgctcaacctcatcaagcgcgacgcctacgtcgcccgcctcggcgtcaggatcaggttcctcagcaccgacctcttcgccggcctctgcgagcacggccggaatctgagcacggtgtgcaccatgcacgccaactgctgcgtcggcctccgccggaaggtcgacgacctcgggctcatgctccaggactggaggaggttcatggcgacgcccgggagtgaccggcattctgtcactggagtgtgcctnggnnttgccggtgnttgnttttccgngnngnngctgttcgcgctttgtgatttgattagttgcatgttttgttctgattagttctcttgttcttgtgatgatntgtcttntgcagtatgaagaaactggggcggtaggagattggaaagattaattgtttaattgcaatgtgttagtttagagccaacacttgctgttgtctgtaccatagatgagatgctgactggaacaaatgaacatgcaggtaattgtcgttgacaatactactcttcttgattagtgctttctaagttgggaagtgacagtacaaatttagtcaaggtatacagcttaattaactgtagaaaaccctcttttttaatacattttttccacgctctgtagttctttcgcatctaatccccgatctgaacaattgaccaaataatgtgttactgatagctttgagataacttcaagctcatagatacattttgtagcggcatttctctgaaacatgaattttacaacggcatacgcccaaatttccaacgaaaaacagtgtccatttcgttgtcctgaatccactgcaatggcattcgagctcatggagctcgcacggccgcattgtcatgacatacctgtagacagaattagtgaaatggatatgaattcagacctggagcagaatgaccgaaatgttgagagtttggtgcaataacagaaaagtttctcctaccgctgctgatgctgatgccatggacgattaaacccataatataaactctgcaaacttccacagaacagcctagcagcaggaatggaagaggcaagcacaggagagagaggcaaaagtgaagtccagcttcaaactgaatctcctgctcctctgcatgccccttccactgctgctgctacagccaaaaaaccagacctaacataacacctacctatcccaaaccaaattttgctgtggctgctgctgatgcatccattggtgaagggtggcatatttgtaccccggccatggtgcactggtagtagtacaagttagctgcagtacatatgggggggagatcgttaggggcggcttgtacttcaggcttgcaaatatcatcagtgtactatggctttcagctgtactcttgtactgcagaagcgttggagcaaacgctctaacggcgacgggtaagccacagatccgttgaggaggtcgtgtcgtgtgcgccacaggcttcactttcagtgaccccgtcgccgttgtcttaatgcaggaagaggttccttttcttctcacttcgcttgtgtgattgagttgctactagtactacctatcagtgattaatcatccaatccataattttgacaagggtccagtctgtcatgtgacgtaggatcgatttatatcgcatcagatctccaacaagttgaacgccacgacatgtatgctgtactagtatcgtctgatgtactccatgccaatatgtgaagtactactccgcaattttgaaaaaaaaattgtcgcgaatgatagtacagattaaaatgttaaatactctcgttttttaatacataccattgttcgtcttattagaatatttttacgaaatgcataaaatataaatcatgtttaaagtactttcaataaaaaaaactcacaacaaaataaataataattaatttattttttaaaaattaagataatatatgttcaaaagtcaatgctgtcatgtatttataaaagtgggtttagtaagatacaataaatgtgagcattacagaaaactctcccatcatcccatccgtccatgtggtaaccggtggactatggaactatagaaaagcatcgggctgtgcgcagcgcgtccctctatgcgattgagccagagcaggttcgcacttacggcaccgagggtctatttgaggagcttaaaattctgagaaataactaattggttgtaaactttcgagaatctgaaaaaaaaagttgggttttttttctaccttatggcttctaatttatggcctgttcactttaataacaaaaaaaaacattaccaaattttggcattgccaaaattttggtatagttgtcaaatttttggcaggattttttacatagttatcaaattttgacagcaaattaaatgtagcctttttttttgacaactttaccaaaatttagtaatgttgaaaatgtcatcaaagtgaacaggcccttaaattacacaactataactttgtagaataaaaaattaaactgataagagaatatctgattttggctgacataagcttccccagcagagaccaagtctgatggtaaaagcggtgcctctccgtgccgcctgtggaagctgtatgcgtgatgcggacaacaaaacaaccacttcattcgtcctaaaatataatagcttatgatcggataagatacatcgtaatactataagtctagatagagatatgtctagatttatagtattgtgatatgtagtatctaataataggtttttatattttgaaacggaattagtaagatccgagacgcgcgcaaatagaccttccgtggatagacgtgacgtacagcatccttgtattgcttgatttgctacacgtgctatttttttcgccgggccggtctatgacagtttgagatgatatgggctgccgaaattcgaaacctcatgacttcagacttcagaattcggacaaaacagacgcatgtggcacaaacacacagacagaagaaagtaaaacaagactcgaaaagaaaaaaatcctgaagtctgtaccaaagttcagtattacacctcacagaaaatggcccgtgtctgcagctgtgtttcttcttcgacagtcatgcgttcctctgtcgaaggggaacaacgtacgggcagccaatccgagcacagtatatatagtatagcagttctgcccggggacagtcaatgtgtgtgcttcgttacattataggagtatatatttctgcacctacgcgagcccgtacttggacagtggtcttagttttcgtacactttgcactcgtcggtctccgggttgtccttgcagaagtcctccagtgggtcgccgctgccctgcaccgccgcgccgggccacttgctcgccaccagatgcgccagatcgaccacgcgttggctgcacaaaaccgcacacgaatacacgatcgatcagacgccgagcaatgcaattgcaacgcacgcagtaacatgtgttgtttgtttgcattgctgattgctctcacctgtagccccactcgttgtcgtaccaggcgaccaccttgaccatgtcgtcgcccatgaccatggtgagcgaggcgtcgatggtggaggagacgtcggagcagcggaagtcgacggacaccagcggcacgtcgcagacgtcgaggatgccgctgagtggccccgccgcggccttgcggaacgcggcgttcacgtcgtcggcggtgatgccggtcttcacggtgttgatcaccaggtccaccacggacacgttcggggtcggcacgcgcagcgcgatgccgttgagcttccccttcagctgcgggagcaccagcgccacggccttcgcggcgccggtgctcgtcggcacgatgttcagcgccgccgcccgggccctcctcaggtcacggtgcgacgcgtccagcaacctctgtgttagtcaatcatcaaacacagcacacgcagaatgtatcagcctctgcacgtacgaaatgctgcagcgatcatcgatcaatcaatttactcgttttgatcagaaaaccgaccgacctggtcgccggtgtaggagtgagttgtggtcatggttccctttacgattcctgcacatgcgtcacaacacagtcaggaaacacatgttgccatacgtattgtgcttcaggttaaggcgagcgattaaagttcttaccgaactcttcgtccaagatcttgacgaacggagcgaggcagttggttgtgcaggaagcattgctgcaacacaagaaacagagttcttatgcatgttgcagagtttgatatgcatatatattgaagtggtggtgtttgcttttgcttacctgataatgttggccacttcgtgggagtagtctccctcgttgacaccgaggacgtaggtagggatgtcagcacccttcgccggagcagtgatgatgaccttcttcgcgccggcctggatgtgcttcccggcgccggggccgtcgacgaacactccggtacccttcatgacacacacagcaatgcagcattgtcagttctgttccctgcagattgagttcacagtcaattgtcgatttgtgtacctcgatgacaatgtcgatgccgagctcagcccatggcagcttgagggggtccctgttggagacgaccttgatcagcttgccgtcgacgctgatggtctggtcgtcgacgatcttgacgtcggccttgaaggtgccgagcatcgagtcgtacttgagaaggtgtgatgcctgaaataattaacacacgcagagaacaaaattatatcggaatcagtcattgattagtctgtgcttgattacgttcaggacaagcttttctgaaggatgagtacttgtacttacgttcctgacgcctccgctgtcgttgacgacgacgacctcgagcggggagttctcgcgttcgtgccagcaccggaggaagttgcggccaatgcggccgaagccgttgatggcaaccttgagcttcgcctcagccggcgccctcacggcgttctctccggtagcctgccacaggttgaacaattcattcaggacttgcgcttacagtcagaatacacgtctgtacaatacatgatattgtggttggcgaggcatccaaaaacgataacttgaccaacttgtcattatagtcttgagtgcatgatactggaacatttatctacctagtactgtaatacacgcacggaatattagtaactaggataatgtcctatgcaatttttgaccgtttgaagttgtggtttgtcccaatatagctcatgtcttattttctatttcatctattccaaaatataagatattttcgattcagattcatgtactagagattgatggagtaagtataaaaactcattggttgtgtccaacataagagactagagatgtaaatcatgtgtgatctaccagcaaagataaagtttcatccatctagtgaagaagcacgcaacatgtcgctgttatttcacaaaaacggctattaataaggtgattattttgtcttatctacacacgctgtgagcgtttgcgtttatactacattttttgttttttaaaaagaacccaactattgaatttccagaagtttgtaacatataatagcagtataaatacttttgctaaaaaaaaaacaagtaacgaaaactctgtatttatttatgtacaacgattactactgttttccatagccaaaagggaccatcttacgttactcatcaggttaaactgtagtcatactaacgtgcgtggtaaattctacagtttgttatctgaaatactgaattgtgcacaggtaaaaggaaaaacagaaagctacagatcaatttgttagctaagctaagcacaggcacgtaccctggcgacgagctgcgagccaaggacatcggagaaggacgcctccctcgcggcgtggctgatggagcacgatcccggcctcagtccggagaagtcggcgaagtccaccctctgcaaccgcacatttcatcagatcacccgtagcttcacacgcaaagccggataataccacaagatcacgcacgcgcgcacctgcttggacgccgccttgctgtgcagccgggcggtggccggaatgcgggacgccgcgagcgctgcgtgtgtggccatggctcgtcgctgccgcctgtatgcttcttccttccttagctcgctcggctggatggatcgaggcggccggatgcgcgcgtatatgtacttggcgcggagggcgcggcgatcaccgctggggctttgtggcgtggagaccggggataaggcgattgcacgcgcgcgcagccacccgttgcgcggaaggcgatatccgtgtgtgtgactctggtggcctcgtaggtgaaacacaaatatctctctgcagtgcgcgcccgcgcgcgctcccgtcgttgtctccgctgctttgtttctcgtcgccgtgtgcctgcgcgcttgctgtcaccgtgtcagcctgtagtttaaactggtgagacgtgagagcctggctgcgtggggctcattttttttttcgccatttctgtttggattaggatactgacatactgttattctttttgtgtgctctgtgtggttcatggttttatggccatcggtgtagcttgtatgcatatatcttttctttgataaaagaagatcactggacaggcaaaatggggtgtaccttatatgggcatttcaacagaaaaatggaagccaccaaaactgaacatgagataaatttgtccctgccaaaattgagcagtgccatttataattccaaaattttcaaaaaatttaagaagggagaaggtttgagtcagcggtcaaaccgaactaccaaagccacatcgaatgggctcaaagcccaaacactggctagcccaccacttaacacggcccacggcactgaacctatcaaaacctctcttctctctctccaccgccgccgccggtctgcgccgtctcactcacgctcagggccgccgcgacgccgtgtccctctccgccgccgccgccgccgccgccgctagcctgcgacgcccgacctcgccgacatgttgcagagcaagaccttcgtgaagaagacgagggcaggccgcgtccagaaggtaactactcggcagcagcatcaccctgcgcgcggcgaaggtgcccccaaaccctagctaacccggagttcccccattcccgcaggtggtcagggagcactacctccgcgacgacatctcctgcggcgccgcctcctgctccacctgtggcgcggtcgagcacccgctctccgccgacgcggccgccatcctcgtcgtcgacaccaacgtcgtgctccaccaggttggcctttcccctcctgttgcctgtagggagtagagctagggattccggaggctgatgttctgagagcttgctgcagatcgatttgctggagaatccagcgattgacgatgttgtcctactatcggttgtgttggatgaggtgaagaataaaaacctcgcagtgttcaacaggatcaaggccctgtgttctaacaaggcaaggaggttcttcgtgttcaccaatgagcaccacaggtgtgcattcgataccttaggatttgctcgatggctattatgatttgttatgtgaatccagtatacagttgctcagttcttatctgaaccaaaacatgtttaaatttatggttaacagaatggggtagagaaaccacctaggttgttaaagaagtatattttagttgctagtactagggagaagatttatctaaaagctctaccctgcatctgatgttccacaacatttcctttttaacagactcagatttatgttgggctaatttgattttgggatttcctaaatccctcttcaaatgtttcttctccaaacagcatatctttggtgtgcatgacagtcggacctcaattttagcactatctgcctgattatatttgcaaaagtctctctatgcatgcactgttgcacatctacactctgcaattttttttaaaatattcttgtcagcaagcttgtatagaccaacagaatttgcaaatttctcgtgataaattatctcttgcaagtacatgtccgtccttatgtttgcgaatttctttaaacacgaagaaaatgagtgcacttccagttccttatgtggtcttcttggtttaaaattacaccattctcttccaaaaaaaacagggatacatatgtcaaagagatggttggagagagcccgaatgatcgcaacgatagaggtactgtaccaaataattctgttagcttgctttatctcatattttgcactactcgaagtacttttgtgtattcttttctcttgattggtcattcatattcagctattcgtgtggctactcgttggtaccaaagtcatcttggtgagaatgtgaaagttttgctgatcacaaatgatagagataacaaacggaaagctattgaagaaggcattaatgctgagacaggtgaaattatggatgttacaaaaatgttagctggatcttttcaaatattggacacattattttttctggtaatcacaacacaatatttctggttccagtggaatcatatgtacgatctcttgcacagcctggtttgctcgatttagtggttgtttcaactagtggagatgtcacaatggaagatgtagaagatcttagaccgtccaaaaagaaagtaatttacagtgaggtacagtaaatttaaactgttgacttgtgcttgttttattggcgttggccatctagtatcaaatacgaatatgtaatttcttgctatcattgcagcacaaacctatgtcagaaattacagctggcctgcggtgtggaatttatcatcaagggaagctccgagttaatcgttacaatccatttgaagcttacgttggaagtgagagcattggtgatgagattgttattcatggccgttcaaacatgaatagggcttttgatggagacatagttgctgttgagctcttgccacaagatcaatggcatgaatcgaagtcatttattgcagacgacgatggtacgttcttcagattccagcacatgatttttcccttacattgatggatgtttctgttctttcagaagatgatgaagaagacgtccatttggctccaaatagtgctgatgatgctccacggaaagccaatcccacacaatcaacagctgcatcatcagctgattctgtctctagtcgcccagttggacgtgttgttggtataatcaagcgaaattggaattcgtaagtcttttataagatagggatatgtttttgtaattacaatatatactcctgatttggaaataacctgaagagatgcatagtttatgaatcttgtttgtatacatattagacggatgcaaattttttgggctcaaggttttattcacccattatgaagttatgatctatacgtttcaacaaaaaaatgtccaaaattttgtatgtgtgaactgctaaaccgtccaaaatttcaacaactaaattgtccaaagctgtccaaaccataacttgcgtgcatttttatatttcaacgtgttaatagtacctaatagttttaaaaatatttcctccctgctatttcatgcatgcgttgtttatccatttttcaccggttagaatatggattgttttctgtgcttagattgtcatctaccaaaactattcagtctataattgcaatttaccttaactgttttatgtgcttcacattcatacaatgcctgcaaacggcaggtattgtgggtccttggagccaatgcccatgcctgctggtagtggaggcgttgctcatgctctatttgtgtctaaagatcgacgaatcccaaagattcgaattcaaactagacagcttggcaatcttctggacaaaaggattattgttgcagttgattcatgggatgtcttgtctcgatacccatcaggacattatgtacggactataggagatattggtgacaaagatactgaaacagaggcaagtcttacaattttacagctgcatttcacactttgtgttgcaacatttacttttactatgtaggagcatgcactgatgctaatgtgctaagtgatatttgtgcgtggaacaggttgtcttaatagagaatgatatcaacacaagacctttctctacacaagtccttgcttgtttgccaccattgccatggacattatcacctgaagatcttgctaatcctaatagacaagatttacgccatgtgagagtctttagtgtggatccgcctggtaaataaatcactgtcatgcattctatttatatttctgtagttggattgaattcttatggttcaactgctgtttaggttgtagggatattgatgatgcgctacattgcacgccactcccaaatgggaattttgaagttggagttcgtatcctttactgatttattttttatttgcagaattcaaaattggaatgctaatttaatcttaagggcacttacactttgagatggttctcaacctgtccactttcttctagtttattgctttattttggcttcatttcatcagattgtcagtatgcactgttccatccacctagattgagtatcacataagtttggatctgtagttacagatggaagtagcaaatatgcaaagcatgcaattttgttaaatgtatgtatcatatatatctacacaggcactaatcagaagaagtgtaactctatgctggttgttcgtattaattctatctggtctgtgcttagagcaattaaactcctcgaggaatttaacacatcaaggacataaagtttaagttagttacttttcattattaaaggtcattcaa

SEQ ID NO: 68696 - DNA, 1441 bp, Oryza sativa
  unsure (1)..(1441): unsure at all n locations
taaaatgcgacatatacctggtttgaaaacacggatagaccaaaatctattgcctttattgacagatcatcatctttatccaaaaggaggaaattttctggcttaagatcacggtgcatcaccccgagcgaatggcacatagccacaatgctgacaattattcttataagctctgcagccttccgctcgctgtaatgccccttctcctgaatcctgtcaaagagctccccaccagcgcagagctccatcacaatgtgcaccgcttgcccatcctcatagacatccttgattgcaacaacattcttgtggcccgacaaatggtgcattatctgaatctcacggcgcacatcttctacatcctccttggtgatgagcttgcgctttgggatggtcttgcaagcatactcacaccctgtattgatctcggtacagaggtaagttgtgccaaactggccctgaccaagcttccgaccaatgatataatgctcccttaggtccgctgtcttccgcccaaggacattgatagatgtaggatccaacccccgcctgagaatactagcagcagtaggcttgaagttgttcacctcaggccaagtatcatcgaacttcttcaagtccaagtagctatccccctgaacgtacccaacggcatgctcccttgggaacagattgtggtaatcactcccaagagtcccgttctggcactgattccccattccaagaactncttatgcaaaccaattccaaagttcctagcctcaaaacaattgtatccttcccaggatgcagatttccacttatatagccgcaccgctacgcgcaaacccgtccaattggaagagttcctcgctaaggcagcccttgcttggcttcctgggcgtgaggaaatccccaacctgacatttttcacaacaaagacttgatcagcaacccatacttgttactacacggcaagggaaaacagcggaaagttttaaacttagccaaggtgaggaagtggaaacctctgggatggcaagaaattccttccaagggcggctcctttggtcgtccaccggaaggaggaaatctccggcctgaggggcttccaccaccagacttgaccaccaaaaccacacaaactttttgctctccactacacgaaatctactagaacccgccctaaaatacgagatttcccagcttcttctcgagccaggcgagcaacaaacaccgaaaccctcagaactggaagagttcctcccaaaggcagctcctccaaaaagcttcctccggcaggaaatccccaatctgagggtttctaatgctaagatccaagctccgcagccaggaacaagcaaatccagccacaaatcgatcccagacaaaaagccgaaacacgcgagaaacgcctangcggtcacccacaagccaaatctatgccaaaaaacacgaaatctgc

SEQ ID NO: 68697 - DNA, 13507 bp, Oryza sativa
  unsure (1)..(13507): unsure at all n locations
cgcgccttttatagcacggggacgcctctggttaggtgcgactcggacagtttttttgcggctgggcccccggattcctggagtattacacaccgacagaaaaccacccctggtttcttggttggtggtgtctcgcagcagaagcggtttggggattgagagacgatggatttattcagtcaaaaacgatttgcattggcttggcttctagctggagctgctgtttatatatactccctacgttccaaaatataaacatttttagacttcggctagtctccaaaatactactttgagtaataatatctataaaagtaaaatattttaaataaaaatagttgcatattataatagtttgtttaatgataaatctaataacattaattttatatgattaatcttttttatatttttgctattaatagttaaagttaaaaatatttgatttgtcactatgctaaaaatacttatattttgggacggatgggtacatatactccgagtccgatccaaattcagttcagactaattcactgacagctacagatactagttttgtaatactactagtaaatgatttcggtttgtttatcctgtacaaatcgaagttagactgtctttcctcggcaggggattagttgggttaattttaggtgttgtctgattggtcagagttcagctggttgtgtaatgtgtatgaaattctgtggaacgttttgaaatataaatttcgtaaacatggggagagccaagagctgcaagcatattctcttctgcaaattcgaatatggtacttccagaaaaaaggataaagttcagaaaatttggtaaaagaatcattagctttgaagataatgttccccatttatactaaaaaaatattaatatgtactggaattacagatgtcgtcgaccagaatatcgagtaaggttgcgacgcaattatcatatctcttcaggattagattctaattagcactaaccctaaggtgtaacatggaaacatatcctctcagcttcccagcaatgcaaatacagtagcaaggccttacctaataagaccaagaaacaaaagggaaatggagccccattggaagccagcccagacacagacagggacgccctaccattgcagggggcacacatgtcatgctgaatttctcatgaggctaggtttctgaagaaaccgctgttgcgtcttcagaaatcaacctgcctgctgcggggtcggtgccgttctgtgcttagaaacttggagtgccttcgcctaaaacgcaataagaaaaggcagaaagcctttgacctgaagccttctcagccacatgaaaattagcaacagtttaatctgctttcttgcgatgggtttattatttggccggtgtcgtgtgcttcaaacagggttaagtggtgagtcagagccacatggtttgattgcataggacacatccccatggaaaattaggtggggctggttatctgtagaagacactgaatttcaggttagagcaaagatcagatactactagaagtctgaaggtttttcaggttcagataagaatggattttgtttctgatgaaattcagagggtctaagcggcaggccatgacccatatgagtcgcaaagagctactcctttagaagcaggagaatgtaacgtgagcttataataagattgattactccttgccacttttgaaggttctcagtggaagcttttgctcttgtggctagtgctgtatgattgcatgggcgacaatcgtatctacaatgacgcaaatgtttatcttctgctacggaatggagattaactcccagcataaatgagtagtgaattattgcaccgaaataattagagacgcttttctttggttgattacaaccatcgcaatttcaactatgccactctgacaacaacacagctcgattatgacactgtcactaccatatatccaggtggaggaaacgagcagagtaggaggaagtgttcagataatagatcatgcaggacttggtaatgatacaattagtatatgatcaatcatcgcaaggaggagttaatactgtcacattcgatcattacattattggcctcttgccgatgaccttttaaatctgaattttgaannnnnnnnnnnnnnnnnnnnnnnnnnnnnnngcatcgacccaatccaattccagacctatcgcagcatgtgtgcatcggttgatgaaagccaaaagcaaccatactaatcaagcactgacagtgcaatgcctgctcaataattttaggataatactacatactgttaccactttactaccaattgctcgagaagttgaaatgcttttactgcgtggcacgatcgagaaaacgagaggttcggtcagctcgtcgccgtttgcaaggttctgctcgatcgatctgtcggttctgacgaacagtgtcgatctccccagccatgcttactgactaaataatgcagcgagttaattactcgtctcggtcagtaactcaaattatgcagtgaattatatgtagccgtcgtggtcagagcgatcagatcagcagttgctgtgttgctagccttgccaagctagcaatcaccatctgttgaaaaggaaggagcaattgacaagtcgctcttgaagccacagtgaccgcgagctcaaaagccttgagaagccagcgtttcaaactctctccgattacgtaatttctgaaataaccacgagtatattgggtgcagaattcagatgataggtgaaagtggatatcaggagcaaacaattggtccaacaaaaaagtgcaatgcgtgatcgatgttgaaagcttggaactttgaaagacgtatacgtaggtgatgacttgttggcggcaaatacaaatagtaccttggaaatttaggatctagacggttaattatgcatgcgttgaaattggaaaggtatgcctggaacttaaagttagttttatccacagagatgcttccctcactatgtctcatatgatattacttattccattgatctagaatcttttatccgtggaagaaatatcaaccgttattcgcttgaaagctgaaacacctggaatctcctcctttgttttttgttacgaaaggaaccaagctagaagccttttcacttttcagtatatagataactacgcccggatagttattcgcgatgaataaaataaataaatgataggcaactaaactccatttccatccttataccattatgatgagttcgtttcttcatggtctcaacctccactccatcattttccacacacacatataaaactactatacgatgtgttcttttttaaaaaaaattgctttaaaaattatattattattttagctaatacttcatgtgttttatattataagtcgctttgactttttctaagtcaagcttcttaaaagtttaaacaagtttatatgaaaaatatagcaacacttataacaccaaattaatttacatataacattgaggtttctttattttgtgttggaaatattgctaaacttttttataaacttggtcaaacctaaagacgcttgacttagaaaaaataaaacgacttatataagaaacggacgtagtaattaattaataatgtactaatttatctctgcgtgaaaaattatttcccaacccacactaaaaacatagccttaatggagatctcctctgatgatgagtaggggcaagaaaaaacacggccttgacgaagatctcttctctgatgataaacatggggagacaagctagcctaaagtagctagggctcgagcccctaaattcctattatatcatctcaaaatttagtagaaattttgaatatatatgacacatgagcaactttagctctattttaaagatttttttctagtccaaagtgaaaagatcacgtacaggatggtacaaagtgaaactttggcaataaaacatggcccaaagtacaattcactaaaaaaatgatattgatggaaggggtatacactccctccatccagatcccttttttttctttacctttttatcaagattgaagttagacaattacaattgtgactgtcaatataactattaaaatatttatgttgaaatcaccaaaacacgacatatggattaattaatatttaaaagtattttagtaaaagtaaatatttacttgtttttatatatctctattactttaaaaagagagtcgacctccttcacctccgcataaaaatctatttccttccatgaaaaccgcccaccttgaaaaactgatttctaataaaatcatgagataattcaagaaatgccattgacaagcgtacaagtcccagaaatgtcattgacaagtctgagttccaagaaataccatcgttcaaacgattttgtcctaaaaataccatcgttgttagggttccgtccattttgcaccgttaaatacactattcatcctatagaacttaacggcgggaatggacggaaccttaacggcgatggcatatttggaacaaagtcgtttgtacgatggcttttcttagaatttacatttgtcggtggcatttttaggatttagacgtttgtcaatggtatttcttggattatctttaaaatcattataaaaaatcgaacaacccagtgaaccaaattcctcctgctaaactcaacaaaagaaccgttgcaacacacgaacctataactaactataatagaaaaaatacggttaaaaatatattttacagatcgtgctattattcaaaatgttaatcgggactatgtaaccgatggaagtacgcagtagaagtagtagcttgaatggtgttagcattaacaggtcatgggacaccatcacgccacagtacatggagtagcagccaacggcccatcactagtctgaaaactcgccgacaaagcgaggtcgcgaggaagcaaacaaatagtaagaggaagcggatagccctatccggttggctggcccggtttcctgtgggacgtaactaggattttgctcttgggtgtgtgggcgacgccgttccacggccaccgccgcctcacgggtcgctttccgatcccgcgcggagggggcagcacagcagccgctgtcgggtccgggcacatccggcaccgcgcggtggacggccgaaatcgggtgaagcgtccgtgttccaagatcacccttttgtactgcatcgcgatcccctccccggccatggaaaatatcgtccctccctgatccccgtctgcttctgcgtgcgatctcgcggttgtataaacaccgttggtattcgtcagcctgatgagtgtacgtacgttgttcaattcgtgtgtgccgttgatctctacgggagattcgatttgacctcgacggcaaggaagggaagaacgggaggagaaaaggagattttgacggttgacgtagccgacgttttacacgaaaattgctgagacaaaccgagggcggattcagccacagaggacattacccacgaacagtgtggcgatgtaatgttactcgagtcgtcagtcgtcaccgctcacttcaccagctgaacaagaacacgcacgggcgcacggctatggttggggcccgcgagtttttaatgagaattttcgcggcggcattatccatccacgttggcgccagcacacacagagcatataccatatgccttattatattctccccctaagcctaaaagtacacatattttgtacaattaattgcctcctgtacacaatttgacagaaggtgccatgcgtgacgccacgaatttatttatttatttatttcgttacgacataaaactagcttgttggtctgaaaaagaaactgaacaaatcatgtttagctgtttgtctcttcgctcacggctagtttggggatcctgaatctcacggtagtctatagaaaatgtattggcatgttatttggtatctttgtctgacaaggaaggctttgagtttgattcccaccggtcacgggtaatctttgtgtatatacaactatgatattaaagtctcgttctttacttcaataaaagttagatcaagattaaaattttcgtgacacgctttttaaactgctaaatgatatgtttcgtaaaaaactatctatatgaaagttgctctaaaatattatattaatctattttttaagtttgtattaattaaaactcaatcaaccatacgttaataccatctcgttttgcataaaaaacttaatcttcatcattatcttcagaagaaaagaacaccacataagataaactgcccaactatgaatattctaagggctactatgaaatgaagaattcctacaagaattttagagaaattcaatcgtgtgaaaaaaaaaatccatatgatcatttggatcaaaagaatagctaaactcatatgaaatttatatggattggcttaaaatataggaatttcggagaaattctaatatgagcttcaaacttttggagaagaaaaaaatccttcgtgtctatctctctcctgattctttttttccccgctacaaccaaatggtcattaacgtggctttcctacatttttttcaatatcttctacatccgtttcaggttataagatgactaccttaagtttgaccaagtttacagaaaaaggtattgatattttcaacataagttaaatttattatgaaaatatattctattattgatttgatgaaactaatttagtattataaatattagtctataaacttaggctttgtttagttctcaacttttttcttcaaactttcaacttttccgtcacatcaaactttactacatatataaactttcaacctttccgtcacatcgttccaatttcttcaaacttccaattttagcgtgaaactaaacacacccttaatcgaacttggaacagtttactaatattaaagttaaaatactttataacctgaaacagagggagtatgatttaaggttttatagcaactcaatctttgcttttctatttatgtgttatgagaatcatacgttctaaaaaagaccgtgaaaatacaaacatactctagtttgtgcgcgcgcgtgtgtttccgaggtccacgtgtagaatttgtgtctcatctctaatatataggattactgatatacctaactgcaaatttgtttaggtgaaagggtgacgtttactaatattaattaaaacaaagctactacaatccaaaatgacaggttcatgggtacaattgggacatgagattttttgcgtgctagaaagattttgttgttggaagaaaataaacatgtgggatattatatgatctcttcgcattacaaggtgagatattaggtgttgatttagtggttgataaaaaatgtagtcatggataaggttattaaaattataatggatgatccttttatgtattcaaaggtacacaaattgtcaaaaaattggcacataaacaattgccactagttattgttaacttgtcatggtcttcctagtgcctttaccaacacctacttaaaaaatataagagcagaaatcttcaacttcgcttatggtagaaaacaaaaatccagcatgtattgggcagctgggagagtgcacgtgcgtcatatatagatacagcacatgatattggacgatggtgatggctcgagtatctctttcatctgatcaaaggaagtacgtggttgttcgtggcacacatgaacgtttacatactttgatggatgtgattttgaccgttgtttcttaagcaatacaaaagtgaataatatctactactccaacattcataactgtgaatatattttatgtaattaactataactattgttgataaaccgataggtatttgtgagcggagaccgagtattacggtaaattaatgtctattctttgagagctgagagtactggctctgtacatgaaaaagttacttaacctaactccacgtgtacaagaaaatgacgtctccatcgaaaaggaaatggaaactgatagtgctcattggtcatggagcacgccgcgcgaagcgcgatgcatcatcacacgaagaagagacgacgcaccacgaggaaaacgcggccggccgagagcgacttcgcggccccatcgcgcgaccgcgaccacggcgtcatatatagcgggccgtccccgccgtttgtacccggaataagttcactttaggtccctaacttgacagcgagttcaattttcatcctttaacgggtccctcaactatcaaaaccagcagatcccatgacagttttgacggtggtttcagatgacgtggcacctacgtggctaatttgactcggtatttcgtctgacgtggcattgacgtgatgaatgaagcaaaaattaataattttaaaaaaataatatgtggatccgcatgtcagttaaataataaaattaaaaaataatgggacccacatgtcaattggttcaaggatgaaaatcgaactcgctggcaagttaagagacctaaagtgaatttattactctgtatccgggctaggccctgtttggaaggcctcagttccggcccattccccgcgaatgggccggagaaggcattatgggcctgaaagcccgctagatctcgaggcgtcagcaacaacagtcagcagttcagcacgctgccgccgcgagggttggcgacgccgcgggcggcgcgcgaagcaaatggagcgcgattttggcggataaatttgggcgcgcggaggcgggaggagcgggaaccaaatcgcggagccgcttccaacctcaggtctcaccccaaactcgccgccgccgccgccgccgccatggagaggaagcaggcggagtacagcaacctcgtaagcttctccttcttttgattctcgaatcacctcgatttgggttctgggctgagcaatggcgattgggggatggcaggacgagaggtacgcgatccagggggagaagtaccaggggcagcagtacagccacatctacttcacgcgactccaccacatgcgcaacctcctccacgccctcgtcccctcctggaagccgcaccttcctggtccgacccctcgctttttcctaaatcgttagggtttctctgctttgtttttggagcttgaactgtttttgggagttgattgcgatgtagcatgatgggtttagttagggtttatgtgctggcatgtggattctctggttcgctctacaaaattctgggggcgaaatttcaggcccattgagctcatattagggttttagaagcaatttggcacatcggctacgatctttgctccatccatagtgtgaatgtatgaccatcaactgagtttttttagggggtgttatgagcttgtcctgtgctagtttgtctatgcttgctgaaaatagtattcacaaaatactgatttggcatcttctatttaccaatagatttttattggttggtgaatgtaactgaactaaaaaaaacatttttcttactaaatgctttgtccagcagttaattcgcaatgaagctagtaatcaatcgtaagatcttttgctggcattatttagtcagtatgaatgtttgatcttatgaaatgtgcctccttattaccaagattgaacattggatccatttgccgcgtgtctatcttagttcatggaaatggatcgtgtaagagacacttgcttttatgcatccacagagcgtttaaacttcaaatcacgcctcttgctgttctgcagttactactgtgttgggacttgaagaaggaaaggattgcataatcgttggaactttatataagcacatgaaattaaagccttccattcttgatgaatattctaaggaggtaatttagcatgtcttgtcttcttatccttattaacttggatggcctctgaatgaactattgtgctacagaggtctgctattcctcttgttaaaccacacaatttcatgcatcctgatgatcatctcattctggaagatgaaagtgggagagttacacttgcaggagccatacctccagcagcatatgttactggtatgtctgatatttttcactgaaaagttaagtttgcaaattctagactagtttctttatgattgtagcatttgtcgaacaattttatccaatatatcatgttgcttggaatactcacccaccaattgtccacaggagttgtaatagctttacatgggaaagaaacaagtgctggcaactttcttgttgaagatattcttgaggctgggattcctcctcaaattacgttacctagcataagtaaattttttcctatcctggcttgctcattctccattttccccatttgcctacacaagttttgatggttagatctcttacattggcatttacctctgttacagacgaggacaaatatgtggtatttgtgtcgggattaagtattgggagtgaaaaattcaatcctctgcaattccaacttcttatagaccatatcacagggcatttgggtgatgagaatgtatgcgcctttttattttatttttcccaaaatgaaggttttcaagtgaagatatgcactaaatttagatgatctctttgcaatttaattaggagcaatccatagcatccaacatagtacgtgttgtggtggctgggaattcggtacatatttctccaagattcttcaatggtcaggtaatgtcactgcatattacatgtttttggtgaaactccatagctttagtttattgcactagtggtgaacactgatatttcaggcagtagcatcgaaagatcaatccaggatagctgaaccaatcaaagaattggatataatgctcactcaggtttcaaccgtttactcccccctcaaatattatcaacgcaattaattattcaggtttatgatgtcagtatgaatgtaatccatttcttctgcagcttgtggcatcattgcctgtggacatgatgcctggatctaatgacccagcaaatttttctttgcctcaacaggtgggctattgacatggaaaaataatgactaatttgcactagtaacattcaagcatgtttttatgcatgcatgactaacttatgtcttgctttttttttggcagcctttgcatagatgcctttttgctggagcagccacttataacactttttcatcgtgctcgaatccacatcaattcgagcttgatagtgtccggtgggtgttggtgtttttttaactttcctcaattaaagcagctgtggagtttgaagtatggaagttctgcatgtaggtttattggaacatctggacagaacatagatgacctctacaagtactctgatgccaaagacaagctggaattcgtggaaagaacactgcggtggcgtcatcttgctccaactgctccaaacagtctaggtaactcttcaggcatttcagccccattgtgctatgctgtgattgcttggtaaaaaacctgtattatatcatccaactgtttgtaattcaatttcattattgatttagtgaccatttttatagcaaagctagaacccttctcatgtaaatatctgtttcacccaggatgttatccatacacagacaaggatccttttctcgttgaaagctgtccccatgtttacttcgtcgggaatcaagataaatatgaaactcaattattgcaaggtactgcttcatgtaaggttcctatgttgttttagcgcccaactaaacatatttgtcatcatgcagggctagaaaaacaaaaagtgaggctgatctgcattccaagattttgtgatagtggagttgctgtcatggtaaatacctctagttgtatgctgactattggtaaagctgcgctgttttatctttgcaatctagaaagttataaggaggccaagtcatcaagtggggattagctccttttacacatcgtaaaaagttcacgaatgatgaaccagtaaaacaatttcatacacttctttgtggaagatttaaaaaaccatgacaaaccagaagtctctttgaagatggacacttttcctttggtcttctgtcttagtatagtacatagccttgatttatgtatgcgtatgcaaacatttttctttgccctttttttgtattctaacacttaacattgttttttatatgcattattgcatacacagataaattgctgacaaacacaagtatatattttaatgcagctcaatttgaggaacttggagtgcagcacgttgagtttctcaannnnnnnnnnnnnnnnnnnnnnnnnnnnnnnnnnnnnnnnnnnnnagataattaggtaagcaatggatcaacaaaactaaagcacaaacaacaactgcagttcctatgctacacacagtagtgacagagcatataaaaggtttcagcctatgagcttatggaaggatatgttactgggagactgggagtaactgggttgttctactgaattaaagtagctcttcatatgcagagtccacgcattgcattcaaaactttaaggcgtcatttcagtcattgagtataaacaggtagttccttatttcatattgaaactcgaagatgctcaccaacggagtaaaggcggagagaagaagacaacagttaactttatgctaaattcaaacagatgtttggttcatagaactagcatccacgatccttgcacaatgtccttcgtgctgtcataaccagccctgtgcatccgaaaggaatccaattgtcaatatgactgataaactgataaatgtgtgctatataaaaaagaaaaatcggatggagtttctagacagagtgccatcagggaaggaacaaaacagaaccaaattgtgccagaggaaacagaataaaacagcatcgcatttactgactcaggttgaggtgaaaacaaaggatgcacagagtaaacaccacatgagccacatgccattctgatagggaaaaaaccgctgtccccaaacttaaccatctgacacatccaatgtctatgccatcaaaggttatagtgatgcattcaaatgggagaggaacctcccaagagcacttatcatcaaaggcatgaagactaaatagttgcagcatctaagatgccggtctatactatgatgactgaactgtagagagtatggatctaccaatatgccagaaactaacagcctaaaggtacagaatgatttcatcacctaatggacagttgaaaagattgcaaatgccaacacgatttatgtcagtgtgtcatgattcataactctgaagataaagtagtactccatacacaataagtgcaaggaatcattttgcagttactattagcagaagaaacgaagcagccaaagtatattatctgtacttatgtacttctgtcattattatgtcctttgtttcttgttgtcacagaggaactatcaaagagaacttgcactgcaatactcctactactagatacttcaaacaaatgatttgcagtggacagttccttaaatatcacatccaatatgttttcaacaaaacatggatgagaaaaggacttaatgtttaagaggtgca

SEQ ID NO: 68698 - DNA, 1650 bp, Oryza sativa
tcctgcagccctttatgatggtttttccactgcaggttgtggtgcctctattggtcagtgatgatgaaaagacactggttgtgtgtatcaactccttgacaaaggtgtctcgtacctgcagtttttccctgtttactgtttgagcgtttcccatttaagtttgaatggcacataataacaatataacatataaacttcatggtgccatggttctttagtgaataagttcatatcatatgttctttatatatctgatcttttgtaaatagcatcaattgataatataattactctctgctgagttgtcctatcagttattttgctccaccaaacctaacgtattacacatcctttggttagatttcctgatctcttgtgcaagtgcttttttctcagttccatgtatatattatgatttttttgggggggtactctggtaagtggtcagattgcaacatatctgaattgctttagcgttcaatgttacaatttagtgggttgtagtcttgtagatgcccctttcttgaattcttcaacctgttgtttgagtatatacgccattctactactttgtgcggaagaatgcagcccaataaactaatcgtgtgttcgtaaatgtatgccctgcataggacacatgaatcatatgtatttgaataaaacaattggattggcacacctctagcatctaggcattgtgtctccgactgattaaaaaccggtaaaccaaatataattttagcaagtgttgttgactgctggttctgtttggataatcttgcagcttgttggacggctttccgaggaggaattgatgaatcagttgcccacatttttgccagcactgtttgatgcttttagtaaccaaagccctgatgttcgaaaggtaggtactaatacagtaatactgtagctcttgtcatggtagatttcttctgtttctcatagtgcttttttatttcactgaaattttggtgctatgaggattttataaggtaggatttgtggaatggttgtccatggcttaagttctggttggactaaattctaataacattcaggcagtgagtggaatatgagctggagaggataggctggtggaatggaattgtaacagtttacatagagaagcatgctatacattagggatgccgcttacaaatgcctatttcctatagttcctgaattaaagccaccctgcccatctctgatactaggtccattagcttctgatgcagtctaggtatcacttgctcttgcccactgaaatattttcacgataatctttttacctgccctggttatttggaacattcagtgttttacgagcttaggacatggaggatgaagattagtttgaagctggtactggatgagattgtcttttttccatagtttgtcatccccatgcagtactactcatttcgatgtgccggtgttgaagttagttaagtcggcagcttcctttgttacgttgctttcttttcttttctctttttgtgtgtgtctggtacaatatccacatacatctctgtgtaaccctgatttctggcatgccctagaatggttaagcctctaaatgtctcaacctgctatagttcttgcattttcaccatgaatcaattcgtgatgcatcatcccggttcatat

SEQ ID NO: 68699 - DNA, 4499 bp, Oryza sativa
ttttgtaccacttagtgcttacactgtacaaagaaaaaggatagtgtaggttcatggagagacctagtgtctgccccattttcatttgctgtatgatttccgttggaattgctaggtgtgaattctcagttgtcagcctcgttcttggttttgccttgcttatggaggtcccaatctagcccaaaacttggtttttgttctggggtttctggtatgtttcggaccagcaacgcgaacatcatgttagctctgaactcatacaaagttcacaccttcaccagcgcagtggattttgttgaaatttttacggcgtcaaattgtctctaattagttgggttcccttgccagtaattcaccactccagtctccaggagcagcaaagctccagtgtcctagccagtgatgaggtttaatggttaggataatgccggttcttcgcaaggagcgggagcaggttgtccgtctgctgctgagtctgtcgtacagtgggtttgtttagagcagtttaaagattctaagaactgattgatagtcaacttcgattatggactatggactatcaagtctggccgccagtatggggcaggcgacaaaggactatggactatgaagtcgattgctaaggttaagctcccatcggatggcctaatcaaacaaagaaaaagctaaattttaaattttcaaacttaattttgagatattttcaacgtagttcctttttagcattggatttaagtcaccaagaatatatatatatatatataatttacctacaaatttatttttattccctagggaaaaaagccaaacgatgaggccttaacattcctatgatgttcttacatttttttttcatatattcctgtagttttccatttctgcatttcaaaatagccctcgatatttttgtcgaggttacaatcatgccgtcctagtctcctagatcaggcgatccagcataatattcctacttgatcagttgattgggtgcgccacattaattgatttgattagccagattagtcagtaaaattccatcacgcgaaaatcatctttactctttagaaccgcactggctgcaggaacccaaagcttttgaaaaaaaaagggatttgggttggtgggtgtctgactgactgaccgagcaacaccgtgtgcagagaggatcagttagaattaaacgtactagtattaatttaattgaatctccggtctcggaatctggacggcatgcaagtataccagcctaacataccaggtccggctgaggaaattctaggtttctaaagtcgccacaacggcgtctcaccgtcaccgcccggtgccctcctcgagacttcgaccgattgaggaatttctaaccggcgcattatctattcggagtagaaagtttggaccgagaaagaacgtacgccgcttcaacgacgcatgcagtgaccaaactatcttcaccgcccgatccgactctcccccgcttttatatacgcgtgctggctagatgcatgcgtggtacgaggaaaacgtactacgtgagccatttcggtgtccgagcgcgtgagctcgatcgtcaagctatagctccggcgaacgtacggcgatcgatcgatggcggcgtcatcgtccctggctttcacggcgcgccgaggcgacccggagctcgtcgcgccggccgggccgacgccgcgcgggctccggcggctctccgacatcgacgaccagcgcagcttccggttctaccgctccatcatctacttctaccggtccggcggcggcgacccggccagggtcatccgcggcgcgcttgcggcggcgctcgtgcactactacccgatcgccgggaggatccgggagcttcccggcgggaagctcgtggtggactgcaccggcgagggggtctcgttcgtcgaggccgacgccgacgtctcgctggaggagttcggtgactcgctgtgcccgccgatcccttgcgccggcgagctcctgaccctgccggagagcaactccgccgtcgtcaccgaccgaccactactctatgtgcaggtacacacgtcgtcataaaacttgaataaaattttgcaacttttgctccatttgtacgtgacgtatacgtgctcatgatgccatgcatgcaggtgacgaggctgaggtgtggcggattcgtgttcggcacccagatctgccacaacctcgtcgacgcggcggggatcacgcagttctggcaggccgtcggcgagctcgcgcagggcgcggcggcgcccagcgtccggccggtgtgggcgagggagctcctcgacgcgcgccacccgccgcgcccggcgtacgaccaccccgagtacgagccggcgtccgacgaggccagcgacaagctccgtccgggcgacgagctcgtgcaccgcaggttcctcttcggccccgacgacgtcgccgcgctgcgcggccagctccccgcgcgcctcgggccccggtgctcgcgcttccttctcctctccgcgttcacctggcgctgccgcaccgccgcgctcgggtacgcgcccggcgacgaggtgcggttcatgttcgtcgtgaacggccgcggccgcggccacggcgggaggccgctgcccgaggggttctacgggaacgcgctcacgttcggcgtggcgcgtacgacggccggcgagctctgctcgggcccgctgtcccgcgccgtggagctgatcgctgccgcgagggcgcggaccatggccgacggctacgcgcagtctgcggccgacgcggtggtgctccgcgggcggcggcggttcacgacggcgcggacgtacctggtgaccgacctgacgaagtcgccgctgcacgaggtggacctcgggtgggggcggccgctgttcggcgggccggccacgacgacgctggccacgttccacatgcccgcccgcggcggcgggatcgccgtgccgatgtgcctgccgccgcgcgccatggagaggttcgcgggcgccgtgcgtgcggggctcgcggcgggcgttccccgtgcggcggaggaggccgccgctctgtcgaagatgtagacttgggcttggatttcattcaagtggcctcttattgggcttctacagcgccaattgttggcccaaaaaaatccaataaatcaattttagaaactgggttctgtatttcggaagctataataatttgatccgaattcaaataatattggatcaaatttaaacagatcttgctaattgttgaacgaaatttttcagcgggggaatcccgaagagttaggccggatgcactgaacccagaaaccagaaaatgtcaaggcccaaagtttttccaagagctgttactttattatcagtttattatcactccctgacgaactgcagttgctgtcctctctcgatctctccaattcctacggataatcaactgtccaaagattcaagtccgtaaccatgtttttcctgcaacttggttcttgcgaatgcacaaggataattagtctgctcccagaactcacatagcaccagatttgagattgtatatcattatgtaattgaacaacagttgtacaatggttctgtttccagaactcaaatcagcacatcacttggcgtggccacgagcctcctctgacgttagagggacatgtctctctaatgtgtaggcttatgaggatggccccacctgctagagacttggatactgggctctcacactctatgaagttgcttgggtaaaccgaagtaccgaaaatatggatggattttaggttttcagcaagcagaggcacaggcgcacagcctagcaaacctggttgtagggctgggcaaaaagctcgaagctcgtggctcggatcggctcgtttcaggctcggctcggatcgactcgagcttggagtcttaatgagccgagccgagccagctgttttgctcgttaagcaaacgagccgagcccgagccagctcgcgagttttcggtaggctcgttaaactcgcatagctcaaaaattagacatgcagcccaacccaataaggaagcccaagttcccagcccaacagctcaagtacccagtaaaaaggaaaaaccctagctttgaccttcctcagtcagccgagggcccgaggcgcctctcttgcgcatgctgtcgcaggctgccgccgtggccttctcttgcgccgccgcagcactgcctcgcgcccttgcccttctccttgcaccaccggcccgccacaggccgcaacgttgccgctgccctgcccaccgactcctcctcccgcagccgcagcgccatgccgacgacgccgatgacgccgctcctcccaccgcagccgccaggccacgccgaccacgccccttctcccgtagccgccgcagggccttcatggatagggagcgccgattggcaagcatggagtccaagaaccgcagcaaggggaagaaatcatcagaagcttgtctaggcggcagccacctcgcctctgttcagaagccaccaagacaaagacctaaatcaaa

SEQ ID NO: 68700 - DNA, 8646 bp, Oryza sativa
  unsure (1)..(8646): unsure at all n locations
agtctccttctcgtatgcatagatttagagaggtatgtaaacaaattgcattgcctattggaaaaggtttgtgttttgatgtgccaacaaggtggagttcaacctataagatgctttgtgcttgtgagttttacaaggatgcttttgttcaatatgcctatgtggatgctaaataccaatggcaacctttgcttgctgattggttagtcttttccaaaattcatccaatattgaaggcacttgctgaagtaactactgtattttctggatctacataccccacagcaaatgttttttatccaagcattgtgaatgtgaagagggcattgcttgctgcatctaagtctactaatagggacaaggttttgaagaatatggttgaagctattttggaaaagtttgataaatattggaaagagaagaacaaccttatgatcattgccactacccttgatcctaggtttaagataaggtatgtgagttggtgttttgttcaaatgtatggtgaggaagctggtcaagttgaggaaagaagttgatgaactctttgccacggctgaaacgacgcatcgccttgagaaggctgcaagaaacaggggaagggatgaaacatccacctcaaccattgacacaagtaactcattagcttcagttaaatcttcaagtgagttctagatatttttgcaatctagctctgcaaatgtatctaagtcagaatggctaatctatctagatgaaccaaatcatcctttaacggacaaggatttcactttgtttgattggtagaggttgaatactcacaggttccctgttgtgtcaaggttggcaaagagattcttgactgttccagcgtctagtgtatcatctgaaacaacttttagtgctggtggaagagtgcttgatgattaccgaagttccttgcgcccatcaatggttcaagcactaatatgtgcttctagttggatacgtggttctcaagataacaagacacctccaatggctgtggtatgatctctcatatcaaccacttgcatttttctttaccagtttataattgcattatatcttaagttgaacttgcaattttctttttaggcggaagatgataaggatgatgttgctagcaactagatgatttccagagagtgttgttgctagcaactaggatagtagaggtaagacattttgtaagatttctgtcttctgatgatttgttcaaatgtatggtgtggtgaggtccaagggtgtttatgtttgtaaaaatatgtatacaagtatgtagacttgaagacaagaatactcatgtaagattatctaattttgtagggactgctagatgcttggatggctgtcaagacattttttgaggctgataagatcttttaggtggctttgaagacaaaatagttgcaacttcaaagggcttttgcttttcttaacagcgatgctattatggatcaatggatattatttatcgattatgcttatgcatgattggatctaggatatgtggatcaatgaatataacagactaatactagaacttgctattatgctatttgctaagtacttgctgctactatgctatttgctgagtatgttatctgtgagagtgtgactgtgaatctgtgatgctattttaattaatattcatagagttctctgaattctaacaatctgtgaatctatgagactgtgatcttattctgtagttttgttttcttattacgtgactgtgatgcactcatgcacacgcacagatggactgatggtggaagcctggttcattgagttaacgagctaatcaagctcaacgagccagctcgccgagtcagcgtttgagctcgttagtcttaacgatccaaaccgagctagctcgttaaggtaacgaggcaaagcgagctgagccgagccgagtggctcgatatccacccctacctggttgtactactagcaagcagagtggatgcgggcggcatgcggctgctacagagccaagccagcgcctccccctgcctccctcgctgttgcatttgccgccacaaatcaagtggcagttagaaaagctaaaatggatgaaaaaaacagagaaaaagaaatcctaccctccatagcgagcagtggtggtctgcactctgcaggcaggcaggcacccaggcctgcagctcgatggcgccgccgccgccgtcgccgccgcgatctctcacctccgtctccctccggactcctctgagccctctcctcttcctacggccagcttcttgcaatccatcggcggtctccggctcctgcagcagcggagcatgccgcggcgtgcgctgctcggcggcgaacaagccttctccttccaccgctccgggcaccgaggtaaggtagccggctagccgccccccatattcttgtttctgtgttgatcggagctcgatggctggggtgctctgggctcgtcgtcgtcggtcgatcgtcatggcttgcttcgtttcttgcagctcgacctccatggcaaagataaggagtgaggtgctgtccccgttccgctccgtgcggatgttcttctacctcgcgttcatggccagcgccgggctcggggccctcatcgcgctcacgcagctcatcccggcgctgtccagcccggcgagggcggccgccgcgggggagacgctcaagggcctgggcatcgacgtcgcggcggtctccgtcttcgcgttcctctactggcgcgagagcaaggccaaggacgcgcaggtggcgaagctcacgcgggaggagaacctgtccaggctcaggatccgcgccggcgagggccgcccgcccgtcccgctcggcgagctgaggggcaccgcgcggctcgtcatcgtcgccggccccgcggcgttcgtcaccgagtcgttccgccggagcaagccgttcttgaaggacctcatggagcgcggcgtgcttgtcgtgcccttctcgacggacggcaacgcgccggacctgcagttcgacgaggccgacgaggaggaggaggaggcggcggcggcggctgggaagatgaagcggaggctctggcagctcactccggtttacacttctgaatgggccaagtacgcgcaaagccgggatcccatgaatttagctgcttaaatttcttcttcatgtcaatcgaaattcaaatgcaaattagtatctcattttcaaatcgattgctgcttcttgcagatggctagatgagcagaagaagctagccaacgtgtcacctgattcccccgtgtgagtatcaaaaactactctgaatttgtctgaaaatataactgaagtttctgcagctgctgaactgaaaccgcatcactcttgcaggtatctctcgctccggctggacggccgcgtccgtggcagcggcgtcgggtacccgccgtggcaagcgttcgtggcgcagctgccgccggtgaaggggatgtggtccggcctccttgatgggatggacgggagggtgctttgaatatttgactgatacagaccgtgaaaacattagttgattggagaaaaaaaaggacggccgggttcgatctatagcttatactagaacaagaacaggaagagtttgatgattgctttaacttctgtggggttgattttgcttcctgcatcccagcgacatcgcccaagtgaatgtgatatgccatgtgcccatgtacatgttgttttgcagcctacgtgacttgattattaacgagaatcctgtgtcaaagatcgctttttccgtggtaggcttctccattttattttatttttgaatatatatacgaaccgtgacaaatctgatggaacactggaccatgggggtaatgatactgtagtcgcctggtctttttatcaggcgctaaatgcaaacaatcagacagcttaaacaacctgaggttgttcagccagcccagaatacaaaaagcccatggaccgtgagcccgtgaaaccatggcccacccatcagtcacgtcacgtcgggacgtgtgcgcactaccccgagaagcgcgcggccgtaagccacaaccacaaccccacaccgcctcttggctgctcgcgccctgacacttcccaaaaccccaaaccgcccatatctctctcctcttctccgctcctcgcttcccccaaaaccctcgcggtggcggtgggccgccggtctcattccgccggcgtccacggaggcggccggagccaggcgctccgcgggccggggagccaccggaaggctggaaccctagcggcggcgggtctcctccccctccccgcgcgccgggcggcgccatggccattcagcggctgctcgcgagctcgctcgtggccgccacgccgcggtggcttcccgtcgccgccgactcgtttctccggcgccgccaccgccctcgctgctccccgctccgnnnntgtgagcttccttcgcaccccccgggcatttgctgccttttgctgctgctgctgtataggcggtttgttggttttggtaatggcattgtatagtaggcgttgtcacgttcgtggcccagaatacacatccgaatggtagggattttggagtccggcgcggcggtggggtatatttttggaatctcgaaactttgtgggtactacatactaatagattgatcatgcatttagataaatctatttctaatccgtgagaactgagcttgattactgtatctatgatcgttaacagcctgaactctgaatgaaatgaatataggactcatttggtttgtttgagaaatttgataatatgccatctaatccgtgtgcctttgataatataccatccaatccgcatgtcttgctaccggggctgcatttttttttgattccgtgccactttcgctggaggagggcatgaggcaatggtccttggtggcggcagtggtggcgcgggcagcagcgaggcgatgcagtggcagcgcgggtagcagcagcagccgaggatgccgttgtcggccagcaggcaactgggcaaggtgaaggagacgttgatggggacgcgtggagctgcggacgcagctggcgggcaggcggcgggaccaggtgaaggagacgccgatgggggcacgtccccagcagcagtagccgtggacgtcgtcggcgggcaggaaatgggatgaggcaaaggagacatcggtggggacgcgcaaggctgttgcattggctacgtgggcagcagccgcgaatggataccgccggcggcgggtcaaggcggaggagacgccggggatgcgcgaggctgctgccgctgaccaccgccaccatcaagggccattgcctcctgctctcctccggcgaaagtggcacgaaatcgaaaaattcacagccctggtggcattttatcaaaggcatgcggattgggtggtaaattatcaaaggcgtgcggattagatggcatattaccaaatttcttggttttttggaggtttgagatgccctaccaaatcattggtagtccgtagtccaaaacgtaccttttggtagagttggatataggacttgtattggttttggcaagtattggcatcaatccaaatatctacaaagtactattaaagttgccaattatttggtagggcaaatttttgcatcaaccaaaacaacccatactcaactactattactatgtactaggttactactatgatctagggacacactggaggatggccatgtccacgctccgatcatagcttcctaggctttcaaattgaaattttgtcatccttgtagagacagacacagaagtgcagtacaacattatctcacatcctcacatataccaatttcagtctccctcatgatatgctgtaccatgcgaagccacttcagggttaagtaaacggtattgaaaaggttagggggtagaatccctggtttgagagtttgggggggttaaatagtcaacctgcaatagtttggggggttatgtagacttattccatgtttccatattaaagtaaactaaaaaatcaagttcaaatgcactactgtaatttagaacaaccaatgggaggtcattcagtgatgcaattggtagtgctgtagtgcactgcacgcgtgcatcattatttggggatgaaaccagtgaacacgtaacgttgatgccctatacagctatactaaaagtccagttctggcaagatccattttactatactaaaccagtgaacacgtaacgttggtgccctatatgagttggatcagctcctatttcctactgcacaatgttgatagacacacaaaaatattaaagaaattatttatagattgttgtaccttgaacctgatctcaatttcactttttagaagtggcatgcttggcttgatttttgttctatattatttggcctgtttaaacttcttggtaatctgggtacatccacacttcaggctatttaacaggaggtcctggtctaaaccaaggaaagtctcacgaagcatttccattgtgtctaggaagatgaacaaacaaggagatctctgtaatgaaggcatgctgccacatattctgtggtggaaagaggtgcttgcaaaagttggcatatatgtattttttttctctccaatgtattgacagggaatcactaatgcttcagctttgttattgctgttattctgtttaatgttctcagaaaatggagaggtgcaggaaaccatcatcaatgcaattgactcagagacttgtgtattcaaatattttaggattggatccaactttaagaaatggaaggtgaatcagatgctcatgcttaatataattatgcaatgatcattctttcacattttctttaagaaatagaaggctagcatgacgttgtactatttttaagttactgtgaattacttcagtttttcatattctaaagtgaaatatgtatgtgttcattactccatttgtttgcttagttctattaatcttacaatttgtatgttcctattctttgcttaatcattggagaattttatggcaatcacggcttcatgtatgtcttgaaaaagaatttctaccagagcaatctgactagtttggagaaagtttattgtaattttgtatcatatataatcaattcctttcttccatggttatttttctttcattttattaaatatttcttgcttgagccatttttgtgttggtcaaatcaggcacatttcttggtatttactttcttttcattaacacaaatgttgatatgaatctttgcagcttgaaggatggaagcctgaacacggaaatgttgcaattcaaatcgaagtttcctcgtgaagttctactttgcagagtaatgctattctattcttttattttgttcacatgcttgatcgtcttttttgcgaaaatctggagaaatgccaagaatttcttagctgggaatttttagttatcaaaacctataatgtcatagatgtttctttctgaacatctatgacatgtgatggtgtgttttatgtgcctctgggaaatctttactatgccataacttacgtgcactgctgtccttgtttccaaaacaatttactttttgtttcactacatacccctccatacccatttccatctgtcaatctggattcgctttcagcattttgctaaatataatactcagaattaatgtatctctccagcgttcttctggttttcctcttacattcaagctggaaaaaaaatccaaatacatagacctataacggaataacctttctccattcaggtgggagatttctacgaggctgttgggtttgatgcatgtatccttgtggagcatgcaggcttaaatccttttggaggcttgcgttctgatagtattccaaaagctggatgtccagtcatggtaaactgttacataactatgctgatgctctgaaattaggattgctttaagaactatcatagtgatctgcctagttaattatcaaatttttgcatcattatgtaatttgttttttgaaaaagtggagaacgaggagcttgaacttcttctgtgaaacagatcttgttgcgttcctttgttatgcttttgaagagtcagcgtatcagtaccatactgtgcggcacttactgctgccttttatctacatataagtttcagtctaaccacaataacattttgtaagttgcctgccttttttttgcaattacacattgtggatatggaagacttatttattttgttagttacttacatcacacctgtctagcatttcgtatgctcatgatccatcaatatagttcaagctttattcaccaatatggtttgaactaggagacatgctaggaattgaagttagcatgcttcatatcttattgttctgttggcaatagtatgaaaagagcattcagaacttgtggcaaacattgatttaatatggtttatactttataactaataatgcacatctttttacattatgttgataatattctatgacatcagagcacatttccttacagaatttgcggcagacattggatgatttgactcgatgtggttactctgtggtaagatgttaactcagttgcttgtaacatatccattaggatcatttgtgcaagggataattgcatctgtacccccattttgaaagccaattgttgttttacccccactttttagggtttgcagttttgccccc

SEQ ID NO: 68701 - DNA, 3946 bp, Oryza sativa
ttggtcacatattgttattgcatagtagatgctcatatttggtccaaatgctcatcacacaagctgaaatcacaaaataggggcaaaatcgcacagctgaaataaaataaaatggggcaaaaatgcaataaccaccaagggtataaatgtccttttttctaccactaacactgttaaaaccggctgttaaaagtgggggtacatggctgattcagattcaaaaagtgggggtaaaactgcaaaccctaaaaagtgggggtaaaacagcaattggcttcgaaagtgggggcatggatgcaattgcccctttgtgcaatgtaattttcagtgttcttgacaaaagaaccacaattctgcatgtaaggaacatgtgccccaaccttgtaccggtcaagctgcataagcggctgattttcccataagtgctacaaggtggggtgatcccatggaatctgatatcactttttagaaccttggtagttgtagaaatacaacttcaactataaggtctaaagtcactgttccagtaagccataagttcaatgatctacatgaaatgtcagtgcttatttggagccgtaatgagtactttggtttgtaatttttatcctctcatcaagccttagagtaaaaagttaattaactgtttacaggacagttcaaggatgttattacttttttatttatgttatttaccagtgtcctcatgctgaacaattgattgggcctgacataagtctctggagagaggtgtatcaagatgagatcttatacatgagatcaccacatgatttcacaccaagaaattttgaaaccaactttttttgcgttagtgctggagtgatcatagaactaaacagttgtggattttgctcagtttattctgtagagatgcaatgctcacatttcacaacctgttcaattatgagcagtacttgaccatgcttttatcaaccgtgacatatttgatcattaatttcccaccaatttggcatctctggttacatttaattggtcatcttcttgaagctgaccctttgtgcatattgttattttttactactgcttgcagtgcatagttgaagaaattcaaggcccaacccaagctcgtgctaggaaaggccgatttatttctgggtaattgtgtgactatttatcgtggaagtttaacttataattttattatttattagtgatgggtgatcttttgacaaaatatagtggtactcatagtatttatcgtccttaagcctgtttcaatgttactggaggtgcatctagatcttaatagtaggaagttctataatgctttttacattttaagttttacaattacttatgtccgtaaccatgtacctctgtttctgttacagccatgcacatcctggtagtccttatgtatttggtcttgctgaagtagaccatgatgttgagttccctgatccaatgcctgtagttggtgggttatacttctagatttctactccataaatcaagttaaatatctctgtgttatctcttccatcgtaactatgctgcttgttagctagttatatgtttgctccataaaatttcatatgtaactttgtaggattaatttcatgttgagagtgtgctagtaaatcaaaatcgagcgtggaaattgattggtaatggtatagtccattaggttatatggaatgttattttcttttattgaacaatacttttatgaactgtttatatctttcattgaaaaatgtcataattactactcatgaatcttgacaaagattttatagcatatttttcccccaaaatttaatgagtacaagtaataaatcatggtgtatagacctatgagtgttgttcaaggcgcaaagaactttttttgtgtttgaggcattatgttatgcttttttgtaagttttaaaatgtatttcatttctgttcgtgctttatttctattccctgtttatatgatggtttcattaggccaccatgtactgattccagcactgacattttcatacaccatgaaatttatattgatagggatttcacgatctgcaaaaggctattgcctgatttctgtgctagagacaatgaaaacatattcagctgaggagggcttaacagaggaagcagttgttactaagcttcgcatatgccgttatcatcatctataccttcatagttctttgaggaacaattcttcaggtttgggtttatatttcagagcaattgttttctcatttatttattgtgtttgatctggaatcaaggatacagtaattatggaactaggagatataaagttccaaattatgctcttaacatgattttctgttcattttggatcgtaccattaaaattgtccaaatttgaaggtgttacactggtatcgtgtttcatgcatttgtacttgaacaacaattttaaagctcgtggtgctcactcctttctctacatttactgatgcattagtttttttatatgaatgctgcatcactcatatgtacgatggaagaaacttgagattgaaatttttgtggagtaatatgattcgtgccattaagataatatgcatatgacgaatgtagttgtagctatctatggtttgaatgcacctatttatttatgatccttcctgtcaaatttcttatggtttaggcacatcacgctggggagaatttggcgaaggtgggctattgtggggagagtgcagtggaaaatcttttgagtggtttgatggtaatcctattgaagaactgttatgcaaggtctgtagaatatatcttggtgtaatggataattatcatgattttttgtgcatatggtccatgtgttgagattaaatatgaacttttgctgattttcctagatttttatgtgccacacttctatattcttctcagtgagccttgaatattgtttcttactttcttatatccccccccccccaaaaaaaaaaatcaaggtaagggaaatatatgggcttgaagagaagactgttttccgtaatgtcagtgtctcattggaagggaggcctcaacccttgtatcttggaacagctactcaaattggtatgagttagcttccttggtagtgttgatcttttaaaagagacttctaaagtggtgacatctcatttattaattaatgtgctataggggtgataccaactgagggaatacccagtttgctaaaaattgttctccctccaaactttggtggccttccatcattgtaagtattgttatttgttggattaagtgcccctatttggtggccttccataaaaatcgtagcaagatctttatattccattgcttatatgtgtttgccttggctcttgagagttaccttttcttatgatatgtaggtatattagagatcttcttcttaaccctccatcttttgatgttgcatcatcagttcaaggtatattttttcactgtgagattcagtgtttgtaatttgctgagttggaacttgagttcactgcgtgtaagatagtatctatttgatttttaattaagcgcatacagttatgattaatattaactttggaaatggacaaaaatggaatgcctaatttcatctgaatttcaatccttggaactttgcatgctttccttttccgatcacatcactacatcatgatggtttaattgctatgactaaaaatgtatttccatcattgtggagaactgcagatactgtcatagcctcataggtcttttcgaggaaaaaaaaaagcctcataggtcataattgcattaacaaaccatcccttaggtggaacataggccccgtttggcacaactctagctcccaactccaacttacctggagcgggagctgtgccaaacggtccacattcacctttttttggagtggagttggcagagctactcctagaaaatgaactacgggggtggagctgggtttttgctactccaca

SEQ ID NO: 68702 - DNA, 2874 bp, Oryza sativa
ctgttgggggacgaggacgagcggcgcggcggcggggccagcaggtggcggcggcccatcttcttccccatcctccgacgacggccacaaccggttgtggcggcgtctgcgttggcagcatacgggggcagcaggccgcggcgcatcggcggcggcaggcgatggcggcggctgcgggcggtgttgcggtggccgcgacgggcggcacgcggcggcggcgtcggcaggcgactcgcgtgcgggggcgtcggcaggaggcagcctgggcgacggcggcggcctgtgcggcggcgcttgctcagcggcttgggaggcggcggagatgcgtgggcttcccggcggcggtggctcgtgggctgaccggctgcggcggcaacgtcaaggcgacgcctagaaggtgttcgatgaaatggcgacaaaggatgtagaaatgtggagctgagtaatctagccaaacacttttttacctacctcagctcctagaggagctagctctcactggagttggagtttggagttgggagttgggagttggagttaggagctctaccaaatggggccatagttgtgatatttttagatatcacaactttagtctcctttctgatatgctctgcaaggttgaaatgattatatccttttttgagcaactatcatctttcagcttatcctgtgtattcttagtgatgctctataccccctctgattccaaatgatagtggttttagttttctcaactctttcctaaatgtaagtcattttggaatggcgcctcgccatctcttttaccatgtttgcacttgccctcttacaaagaaatgactcatccttttccaatattgtataaatgatgggcaatagactgatagagttgtttgagctatttctttaattctcgtgcagaaatctgaaacaaatatattttggattttgttaagaaaaacttatatttggaatcagagggagatatttgatactacgctgcattaatttcattttttctgttcagatttcattttttgccttttgttctagttccccagaaaattgagtaatgttgcaccatgtgatatcataacagctgttataatttgaactcttgaactgtttcagaggcttgcaggcttatgggtagcataacttgctcgattcctgaatttacatgcataccggcagcaaaggttgctttttctttctccttagagatattgcaacaccatcagttatactagattgtgtgctttgttgcatgttcatgctggataaatgaatttaacgtttcatacccagtagttatataccacagcccagagtagtgcagtgtccttagtcatgtgtaacttgtgtgatgtgtacagatgtttgtggttactcaatatacagtaagctggttttgtaaataattctgaggaatttagccaagtaagatgcatcatatgacaatactgtttggagatacaaaaaaaaaaggtcttttcaaatgttcaatgtttattcttcttggctattttcttgagcagcctattgcgcatactagaaaataggcactgctactaactggccacacaatatgttcatgggccattttatagtgagtaaaatgataattgggatatcaaaaaaggaagtattgtagattcctttttgttgtagtactttcaattttattatatctttagggaaacctttttggtctcctgttagttttgatcaatttagttatcatatcatgattatagtgcatactgttttgtcctttttctcatcctatattatttttcaaatgttgattttgcagcttgtgaaattactcgagtcaaaagaggttaatcacatcgaattttgtagaataaagaatgtcctcgatgaggtgttgttcatgggtagcaatgctgagctttctgctatcctgaataaattgcttgatcctgccgccatagttactgggttcaaagttgaagccgatatactagtaagttgaagccaattttgatagtctttcccttcactatgttattgatccggagcatcttattttgccttttttgtaggtgaatgaatgtagctttatttcacaacgtatagctgaagtaatctctttaggtggtgaaagtgaccaggcaataacttcatctgaatatattccgaaagagttcttcaatgatatggagtcatcttggaagggacgtgtaaaaagggtgcatgctgaagaggagttctcaaatgttgatatagctgctgaggcactgtcaacagcggtatgttttgagcaattggtttctgtgtttatcgaatttattgtgaattgaccagaattatcagtatttgaacaaactaaaatgctatgttgtggtcactaatgtaaaaatgtgcgaatcttcaacaataaatcaatacctgtggctgcagtcttcaaacaaggatatgaatactgtggatatttgcaggaggctgaactgcaccttccgcatttgcatttcctttgatatgatttgtcatgagtcgactaagacattaagatttttttttcaggtcattgaagattttctgccaattatttcaagagtaaaatctgtgatgtcctcaaatggaagttcgaagggagaaatcagttatgcaaaagagcatgaatctgtttggtttaaagggaggcgattcacaccaaatgtgtgggccaacactcctggtgaactacagataaagcaattgaagcctgcaattgactcaaaaggtagaaaggtcggagaagaatggttcaccactatcaaagttgagaatgctttaaccaggtattcaatatactgatgatgataaccacttggtctggcaacctcacttaataatcaaattggcagtcttacccgatttatctgt

SEQ ID NO: 68703 - DNA, 8997 bp, Oryza sativa
ttgttcttcacaaaattgacgggggatggcatattatgaccaatggtacccaaccaattggtattggcgggaccttgaatcttgactggtatatgatgttactgattgggtgcatttctgagagggtattcactatctccatgtcagccacctattaaaaaaaagtcaaaagttcagaaattttcataggagtgttcgacttgtttgtgcccagcaactaaatcccacttcggtgaagcggttgaaccccacaatcggtgctagtgatttcctccctgtacaagtggaaaattccatcctaaaatacagttagttctttttctgttttgtttagttatatgcatataaggatgcctccgttgggctcaagagctctagtcgtacatgaaactgagatcttatcgaatttaagtgcatgttatggaagctgatttatttagagggagggacttctgactttgtcatccaggatttggaaatgtaatgctttggataaacatgagttagtggctaaacaggagtgtcacattgttctaactccacactcttaaaggcatagctctaaaggtggagagtgctccttcagctttttgtaatgggtgcctttcttttttgccccctctcttgctgatagtagattcagtcacacatcatgagtttttgaagttcgttttgttggtgagggcttaagtacaaggttggtgattaacttgctgtatctacagttctacagaattttctttcttttattagaaacacagatataggttgttcattaaatgtcaatgaactaatagtgaaaatcaaggcagatatagttagatgaagtgtgcacactgcaaaagagatgcacagattttagaagtatataggtttttcaggaaaaaaaacaatttacaagtatatattccctgggaactggaactggatctttgtacatcttcttgttatataatataggtctataattgttctgttaagtaaaatactctggatagtattgggtttgtaagtggaatgagaatttctctagagaaggaatatagttagaattgacatgatgagggaagaacaacctcagtgtgaagtccagcaaatgagcacttggcacagtttttactttcattgtcctttctccactaagcatgctgcgctgtccaatttaaaatgctaccatgcagattctgggttctttgcaattgatttctctggagaagtacctgcagacatcagcaacctcgtcaaggtataaagtagctttccccctcgtcttgtttgtactcactactaaccatggaagatgaatggcttgaacatgcacatggttcttgagagcagcaggaggaggaggatgaagagcaatggctaagctccagttcaagaagctcttcaactccatggtgcctttccggcctcctaggtggtcggctgaggtacgcaccaaaccggcaagtcacaaaacggcaatggtgaaactccagcaggagtccacccttttcttttctgcatttccatccttccagttgtatcaggtggtggcgaaataatcagaaatatctgtgtgatccttaatatcaggtggtggcaaaattattgatacctaattgctgagtcaatgcttgttttatgtgtactctggaaattgccctactactaataaatggctgctttttatctagaaagatgctatgttgtctcatttgattgtctttgtgccagttagcagttggtcatatccttgctttgagacaaagttgcttctgctggggggatggagagtacacctcatttcatttctgccttatgccattgcaagtatgttgatcctgtaaagatctgccataagaaatcgatttgcatgttatgttggtgactatccagttttttctattgatatacgtttccaccgaggcagaaatttccaggtaaaaaactatgatttgaaatatgccaataagatttttaaaactgaaaagaggaggaaaaaattcaaagaagttttcccttttgctgctgcctgctggctgagtccagcatttcttctgaacaagcccggaatgatttactgaaggaagatgaattgttgcaacgcaaaagagtactactactttgcagtggtgcctgaagcagaactaacttacagttacatgtgtttcactgactcctaagtccttgaacatgaaaccttaagactcagacgtggaaacttcttgcagtgtactctatgaaaaggcagctatggtttcgatatgaatatgtgatgatattcttcagatggtacatcagttattaagctctcatatgtacatgaactaccgggaggaaagaattaaaacctcatcatcttattaacgattaatctgcttctacctgatctactcactgcaggattttcctgtgtttatgtgcacctctaacatgaaccatgttaccactcatcttttttttttcgcctgtgccttgtgtgtcaactgtcaagagattttgagaaatcaacttctcatagtctccacgatcctctccctgcctggagcagcgaggcgtacagcagctcgttccaggaatccggcacgccgggcaggcaccagtggctgcagtcctgcttcgccaccgccgccatccgctcctcctccgtctcgtaccgcacccggtacaccgacgggtgggcgtccttgcggtagtccgtcatggcgctgatgttgaggtagatcaccggcgtcgtcatccgccccagcacctgctccaggatcctcatcttctccgggtactcggcgaggtgcgtccggttgaagatcggctccgtctccctgtggcatctccctcctgagttccactgccctcccctggaaggtgaagatggatcatcagatgagatggaggagaagaagaatacgccgtgtgatgattagagttcaaaattccggaacaaaatttggacaaaatattaccaaattcaccaaaaaaacatgaaaaactttaaatattttggctgaaataatatcatatcggggtctgatacaactgaattttctaaaatttcggtatatcgacaccctctgatacaaacactgaaaacgaaagattgaaccctggtgatgatcggatggtgcgacggagatgtgtgattcgatctcttacctgaaatgtgtgagggagtatcctctgaacaccacctgagttcttgtggagtcgatgttcttgtcgacccatctagcccaggtggtcagagctctcttgtatgcgtccatcacctcgaggctggggtgcacgtagttaccttcttggtagtaattcagcctgtggagacaagaacaacgtttgatcaatggtttggcaggagagggtgaaatgacagattttgtgtaaagtttcatgtggaagttcagtttggagaacggtgtgatataccctcttgatgttttccagtgcgtccaccagtggccggtgttgaagacgacgatgtcggcagtccggtacgccggagtcgtttcatcgagttcatccaatctcaacttagcgtccaccacggcgccgcctttggtctcgttgatcatctccttgactagaaatattgatcttatgaaatccacggagcaattgtaatcctacaagtgcagtgaaattagccatgagatacaaatgttgacaaaattcagagctagtgttgttcagtgagccagcctagctgtgtaccctgaatctgaaggagtagtatcccctggtcttgaactggttcctccctgacgcttcatacatcctcctcttgtccctgacaccatgccgcagaatgcacaccagagactcccacatgttgcggttcagtgagtcgccgacgaatatgatcctctgccctctcagcctctccagaaaatcaatcgggttcagcctgatgaagcagaagagaattaagcttcgatcacaaatgcactcgaaatgatcttgaaatttttataattccgaagcgaattcagaaaggtgtcgcgtgcatattacagtgtacgtgacggaacaagatcctctaacgttacgcaacgtaacgtcagaaagacatggtcgctgacatgtgggtcccactgacctccggttctcttggagttactgggaagttcacaggagctgaggttgttgggctcacctggggatgtcgcagccgtgcggctgccacctccacctgaggaagccggtgtcggcgcggccgttcttgtggcagttgaagtcgtcgtcgatgtgggggcacgagcccggcgggtagaacgggtaggcgccgccgccctcgtcgtcatcgcgcacccagcggccactgaacacgtcgcacttggcgaaggagaccaggccactctgcacgccggacgtccagacgacgcggttgtcgccgacggtgctggtgttgatgatcgtcgcggcgggcaatggcatggcggcgccgtcgtcgcggcgatcgggagcttcttggcgcgccgccgccgccgcgaggaggacggtgtcctttcgccgcctcgggtgctggtgatgctgctgctgcttgtgcctgatgcctctccgatggctgtggtgggtgtcagccttcctctccggcggcgtcgatggcgtggctgcggctgctgctgcggctcgcggcgtcgccgtcgagttcagtggtggggccggggcgtcggtggagttgccgggagcggcgacgatggcgtggtgggtggagttcttctcctcgtcccttctctgccatcgcggcattggtgttgcggtttcctctcgctgctgtcgtgatcgcgtgccattcccgacgcgttgatccccgtcgacgtcaccgacggtggcgttcccggcgcccgaccggagatcagaaacccgcggtttggccgtttgctccgccgccggcgccggcaaccccgagccctcggcgccgctctgcgttctacgcgcggtgttacgcagatcagcgccgccgccggcaggaggaatgggcgggtgaggcgggagagacctcctcggcagcgccgccgccgacgtcgagttcgacgacagccacgacaggagtgacgacgacgacgcccccgtcggggaagggaacgaggcggcgtccgcggtggggccgctggcgacggagacgtagaagaaggccaccacgagcgcgacggagaagcatgccagcacggccttgctactcgtcatcacatggccgccgccgcaaccaccaccgccgccgtgcttaccgccgccgcgcttgtaaccgttgagcgacgacgacgacgaggacggggagaggaggccgtggaggtgcacgtgcagcgacccgctgctcccgccgcctccgccgcccgcgcctgatccgccgcctcggtccagcatcgacagccacgccttcctccacgcgccggccattcaatagctactagtactagctagtcagcgtgatcggtgtgtccggctagccgcgcgccgccgccgcaacttgctggggagtgaagcgagcgaggagtcgaggtgtgtgcgcgactcttgcagcagttggtgataactgtagtggagtggagtggatcggatcagccagagatcgaagtgcaaccgcttttactggttcttggccagtgcccagtgcagttagggtcgtcgagctccctctccccgcgcttcgcctccggactttttccaaacaccttgcatgcaacacgatctcgtcgatctcgtcctcgacccttcagaatagactaggaggcccgtttataaatctaacccagccaccgagcatctcggcccaatcatctattgctcctacatggaggcctaacacagaactgggccgagtcatgggccgcaccctcgttatcttagggttagttacccatgaaatcctgaccgtttaatctctcgtatctgcatcctgaccgtcaaacaagattacacggagtactaattaacccaccttctataaaagctcgcccccatctccctccgcctcagcaagcgccgctccggttaataatagcaaaatcccctcccacccccgccttctctctggaagcttcctcctgctcttcgccatggccggcggcgggaacctgttcgggagggtgctcagctacgtcgtcaacgagttcatcgtcgaggggctcgccaacaagtatgatcccccaatctcatccctctcctcccccctccccctatcttcagatccgtctgtacatgtatgcgaattcgtttttgattcgattgatgtgctgcgatcggtaggctttcgagagaatcaagttcccgacggagtcgtcatctcgttatcgtgaagtgatatatgttcttaaattattttttctcacaacttttcgaatggatgtcatggaacaaacgagattatgcgttcttggaatctgtaggagacggactaggatttggagtcccaaaaccagcacttgaccgagtcttttgttgatttgtgtccaatcctcggtactctagtgttgatttgtgtccaatcctcgtactcgggttcatgtcgtgtccgatcctcgtactctaggtcaaccaacttttatctccgccgcctccacctcccccggtgtagcagaattctcttccctgtgccatggcctgtggtcctggtggcaacctgttcggaagggtgctcggctacgtcctcaacgagatcctcgtccaggtgctcgccaacaagtaataatcccccatcccatcctttatccccccaactccttatctttagatctgtttgtcacatgcgaattcgttatttgtttcatgacatgtgattgctacgcttcgtcatctggtctgtgggagaatcaagttcccgatggactcgttcccttgaagccacattgtctcgttgtatcagcccttatcttgcgcccttgtagggtttcccgtgaagttgggcgcagtatggctcttacatacatgttactgtcaccatgttttccagtaatatgcgtaatgtctgattagtgtatggaatttttgttagttgtgcctgtggcagtgatgagccctaacagacctgtaatgattcttgtgtatatgatcgcttgattcaaagaacatctaagggactgagttgtcatatatgcacaagactggtgttgtctagtctagtaaattgctactgtatagtacattgttattctgtctagtacattgttactctttctagggatgagatgtgatcgttacgcttcgtcatctggtctgtggggaatcatgttcccgacggactcgttcccttgaagctatattgtctcgttgtatcatgggcctgtcccttatcttgctccctcggaggatttcctgttaagtagggcgcagcatggctcttacatacatgttactgtcaccatgttttgccatgcgtattatgcataatgtttggtaactagtatggaatttttgttggttgttcccatggcggtcttgagccctaacagacctgaaataattattgcggatatgattgcttaattcagagcacatctaagggactgagttgccataggcatatggacaaaactggtgttgtctagtacgttgtcattctgtctagcagagtagttgtttgtgttagtgatcgttaccgcttctcgaggttcatgcttaagagctggttgtggttcttgagctttggaaagtgaagcaaaatactttgtggttcctctcgctatccggggcagaattctctttgatgttactggacgtcgaggaactacattagtttgcttgaaacatgtagtcatctcggtgttgatttgttaattgtgtcatgcaatgttttaatgtagtttttgtgttatcatctggtctttgggaaagattaatgtcctgatattcccagtagacttgttccttggaagctacttcctctgtttcacaatgtaagactttctagcattgcccacattcatttagatgttaatgaatctagacatatgtatgtgtttagattcattaacatctaaatgtatatggataatgctagaaagtcttacattgtgaaacggagggagtactatcatgttgtattatcatacataggcttcccttttcttgcgcccctggaaatattatcatacataggcttcccttttcttgcgcccctggagatttcccatgggacatggtacttcatggcttttttactttcatgccatcttaccatgttcatttgacggtgattagccctaacagacctgtaatgattcttgcggatacgatcgcttgatcaaagaacatctaagggactgagtaatagtatgctttgtatttccatctttggtcattggttttaatggatgatctttatttattcgaagcttgtgaattactgcatggcaacagtgatgagtccttacagacctgtaatgattcttgcgggaatgatcgcttgattcaaagaacatctaagggactgagttatcatgaagcttgtcaaacacattttgtattatgtgcttgtccattagataatctttgctcccatctcttctcttgatttgtctttcatcctttgcttgttaatgctgaagtaaaaaggcttaatttaacacttcttatttcaatcctgctgagcatttctgtgtactttcaattgtttcctattgtacttgtcttgtttctgttggttcttacagtgggacatctcaatttttgcagccgtaccttccagagatttgctgtgaggaccaacaagtctcttgagaatctatcgtccaaaggtagtttgcttagcctctgcagtgattatagtatatactggtcatgatagggttaatctatgtgttatgacctcgtgatattctggtgaattgttgcggaacattacaataatgttaccgatttgtgcttttcagctaaagaagtgagggaggagctatcggagcaatggaggaattctcgtggcaatgatgatgtaagtggttcgcatagagctttatactgtttcatattccatcaagtgctgtatctgatcaaattctgttttgcaggggctgcaggaat

SEQ ID NO: 68704 - DNA, 14882 bp, Oryza sativa
ggcaaaattcaaattatcaaacaagcttacataatacagtaatttacagacagaagtgtgatcggtcaaaattcaaaaagctaaggaagatccacactaaggcaattttgtgatgtaaagattgttgttaaagcgtcaatataatctacaaaatggagtacttcaaatataatcaacaggaaacatctttgaggaccatacaaatatatagttttgcgacgggaaagctggcatcacacaaatatatgtgaatgacaagctatggaacagacatgattctaccaaaagctcatgtctttaaataaatcagcacaactttgaggagctacctggaaacaagtccacatagtgatacttgaactgagtgcaatggcactttcactcttaaagattgcctaggttctccggttgccacacacggaggagtcgatcataaaatgaacaggtagcaacaactgaaaaattcttgttctgttctgcaccttcatttatctgccaatccgcaccatatgctaaggactcatgcttgcaatatgtttccactactgcagcatccccagtacctactttaacaatggcaaacccattgtgcatgcatgcagccaagacaacatctgcaataagaggatgatatttaatcctccatacaccaccccctaaatttagggacttcacattaacgggtttcaccattgatcttatgtcccaaactctgagaaattcatcatagcttccagtaagtagcatgttcccctctagtggattctgagcaatgcaacagacacccatattatgcgactttttgttctgaaacacagcatttgatgggttctgtcgcaagtcccagcagctgaaggagcagtcgtctgatccgctgtataacaagtgtggatttgcacgatcaaaatagcaagtccacacttcatactgatgagcagtccactgttctgatacctccaagcggtcctccctcatggaaaccacagacagggaaccatccgataatccaacggaaagtgccttggcagtttggttccagtccacaaacaagcacatcgaagaagaaatgtctccagaacagacatccctgagaacagcacctgcataattcggtcacataaagcacttgaattcagcctcaacatataagaaatacatggtggactacaaatatgacaaatactgaggtgtttacaaatagctacacaagctcccctgcttccagtacagaatcaactagactatcgtggcaatttaactaaaaaatcaagaccaaatttgatccagaaatgcaagaatacgaattgacttagaacatcattcagcagcatattgccttattctcaaaagaagatgacagacacggatcacctccagaagggcagaatattgcatagttgaagcaacttcttgttaatccagattaaccactgggaacacatccactcaatccatgagagtaagaaacccatttcaccaaccccccccccaaaaaaaaaaaaaagcataacccctgaacccctaaatacttctgcaagcatcaggcaacattcacatggatgatagaacgctttcagaatcctaagaacttgaatttgcctttggcatcagtagcagtgcatcactatgttcagtaaataattcatggaagcttagtaagtggatagtgatccaattttgacacagcagacaacttatttgattctatggtaatgcaaatgcaggaacaaacagcacctttgtccgatccgtcctcctgctccaggcgccagagcgcgaggcggccgtgggcgtcggcctgcgcgagcagaggcgccacggggctccacttcatgtcgaacaccccggcggtctccaccgtgtggagcagccggagcctccggggcgcgtcctcctcgccggcgtcgacggcgaagagcgacacgctgcccgcgcggtcctgccgctccccgccctgctcctgcagcgtgtaggtggcggcggcaacgacctggcggaaggggccgtgcaggcataactccaccgattcagttttgccgccgaagtagcacgaccccaaatccatcgccctggaaaaaccctcgcgttccgcacgacgcggttcgcggcggcggcggcggcggcgagagtcgagagcgctttcacttccgcggcgaggcggcggcggcgggggcaaaatagtcaaacacttagtccataccggtcactatatacctatcctgactggggacgtggcggacacccatggccaccctagccgccgcgatttcggcgggccccgcggcgcccgcccccgccgctcgccgccgccgccgccgcgggttcgccgccgtgagctgcggctcgtcctccgcggccgacgagcggcaggccctcttcagccgcatcgcccccgtctacgaccatgtccgttacctcccactcctcctccccttctcgcaaaattttgaattccactggagatatgtatactaccagcagcatcgtactgacgacgggcgcagtgccgtgttccttgtagctgaacgacgtgctcagcctcggacagcaccggacatggaagcgcatctgcgtgtcttggtccaggtacgccactagtggcagcatgcatatactcttgttctgcaattggttgatggaaaaggttgaattattgtggtcagggcaaggagaggggatcgtgttcttgatctctgctgcgggagtggggatttggcattccttctgtctcagaaggttggcttggatggacaggttggtgttggatttgcttggctgctttagatttcagaaagaaaaaaaaatcgacttgaatgttctagcccaagctctcatattttacaggtgatggctgttgatttctcaagtcagcagctgcaaacggctgctagccgtcaggatcaacgctggaagccttgctacaagaacatcaagtgagcatcctcaatgtgagagtttgtagattaagaacaacctgtgatatgtagttttgtgattgctgttaatgaagtggacaggtcgtgcgcgtggctgacagatgcgtgctttggacctctatggttgcaggtggatcgaaggcgatgcacttgatttgcctttcacagactgctacttcgatgctgttacggttggttatgggttacgcaatgtggttgacaaacccaaagcaatgcgggagatatttagggtcctaaaaccaggtctagtgcagattccaaagtttttttctggttgatcatgcttatacagttcagcagaaattttcatgattgggtttcgctggactgcaggatcaagagcatctattctagattttaacaagagctcatcacttttcacaacgtcattgcaggtaaaatatcagaccatctatagtacacgcaagtttggcttgtgtttgagatcaaagagaaagataacttcctgattattgcactatgacaatgtaacaacatcacggtctcacggatggatcatgcgttgacttccagtgtcaatgactttgggttggtcctataattccctaaccaaattgatgttttcccttggacagagttggatgatcgataacgttgtggttcctttagctagtggctatggactcactgaagaatacaagtacctgaaaagttcaatattacactatctaacaggtttgcatttatatttcctttgtgagaaaattcccttgaagaacaagatggtcacatgttttaccactttttaagcaatactcgagtaaaacaaaaaaaaattataactttagaaaaacaaaaaagtaatgacacaacttacatttgtcattctgatagtagcagtacttcaacacacttctcaattaatcctgatggagtacagtaggaatcccttttttttcgctcacaaggccacgcatctaaagattcaattcatttttatatgagaagctgcattcttatattccaaacagtccattggtcaatgccctttcatcagcgaccaaagttatctctcatgtatttaccttaatttatttgtgctggtttacgtccattgtagaaaaggagctggaggagttagctaaagaagctggcttttctgcagccaagcattatgaacttggtggaggtctcatgggagacttagttgcaactcgctgagtagaatggttgtgaagaacctgatctgtacaacttacctgaattttgtagctgcttcattccttttccctctacatcatctgatagttatgttccgctgatccaacagggatcatgcatcaaaaactcaaaactttcgtgatgtatatttcctttcttctttaataaaaaaggacaattgtaaccacctgaaaaaatcaataacctgcaattcatgatagtgcaggagcggttcgatcaaaatcagacgattgagatgaaatccggtaccgtgcataccagcgacctggcaacatttgagctatctgactggaaatcagccagttcaatcaacgatccggttatcggaggcatgaaagcaggtgagaatctcaagccctcaacccaaaggatctccatagtgtgcattgccctgatttcagaatcctctgtctgatgattaatcggtccctattggcgacagaccagatgtgcactcgtatttatgggcagagtttttaatcactcgtcagactctttacccacttcgctgcacaacgggacaagtattctgtagggtcgttataactgagctcaacgaaccagccaccaaaatgttcgcaatataaattctagcaacgaagttttactgagctattacaaacaaattctccacctgataaccgaggagaaaacacatgccttaaacccccactatccaataagtacccttgcaacattaacaaaacacaacccactgtaggctcttaattcacccattacttacttactttcacccctaaaccagattcaccatcactttcacctaaaccagaaaaatcaaagaaggtagagagaaaacttcaaaacttgaaccagcactattaagcacatacagccagccacacattgtaatgtagtagtaaatatgatgtactctctgggcaaagtagtagtgtcctgtgaatgcctgatgagatcgatcaattcctcctctcgtccatggcgaggatggtgctgaggttcatggggctgatgtggtcggtggagccgtgcatgatctgcgcgacgatgagccggttcgcccgctccgtcgggtggaacgcgtcccagtacgcgtacacgtcccggttcgcgcacacgttggacgccggcgtgcacagcccgataccgttgtacggcccctgcccgcagcacgccaccttcgccgtcacaaaccctgcaaacccccacaaacacatcaaaatcatctacatggatcttccgtctgtctcagaaaaaaaccaacttctaaaaacgacttctgttcagattcatctctgaatttttgttcttggttggtaattggttaccgtagtcctgggggttgaacatgaagtcgaagctgatcttgttggtgttggcggcgatgaagacgtggccgccgagctcggagttgagctcggcgagcatgcgctccagctgcgggttgaagaggtcggcggcgcgcgtcaggtcggtggcgcactcgccgtcgatgctgtgcatggccagctccgccggcacgcacccgatcatcccggtgcccgtcacgatcacccgacgcggacccagatcgtgcagcctctgcatgcaccaccatatacacggacgcagtcatgtcatttttcctttcaagacgaaggacacaaatacaatttacatgtacacgaagctgcgagcactgcacgtctgcacgagtggcaactggcactgtcgttgcatgtggcatgagtaaattttggcacgatggcctcgcgggtacacgagtgagtaaatgcgatgacacaacaagccccctctacgatgactgcatcctgcttgtttttttttacagcgttaattgtcctacttggcatattcattgcctctgcagagtgaaggtgtggtaggtgacacagcatgcatacatccacccgaacggcgacgaggaggaacagtcggtcagacagagtactgtcaccgactcaccgtacggtaaaacttgggtgctagatgtactgctacctcctacctcttgaaattatttggtgggaagccgatctagtagtagtaaatgtttaggcctattggcattgaaccccatagatcatagtaataagctattcataaatcatacagtaactcaagagtgtgaaggaatgtgtagatctgaagcagagagatctgatacagtgacttgcccattttcatttactggcttactgctccttgtaatgaaaatcttgtacttctgataatgcaaggcgtgaagcctttttcgcattacactgtacttatattgcttgtcagacatgttaattgtttgttgcagttcgagctcttaatttaatgatgctaaagttagcataatgtcctaactggaagtatttttacaggtattttaaatagtcgctacaatcaatctataccgttcatattttctaatctaacgatcatatatatttacgatgtgccttaactactagtagaacagtaaatcataaattaacggttgatgatgatacaggtattggtatacggagtacattactactaccagaccacccatacttctattttcttcctttgcagtggacaggaggatgaagatgggggcttactgacactgactgcaaatagtgtgagatgaactgcataatgtattcggcttattgttttcaacaggaactttctcaggttgatacagaaaaaattacaggtcatgtcattgacaacatattacccaaaagagactccacaccaggatatgttcactctgcaggctgcagcctgcactttctatctattgtttgcagtgccaacagttaacatgcagcattgttttctactactgcttttatgcaagtgagttatgctcatctgcttcgatcggctgagtctctactgaaatgctaatcgtaaatttgccaaattctacctttggtgataacacggaagttaattgaggctacttattattctctagagcaagaagaaacttggaatcgatgagatgagactaaccgtgaggatcttcctgtactcggagatgaggtaggggacgtaatcctggatggcgaactgtcgggacctgacggagaatggcaccaggtagtagttgttgacgaagtcgttgccgccgagcgtgatgagcacgagcgactgctgcaccacctgcctcgccgcgtcctcgccgacgaacgccgccagattccgctggtagttctcgaagttgtccagctgctgaccgatcctaattatgttcacctgcacccacagcaaaacacaacgttaatgcgcatttgttcgtgacgaaaatggtggcggatgcgcgcgcgggggggcttacgaactggatgccggtgtcgttgaggatgccgacgccggcggaggcgaagttggcgccgacgagaaggttctcgcctcggaggtccgggctcaggtacggcagagcaggctgggacccgaggtactcgcctgagcccaaaaaaaaaatgcagcgtgtcaagaacagttgtaactaactttgtgcattgcattgtgtttctttttacaagtgacagtgatggataaggtgctaactgatgatgtccgggatgttgagcccgtttgagaatctccccgtgggcatgtgcgtcgggaagtcgatcccgtacggcggcgcgtccgcgcgcgccgtcgtcatgaggtagttgttgttgccgttgtccacgagcgagtccccgaacacgaagaacgccctcggcgccgccgccgccggcgtcgcggcggccacgagcagcgccgccaccgccgccatgaggaatccaaccaaagaagaagcgcccatcgcgcgcgtacgtcggcgagactcgcgacagcagctgagagtatacacttggggctagctgactggcagttggacagtgggcgacacgacggtggatgtatggacggcgcgagggtggcggcgttcacgttctcgcttgcgatctctcttatagagggaggccgcattcgcgttcgcaattcgcatcgatgtctcgcgccacgccaccttaagacgcgcagttaaggcgtgagcagtgagttagcggggcgcgggacacggaaagcaattgcgcgcgaggaccaccacaccacacacccctcttctctctcgcgcgcgcgcgcctgaccaagcacgcaagctagttgtttttgctgctgcacgccgcagatgcagggtggttggatgctaaatgcggcgcttcgcgttgcgtccccgcgtacgcatctcgccctcggaggccacttggctggcccggccctgccctgccctgccttgctgtgcctcggatcatgtgcatgcacgagaaagagatggagatcgatcgaaggggaaagaacgctgcgagctcgctgttgctacctaccaccagaattgcattgctccccagacttgaaagctagtgaacccggcagtacaggaactgaatcctcttccggccgggatgcattgtgcgtgtatagtcatcgtcaattattcagttcgttccagatggagcaggggggcatgcgcagctgtgcgtcttaatttgtttctcattgaattcgcctttttggtggtgtctccataggaggagaagatgtgtttttgcaatcacgagtgagagcgacgcgtgttaggatggagattagtgtcatctggattaattggtatatatcgatcgatgatcgatcatttatggttggtctcacgattaatgcggtcgatcctctgctgttcctgaaagtagaacagtgtgggacatggagcgcggacatcttaatgaagaatccaataagagaaaatccgtagctgaaactaagttaactaactcccgctcaattcaaatcgggtacgagaagcagcacagtgacaagatttaaacctcaaaatcggtcgtcttcctttaatttgggatgcgtgataaacaacagtaatctgattctgctactcaaggcaagctaatttgattttccaacaaacgtactaattcagagtttcagactcagcgcgctagctcctctttccgctttctagacagagttttgaagcgagctctctcacggacaaaagtcgcaaccatgcatggattctacaccgaagatttcaatacgccatattgtttttcatcctcttgggctatctcagtcctcctaactagtaactactcgtacctgcaactcgtgagaggttggcgagttaataatgtaattaaatcccctgaacatatactgcacttaccttccatcagaaaaacattgacatgtcataattcagctgacagctgggatagatagatgtacatatatcatatatgtatggtccataccgaagggagtttaccacttacctagctagccatttcatttgccttgcggccatgcccttaccacacttaattaccagttaccagtaacgaaacaaattgactctgacaggtacatgtatacgcattccatgtaaattcagagtgacaattgtgatgtatagatgtatacgtattccatgtaaattcagagcgacagttgcgatgtatagtgcacatggccgtatatacagtatacacacggagcatcatatgtatcgcggccgtatactgcgtcgtaccgtacgtatagacggccagctttcatttattgtacttgatccagtacgtattgcgcatgcatgcatgcatgcatgcgcgtagcagaggggacgccacgccatgtgagattcattaagcggtggggtagaaatcatcgatcaatcaatgtgtgccaccacccatagctaataccgcctactagtcgcacgctcgtacggcgagtgagataaaatctcgaggcgtaattgcgcagcgctgtaaaaagatattcgccggccggcgattcgtcctatgtactccatcttctgcaaatcgtacaggctttgcagcgaagtactcctacttactgatctgccagatcgggctgtaagaacgcattttggggtagagcctcctctattcttaactttccatcacatcatattacataaaaaaaacttttctacacacataaacttttttttttttttacaaactcccaactttcttcaaacttccaacttttttagaaactaaacacacccagagtattactccatgatctaccaattgtgatgtaatcgagttgtatttctcgacttcaaacttcaaacttctttgttttctgttaacacgcttattaaactgttatatgatattttttataaaaattatatataagttatttaaaaaattcaaataaactcatttttaagtttataattattaatacttaattaattaattatgtgtaaatgagatttcttgttttgcatgcacaaaaaatctatctcaaaacatagagatcgaacgctcaccagcagctatcaaactcgcgtcgtatgtatatataggagcgtattcagtggcatgcatgttccagttccggttctctctgtgtacgtaggtgtgttctgaaatttcatattcagcgttgtatatatgtactactcgatcgagcttcatcgagctgtgcgagttcaggaaagaagcagttcaggaatttaggcacagctcgtcgatcgagctgtgcgagttccaccaggaaagccatacacaccgatacatgcatgcacctatcaagcagcttcacatctagaccatgcagttaattgtacagtactcaccatgagtactacagtaaaattgtggagaggagggggacaaggtaaaacccgatcggtcgttggctgattggctctctgctgttctagctaccatctgtaactgtaaaggctaaagcgagcatttactcgtaacagctggctcccgtggactgatacacatgtacttggtctgcagatcggctggcgaatggcgatccatctgcaagctactgacgtacaattactctcccatctcgcgaacgccgaacggccggccatcaagggtgtgtttagatcacgctaaaattaaaagtttggttaaaattgacacgatacgatggaaaagttaaaagtttatgtgagtagatcgagcagccgcagaagttcctgctgacactcctcgcgatcgaccggctggtctctctcgagtctcgacaattcacacgacagggcaatgcaggtcgacgaggccggcttagcggccgtgaaaactgaaattactcacagatcgatcgatctcgccgcggccggccgtacggagcggcgcccgaagattccaatctcttccggccgtcccggtggtctcgctgtgccagagtacctgctgtaacaacagtgagttcataaatcataacgcgctgtaacacaaacagtgagatcagttcgtattaactgctcgatcatatcgtgttctctcgatccagatcggtccagctccgctcctcattggatcgatcgagcgactggctgctaggctcttcatggtacgcatatacatatatgcatgtgccgtttgatccgaagcactgcaggcacgcacttgtgttttaactatctcttcttctcgatcgggaccagctttaaaacgacgctgcagtgctttaactgtgtgcagttaactgtgtagatgtgttctacatgatgatgtcgcgttccgttttctgaactgaacctcctgagtcctgagcaaacactcgacgggaagatccagacttgcagagctcgacgaacgatcgacgacgacgcatgcgtgcgtctggttaggtgaccgttcggctgtgggccgtgacgggacacgcacgcgctatctgggctgagccttcggcgtgtacggacatgccgggtagcttatgggccgtcccggtatggtccatttctgtccattaataggcttgccagatgatttcatggcgggccgaacggaggccgcctgtctcgccaaaaacggcccagatgagcgccggtcagcatcgcagccatatgacatcgagacatacttcgtggaacaaaccttttgtggaataaaccaacctattacgagatgtgataggagatataaaaggacgtgacattagatatcacattccgtattagatttatttgttttgagacaagagaatatgagatatagatataggagggatgggcccacataatttttaaatttattcgataactagctgccacgtgaacaaccatgtcgactaaaatcactctcaaagcagtttcttgtgagtggtgatatacccaattttacagctgagtggtatgaatcatattcaaccaatataggagggagtcaaaatgctttctccagtccattagtatgcgagaaagtctattttgacttgctcgtctcgtgcttctgattaaatcgcgttcatcaaccacaaaaatggataaagcgcatccctatttttcaaaatccggttcaaattgaatcctccaatgatctgagaacctgttttcgctgacgtgataggttgatcatgattgactcgctgagtcagcaagtagaacctatctgtcgacgacttctcctcgtctcatcttcttcatcgcctctctctctctctctctcgctactacctcaagggtggcatcttgaggagggcagtcgtgctaagcctcgtcgtcccgtacattctcgggatcaagtcatacatcatgctttcacgccccgcggtggtcgagcctggctaagcccgacgaccagcagcagcagacccttctttgtccccgtcaagtgatggccacggaaatgacggaagaaccccacttactccctctgtcccacaataaacgcagccgtgggtttcagtgtccaactttgaccatccatcttatttaaaataattttatgattattatttttgtgttttattggatgataaaatatgaatagtactttataagggactgaacttttaaaattttttaaataagacgacggtcaaacgttgagcatgaaaacttatgggtgcacttaatgggacgaagggagtacctctgttgtgagtgtcgtctccttgcgtggggaatcctcggcggcagcgagcctgggatgtggccgccgcttcttccccatgacgcgcggtgcgacacgtacaaccgcgttgtcgccaacacatggttttggttctgccccttctgcagctccctgtccggctatcgacgctccgcacgtcgcttgatgggacccgagatgcgcgaggaggtcttacagcaggcaatccgacagatcactgagttggtcctcctccacggcggccccgtcactgtctctaccgccttcgtcgatgcgggtgcgtgggtcccataatacatatatgatatgcctttctgtggccacaagaggagggtagggctccagctcttcaccaccgtcgctctccctgcatgcctctgctgctgctattggaacgttggatggaggaagaagattagatgagaaggaaccgcttcccaaaccaccaaaagagtcaatttacaccggtttgcaagatgagaaagacgttataactggttttacggttgagccaagggattcgaacaagacgtgaaggaggaaaaacagacttattccttaatatgcgtgctacatgactacgtgacggggcaattggaggccgaaaacgaacacgaggcagccagctcaggctcggcatgtctcgccaaaacgacccacgttaacctttaggccgaatttcgtggtgattgaaattgagacacaacttcgtgcctccgtgaaattggactattaaatagcctttaagcccaacaatggccattaaaatcagaggtccatttattcgtgggccacaacaaggcccaaatcgctgctaaatagctgctgatgggccgttccaatttggtcaattgatcgatttgagttgagtccaccgagagctaacaatgtttacgtcacattagctttcttcggtaatcttaatccaacatcttcagtactagtaccaatcgacttcttatgattgggttcatgctgttcagtgttcactacttgtcgatcgactcagcccgggctttcatttgtagccaactagccatgaaaatgtgctggtctcaaacctttttactactactccataagtatgagatgaggtaaatgattggagttgaagaccaggcctagaaagagcgtgcgagaacggacgatcgccttcagaattctgatgctgcccgtcctctgagatctgccacccgctgcactcccgcatctgtctgtctctccacacgacacccccgtttgagctctggagctcttaccctgacagtttcctatgattttttttattataaagaaagccattactgtctactactccgagttgaacctttgcaaaaacagatcacgcctcgtctctttcctactcagcagtactcaaccttttccttgtgaatcatcagagaaaacgctgcggccatagctgcagtgctgcacctgcgtgcactggtccatccatgcatggcggctgaacactgaagtccagccagcgacgccgatgctgagagagtgagagcatgtgtgcctctccaggctagtccagactggtgtgacctcgtggggtaaaagcaagcagatggtcagtaataaaaggagagatcaagattggatggatcatgggtctcgcggatggcgtgcgacagcacgagtgccccactgttttttttgcaaaagcgagccgataaaaaatgatggcttcagtacgtaatcattgtcagttaaaccatcgagagccaacctgtacctgcgatcccttgaagcatcggtaagctaccttaat

SEQ ID NO: 68705 - DNA, 2422 bp, Oryza sativa
ctgcagcccccttgaagcatcggtaagctaccttaattcagattaggacaatgcagtgtaaatgtgtaattaactgaattttcaatactgtttttagtagcttactgaactgagaccgctgactttgcatcagtgcaacacaaaatttatttagtactggatgtttcagactttcaggtttggatacgtggaattaatttcagggtctcccatttgtttcggcctttctgggaagcgaagtgatcgaaatgaatgcagcgtgcgtgtcctactgcttagcttagagatcaggataagattagctgggatgtaacatctcgccgtagctgttgcttgccagtactgtaggcgggctcgtctgctgaaatagctgcatttttcgacctgatttggtgatacgtagtacgtgcttccagctcctgttgaattcaaccaagaattcgcgttaggtgattggtagtaatagtagtactttggtgacggattaaaccaaaccagggattggcgacgaggcaacatcatcacggcaatacgaaacgattttggcactgtttgattgcgacactctgtcatgtcttgtactcttgtatgcttaagaacggccagttcggacagtagtaccagtactcctgtatcgacgctttagccataacaaaactacactttcaaataggggacacaaattttgtccgctgctcaaattatggccaaaattcgtatctgccgcggatatttgaggcaagctcgtagcggggcccactgctcatggagtccagttcacacctcaaaaggctttgcaaccaagaggggcctaaaagcgagaggttacgaaaaaccaggggtgtaaatgcacaaaagccacctaaagcccccccaaccaccctggcattcgtgtctcgctgcgcttacactccccttctccttcctccagatccggccactcccctcccctccccctcctcgactcgcctcgccgctcgcctccgggctcgaaaccctaggtttggtcgctcggggtgtagtgggtgggggcgggggggaaatggaggcggcgctggaggcggcgcgcgccaaggacacgaaggagcggctggccggggtggagcggctgcacgaggcgctggacgcggcggcgcggcagcgcgggctgacggcgggggaggtgacggcgctggtggacacctgcatggatctgatacgggacgccaacttccgggtcgcgcagggcggcctgcaggcgctctccgccgccgccgtcgtcgccggggaccactttaagatccacctgaacgcgctcgtcccggccgccgtcgagcgcctcggggacggcaagcagcccgtccgcgaggccgcccggcagctcctcatcaccctcatggaggtccgctcctgttgcttgcaatctcattggttgtttttttttcgttctgtttgggagctggatggagctgcaaatacgagttagtgttagataaggagcaggcttggcatcttgtgggcttgtttttgagtagttcgattcgtttattggggatgttgagctgcacagccgaacttaaatgagaaaactaaaattgtccggcacattacaataaattgataggccctaataccaaaattgatcaaaacactaaatatgattttcagggagcacttgtttaccgggtttgatgttaaaatgtgggatacaagtgaactttgaaacttcttccatgcatgtagtggcttgacctttattcggagcagatgatttaactttcaaatactcatattcaaagatatttcttttgcccttttgtgctgatatatatatattttttggtgttatagtgtaaatatatgatagcttttctcttttacttgtcaatgttgatttatatatactaaacgtgctatcatttttagacctttttttttttttacttttctacattcatcctatgatttgaaaggaccaatccaaacatgtttgtcttattatcagggttttggattattggcagctaaccttttaatctatctgtatctcaggtttcttcgccgacaatcatagttgaaagagctggaagttatgcatggactcacaagagttggagggtccgggaagagtttgtacgtacagtggcaaccgcggttgggctttttgcttcaaccgagctcccattgcaacgagttcttctttcacctgtaagtctaggcttcatttagtaatttctcctgtggagagctcctactttatttctttaatagatgggcttgctaagattttctggctttccaggtcttgcaattgatgaatgattcaaatcaaagtgttcgagatgctgctatctattgcattgaggtcagctgacgtcaaactaaatgattcagctaatgcttttcatatttttctacttatctagctctcaggggctgcagg

SEQ ID NO: 68706 - DNA, 831 bp, Oryza sativa
ctactaactctttataatatgcaatctaatcgaactctaggagagtaaattctgatccagtttggttgctaattacgttaagtggcaggagcaaagtcgtatccatcttgcccgccccaattttgtccacttggtagtatgccatcattgtgcatagtaaggggccttcgtccatgtggaacagtgggagagcttatgttgcgaaatgcaatatactatggcataataaactgcttaattcggatattatttatgtcgtactacatgattcgctactcaaaacaactggatttactgatgacactatggctaccactatgaggtcccaactaggtgtagttaatcttctatcaacaaattcccaaatattcttcagggagactgcttgtttgcaaaattgtggctatcgaaattcaaaacgctctcatcctatgtttctcatcaatagattccctgggggccattgccctgttacgggagtgagatacttgaaccccacatactcgaaatgttccacccaatgacccaaagctagtataatgtgattctgtgaatatgtgatgagaaaggtgcaagttatcctctgtatatttatttctatgacaacaatggtacgccaagttattttctgctcggctctccagaacgacttcggcttcaagtgagagtcagcatccgatgcgggtgacatttgtcaccgtgaacaagttgccagctcgcgacggattttacgttgccagagacttacacgagtgtgggggctcgcctcacgcttggcggtttggcagttttgggccgcgacggcgacgtgccgaagccgcatatgcatcg

SEQ ID NO: 68707 - DNA, 5286 bp, Oryza sativa
aaattacacatatagatatagtcttaaaaataactaattacacatattgcgactaatttgcgagacaaatcttttaagtctaattgcttcatgatttgacaatataatgctacattaaacatttactaatgatagattaattaagcttaataaattcgtcacgcgatttactgacggattctgcaattagtttttttattagtgtccaaacaccaaatgtgacactatatataatatctgatgtgacacatcaaaactttacaccgctatatggctgtatctaaacaccccctcaattgatcatgatatctttgaaaacctagcctcatatgagtagtaccattatgacattatttttgcatgagcaggcagcctggcacgcctggaaatggctcatgagtcatgactaacctgtgtgtcatgctgctacacacgaaagctgccggttcagggttacatagattgccggtttgcggacgctctctcggctcgtcagaaatgtcaggcatctcacctgtggagtctgcctcgcaagttcagctttacgtaaatctacaaacagtgagccacgtcacatgtgcctcagtccctcagtgacccggcctagtgtaattagtgaaacctatattacctaaaagactttagacagcttgatcatcctaaacttttcttttgacattttaaatactactccctgcttaggagaagctcgtccaactatccaagcactcgctagtgcttaggttcaaattttactcggagaaatatggacaattgtaggcaaacgcaagtactaggaaaggaatatctctttcacgggaggacgagacgttaaatcgtcggtattcgtggtgcagaggtaccagaatctgtcatcgtcgtacatccgccggaacgatggacgtttcttggcaagttaacccggggcggtgagaaattccttctgatcgtatctccccaaacaccaacacgccccctccccgtgccgcgcaccgacagcgtccacgcgtggaaaagaacaagagaagacgagcagcgcagcggcgaggcgacggagaggcacgtgacgagacaccgcgaggagtatagtaccccctgcaccagcagcccacaggcaggcaggcatgcggccgcagcgcatgcaggcagcgtggtcgatctgcccaacctgtcgcggtgtcgctcggctcgccgggccggcgtccgcttccgcgtccgcgtcatcagcctcagcgcgcgtaaaaaaacaccagaattcgccgtgcgcccgtgtgctcgtgcagctgtggtggtgtgccgcgcgggttggctaccggcgagggagctgggacctgggaggcggggggtggatggggatctcgatgagcggggagtacgtacggctccggcctaactcgcccgtttgctcgcagccacacttgggcgtacgacgtccgcgggaccgcgcgaccgctgcctgcatggctggctgttctcatgctgtgcagtgcacgctgtacagtgctaaccgcgggcgggcacagaccccagacaggcgcgcagtggcgtcccgatcgaatatcgatcgcccgagcccccacacctcccgtgaacgcaccacaccaaagctgaggccagaggccagagccgagggtaggacgaaaaccaaacaaacgcccgttgaggcccgtctgatcaacggtgtaatcgcttgcaatgtgtcaaaactcgaaagggagggtgcaacgagcgaagagttactgtaactgccggtccagagaaagcagtccgatggatcaatctgttcgcggtcaacgtgctttacgtcacgcctgtacgaacagttggtgcgttacgacttgactacggattaccgagatgcttgttttccaaagctccaataaataacggccgtgttattacgtgggacttttgaaattgaatctcggtttgccttccctgtcacaaaacagagaaacttcggttctcctccgtaaagaaaaccacgcgtacaagcgtacaacaaatgaataaatctctgcacatttacacggtactcctactccgtactactactacgactggaaggtagcagtgccacggattagccgaagaaagaaggaacacacatggcgtgttgtgcagccgccgctgcttcccgttcttttcagttcagttaattactcccccacttctcatcatcccatgtccactttctttcttttttttctctcttgcacgcacgcacgcacgcaacccacgcgcggagtggcggtggatggatggaacgcgtgactgcgtgagaaggtcaagagcaaacaagaacacgcacagtttcacgaaggcgggtcggggttaaatcatcccaccaacaccaaccaaaccaaccaaccaacctccccacaccgccgccgtcgcgtagcgcccgcccacccccgcgctcgccgccggcgggcgaacgctcgccatccgcccgcatcgccataggtgcgcgcctcccgattcccatccttttttctctctcccaccattcccggaattaatgcacggatgatggatgagttgcgtgcctcctatccgatgtttttcgtttttcttgccttctccgttagatcttcctcttttcatttcttctcgtttcagctccgctccgcaaaaccctgatgatggttgtcctcgaccacccattgcgtgcggcatttgatccgggcgattttttctttccttttttttttctttaggcgaggtggtgtgtgttcgtggaaatcccggtggccgtgcgggaggggcgcgcgtgaagatctgagctcgggtttatgtgatatccctcggaccgaaattcccatcgatgatggcgtaaaggcggcgccttttctctgcagttcctcccctcccgtccctttccgctcccgcgcccgagaatttattgctcgcaatgctgccctctctgatgatgagcagagcaaaggatgcagagcctttacactttaaatgcttggtcggtttggctgcaagatgccatattgccatctcatgcgtaccaccgccatccgtccgtcactgagctcctgcttgcgtagtgacgagcgttctggtttcgctcagctcgtctcgatttcacacggattggaattcggccgcattccgcgtggaaagcttcgagttcttggtgcttcttgttctccgctgcgaaaaccgcagctttagtaagagctcatcagatttcctcttttattttttttattttttctgtcttttgctttcggtttcagggatcgtttggggttcagggcgtacgttacgtctcgttcttctcattcctttctacgttgtcgttatacttctcctcctctccccctgctaatctgccatcaggaatacctggcgtcctcttcttttcattctaccgatgttctgatgaaaactgcaagattccctttgaggtccagcccgtacgatctcgttgctctggatagttttctattatatgtttcttattttgttcttttgaattctgaattcttgaaactagatgagcttgaagttaacagctcgaattttgatttccatggagtagaaagccgtgcttctttggccttctctctcctgccagctgtggagctgtgcacttgttttgttcatgatagctgaactatctgactgaggaaagtgcagcctttaaaagcctttgttactgcaaagattccttttgatggtaatcatggatttgtaatcctctccatccaattggaatagtgcatctgcttttatgtttacctcctgttggctgctactataccacattctactttttcatcttgcctggtgttgctcagtccccatcgtatcttttcgtcggacgtgccattctccttttcttttggttttaaatagaacagggccatgaactgtactctccttgcatcaaattgggcctactaatgcctgcaaaaatccagcctttgcatgtgtgtgttgatgttttcctggaaggacagcatcttgctacagtgtacagtaaattagtaagctcgtctgaccttatatggcccatacccacagtttcaaatttaagggttcaatactgagggctttgcaagagagcattatatgctttgctgcactaggttgttcgctcgccagtttcttaccagctacctgtaattctattgtgatttaattggctacatcagcttttggatcacgggtacaaggttggttttgtaatgttccatactcgctgttccatttgaatgaatttcttgtcataactgtcttttcaggattcatcaatgttgttatcctctgaggcttcctttgtaataagaaggcagtgatcaatttgtttgacctgagtaccgggatgaccagcaaaaatgtgctaactgatagaactcacagagatggtacaaaaatttcttccactttttctttgaagtgctgcttaagcaagtgatctgcaactcctgattttgctttttttcgccgggtcggcaactcctgattttgctttcataatgcatatgaatttatactttagagttacttgtgatagacgggctagatggcattggcattgtttgaataatgattcatttgcataatgttagatggtggtctccctttagacaatgtcatgtttgattgtttgtagatgatgacacatttgtcttttctttctggatgttttcctcttcttggattcgaaaataattcaaaagagctcttgctatttttgttgcaagacactgaccttaaaaatcaaactgactgtgttctttatttgttagtttgtattgatagacataagtgttttctgcctaatgttaattgttcagcttgcatctttcaggctctcgagttcataaaagccggcaagatgtcaatagaactgttgatcccaaaataggttgtgtagaggacaaattagtgagtatcatgtcatttgccctattctagcatatgtaatttcaatttatcgtaggtgtcagattgtccttctaaatatatatctggacagcacttacacaattttgtaaatttcagaaagtatgtcttcatttttttttctaatatagtattcattgcagcaggtagtagctagtactaggaattcttcaagcaacaaatcaaccatatctccaatgaacagattagtagcaatggagatgtccaaaggagtggaatcaaagaggaagccacctagtgtcgttgccagactaatggggcttgatgatgatctacctgctaaagaaccagcattacaatcttctagaagaaatttgcggagaagtcattcacttgata

SEQ ID NO: 68708 - DNA, 1022 bp, Oryza sativa
ctatagaatctggcaagctatggaagttgcaagctgaaagattcaagatttctaggttctcaagggcacatactgacatgggcagcacattgagatttatgcaattgtataaatgaagagtttgcaaattgtggagactactgatgcaattgggcagagtactgataagggatgaagaaaggtccaagtatctcaaatgcttcaatttaccaaccgattgagggagctccataatttggctgccgcgcaaatctagtactctcaagaacctggagtgaagaaataaattaatgtcaagactacggccccaggaatgaaacgcacggactttgcgaagcatgctccaaagaacatcggtcgaccccatatcatcatgcaatgatgcatagcggcaagcttctgtcctcccattgactcgcttagcgcttatgatctgaacttcatccccggcaacagactgagcaaggtcatgcaccaagtcgtgaattttgtacttaactcttccatcaacctctaatcctttctttgacaaatcatgttggtctacctcttgaaggaatgacatccacaacaagtgctcaaaacagtcgtccgctttatcagaaaccggctggcaaccatactttgagggttcaacaaagccaagagcaacccattgctgaataagcttacccttgtcaatctcatggtttcgaggaaacaccgagcaatacgcgaagcattgcttcagaacgggtggcatttgatcatagctgagtttgagagatggcaagatggtctcctccttatccagctgccaaatctcactgtccctgacagcaatccatgattcctcattcctcttgaacctcagcatgctcccaagggccttcgccgccagcggcacgccgccgcatttggggacaatctccttccctatcctgaccaattttgggtacaattcctcatctgcttcctcaaaggccttcctcttgaacagctcccagcaatcctcatcagagaggctcttgagcatcaatggc

SEQ ID NO: 68709 - DNA, 7051 bp, Oryza sativa
  unsure (1)..(7051): unsure at all n locations
atttccttgtgcctgccattgatatgacttatgaggctgtcagggtcactgttcatatgtaagcagggtatgccacaatgttcatatgcaagcatccattcctaattacaaagaggaaaaggaggaaaaagaaaaaggtgtaccatattattgacttcaagtaacagggtttcctgtacttcatcaggatatatctcataagtcatatcagctgaaaatgttgaaaataatagttttttcctgtaaatatggatagtctgggaaaatgccacaatcatgcagtataatttttgtccctatactgcatataggtgtgacacaaacaacaaacgaaatgaatatggtctatcattttgtagaacccaatattgaaggtttacccctttcaaggatctaaattaaaagatagccctttaatctcaaaaaaagggaaagaagatcctgcaatcattaacttgtgaattgcttgtgttgtccctgaactttaggataatacaggtttaattcgcttttatatatccgtgcacatttataaactttgcatttattgaattaaactattatttattgtttatgtgcatccagcctctccattaaatcagaccctgatggtggcattgagattgaagatctggtagcagttactgtgaatagttttcaagaagtgaaaagattgtatgaaatggggacccgtcttagatcaacagcttccactatggcaaattctacttcaagcagatctcactggtaaatttttattttattgaagaaaagatttcttatatatatctatacaattagaatatcaactatgattgcacctgactgaaagaggattcaatcaaaagttagagagcaaatgttcacagaaacatcttgagtgaataaaatggttgtttttaaattgagaaccatggaataatcactttcctgaaactctgtactttatttgttcatttatgcaacagtttgattcgcatctcattgacttccttgaatgcaactgagagaagaaaagcaacaagtaaattgtggatgattgatctaggtgggagtgaaagacttgtaaagacaaaagcaactgggaaaaggctcaaggaagggaaagccataaatttgtcgttgtcagccctaggcgatgtgattgacgcactacagactaaaaaaccccatgtcccttacaggtaaatgaaactcataatgcacaagtgtatggaaattggtacatggctgccatttcatcagaaaaatatgacaaaacactaacatgtcgcccttccaaatttgcagaaatagtaagcttacacaagtactgagagattctctaggtaaagtagttcatcagtaactatttcaaaagggataacaacatatgtagttgaattattttacacatatttttacagcttaccttgacatattcatgtttaattgttgacaggatgtgaatccaaaacattgatgcttgtccatatcagcccagatgagggtgatttgtgtgagacaatttgcaccttgggttttgcaacaagagtgagaagtattcgcctggaaagtgaagaaccaccagtaagattttgctcttaccattatgatgagtgtatatgcaataactaccagatggctattttattcatttattcattaaaaatagcataaaccaaacattaattaaggtaataagacagttaatgctctcacatttcaatttgcaaagggacaacttcgaaaacaagatcatttttatgaaaaagttgagctctgtgtgatcagccaaaattaaagaatgctcggtttgtatttttacaaaacatgatattggcattcatgcacacataaaaatanacttttatgtgaatttttataaagtcgactaatgagtacacaacatgttttgatctcaaacaggagatgaaagcaaggaaggaaacattattaatagatttaggacagaaggtcaatgatttggaacatgaatgtgaagatattagaagaaaaattaagaatctcgaggagagtatggagcatttgacaggacctcagccaactatttactctaattttgacatgtcacatctatccagtgaagaactgaaaacagatgtatcaagtaatgtgaggaattcaaagaatcgcagagaagcctcttccaggttaccaaggttcatgaagccaactgcttctagccagcacaggataggcttaaataatcgcactcccattattaacaggctaaaaccaccagtaccaccaaggaggcggccttcctcagtttatgctgagtctgtaatggtcccagtaaatgctgccccttggcaatcagaatgcagctccgaatgcagtatgtccttaacaagtgacatgaattggacaccaagcatacgagatggaactgaatgtagccaggatgcatcagaatacgagattaaacaggtgattttctcagaacatgagaaatcatcgcatgatcaagtgacctgctacacagattatccacttgcagaatctagagatatacagattaaaatcgaagagaagggaattgtagacattgacaattggctccaccaacaaatcgttgagaagactagcacatttcgaagcaaaatggtgcttgatattcccggagtaactgaagctgaaatccatgtttctagtattccttcaccaactactatggcatgcactaaagaagatagccaggtaaaggatgaagtaatgggcctacccttcaatcctcaacagactatgtcgaggatataaagcaaagcaagactgataatcaattcacagcaaaagaattatgcactccaccatttaaagaatttagcagcaacaatgaagtgaagggacataaaaacgaacatcctgtgtaccatgggagacccagaaggtcactacaggaagaactggaaaattgcacgctagagaagccaaacatggactcaaaatctcacaggtcacatgatgataaacacaaaacaggtaatgttctgtcttacaccggagaatgagcatctacgagaatttaaattttcctggaaaaaagccactatgcatcccagtatcatctggatttattgaagttgctcctaaatttgaagccacggtaagagaatgcttagcaacaaaacattttagaatatgcctatatagatgcagaaaagttcatgacaccagaattgcacatggaacaacatgaataaattgtatccacataaatctagttgtacttggcaaacaaccacaaatgatccaaatacttataatcacatttttgcaatatctaagacagaaaactccatcatgcaatggtgttcagcctttctgaaaagttactctttggtgtatattagacccaaaaaaactccacaaatcagccatgtagcagacattgtgaaacagcatgtttatgcatgaaagagaaccttaaaatgtaggtagaccttgcaatttactgtaattgttgttagatataggtagtaaatgtaaaatctacaggaaatctttccaaaaaaataatcaaataacgatttttctgtagaatttattcctagagcgaaaatagaataaatattgaaagtaaacttcagtagataaatttttgagagaaaaaacttcagtacatagaaactgaagtttctaaattgacttccacaatgacatgaatatctgtaatttttagctaaatatctcagtaaagcatgtcatgcaaaatttctctgttttggtactatcattttgaacagaatgcacaactagcatacaaatactatcatttatccacttgggatttccgcctgtctacaatctacacatagttcttgttcaataagctatattaccggtttatacttcactgcagggaagttcacaaagttctttcaagctcttcaaacagcatggattggtgctcttctagcactgggaactgtaagcattggattagagcatggcttctttcagagtttgacactctaaagtacctagaatctcatcactttgagatatagtattgaattttaagagaaactactacaggaagtaatgctctcggtgtatattgtaccacgagcacacaatgaaatatgtccagccagtaccacaattgcaggtgaactgttgattgatgctaaaagagctcctttgatttctgatgaattctttcagaaagccaaaaaaattggggtatttgagtaagaatgaaggaatgatcatacaagaaaattggcatcattcaatcatacagtaactgttagtttgttacagtaattagtattgcactgccctaactctgacaaagaattgttttatagttctaaagcatttcagcttatttgcctctgtacacacctaaaataagttaagtgtctcagtaaagcagcaacttaaatcagaatgctagagtatttgtttgagataagttgaaaagggaatggcctatctattctacatacattgctaaaggagaagtctgatgaaacaaccggtcggtcaatatcaagaaaagaaaaaaaaaacttctgtttagatgttgcccgtacctttaactgaagaagaaaggcttggccaacttttatcctataagaagactaaatctcacatcaaacaactagtcaatcaagaatctactcttgagtttcaaccttgtgctgttgtgcatgcaatgagttggcgaaaaactactcctttaaaacattctctaaattatcagctatgttcacttatcacacaaggcaaatatgtttctttctgagtgtaccaaagtatgttgtcctccttcaatacaaacaagtgcttcgtagaatatgagcataatcattggaatctgttttaccatcaaggcattaaggcatagtgatcacttttgttttgctggaaacaatgattcagtatgaagcattgcatcaggtatcttctgtatcagtctgagtctgactggaaggatggggtttaacctctaggagaacttgtaaaccatgccatcaatcttaacaaaacttcaattgtgcacacttggcatgtgatggaacaatgctcacactagatgatgttcatctcacccttcttcaacatcatgcaaactttcagggagcagcgcaatatgaccgacggattttatgttactgttaattgcacatagaacttcacgtatcttatgcaaggaaggatgagagccatctctggaagtgaactcatgaaccatgccatcaacatcaatagaacttgcccctggcacatttcttaatcctctatctctcattgatattcgaagttctctcacagcatcccacctctcctgttctgcgtatatattagataggagaatataattcccactgttgtgaggttcgagctcaattagatgcaacaaggcttgttctccaagctctgtatcaccgtgagtacgagcagcagcaagaagagctccccatattgctgcatttgccttgaaaggcatatcctgaattaaaccacgagcttccatcaaacaacctgcacggccaagtagatcaatcatgcacccgtagtgctcaactcgtggcttaatcttgtactgagacaccatagttttgaagtaccagcggcccaaatcagtcagtccaacatggctacataccgataggactgcaagaaaagtgatatcatttggtgacacattctctttctccatccggcgaaataactccacagcttccaaaccaaggccgtgcaatgcaaatccagcaatcatcgttgtccaagtgacaatactcttctgctccatgccctcaaacacttccaacgctttcttaacactcccacatttgacgtacatgtcgatgatcgcattcatcagcggtatctcctggcataaaccccgtcgcagcacaaacctgtgcacccactctcccaaatcaaccacaccaagatctccacacgccgagagcaccgacagcaacgccaccccatccggttcgatcccctccacctgcatcctccgaaacacctcgatcgcctcctccggttgcttcatctgcgcgtaggccccgatcaccatcgtccacgacaccacgttcctccccggcataacatcgaacagctcgcgcgcacgggccaggtccccggacttcacgtatccatcgatcatgacgttccatgaaacgacgtccgcggaggcggccgtctcgtcgaacaccctccgcgcggaggcgacgctcccgcaggagcagtacgcctggacgaggctggccgaggcgtgcgggtcggcggcgtggcccgcgcggacgagcagggaatgcagctgcgcggcgagccctcccccgccccggccgcggagccgcgcggcggccctgagggacacggaggggtggacgcggcggacgagcgcggccgcgtggtcgcggagcgggaggcggagggaggcgaggaggagcgcggaggcgacgcgcgcgtggcggtggccgccgcgggggaggaggtaggcgtgggcctggaggaggtggcgcggggaggcgaggcgcgggagcagggagagcacccggtggagatccgggggcagagatggcggcggcggcggcggcggcggcatgcgctccgcggtggccggcggcggtgggcggttgggttcgatggagctcgtgcgatcgtgggggcgcgcggtttcacgcgcttccctttcttctcgctgtttgggcctatgggcttcagaaagatcaacgcggtattgggctggaagcctgttgtgagtacagtgttgggctgaatggttgatgtgccgagatctgtttcggcacgggctcgtacatagattaggccctattgggaggtaggagtagtttttttttttcagaaaatgatttaattcgtttagtacggcaccgcctccttttcaaaatgtatgatgccgttgacttttttcacaatgtttgactattcgccttattcaaaagtttaatgtaaatattgaaaagtataagttaaggttatattttattcgatgataaaacaagtcatcacaaaataaatgatatttatataaattttttgaataagacgaatgcttaaacgc

SEQ ID NO: 68710 - DNA, 15069 bp, Oryza sativa
cctgcagccctgcagtgtgtatgacaggtgggaccatatattagtactagagtaagcaactattgtatgaattggctattagattgaatataggtgaattggagctagtagtgggctatactattgaacttgctctaacgaaaccatctttgatcggttgcccaaaatccacaataatcccggtttgaataggaaccgggactaaagaatatctttagtcccggttaaaagacgtgacggcactttttgttaccaaccgggactaaaaatgatctttagtctcggtttaaaagaaggcaggctatgtcagacccctccactatccttagtcctggttggtgttaccaaccgagactaaagatttattattaaacaaccgggacaaaaaatcagcgaaactgcccgtgcacgcgtcccgcctcatccttcctgcccccaaccttatctcttctctcttctcctccttctcacccctcattccttttatctcttctcctccttccccatctcctcctccttctcctcctctcctctcactcctctcctcctcctcattctctctccctcccctctggctcccctctggcgggccgcggctcatggcatacggcaggaggcgacggcggtcacccctccaccggatccaggaggggagacggccgggcggcggcggtggaggccagcgcagagggctgtccctggcggcggcaagcgcgaagggcggtggccgactgcaaggcggcgcatggccgggcggcggtggcccgatgcaagacggcgctcgaccgggtggcggccgggcagaagcgaccggcgagtgtgatttttttttaaattttgtgaattatttgtagtgaatgatttgtatattttgtttgagatttttttttgatttggggatgattttgtgattgatttgtggattgtggatgtgtatgtattgtggatgatttgtgtggatttgggtgggggaatagatacaagcataaaaaaacaataaaagaaaagaaaaaaaaccgggacgtggcccatatctatcttaagtcgatgtatttttagtcccggttattttatccggtactaaagatgcacatctttagtcccggatttgtactctcggttacaaaaccgaaaatacatggggttacaaactaggggtaaagaccatttctccactagtgtaaattgctcatataaaaactttgtatacataagtttttttaaaataaaattatattaactttaagtttaaattaattaatatatatggtaataactcatctcgtttcactgagcagatttgcccaaacaccacttagaactaagtcttatacattatactctactccaacagtcgagacatagctttaatacactaaaaaaagtttaagcaccaatgttttcttatttctcttctcctttgtgtctgcaaatttaccttcttatacccggaaaaattcactactacctccatcccatattacttgtcgcttcaagtttttttaatgtttaatcattcgtcttattaaaaaattattatttattttatttgtaacttgttttattatcaaatatactttaagtacttatcttttttatatttacactaattttgtgaataaaaccgaatggttaaatattgtaagaaaaagttgaagcgacgagtaacaggaaacggaggcattagtagtgattgtacatgcactcgagaatggaatcatatagactgcctctgatggattattgccttttctggtttagacaaatctggccgaaaccaaaaggagcacggatgtgactgcaatcatgcaagccatctcgatcggtggtcgtgccatgttctcaactcaatcatgtgcttacaccgtactccctctctcttacaaaatttaaaagattttaactctacaagatactcccttcgtcttgaaatataattatttttagttatgaatctagataactatgtgtctatatttatagctaaaagttactatattttatgacgaaggtaatatattttaggactgtgaatttgaatatgctctctattcatattagtaatactactccctccatcctataatataagttattttttttaaccattcgacttattcaaaaaaaattggaattattatttattttatttgtgacttactttactatccaaagtactttaagcacaactttttgtttttatatttgtacaaattttttaaataagataagtggacaaacagtacaagcaaaaaagtcaaaatcccttatattatggaacggaggaagtataaaatatcacatccaatcaaaatatctttaaataccactacaaatcaaattttgtaacaattatataacaaatcgtgctccaatgaacgaaccaaccggatagccaagctatccagctagccaagaaacccacaaattttaaacaatcattggagtttatcaccacatcatcgtcctagctcggccttgtcaggccgagccaaggatttcagtcccccatcattgcccccgtcaccagcttagaggtgggagggcggcggcagtgatggcaagtgggaagatggggagagccggagatagccgagaggtgttgccatatagggccaaggaaatttgaaaaatagagaggaaggttaagcacatgataaatataggccttatttagattcaaaaattttcggcaaaaaacgacacatcaaatatttagacacatgcatggagtattaaatgtgagaaaaaatcaattcaacaatttgcatgtaaagcgagatgaatcttttgagcataattacaacatgatttgacaatatgatgctacaataaatatttgttaataccggattaattaggcttaataattcgtctctcaattcacaagcggaatctgtaatttgttttgttattagtctacgtttaatacttaaaatgtgtgtccgtatacttcaaaaactttatacccaaagaactaaacggaatctttttaatagctcaccaaatgtaaatagcagagagtaagactgttagagatgttttaatgttactatctccgtcccaaaatataatatattttagctatgaatctgggcacacagatgtctatattcatagtttaaaatacttacattttaggacggagagagtacatgttcaactcagatattctcatacctcttggtcttgttttgaactgatgcactcaacaacacctcaacttataaatactcatcttataaaatgacaatagctcaacatattaatccagaaaagcaaaaagggtaattaagtactacatacggttcgagaccactgtactaaaaccggaagccggaactgctgttggccctctgcacaaatggatgttttatggagaagtggagaagagttgcccaaactgaattgagtttgtgactgagttcttgttgtttcgttgctgactttcagtgatgctggccatatttccgttcctgacctgagcactgctttccacttatttagctgaaagctgtctgaaagctgtggtatgttcgaagtaggtttcaggcgagttttaatccaaactttttcttcaaattttttacttttcacttttctacacacacaaacttctaatttttccgtcacatcgttttaatttcaactaaactttcaattttagcgtgaaacacaccagtttctttcaaatcaaatttagtccaatatgatacaatttctttcaaatcaaatttagtccaatatgatacaagctcttgtagttcatatttttttatttaaactttcaacttttccattacatcaaaactttctacacacaaacttttaacttttttcaataaacttttaattttagtaacttctaattttaacgtggaactaaacacaccccaatataaggaatttggacaaattattctctttgacgtcatgtttttcaatgtttcactggtttttgtgaaggatcagagtttttcaatatttcactggtttttgtcaaggatcagaccacaacgaaagccacatggttaaaatcttcgcgtcgtcactacgtcatactaatatttactctccagtttgttccctgagagcctgagtgacatcatacttgcctcttttttttggttgcatctggataattttccggacaactgtcaaaactcattaaattccatgagccctgtttgtcaacagcaaaataataataataataataataataataataataataataataaattttaaagaaaaactgccgctgaatcgactacgccaggaggatctcgaaacgaaataaacaaagaaggcaaaaagaaaaaacggaggtgaaataaaaaaaattcgaaaatgtgcggcgaatcacgcgagaagcgaacagggcgaagaagcgcccgcctgctggtaggaagcgtggatagccggcgaaggtttagctctcgcacaccaaggttaggcacccgggtattcaggatcaagaacccggggactctttacatgtgcgttgttgtaaaaaaaattcaaattcaaatccaaattcatagcgcagccattgctcggttcagagaagaaaaacgggaaacagttgaatcgagacgacgcaagaaagcagcaagcaacgcatcaagtcaaatgaaaatatattggattaaacacttatggttgggaagaacacctatcaggatcacaaaccgaatccaaatccggaggaggaggggccttgagcgccgcaacgaagagcgaaggtgaagacggcatgagaggtgagagctattggtagggtttgggtggggatttatagagggaggaatcaacgacagccgtccgatcgagttcttgggctgttttatggcgatcgtacggtgtccgtctcttccacgggcggtccagctgttgcgagggtttcgcaagggcccaaagcccaagcccatgggaatcgcatttggtcccttatctaagattagtttaaatcgtaccctctcttaaccttagtttgttcactttgctatcattttcaaacttaccaagttttggtattgccaaattttgataagattgctaagggcctatttactttgatgcaaaaaaaatcttaccaaattttggcagaatttcttatatagttaccaaaatttagcagcaaactaaatgtagccacttttttagcaactttactaaaacttagtaaggttaaaaatggcattaaagtgaacagaccctaaaattttggtaaggttgccaaattttggcaagattttatatgtacttactaaaatttagcaacaaactaaatatagccactttttttggtaactttgccccaaaaaagataatattgaaaatggtagcaaagtgaacaaacccttgaaacctgttacaatgcaatatctcatctcctaaaaggctaaaaccagttccaggacggtttggatttccaaaatccaaatgcctcacattctcacttggtaaggttgaaaatgacatcaaagtgaacaggccctaaaattttggcaagattttatatgtacttactaaaaaaatatagccacttttttttgtaactttgccaaaaaaagataatattgaaaatggtagcaaagtgaacaaacccttgaaacctgtaacaatgcaatatctcatctcctaaaaggcttaaaaccagttccaggaaccagtcccaggacggtttggataaatccaaatgcctcacattctctggagagacgcatgcacagtttcacacacaccttattaggcatacctctaagctctgaaaccggtatctttcggtgctataaaaccaaaaacgttaactttcaatgctatataaccaattttcccaaatttataagcctgaaaaattgcattggtttaaaacttcaagttttatgaaaagaaacaaaataattcatctaaatgccatcatagctctctagcttcaataaatcttggattttaaattgtgccatgaccttggtccttggttttggtcacccatacggtatctcaaatgcactacaattatataatgcttatacgacatactgaaactacaattatatacgaaaatgcacttttgaatattggtctacacgtacaaattacgattggaccaacaaaatggcccaatcctcagctcgtgtgattgcacagtttcttctttctacgcacattttcttagctgagctaggaccaaagatactactccctcagtttcacaatgtaagtcattctagcattttccacattcatattgatgctatcaatagatagattcattaacatcaatatgaatgtgggtaatgctaaaatgactaacattgtgaaacggatggagtagtaaaatagcgtcgtttcagcatttcttcaaaaaaaaaacaaaaaaaggtgctatggcactcgagcctcatcgcaaaaatgcaactgagccaaacaaaatgcgcctttcttgcaaagctccgggggatgctgacagttcagggaaaattaacctctcttctcctgaccccctgagctacgatgatactgcttactcggcgatcctaaccttcttgttcttcttcttggatttctccacaggcgtctgaggaacctccgaggtcgtgccgctgtcgccaccacgaacctgggatccttcggccgacttgcccgatacattcgagtgccccaaactgctctcatcctttctcttctgattgtgcttgtgcgcgggctcggcactctgttggcccagcgattgcgctgagccttggctgctgcggttcttcgacccgctagtgaaccgagacctcgtcttctttgaagaacctggaagaccggacaaattcagatcagtgagagcaactactgtttaccaaagtgttctgtttatgatagaaaaagagaaaacacttcagctgttggctggaaacctttattaattgaaagtgcataccttaaccaacagaaatagaaactacagagatgagcttagtatttctctctcagaacagttcttccatcttataatacaagagcatgcattgcatcattggcatgagtcttcaataatatatatcaggaatttggctaatgtcaactttcaatggtgcccaaaaatcttaagacaaatagtatgttcatcacctcattactgtcaatgtgaaaagattgaacagtaatatgcacttacaaagttaaatctggtgatactggatttctagttaaaacaggaggctaaacctacacaagtctaagttattgactagttcaaatggaatggcatatcatgcttgtcaagtctatataatacattcaccatagacagcagaagagtggcatcattataaaaagatgcctgagaaaatgtactcacctgcagatttcttactgctaggagtgagactccccaaacctggcttctccagttcttcagggtcaggataacgaactaagctaactcgacgtgcaatcttcccaactggaatttttttaggattaaaagaacaatatgcatacagtaagttaaaagaacaatattagctgcctcccaggaaaggaagaaatgatagatgtgttctaccgattgtgctatcaagcacgaccaaaatcacaaaatcaaataggtcaacaaacagctcaatttaacaagaccgataacaagtaaaaacaacatccatgcaaaatagtaaaatactgcagaaataaactgcaaagttggtatttcagcataccagcttttgcttctggtccggatggaaggaaaacagttgcatctggttgctgagcagcaaagctgacaagatcataagacttccctgccaaattaagtataacaagtacagctcaaacttttgggagaactttaaaatttaaattgttattgccacaataatttaaaagcgacgaactgacgatcttaaccaagaaaaagaagttagaaaacctagtagcctactgctagtagtcttactgatgaatgttatcattctagcttcaaatcacggattattatacgaggaagctgagagcagatttcacttcaccaatcaaacttctgaacatacactaaacataaaaacttctatatgtaaactaaattatagcaccttaattccatttgttcatttgttgcctaaagatctgcaaaacactactagtcatcaatgaaccagcattgacttcatcttcatacaaaaatgagaggcaagcttgaccatagaaatggaagcagttccattgataggattaacattgtttgggattagtaatgagaagtctaggtgcccactttgggaaaaactaatcaataaggtcaaagtgtgattgcatgagcaaatacaggttgcatccaatccgactgtacagaaagctgaaaaaccttcaaaagacataatcgatcaggtgcaacatagttcatcgaatatatcttacccgaggaactctccaaactgctcaattttccatcacggtgcaacttaagagtaagttcttgaccatgaaaatcagacgcatctaactgcatgcaacacagaaaaacgttaaattcgagatcccttgtgcagcatgccacctggcacataatgaaaataatatccgcataacctgatttagaggccactgtattagccaaagttccgttgactctgtttgtgatatgtcaagcatagcctcttcgctgttctcctcaaatgctggtccaggctcatagctacaatggttggttgcagcaaagttaaaaataaattacagacaatgcaaaaacttaccaacaagtgtataattgaaacaaaatgagctactgaattcaatccaaaaatccacaactataattttccaacctctcttatctcatatttgaggcataactgttaatctgttattcagagaggaatcagaactaccaaatccacaaattcgatataccattaaaagttgcaaatccacctaataagtttcgttctgaacaaatattgcatagctttactgtagataaatgcaatgctcaaacaaaagcattcctgcttttaaaattgttattcagatgtggctttgactatcaaacacgttctcctattgtgccccttcgcaactgctgtgtgggacgaagtgagatcaactttcccgattagtttatgcagggacgaactaacaagtatgagacagtggatttcagatttcatgaagaggagttagtgcctccaaaacacagtgttagcagtcaccctttgggacatttgggaggcgaggaatgattcaaggaacaagtcctcctccttgcatctgcgtaaagtgggacagaagacagtggcatatgtcaacatgattgtgcagcactgctacaaggtgacgatctgtccgagaagactaaccgctaaatgtcttagcctgctatttaaaacgctgctgcccaggcaattttcctcatcaacgtcattcgagatgtaattcttggagtgtatccgggatgtcctctgtacagatgctacttacttaatcaatgaagtgccatggttcatctcaaaataagcacgatactgctacacgcctacactgcgtcagaaaatgagaaaaaaaaaacgaacaaacctcctcatcgtggtcggcgaggcgacgtttttttttttttttgaggagcggtgtcgccggagagccggagtaggatcagaggtggagaggcgaggcgactcaaagccgagtcggcgagggcaccggccaccggccaccgcccgcgccgcgccgctgcgccgagagcaaaagcgagcccgcgaagatgagctggcgacggcgagcagcggctggactccggaatccgggtcagggaggcgtgcggcggcgaaggccacgaggtggcgtggcgccggcgtgcagcggcgacggccaacggcgcgcttgtgtgtgggtggcggctggggattgggacttgggaggacagggagtgagaaggtagcaatggggggggcttaggttttcttaagtgggccaagcccatcgcaacttgcaaatgggctaggcagcttacgtaggtgggaaaaagtacactgaaggtctctcaacttgtcatcgggataccaaaaacatcctcgaaccgcaaaaccagatatacggggtcccttaactatacaaaacaggtcacctgagatccttgggtgtttttgaccccggttttggtctacgtggcggctgagtcaacgtgggacccacgtgggccccacatgtcagctggccacgtcaccaccctctcccctcctctccctttctcctctctctctctcactcctctcttatcttctctgggcgactgggcgagcacggctgcggagaggcggcgtcggcgggcgagagcggtgtggcgtcggcgggagagagcggtggcggtgcggcggcggcggcggcggcggcggcgggcgagcgcggctgcggatggggagaggcggcgccgacaagtccgcgccacccggccttgtcatcggcggcggctccgggcgcgagggatgaggacgcgggcctcgtcggcggcgttggcggcgagggtggcacgggagaggccggcgcgagggcacggagtaggaggaggcagataggacaggagcgagggcatatggggaggaaggcgccgtccgtggtttgctgttgcttccctttcaccgttgccgagctcgtcgtcctcgcggtcgtctgcgtccctgccgcgctctgccacctcgccgtccgaggtggccaccgccgccgcgtctgctctgcgaagcagaaggagatgggcgagctcctcaccctggacgtcacctccccgaggtcgctggccgctgcggccgccaaggccaggaaggtggaggtcgagttcccggccacgcccatggccgaacacctcggggaggcggaggtggcgcgatggaagtcgggactgcaggcggcgctgcactgggtggcacgcttgctctccagcgccggggaagacgcccggcccgccgccgacctccgcgtgctgctccccgtcctcgcttgcccgctctcccccgtgcccatcctcccccgcctcccccgccatgtacgttctttatcgtgttctctgcctcgcaaactcgcctcaattctttccatcccattccaacgaaagggaagaaatcaagatagccggaaacacacaactgaggggaacaaaatcaaagaaagaagagaaaattcgatcatagcacaggaaaaaacctggtaccaaaaaatagcacaacaaatttttcacttcgactaaaagcacatggcatcaattttcttgcgattcatagcacttccgtcacatttgccatccaaacatgtgagttgacatgaaaaaagacacatttgcccttcttccccgacctagcgctcttctcccttggtgatgttgccgcgcccgtgtcgccgacgcttggtgagctgacggagccgcgcttccctcccacccgcccgctcagccgctcccgatcggcacccgccaccatgcctcccaccgttgctcgcgccagatccgccacgccgccgaacgattcgcgcgtgtggggtggagcaccggccagatccgcacgggaggaaggcggtggaggaggaggtggagacgccgcgcttccggcctgccggctcctggccgcctattcgttagcggcgtcgccgcccaaggtcacggagccgacaaagcccgcagtccgcccactcacgaatcatcccaacatccgccagcgcgcgccacagccccgctgcaggtcatcgtccccgtcgctgtcatcgtcgtcattgtcacgtggaagtagtggcaagccagcgcgctgcggcaccgtggcgagggagaggttgttctggcgccgagtacggcaactacgggccacatccatccatgccgaagctagggccgcccacgtcatcgtcgtcgtcctcgtcgtcaagctgccgccggcgcgggaggcttgccctcgatcaacagcgccgagtgccagacagggtccacctcaccgtcggcggtgacggcgagccggtctccaggcaagccgatggctgccgcgctgccattcacgagggagcgaaagaggagccctgttggggaatgtggggaacgaagggcaaatgtgtccgacaaaaaatttctccacactgatctaacaccgttacttcaaaatgtgacagaagtgctatagggcgaagaaaaatcggtggcctatgctatggatcgaaagtggaaactttttgtgctattttttggtaccgctttctttcctgtgctatggatcgaattttctcaagaaagaaagggtcaaaaattttatccccaaagcgacgagacgactcgcttccgccctctcagtcgaggaatccagtgcggcacaggacggcgttgcggacgtggtggaggtcgcagcccttgagcatcctcccggcgccctccagcaccgagctgtgcgccgcggcgcgccgcgcgacaaccttgtgcggcgagacgaccatggcggcgtccccatcctcgccgccgacggaggactgcgtcgcccacctccccctcctcctcaccgtcgccgccgcctccgaaggtatcctcacgtgcggctggcgatgctgtaggagcccaccgtcggtgacaacctcaccgtcccgctccgctgcgcctgccccttgctgccgcaggtcgccgtggtggtggccgcggcgcttgacatggcctgcccaagaggagagaagtgagagagggagagagaggaggaagggagagagatgaagtggacacctaacatgtggggcccacgtgggttccactctgactcagccgtcacgtagaccaaaaccggagtcaaaaccaccgaagaacctcgggtgaccggttttgtacagttaagggaccccgcatatctgttttgcggttcgaggacgttttttatcccgatgacaagttgagggacctttgatatactttttccacgtaggtgtggtaatgggtcagggcccatagaacgttttttcgcaactcttaaatgtttggaaaaagtacaccagagatcccgtcacttaattacaaaatcatcctttaaccacaaaaacaggtacaatccatcccctaacttataaaaccagtgcaaacaaggtccctcggcagtattgttactggttttgattggcatggcatctatgtggctcctttgactatgtttttatctcatgtggtattaatgtgacgtttacgtggcaatttgataaaaataaaataaaaatgtgagacccatgtgtcagttatactagaaaatgattaaaaaaatgatggccccatgtgagactcacatgtcatcttcattctctcctccctcctctcttcttcctctcttctcgccacacaacatcggcacgctcgtcgtcggcttatttcacgattaagccaaacgatggggccgtaaatgtccaaaccacctttacatttataacgacacgcatattagggaaacacctaatatcaaataactagaaggggtgaagcttcgaactcaggtcatctagcccaccacattgtggagctagccgaaaaacccctgggcgtttctccgcctttacatttatcattaaaaatataaaaaaagacaaaaggattgacccaaccccaacgttattgtatccgtgctgtctttatttttttcatttgttttatttttctttcttttcttctttgttcttttattttttaaaaaaataatggtatatctaagggtagattggacatttaacggcttgctgatgtggcttgctaatgtattgtttcctgtgggttcaaggactagccgtgtgacaattttttaaaaatgttatggactagattggcctcaaagggaaaacttcagagactgttttgactattctcctttgcaaattatactttccattgtccattgttcaggttcgaggaaattgctttcagcttcaacggtggcaaatattcaactgtaaacacctttacatttccttctacctattgtttcaattatttagcatatatagttagttccaaattccaaccaacaagatgacaacgttttggtgagaatcaccttaccgtttgggaagattaaaattttaagaagcaaccagtaagaatccagctagtgagaatttggaaaatttaggtttttcagtttttggcttgtcattttctagaataggaatctaagtgagaatattaactgtttaaaagagcttaagattttaggagaagttgtggaggttaaaaattcctcaaatatggccatagaagccttcccaaagaagaagcctaccaaagcaatttttaggcactagaaacggcgatccgaatgcggtgagtcccttgattgattcttttgcagtagtgcaatttgaggttggtcaaaaacaattcccctgtctgtccttctctcaagagggtgaatccattcctgaattggtcttgcaggattgtctcctgatcatgcgagtcaatcggactttcattctcttttcagaggagccaattctaatgctttgctgtgacaatgatgtactgcacggtcaagtactgcagccttttatgattttcaatagtcacacctttttggtagacgttaggtttaggcccggtttagtcccaacaacttttccaaaaaacatcacattgaatctttgctttgcgtctcttgataaaaaaaatcacattgaatctttggatacatatatgaagcattaaatatagataaaaaactaattgcacagtttgcatgtaaatcgcgagacgaattttttgagtctaattagggcacccacaatggttatctataggctctctaccagagatccatgtcagcatattttcctacatagaagatattaaatgaagagagagagcaaaactatctaccaacttagagatagtctatagagaaaaacgagacaatgcatgagagagctatagatacccatgtagacatactattgaggtggtttactattaatctagtctattgctgagatgtacatgttttatagagagcaccttactttaccattgcgggtgctcttaggtcatgattagccataagtgctacagtaacccacatgtgctaatgacgg

SEQ ID NO: 68711 - DNA, 5162 bp, Oryza sativa
aaacacttaatatttatcttcatcttcatcttcagatgactcaaacaccaccttagggggggattgcaaattcatatttgacacaaaaattgacactatatatattcattcaccaatacctctctatgagtatcaatgctcacataatcttgttgagaacttgtacctgtataattgtaaaagatgagaatatgctttatttcagaaaaatcttgtcgagaacttgtacctatataattgtaaaagatgagaatatgcaatttttttcagaaagaagaacaagatttggatggagagccttcgctccaaacagtttttacgaagaaattatgagtgtgctaaagattgaacatgagatctcatagttaaaaccacacatttcgtaccactgcactgtctaatacatctcaatttgtttttttttccctttacttagtattaaccggtgtgagattgtttgggtagcatctctttcaatttggcttgcgttctccaagacgatattttaattccaaataaaatccagtatactactgcattaacgaatggtatggtcactaccgtcgagtgacgaactctctctcacgcttgtgttcaattcagccacgccacggcacaacgctggtccatttgtacaatgcgagaatcgcttgtttctttgtggacgatgttgctcgttggctagctacatgggtcgccattcgccaatgcgaatgtgcatgcccatccaaaaatccaaccaacatctacctaatctctgcagaccggtaaggagtgcatgtaaagcagtaacctacccaaggctagttcaaaccgtcgtccttttatatacaccaaattaaagaaatggcacgccatcagattgtgtataccctccgttccataaaaaaaaacaattctaacaatgtatatagatatatgtataattaaattcatagctagaattaatattttttttggacggagtagtatatatgaatatcaatcaaataaagtcaactttttcttatgtacatataaattcaggattaaaccatacaaccatacaagcatggttgattctactttctcaatactcgttgttgtttatgctacatatttgtcatcgatgactattctatccattactttcgtagatcagtaatagtataaacaacgatatatgagcctcacttatttgaaaaaaaagagtaaacagacaggagaaggttcagatgaaaagagaccctccgacgtgaaattagagagatgtagtcatggatatatgagccccatcgtttcccgggcctaaatgtactccttccgtcccataaaaaaacaacctgctaccggatgtgacacatactaagagtaggtacaatagcaaactataagccagctaatatacatattttaacgagataaaagaggagagataaaagcagcgggctacagatttgttgctagctgtagcacggactccaagacgcatgtgtgtatgacagatgggaccagatattgattgtgtagtatatgtttataggtaactattgtatgaatcggttattaagttaactatagatgatttggagtcaatagttggctacactattaaatttgctctaatactacaaatacatacatacatacatacatacatacatacatatatatatatatatacatatatatatatatatataaattcatagtacttagatgtagatttgttttttatgagacggaggaagtaagtggttactacctctatcttaaaatatagtaaggctgtgtttagatcaaggggtgaaaaattttgtcgtgtcacatcggatatacaaatacacatttgaagtattaaacgtatagtctaataacaaaacaaattatagaatccgcatgtaaattgcgaaatgaatttattaagcctaattaatatgtcattagcgtcaaatcattgatcaattaggcttaaaagattcgtctcgtaatttacctataatctgtgtaattagtgttttatattatctatatttaatattttatatatgtatccaaacaatgtgagaggttaaaagaagttatggaggatctaaacaggcccaaacaacccatcctacattttgggacggatggagtagtcggaggatttccggtccagaccaccacgtcagcggcgtgccgggtccacctacccgaacgcgcgcgagacgagaagaacatcggaagagtgggagaaggagaagagaacgatagaaaagaggagtactatcatcgaaacgaaagcgaagcggaaaaaaggccccgacgcagaaacagcatccgcaaacgtgcccccgtctatccactcccctcctccccttcccttccctttgtggaggccaggccaagcctcccctcccctccccgctcctcctacgcagcgccgcggcggcggcggtagaaggcggcggagctctccaccctcccctccgccgcggcggcggccgtgttcctctgcggtggagaggccccccctggtcgtttctccgcgccggctcggcatctctccggaggaggaggaggaggaggagggaggagtaaggtgtggggatggagatcgaccgggcggtgcgggggagcagcgaccgccgcctgcggaccaagtacgacaacgccgtctacgtcgtgcagcgagccttcgcgctctacccgtacgcgccccccccctcctccccccctcccctctcactagattcgtgtggtagcggtgatggtggtggtggtgtcttagctcgatgatgatcaacgcgatatttgttggggttgctgctttccgcgatcgggtcgggtttggtttggcgcgtgccccgtaacgagtgggttggtttggctggttcatccagctcggatggatttggggataaatgtggtaatcacagattggagagaggaatatcgacttgggggtttagatcccaaactgcaggtcgctgcagctgtttaatcccgatatgcattctaaatttgtgtgtccttaccaacagaaaattcatccctatttgcctgttcgatttcttaatcccctttgtgcaatggtgtatgctgttatagtttctgaacatcaactagtagcaattttttaggacggtctagactatttggattggctgccgcaacaatcgtctagtctcgatcgattggatttcggctggattgctctgtcgaactgtattttcagttgattcggaccacggattaaagtacctgtgtcttgaatgctgtccaggatacaacgggagtaggtacattgttttcgttgttggctagtcaggttgtatcggctgttcttatgccagttctgatgagctaaatatttatacatccattttgtgagttgtaaactgtttccttttttagtcaacacttaacttaaaatcgagtttctttggatgagaaaggagattctaaatcaaactacatccatacggggagtgaaaacccatgatgcttgtttgtcacgtcatcttaaaccagggaaaggtccatccagtgtttccacatttcctttgcagaggaatacatctgcaaattttgagctaaataatctgagtctgtgatgaaagtatgtgcctgcatgctttaaagtagcttccaaaattacatgcatcgattcataaactttcaattttagtttcagtttctatatctcaagcggctcagaatatgtaattcgagtgaaaatgcaacactgcctaccaatttcttgaggatgtcgagtgtttgaaatcacatagttggagtcaaatttttaccttttctcctaactatactatcaggcacatttatcatgccaactgggttgtgtgactgctatgtttttagcttgtaagtatgatggtgtacatgttctgatccaaatcttcatgctgttccaatgcagagtatattttggtaaggtcataatgacatttctgtaggacactaaagattttttcagtgaatgatgaattataattctaatcatgcaaacttcttgaataactggaatgtgggatgtccagttgtgttgaacatgatataagtaatggctggtggggagtttaaatatcattgcagtgcacggggacttagtcttctttgaaaacttcaaccagttatacctggattatgtgaataaggcacaaggcagatgttccccaaatgcatattgacagttctttttggcaccctatcctttaatttccctatttagtttttttaaatggttctgcacttgtccaggatggatattcaatagagggtggggttggtttgaatgctctcattttatatatacattgaatacaggaacatcctaaatctcattctcagaaatttcattttccaggtttgaggaagttgccttcagctttaatggtgggaaggattcaacagtaatatctttataatctctcttgcttgtcatttttcttctgtatgttaagtgacggttttttctattagcaagtttaacaagatatgaatgctatatatcaataggttctgttgcatttacttcgggctggctactacctccacaaatcaagctctgatggtgaagtcgaaatgaatactatccaaaactgtcctgtgcgcaccatctattttgagagcccttgtgctttccctgaaatcaactcattcacttatgaaactgtctcaacgtaagaaatcactaagattcgttgtctttgtttatttgctaaccttgagaagttaaatgaaatattctttgtcctccgttctccacagttatggtttgccactggaaactatccgctcggattttaagtctggcctagaaggcctattgaaagagaggcctactaaagcaatttttattggtactagaattggcgatccaaatgcagtaattttcttgttcccttgtttagttgctcttcaaatctcgatagacttgttatgtccaatcctcatgcccatagacctttcacttattgatgtccctagactcccgataaacctattacttactacagtttgggattataggttggtcaagagcagttctcgcctagttcacctggctggcctcctttcatgagggtcaatcctatattggactggtcatacaggttttcctcctgatcatgtaaatcaatcaaaaggtgcctcctagtctgctaatattcatgtgctaa

SEQ ID NO: 68712 - DNA, 3110 bp, Oryza sativa
  unsure (1)..(3110): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaaagtttgaccaaatcttgtccaaaatgtcaagttttgctggcctagcaaagaaatgtcattttttttatgactggagtggagggagtagtcattagtgaggacatgaactatttatgaccagagggagtagtcattaatggaaaagagcaaaacccataacaccatattcgcaattattactaccaagcaaaaattggttcttttaaagaacagaatcctctacacgatggaatgatgacatgacaagcaagcatgatatgctattttcacccagttggcactagcttcatcagtggctggcggtaacaaccagataaaagtgagactgccagatcagggaaaacagaactctgagcaagacagaattactaaagtggaaagtcccattttggttctccatcttcgcactctgttcctccctaaaaaaaccttattcaaaaccccaagcacctcccaaggtgacactaccatgtgggtctagccatctaggctccgcatatcaatgacagagaaaatcgagaggcttgtaccaattcttactgagcgtgcctttttaggacattgaaacagaggacccttttctgatcatacaaaaaagctggagccaaacttttcccttgctaaattcacacgcctaatttcctattctaggtagtcagttccacttctcaacctcgcaacacaaattcggcaattttttcctcattaaacgcaaacaaattcaggaatttcactggtataaaaacacacaagagacaatgttccgtcagtcacctaccttgaggaagcggcctctcttgttctccccaatatcgaagtagaacacctgcgcgcgagcgtgccgcgaccaaaatcagcaaacatagacagcgccaaaaaaaaaaagaaagaaaaaatcagcgggcggcggaatcaatcgcgaccttggtgtcgaggcggagctccttgctgaaggcgtcgcgctcgtcggtgcggatgtagtagtcgaagaggtcgaggaaccaggcgacgccggcgacggggacgatgatggtggagcgcgtggaggacgtcttctcggagatcttcaggtacctccccctcgggttctccttcagatcgaagtagaacagcttgtgctcgaactgcagcgtcttgctgacgagctccacgtcgcccccaacgccgcctccccctcctcctcctccccctcccgcgacaccgggccccgccatgacgcccccgcctcctcctcctcccccgccgccgcccatcgccgccgccgccgccgcgaactagggttttgagctagggtttgggtttaaactcgctctcaaactcgagtcgtcgagtcggggagaggtggggatgtgaggttgggaattgggattagatctcgcgaggtggagagggggtgtgggggtttacccttttggggattcctccacgtcactgacgggtggggccggggtcaggtggggcccggggttggtgggcgggggtagggaatcggtgggcggggggaagggggggtgctgaccgtgtgcggggggtggtggcgtggcgggatgtgattggtcgggcgaaggacgctgatatgaccggaaagggtaaggtttttgtactggtacgtgtgctgctacagttgcggtttgggggtagaaattgtttggacaatgacaatcgtgctattactggagtatagtccctttgtaaatttcagtttacgtaggatacgagtaaatggtttggacaataactgtcgtgttgttaccaagcatactcccttagcaaattataatttgtgtagactagaagtaaatgatttgaacaataaatgttgtgtcgttattgaggtactccctccgtttcataatataagggattttgaagggatatgagtatacgacacatcctatgacaacgaatctagataaactcctaaccagattcgtcgtcttagaatatgtcacatccctccaaaattccttatattatgggacggggggagtatactcttccgtcccccaagaaataaacctaagaaatagatttttttaacgactcgcaccagacagtgcgaaattcatattgataagtaggaaaaaaattataagattacaacactgggaggtcgtaattaggaaaacaaagaaaattataccaccacccacgcaccaacagcaccaacacacagaccctggagaaggctagcaccgaaccggccgccactaagccaacaaaggatgtacaaccgagattgtccaaaactcaaccctaacaactaacacagaagcctactctatccatgtctttgggattgagtgggagagggtgagagagaagaatggaaccgctctcccccctaggccctccaacatggccaacttgcataagctaaggcgccgatataagagaacaggaatctagagcaagcttgcaacgattgtttgggaggtttcgacaagggagctgcttagacgatgtctctagggagataacgacaaaagcaccgctgccgccgtccgtcaaggtcttcaaagagaacagtgactaggttttcacccggtagccccacaagagaggatgggatagcacgacaacaccctcaagaggaagtgacgctctgaacgcaatcgttgccagctcgaccaaggccggactaggttttcacccaccgtctgccgcttgccaatccatcgctgacacatcaatgctccactgttgtctaacctccgcggacatgtgggcaccgctgcaccgacgccccacgccggctatcctccgcgtgccgccaccctcgtcgcgtcgtgccgaccttcgctactgaccgcacctcgcaccgcgccgacctttgctgccgggccgcgcctcctcgcctttgtcggccgcacatcccacccgactgcagctcccgccgtcgttgtcgcgagctctgccgctgccg

SEQ ID NO: 68713 - DNA, 4522 bp, Oryza sativa
aggtccgccacggccacctcctccactagccacctagcaccttcgctggccgatgccgacacgcctcctcgcgtgcgcctccattggccatcgggtcctctttgcccgccagccgcagccttcggcccgtcgcgcctcccgcctccaccgggctgccgttgcagcgagcaccgccgctgtcggggtcggggtcgaccattcctagccatcggccaccaggggtggggggggggcgcagatccactccctagggggagcggatccatcgccccgccccgtcgaccgccacggccaccgcctctcgaccggcgcacgccgcttcgcctcccacaccaaggaggagctccaccgtcggcttgctctccccgtcgccgccttctcggccggctgcgcggttttcggcgatgagctccagcggtggctaggcggctagtggggagggaaggtggcggcacgagcagctagggttttgccccccgagccgcttgcgtgagagcggcacgaggacgagtttggttgttatcctccctaagactggatatgagatattataatacaatgaatttagataggagcctatccaaatacgttgtactatgatatatcacatccagtcttaagtttgttttttgtgggacggagagagtactcccttagcaaattctagcttgtgtaaagtatgagtaaatggtttggataatgattgccgtaccgttactagagtatactcccttagcaatttcttattattccattgtcataataaaccttattattagttattaataaagtgaaagatcggcaatgtcaaaaatgtcaaattttaataatgtcaaaaatgtaaatgtagtgtttggtttgatttcttaccaattgctggtgtgttttgttagtggaagattccgaaattaccaaattttggtagagtttggtaagatcacaatggtaaaatcttgtttaatttgttaacgtactaaaatttgataatgccaaaaatcgataaggtttgttttggcattgaagtgaacaagctctcaatatagtatataaaatatattctcctgttctaaaatatagtaaatttctaaaacattctaaatttagcctaaaacgtagtagtaacagcttcgctacatattttcttatctcaacgagtatagattctttagagcaagtttaatatcatctactcatcatcacaaagttcgtgtgtttcattccactccaagctcctgagagtactagatttgcgcgaaagccaaattacggagctccctcaatcggttggtaaaaatgaaacatttgatatttctacaaacgctaagggtacaattgtataaagaaaacatatcctatccacacaagccttcgcatacacataccgtgcacaccaactaacaaatatcaaaaaaatatagaaaatttttatatatatactttggtagtattatatttatatgtaaagttttaccttcaaattcattatacatatgaagaaaaaaacaaaattatgatagatttatactcttaaaactatcagaatttttatactttttacagctaaaatataataaatttgaggataagactttatatataagtgaaatatatgaaaagtaaatatataaattttttttctatttttttatatttattagttggcgtgtatacgaaaagcttaaaactatcagaatttttatactttttacagctaaaatataataaatttgaggataagactttatatataagtgaaatatatgaaaagtaaatatataatttttttttctattttttttatatttattagttggcgtgtatacgaaaagcttgtatgtatagagtatgttccccttaataaaatgtgaaatggttgaaagtccgccattcgcttgtagggctggaaatcgaccagagacgaggctgtgtatcacaacccaggcacaaaaaaaaaatcatgtctgactaagctccaggctgtgttaggcggtaagggatggggactaattcctcccaaacgaaaaacggagcggtccattagcgcatgattaattaagtattagattttttttttgaaaaatcgatcaatatgttttttaagcaacttttgtatagattttttttttcaaaaaacataccatttaaccgtttgaaaagcgtgcgtgtggaaaaagaattatgtgggtcgcaactttaggtgccgaaggcagacttagtgcctgaattttgtacacaacttgtccattctctcaaggcggccgaactgtaaaaatgtgcttcatttttatacgtcagctgcactccagttacattgttaagggtcaagtgatggccagttacatacttacatattgtcaattgtgcactcattgaaccaccacaaaaaaaaattgcacactaattacatttccaatctttccctgcatatttttttactatagttctcactcctacagagctacagacactgacaatcaactcctgtctatatagacataaaaattagaataaaatatctgttcattgactataatctccgactcactagataaaccattcaaggacaatgcatgatgggaacaaattgagtagaggataacttcagcataatcagatgaacttgcaactcaccaggactttttttttgtttaattgatcaacagaagttgcatagttatctgtcacgagattacgatgtttgggatatgacagatcttgaaccaatccttgcctgtatctttcctgcagttttcgttcaactcagagctacaggcagtgacagttaactcctccagagcagtcaaatgttgcaaaccttttgggatcgagaccaactttgggcagcaacttatttgaagagattcaagtgctacaagatcaccaatccattctggaagcgcgtccaattcagtgcaattgctgatcttcagctttcgcagagtggtaaggtacctgatgggttctgcaagaacacgtagcatttcgcagtattcgatggttagttcctcaagttttggcctgtgctgcaacaatttccactcactggatgatacatcggactttctgatccacaatctcctcagaagtgatgcggatgtggaagatgatgatccaaacatcttcctgactgacaatatctcgctgctgtcggagattgacaaatctgttatagcatctggaaggcatggtttcggcctgagctttgggcatcctgttgcggttacagttttaagaacaggaaacatggatccttctggctgagtagctctgtcatctgtcgctgctgaagttggccaggtctctaggttaggcatgtcttcaaaatggagttccttcagtgactggtacagcacacatttctgtcttttcacaagaatttcagagctcatgctatggacaccggccatgtatcggagatgaagcgattggagataagggatgtgtctgaggggtggtaggcagctacagttaggaatgttgcttaaatctaatgagacaagatttgggagccatgattccatgctcttcatcatccaactgggaaatctagtgcccatgtaaccatctatttcaaggacctcaagattttcgggtggcacaagaacttcaagaaatgtttcaacattttcaaaatcatccgcagaacaaggaatggtccacaacaaggtcaacttgcttagttttttcttatttctccagtttgctcttttggcagcagttgtcagatccatcttgtgtgaccaacattcaatcctgagctcaccagttagattgtttagatctttcagctccgtgatactgctatgcttgtcacctatcatgagtaaggacaatgtttcaagtttagtccatcgcccaaatccattaggtagttgttttaaagatcgacattggtcatttcttaaatgtttcagattggtgatccttgtcatgccatcaggtaacttagctaggttttcacagccaacaaagttcaaactctctaacatcatgaggttggttatagactcaggcagcttacgtagactccagcactggaacaagatcagggtcttcaaactatgaagattgccaattgattcaggcaattcctctagactaagattccatgagagatctaaagtctgcaagtttgggagatgactagttgatacaggcaatgccaaactgcttgcatggtgtgataaaatgagtatctgaagttcatgaagaccaccaatggatcctggtaactctgacagactactacagtgagacagatccagaatatgcaagctcttaatgcgacctattgaggttgggattgattcaagatcagtgcattgtgataaattcaggtgcaacaaatttgaaaggttaccaatatttttgggcagtgcttggagaacaccacatcgtgaaaggttcaagaaatgtaaattttgcaggctgcatatagtgtcaggtagaatttcaaggttgccacatcccttcaagttcagcaaatgcaaactttggagtgtaccaatagagctaggtaatg

SEQ ID NO: 68714 - DNA, 10204 bp, Oryza sativa
cccaccgtcttggcctcgtcgaccatggagatggtctcgcgcatgagtgggacggaggggagctgccgcgacgcgggcgggcgggcgtcggggctcagggagaacctgtccttggatgcggcgacggcgcccagctcgcgcctgagggacctcagcctgtgcgccatggcgaacgagcgcggcgtgaggccgccgcacacggagcagtcgcccccgccctcgccgcggcggaggtcggtgtggcaggcgtcgaggaagtcgtcgatgtcgtgggcgacgtccctgagcctgcggagccagtcgcggacggcggcgtcggcgagcacggcgcggatggtggcgaactgggcctccatggccgcgaggtccgccctgaaggtacagaggagcgcgagctcgtcccagacggaggagccgaacttggtcagcacctgcctcacgatggtcgaggcgagagcaccctccgccatggctgcgcgctagagtgtctctctctctctctctctctctctcacaactcgctcaaatcacaatggattggaaagtcaaattgggtggacgaagctaacgctgtggagtagctaataatcattcggggaatggcgcctgcctaattccatttcgctctaaataatactccaacaagtattttttttcttaacatccttataaataatatactatatctgtttcatattataactcgttttgacttttttctatgccttcgtacttttaaatttaactaagtttatagcaatgtttttttaacataagacaaacataacatcaaaatatatctaatgatacatttatatatttttatcataaacttaataaaatttaaagaaatttaacttaaaaggtcaaaacaacttatattacagtataatataatgaaacaaggggagtagtactactcgctagagtgtctctctctttctcacaactcgctcaaatcacaatgcattggaaagtcaaattgggtggacgaagctaacgctgtggagtagctaataatcatgagatatttaactattcattgcgggaatggcgcctgcctaattccatctctctaaataatactcctcctctttttcttcctaaacttccctgaaaataatatactacctccgtcccatccctttgagtttttttaatgtttgattatttatcttattaaaaaatagaactattatttattttgtttgtgatttgctttattatcaaacatactttaagtatgacttatcatgttttatatttgcactaatttttcaaacaaaacgaatggtcaaacgttgcaaacaaaaaatcaaaacatctattataggatggaggtagtactcgataactcgttttgactttttttcatgtcttagtacctttgaaatttaacaactttatatgaaaaaatagcaatgttttttttaacataagataaacataacatcaaaatatatctaatggtatatttagtgaggttaatttggtgatgcagatgttgttatatttttttcataaacttaataaaacttaaagaatttaacgacttataatataatgaaacgaggagagagtactgctcctactctacatacaaaataggaagtgcttttataaatatatacatcgttttttttcttaagaaatgcattggtttttaattatatggaagattcgatggagatggagaccggccacaaatgatttggctcactaaactgctattgaaagataactaattatatggaagactcgacggagatggagaccggccataactcatttggctcactaaactgctattgaaagataactcacggccgggcgagaaatgattcattgtgtcgacgtttgatgtctcgactacggtatttggatagtatggggatcgccgatgctaggatatacgcgagactgaggtaaaagagatagagacaaggatttttatacaggttcgggcccctgagttgtcaggtaataactctacatcctgttagccgaagccggtattgctcttattcaccataatcacaccagtacaatatgtgggtagcctatctaagtgttgtcgacatatcggtctgaaggtctgactcgtagtcgacaacagggtagtcttcctcctcgaatccgtgctcggcgagatcagagatagcgctttcgtatctcctgacggtatccggaaacaccataggggaatagccatgcctatccctgaaatcgatatccggcggcgtgtcttggcgcatgtaggcttgtatgttgtggtagcctatctaagtgttgtcgacatatcggtctgaaggtctgacttgtagtcgacaacagggtagtcttcctcctcgaatccgtgctcggcgagatcagagatagcgctttcgtatctcctgacggtatccggacaccgtaggggaatagccatgcctatccctgaaatcgatatccggcggcgtgtcttggcgtatgtaggcttgtatgttgtggcttctggtgggcgtgtgttgattgtcatgggtgtcttccatggtcgttctcctctctcctcctagggggtcttgtatttatacccatatgtgtccccttatccaagtagaactagagaaatcaatatggatacaatccaagtagtccttgtcgtttccatgtagaactctggttgtctttccttattcggaactcccacctatatccgtaggttgtttccgtataggacatagtatgtggtgggtcctgccgagatttagtcaactactattaggtatgtggtatccataaccatgacacattggtataccacatcaccggagctttcgcttattggttccaattttttaagtgtagtcaactactccttaagtatgtaataatgcaactaacgtgacagtacagtcatccaaaaaataatgaaaaaaatagtgggattcatctgtcggttccctttctttctttcttaaacctcgtttcccttccatctctctttctctacccctaaggccccaacaggagagggaggaggtggcaggcggccaactaactagaggagaaagagggcggtggtggacctcgggcgtgaaaggcgtagtacgacctccgaacagatgtggcggaggcaccgcggccatctcctggccttcagctctaagctcttcgatcgggcaaccacctctcagacggcggcacgaccaacaagcgagggcgagtaagggaacaacgacgacgatggggagctagatgccaagaggcattctgcgagcccattcttcgtcgatgtggcattggtatgttttccttgtggtcaatggtcgatcttgctgagaagatgtccattggctcaacatatgttggaatgatcttaaacatgtccgtcatggtcaggaacgcgaccacagcttggttgctgccaccattgacgttgagtgcagccatcaaacacttggcgtgcgtctctttggaacagtccgtggtatcgatgcagggtgtgtgggccttgtcctcaccatatcccagctccaaggtgaccgtaggaataggtaccttattggtgtggcttgagctcgctgccatgcgtgcacaaccatcattgaagcttgccgtcgagcacttggttggcatcataggcagcgatgtcttgggtgttggaggatgccgccttaaggtcagtggtggctgccttggtggcatccgctgtctcctaggaaagccttcccccttagagcttcgatatcttcaaacttctctaatgcccgatcaagcttatcctccatcttgcacctggcatctatccattcctcaagaaacagccttagtgcttcatccctgaatattttctcctctttcatcacaggcataacatcttccttgtacacttcgaacgggcatgacattcaatcaaacatgtggtgagcgctgctctgaagaacagtactactccccatgcctaatcctttctccctcgcgctgttgagtgatacaggtgttcctcctctcttccatgctaagacaccacgaatccaacagccagattattagcaaccttcttcactcaaaacaagcagtagcaactagcaagacatacaagcttctgattgtagaaagtataaaccctcttcactcaacaagtagcagcaaagagacacaagctcctgtttggtaccgagaaaattaaggaagacgaaggagtggctcaaagtgtactaaacttggtaggaagaaggggaaggagagagagagatcgacaagggtccattgccggttcggtcgacctgttcgattacctggaagtgcaacatttttttttcttttgtctctctcccttcagcttgcttgggctgatatttaggtgagctattgaattggccccatagtgcagcttacttgggccctaacatgtatatgatgtcacaactcgaattgagatcatacacacctgtgaacgacgggtggatgattttttttccaaagaagggtttttttttttatcatgcctctacatccaactaaatatatgtagtatttttaaatcatgaacttagctctcaaacaacccaatctaaaattcgcttttataaagatttgaattcagtagcttgggtgctaacgaccggtggatgacattcgaccgaatatatcatacgtaggcacatgagacgtacgttcctctcatgtgatcccaattgctgcgccacctccacctccacatcacattcactcgactcatgcgtcgacgccgcacgatccccatcccgttttaaaccctatcacgagcgcccgcgccaacctcctccgatccacgtacacgcgtacacgcctaattaagcttatatacttttctccaaccaaacctgacatggcgtcgatcgatcccctcttctatctcgattagtgtctacaccatgcggcgccgcagcggcatacgcagcttctgccacggcgtcgactccacgtcgaccacgatgcagcgccggctggtcggcgccgacgcggcgtcgtcgtctttcctcaccgtgccgacgtcgacggcgtcgtccgtgggcgtcgctgagagcgaggcggcggcggcggtgacgctggagcagatgatcctgcagcttgacctcgaggaggcggcggcgaggaaggcccagcagcagcagcagccgcggcgcgcgtcgtgcgtgaacagctcggacgggcgcgtgctccggtcggcgagggacgcgctcagccagtacccgcgcttctccctcgacggcggccgcgacgccatgtaccgcgcctccttcagcgaccaccaccactactactaccacgacgccgccctcgcctcctcctcctccggccaccggagatcgccgccgccgtgccgcgggatgccgccgacggtggccggcgagagcgtggtgtggtgcaagcccggtgtggtggccaagctcatgggcctggacgctgtgccggtgccggtcaggggaggagggcaacggaggggcggcgccgccgccaccgccggcgggaggaggaaggcgagcggggcaccgccgctggcctcggtgatcgccggcggcggcggaaggaagcggagggggaggaggacggggagagaggaggaggagctcgagaaggagaggctcttcatggcgctgcatggctatgacgtggcagtggcccgcgcgtgccacgctggcgcccttcaccccagcgtggcccccaacgtcagtgggatgggcaggggtgcggaagatggctggggatttcgacttcctcactgaaattaatttgataatgataataataataaaataatggttattatttttatgtagtatatatatatatatagcaagttgttatagacacatatttcctacagtatatcctaattctcacatgaattttcatgtaaaatcgtcaacattactagcgaatagctctatattttcaaaagagctaaaatgatggtatgtactgctgggttttgcttctcagtttatggtctgtttttttaggaaaaaaatatatttataacctagcttacgtatctgtaaacttatgagtagttgttactctgtttataaatgtttgattcccctgcatgtcttgttcacattgtatgtcttgttcacattgtgttcgtgcagctaaactagctaatttttctagatgttttagtgatatttgttaattggtgtacatgaatacatggtgtatacccgtgagtaggggtggatgtcgagctagctcggctcggctcgttatcctaacgagctagaaacctagctcggctcggctcgtcaacaagctcgagccagctcgttaagctcgcgagctaggggcaagagacatagccggcgagcacggggaggaggggaggagcttgacggtggaggaaaagagctcgagctcgccgccgaccatagggaggagctcaacggtggaggggatgaactcgacgcagctccgccggcacttggaggagacgagctcgagctcgccggtggcgtcgggcgctaggggcgggcgccagcggcaggggcgctggatcgctgggggagaggtggagatcggcggcagcgggcgcttgatctcccggcggcggtgggcgttgggggataggcggagaccggcggcggcgggcgctcgatctctcatcggcggctggcgctggtgggggagaggaggagaccggagccggcgggcgctggcgggggagaggcagagaccgccggcggcgggcattcgatcttcccgcggcggcagcggcggcggctgggggagaggtggaccggcggctggcggttaggggagaggcggatcgcgcgctgctacttggataaaggcggagtggcggcggctgggggagaggcagagtggcggcggcggctgaggagagtggggaattgagtgaagagtgaggactagggtttgcagtgtcttgggcttgggcctttttgttgtattgggcttttgggctatgatggagtcctagctcattaaggctcgcgagccagctcaagctggctcattatctctaaccagctcggctcgttagaaaattcaaacgagccgagccgagccaagcgagctaacgagccacgagctttctggccacccctacccgtgagggcttatgtgtccaagttaactagctcatatatgtttgcggtttgcactaatatgcagtcattgatatagctgacaagctaaaagtccaagattaacttgccctgccattttttattagacgaccctgttcctctattagtaccaacatttaacgaggttaaagtgcataattactccttttatggctaagagtccagatgaatatttttcacctggcagtccagatgcataaccatttcttcttgagcaatgaacgtgctaaaacttcattatcttcgtcacctaaactgcatcgcttaattcattccgtcattaactttacccaaaagtgtcaataatcaattaatggatcaagacagaataatcttaaactttatgaatcaataatcaattattgctgacatgaaggctctcaacagcatatgtttgtttattctagtgccggtgcctgtaactctcaacatatatgcgtgcacctacctttggcccgtcgtcgttggcttaaatattcctattaagatgagatatagatcctgcagatacactggtgattaatgaagttaactaattaaggtggttgacagaaagatgaaagcttgtcagctagctagcatatatagatgaaactttctaatcgctaatcaccttgtcggtgagaaaacagagatatactctttaggccttctagaatctagaggctgggactgggatatattcataagggtctagcccatttttgcggttgggataaagggagtaaatttctttttagaaaaaaaaggaattttttattggtctcggacaataatattaagtgatagaactatactgacaaaactcctggataaagggagtaaatacatttcaatgcggattgatcagtccttgcagcttccgtggctggctgtttgtttgaacctatttgttctcatcttgttggcctctatatattctcatcaaagttctaaaaatgtgggtcgtgctacattcatgaagcagttattacttgttggttaggctgttttgcatactcctgtgggtctcttatcatgcattatactcccatcttatcattcatgaagtattacattattgtcaagtggccactggctagtgtaactaatgtcttgatcccatctcatcttttgagtagtacttcctctaactacgataatctattacacctcctaattcttgaatcaaacgggaaatttctattactactgctgtattacattttgaccttcctttaatgattttacagtttgtgattctaattgaaaaggtgtagtgcttctataccacattgacattgactatttccttttcttctaccagtacttgctttgctctctgtaactttgtttctaatatttttctaacttaccttccactcctgaaatggccatcaaatgaacatctccactccttctccttttgcttaaaaggaagaaaaaaaggaggagaagaaatatgttactcttaggctctactcacctgagctcaaaaggtgctttgccagcgagagaaaatgcaagcagggagattgcagctatacatagggggagcagtgtgtactcatgatcatccaattcttatggcccataggcaatagctcctccatatcttatctgcccagatcaataaagagatcctcttatcatctttctgtgctctggaaagagggaatttgatcaggcatatcactgagaaatcttcacatatataaacaatacaaatgtatcaaatgcatactctttaacagctgagatttttataacgaatagagctaatctttttctataaggtaaatataaatttcaaatacagtggcctttgttgtcaaacgaaaagaagagaatattcagtgttccttgttggatttgaacgcctatagttttttccgttcaaaaaaaaatagacattcacttctccttttcattggacagcaaagagtacagcaagatccattacttgctaactaaaatagggacaggcaatatccctacaaaaggccaatgggtccctggttttattagtccacagtttgtcactgccttactggtgaaacttacctgttgagacccacttatcaatacaatcatgtacccccttgcttgaatgccacactggactgtcttgtgaataacaaatgcatttctggaataaattttattttatccgcaggcttctaattacacataaaaatgttgtagcttgtaagataaccttagcaacttcagttctaccctacaaccattgaagtcactgttaaatgcacaaatggttgcactgtcgaaagtaaaagagtccacttaagatgaataccacaccgaataaaaaaggatcaggcaacagatacagactttaacatacatttatcatgaaaatacctggatatctgcaaagattgaagggatcatctcatgaacgaatcagtacaacagaatgtacaagcagtacttgccctgctgacctcaccatgctcagataaagaaatattacgagcccaaaattgacggggaacagtgtccgtcagtaagaaaccactgaaaaaatagcaaggcattttgttttgagcgataatcacaagattgattagaatccagcatttttcaggctacagtcccacctgttgcttcactgaaaagctcagcatggcacatggtaggtgagccttttcttatgacagcagaacgagaatggttttcattagccaagcaccgcatccacccattaaacgttgtcgccatgtgccacggaatataatctatcattagctctgccatccaataatccatacttaattaccatcaccactcccaccctgcttcactctgtgtccctgtgacagacaaaaaaaaaaacactgagggagttacagctgttgtggttctgactgatctcgagctcccttgaccaaagaatcccaagcaacggaaagcatatgctgctttgctttgtcagcttccttgggtatgtacatatggcacagctgaaacagcaagctccattccatagctaggtgtcccaaggtctatttgatctgcagttataaggacagttttggaggtagcagctacggcagattgtactgtca

SEQ ID NO: 68715 - DNA, 3354 bp, Oryza sativa
  unsure (1)..(3354): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatggcgggtgcctttttcgttgcataaaagataattgaattcaagcaccaagctgtttagtttgagtacctcgcatataggttgacccgccctttctggataatccaatgctgctgcattccttgcacctccaccaaactacattttgaaaaaatagcaactacttaattttgatgttccaaaatcaagcgaagctttactacctatagactagcataggcaaatatggcatcccatgcgcacagacaaactaatcaatttcttaacgaaaacagaaacatggaaagtagataggctatcaatagacatgagtttcataaatcatttagaaagatcacagttgcaacagaagaatgtaaacttataacaagaactactgaatagttgctatatcttttgcaaacccaacaagtgagaaattcacaaaatcaggatagagggtaaactatcagccaaaagccaaatatgctaaacaaaggactttgctaaccaacggtaagaaaacaggcaagaaagattttcatgtcaataatcattgatcctagatgtctttgttgacacatttgatttaatcaaccaaattaatgacaacggaatgggaaaagaaggatattttttattatgttatcagaatcaacaactgatcttacttaaagaaagattgagcacagaagtttgccatctgcagatgcatgtagtctgacccagtacaatacaatccaattaagcaaaattagcaaacacaaaacacccaaaaaagcagaataagtaaacatgaagcggccaataaagcaggcaacctacagctttctgctttcaaagggatatccaagtgctttaacttgcagaggtgcacctccaccgcgaacccaaactctaatgctgctacccgatgagtgctaccgatgcgccggacaagatctaggcagtggcatgcccaattttcaagctacagaagaactacatttacattggccgaatcaatgttccccatggcacgatcctcacttgggcactaagctgatcacatggttaatccatccaccctagagctgcctcatccacgcacgcgcgcgcgcgcaagccgcaacgaaccagatcgggaagggaagcgcgaattaggagactcacctcagtgccgccgcgatcgcgcgggtggttgtagcggcagcggtcaccgaagccgcacgcgccggtgcggaggtagtagacacagtcctcctccccgggccgctccggcagcctccccgccgcgtccccatcccctcctcctccacctccacctcccccgcctcctcctcccagccccatcctccacatcggccctgcaaccacaaccaacaaaaccaaaaccaaaacgcagctgctcatccaccacccccgccacacagatcccgcgccacccccgtacggacgccgagatctacatcctcgagctccaaacacaaaaaagcacacaacgagcacgcacgcacgcaccttccaggccggtgtcggggctagccccgccctccccctcccctccaccagctgcggcggcggcggcgtgcggctgctccatgccttcgtcggcgtcagcggcggcgatcggggcggggagcgatcggagtgggaggaggaggagatcgggggtgaggttttgtttcctcttattctctctcctctctctctctctctttctcgcgtttcctttccttccaccaccactctggtgtggtgtggctactgctcttttctctctctctcctcgttttttttcctccctttccttgcctttttttccgctggttttttgcagcacctgtccgggtttcacacggggttggtttcttctgtttttctctttttctttctaaaaaaaagaattcactttttattagtatatatactactctctccttttaaggttaaaaaacgttttaactttggtcaaagttaaactattttaagtttaactaattttatatacaaatataataatatttataataccttaaattaataattgaatatattttcataataaatttatcttagattgaaaatgttattgtttttattttttaaactgagttaaacttaaaatagttcaaaacgtcttataacctgaaatggtgagtatctttttttgtttttcttttaaatttaatgggagttgggatgggggtgcaaaggaccacgcctgatcaaggggtggatctatcactcacttcacatgtggggattgatggtgattttttttttcctctttcttcgttgcataaatgtggggggatggaggcggtaacggttggagttatattaagcttcatttgctttttgctaggatgttttatggtaattgagtgtggggtgtggaggaggtgagttatgtgataattacttcgaggtatccataatccatgtcatgtgtttgggactatcctattcgcgtgaccgaaagagtgatatatgtgtgatgcatgtcgctggcgtcatggaaatagtggacacgagcaagcgggctgtgtgtttgtgtgtagtagaggccatgtgttgtttttatgtgcattgttttttgcttattcgtgtgaccaaaaaggtgatatatgtgtaatgtgtgtcgctgacgtcacgaaatggtgtaaatgggcgtgctttatgtatttgggtgtacgagcgatgtgttgttttttttgtcatgtcatctattgtttcgcgtgttatctctgggtcttgattgtgtcctaattaaattttctttttttattgttatgtattttcttcgtaaccataaaaggttaatttgcacgtcataaatagatatatgttatgttgagttttggttatctcgttgccgcatggaccccgcattctatggtaacctttaatagccgtcatcggaactacgacacggttgatcacatccttgtgctagtcatgacgttactagcctacacgtggacaaaaggatatattaacagggacgacacgactaccgtgtactccatacatctctaattcgatttatatagtttatactacataactacccgcgtgttgttgtgagagtttagtataatagcaataaatacaaattatatgtgagaactagatgacataagtttatatagtcgatgtaatttacaataatttaaaaagtatatagaatggtgttcaaatgtaaaagtaaa

SEQ ID NO: 68716 - DNA, 19665 bp, Oryza sativa
  unsure (1)..(19665): unsure at all n locations
aaaagtaaagtgacgtggctttacgagaaaaaaaaaagagaacggtagtttggactatagattaatcatctaagagctaaaaataattgtgatgatatggttttatgagatgagaaaatgatgaagataatttagaccacagattaattatttaagggctaaaacaaccgagatgatatgtcttaataagagaagaaaaaagagagataatttggaccatagattaatcatctaagggctaaaaataattaatatgatatggtttaatgggagaagagagaaatatcattaactaagtgataatgaaaagatatattgacatattgtgtgaattatgtgtgatgatgatttaacatgcttgtattttaaagctctgaaatttaacaaattatagaattataaataatatatcatgcttgtataatgtttaaaatataataattgttaatgaattatgatgtggtattttgagttttagaatttagtggcttataactttattgtaaaatatgatactcaataaaaaaattcgcaatcctgcggtaggtgttgtttttacatatgcgtagaatgagatgtaatttagcgctaaaattagtttaaaaattaataattattaagcacatggtacggcatgactctttactgtagtacatggcccaaccaaccccaagtctcttattcgcttgtgatcaaatcaactatactcacatgtggaaagcacgcttgttttctagcacaacgaactaaggaataattatttccctacgtctcaacggcaaatctaccacgatcgattctcttccaagaaaaattaactagtctaatccactagtttagccataaactttggtcctgttattttctcataaagattaagattttacctcggtttccattactactaaacggtatatttcgtgcgaaaactttctataaaaaaagttattttaaaatatcaaatatatctatttataataattaaaacttaattaataataagttcataactttttctcgttttaactttatctttatcgtcatgagtttcgaacccaaccaaaatatcaccggcctggggaagttgtatactcgtataggccaccttcggcaaccgattttcatttcccttagaggatatttttttccaaactatgccatctgtgtcgatttattaatcaaaaagaaaaaaaatcaccggccaagattactacagctaaaatgccaataggtagcttgcactttctgtatgtcaatcaaaagcatcattctgctgcattgccctgaaagcatcacacacaaacacatatatactcctactgttcttgatactggcaaaaagtcaactaatctcatcatgccaccacaaatccaccatccatacatgcactcgctcactaggccccgttcagatctcacctcaaatttttcaccatatcacatcgaacgtataaacacctacataaaatatttaatataggctaaaaaataactaattacacagattacaagtaatttacgagacgaatcttttaagcctaattgctccataatttgataatgtgatgctaccgtaaacatgtgctaataacagattaattaggcttgataaattcgtcttgctatttactaacggaatatgtaactagttttttttttattaatggccgaacaccccatacagcatcctatataatacctgatgtgacacgctaaaattttacaccgttgcatctaaacccctcactaacccccggccagcatcacctactctactctacctcaacgcaccaaccaaccgccgaaaagaaagaaagaaaagaatccgtcaagaaaaggagcgtgacgtgagaagcaaggaagcaaacggggtatgtaccgttacgatagtttgtgtgtgtgtgtgtgtgagagagagagagagagggggggggagagggagagtgagatgtggcgcacgtgcacggggggcgtgggggcattttatttatttgtttattttgttgatgattgacacgtatagtaccccaagtactcctacgggggcccgtgggcggccgcatcctatgcccgaattttcatcgagccaggcgtgcgggtttgtcctcgttaactaattcattaattaattactccctcagtccccttaaaagggatacttgtactgattgatcattcgtcttatttaaaaaaaattagaattatttttttttatttgtgacttactttattatctaatgtactttaagcttaacttttcgggttttatacttacacaaatttttaaaataagataagtgatcaaacagtgcaaacaaaatgtcaaaatcccttatattaagggatagagggagtagcttattatcttatttggtttcatgggctgatccaaacaggtgggctaattcattagcccatacaagaggtactaatgggctaattttctatagggacttaaaaaaagcagttatctctctcctatctctctaatctctcgccacattttagtcctgaattagcctatggttccaaacatgtcactctaagctaatgtttagcctaccgattcaagactaaacattagctctcaaaattagtcctgggctaatcttccaaatagggccaatttggatgttgtatagaggagcgcatgtgcatgccgttggttagtcgatacgttgttgaggtggtggtagtactttctcctccgtgaagacttagagcctgtttatgagagtttcgggtagtttgcagcttctctcggaattaaaaatttctcaaacagtataactttttttttatactatgagaagttctatttgtaaaatttagaaaaataaactagaaacctgaagctgtttcttcatattctcaaaagctgagtaccaaccagctgcttctcaaaatcttaagctaataaatccttaacagtgtttgagagaaggagaaagaaaaatgttgatataatacgtaaaacgagatgggtcattagcatatcattatttaagtattagttatttaaaacttaaaaatggattaatattattttttaaaacaactttcctataatttattttggaaaagtacaaattacctcccgaactattgcggtcgaccgaattaccccctaaaacccgaaaatcagacaacgttcaccccctcgacccaatctagaacagttttgtcctacgtggcgtacccgtggcagtccagttagaattctatttgtataaaagcaggactcacctgtcatactcctcttccactcttcctctctctctcgtgggtcggcggcaggtgggggacacggagcggcggcggcaggggacacggagcggcggcggcgggggacgaggaggcggcggcggcggctgcggccacgatgagcagctgtcgccttggcgcggggacggacggaggcaggggcgggcggggggcgggcgaggacggaggacacggaggcaacatgctcagtgcgcggagaccctcctgcgccagagggagttcgccgctccctcctctgtgtcccgcgtcaactgccgccgcctcctcgtaccccgcctgccgccgacccgtgagagagagaaggaagagtgagagagagaggaagagtggaagaggagtatgacaggtgggtcccacattttttaaaaaataaaatactgactgaactgccacacgtacaccatgtaggacaaaactgttctggattggatcgaggggggtaatttgcccggtattaaaagttcagggtgaacgatgtctggttttcgggtttaggagggtaattcggtcgaccgtgatagttcgggggtaatttgtactttttctttttttagaaaaaaaggcacaccgtttaacaattcggaaacgtatgcacggagaacagcagaaatctaatatgtttagccccgtttgaacctaaataagatacgtattttactgattttttgttagaatattttttaaactactaaatgctaatcttgcttgcactactagaaaaaaacattttttaggcggccaaaagcaatttttccagacggaggagaggaccggctgcagaccaacgacacgattttcgcagccagggcaatggcccgcctgcgaaaatccaatgaaaaaacaaaaaaaatggcctcgtcgccgccgccctcccctggcctccctccggccggatctgggaggggaggagaggggagccgctgacgtcgccgtccacgcgcgcgcctcgtcgcagccgccctcccccggcctccctctggccggatctgggaggagaggggaggggagctgccaacgtcgtcgtccacgccgccgccgccctcccccggcctccctccggccggatctgggaggggaggggaggggagccgtcgccgctgcaacaggagccgccgacgtcgccgccgcaacgggagccgccgacgtcgccgccgcaacgggagccgccgacgtcgccgtccacgccgccaccgtgtctgcgccaccggtggagggatggaggggaggggaggggagggggagagagctgagaagccggtggagggagagagagagagagttgagaagattagtgttgagggaaatgagtggtggggagggggttggagtagataagtatcaaagtttttttttggtaggtaccatttttgcaggcggaccacataaggttcgcctgcgaaaataggtggtccgtttgcgaaaatgattttcgcaggtgccgcttaagtggtccgtctgcgaaaatctattttcgcaggtggatagcgaacttcaccccgatttatatttttataggcgattatttggttccaagggtcatgttcgcctgtgaaaaaaaagacccccatatcaggaaaaatgttttttctaagtgtgttggcttcgatttgatctaaagaggcatgcattggagtgttatttaggccggtgagtgatatttgtttcttttgttacggtcattgatctccggggtttcttcggacttcttttttgttcgatttagaaaaatcgaatgaatgctataacaaattatatattgggatagaactatagattgtgggaggactgtttcgagggggagagggctacatagatggaacggtcgcgtggccaacagtgaacagttaatgagacaacgggttagtggtagcaccatctaagggcaagtacaaaggtagagaccggtatggtctctacgttaattagaggctattacgttacaataattaagacaatactgtctctaacattaatgcactaaaatactttcttactagtgatctttcctttattagactcaatgcaacgaaaaatttcctaataaatactaagagtcgactctatgctgttgtcatgcgtagcaaccatctttctttttccttctccctctctcttccacgtcaccaaatatgcttgcatgataataaagagagaccgctaataaagaccattgtacatgccctaagcctgcatggaagagtatagagagtaagtttgtcttctttcgaacatttccctagctaacttctatcttccgtttttacacgtacgtttcctaaattatatttgatccatttccaaagttttttaagctaatatttaattaattatacgctaatttattgttccgttttacgtgctgaagtgagggttccaaatccgtagtagcgaatgcagcttaattaaatgggggtgtgcgattggagtgagcccttttgaattggaggaaaaatataggaattttggaggattttaatcatataggaaaattttctatgaagccctttgaaacaaaggattaagtcatatctaattctttgaaattcttatggaatggacaatcctatagaggttttagaggaaatttagcaagagcttcaacctcttggtaactttcctttgagtctatctctctcatccaattcctgtgtttttcctgcggttcaatcaaacagtcatttctgtgtttttcctgcgttttgcaattctttgttttacacttacattcctatcaaaatcctatgtttttttcaatcccgcgattcaaaggggccctaagtaagaagtggaagaattacctctccctccattttatattataagattctctttaatttatctatcataagtttaatttatccacgtttgtccaagtttttatgaaaatgtagcagcatttcaacataaaatgaatatattaaaaaatatatttagtgaaatcaattcggtgttctacgtattgcaatttttttatataaagttagttaaattcaaacaagcttgactttaaactgaaaattttttcaatgtctaagtatctggacaacataatttttttctcataatatacaggcaaaccttctagaagcgtggtagtcttcacaagttcacattggggaaaaaacgaaatatggatatatatatggtatcttttgaaatattaaactaacaaccgttattatctcgcagagtacggctaaatatggagtaccgggcgtgatggaaaacggaaaaaacatactgtattttgtcttaaagacacgacaggagtataggaccatagtttcactgaatgcttatcggttttgtaatattgatgtcaatttttgatgtgacatttatctattcatcttattaaaaatataaaatattatttacttattgttaacttattttatcatcaaagaaactataaccttaacctatatttttcatatttatactgaagttttaataagacgagtaagacgaatatttaaacaattatatgaaaaattaacggtgtcgtatataagaaaaactgcggtagtatcatttataaatgtaaatccatttctttttcccttgattgcacgctagatccggttcagacagaattgattgggcaggtggcgagaggccgtactacgccacattgtcctccccctggaaaaaaaaggcaaaaggacaagaggaccaacagaaaagggtgagagagagagagcagggcactgcacggtgcacagccacagcctgcactgcagtagtgcagtttgcagcaaaggcagcaaagggcatgtttagatccatttgaaatggcaaatggtaaatggtaaaagttttattattgtaaaagtattagttggtgtttagatgtattttaaatttttgccattctagcactaaagtgagagagagaaagagatagggagtggtcccaaagcatttttttggcacaatttgctactatggactagcaaatgccaaatgtcaaattgccaagttttaatactagtgtttagatccaaaatgacaaaatgtacttcaaaatggcaaaatttttgctattttggaggatctaaacagggctaaaggctagggtagtaccaggtactggagcactgtagtgtacttcctgtagtagcccaaaggcaaaatttgctacaggacacgcaaaaaacgtgtaattagctgggagacaccgcgaaaacgtgacacggctgatggacactacaaaatttgtgtaattggctataggacactggtcgcattattttattatttccgagtcaaaacaagtgatatatttttctgaatgtctagattgccctttctctttccttccttttctcctacgccgggaacctgcgtgatgggacgaggtcggcgaggtcaccgggaacccgcgcgatgggacgaggtcggcgcaggcgcgagcttgatggcggcagcggggcggcagacggagaggcccgcctcggcgatgcgcagcgcaacggcgaggccggcggggccgctgacgacgacggcgaggtcgacgggcctagagcaggcacccggggggaggggtcgccgaccgctgccgcgcgggtggggggaggcgtcggcgagctcggcgcgagtgggcgggcatgagctcggcggcagcggggcggcagggcgagaaggcgctcggtgttctcggcgaaggcgctgagtgtccgcggcgaagacgacgactacggcgagggcgagagcagcggcgcatcgccgccaactccctctccggtagcagctcacggcgcccacctccatctcgccggacaagaggaagaccggccagctagcagctagcagcagccaagcatgcgccggcgagctcgctccaccagcaagaagatggctagctagctccttcaattcagacttgagagcttgagcaggcagcaatggcgagctccttcagacttcaggcttgagagcttgagcaggcagccaggaggcagctgcagccggtcaggggctcgatctggtctctgatttgcaagtcggagcatgcacaggcgtcctcttgtgccgacctcgccaacctcaccccactgcgcgcgatcccggcgaaggagaaaaccaaggaaagagaaggggcaatctgggcatttagaaaaatatctcacctcttttgatccgaaaataataaaataatacgacaagtgtcctatagctaattacacaatttttgtagtgtccgttagccgtatcacgttttcgcggtgtcttccagctaattacacgttttttgcgtgtcctgtagcaaattttgcctagcccaaatgccacagttttgggcctaattggaatataatcaagctgagctgccatgggccacggccactgcacgctgaacagctcagcgctttaacgtgccaggccatctgtttacagggttgttttcttaattaagtgccacatttttttctaaacaaaggcaagagatacacatgacccaagaaaaagttctcactttaaacaccataatattacaaacactaaaaacacctcaaaatcattccccaaagctacattaaacacctaaaagaaaaccaaaaaatgccacattttacccaaacatagtcaattggtttttagtcacagactacgctcatcacatttgaccctgtttagatgggactaaaacttttaagtccctatcacatcggatgtttagacactaattataaatattaaacgtagactattaataaaaactcatacataatcttagactaattcgcgagataaatctattgagcctaattaatccatgattagcctatgtgatgctacagtaaacattctctaattatggattaattaggcttaaaaaatttgtcttgcaaattagctttcatttatgtaattagttttgtaagtagtctatatttaatactttaaattagtgtctaaatatagagactaaaattaagtccctgtatccaaacaccaccttatattttttcttcttacctagccacagactccactcgccatatttaatttttccccttaccttgcctaaggtgtgaacaatagatcttggccacaccttagcaaagggttgactaggtggtgttgcattttttttaaaacaacagatgctcatataaatgtgcacgcaatcactctatccctttgagcacctttgaagattgtataagtatatcttgagattcacgaagtcacctatccctataaaaacccgggtggatagattgcaccacgaagaaactaaccaattaagttatactcacttcacgccaatatgtgttatatctttctcttgagcaaatactgttacctttttttgtttgataattcatgtgtttccatggccaaatttagggctccttggaacgcatgaatcttataagattttgacaggaaatattttagctcctcctaagtttttccaaaaaatcatatgcttcaagggaagcctcattgatcctcagtagagtcttaaaaatcaacacaacgctatatatcggggtatttaactttttgccactttgaaatgtggcaattaaagatttaccactcgcaatctatgacatgtgtgcctagtggcaaatccttaattatcacttgtaagagcggcaaatagttaattattccctatatatataaagtttgtttggtttagtagcccaccaaaataactctagagtattataaatgaatttgttcgaattgatattaattggaagccaaaatttatataatagcaaagaaagttctagaattgtttcaaactgagcatgtgcattacccatcatttggcatcaaaccaaaccatcgtatttactgctcaaactaccaaaacaattggtatgacacgtcttagcattgatccaaaatgacccattgttgcctagcagtttcatccataacctccataactaactggctgccaatcaaatttgatcaaaatttatcaaacaattgaatttacttcatccatcccataaccacacaagggattaaaccttttctttttccaaaattaaggaagtagcaaagtcgtgatacaaaagtgatagttataggaatataactacaaaagttagtagatagggaataaatagtagaaaagttagaaattgaggaataaaatatcttatattttaggataaaatagaagagtaaaatattttatctcgtagaacagagagagtatgagcttaattaattttatcaagtggtttccaggtggtcgatttataaggccgataatgttcctcgctgactatactcttcatatagccccaagctagttgcatgaatcatataatactataaagttgatatttattgactcttaaaagtttaacatgcaagtgtaccacataaacccactagcaattattatctacaatattttaaatatcatgtaaacataatatatcatttacaattttattgtatttctagaactcaatatgcaagtaatatcaaatcattatatctacatcattttcacattatttaaacatatacatatctcgcaacaaagtatactaattcgaatactttgactactaatacatactgatggcatccgtggatcacaccgttggtttgtcaaggaaaatacttctaatcttctatacaacattttcactcttttactattaatcttgaagtccataaatgttgcttcgagagaaaaaaataaccctgatgtccaaattaaaacaaatcagctcaccttatatctccagactcgatcacaaaactctgatggacgacgcgacaaagagagcttgggaagcaaaggcatcgagtagtacacatggctgatcagttggcatgcttcttgtcaagccgcgagatatggagggcttggttgacctagtttttagattctaacacgcggctgtttctgaaaatatggaaaaactctgaaacccagcttctccagtttctggcttcttaatttattcttcagaatatgtaactacagattctcaaaagctatagactgtttgggacagcttctaacagaagcagcttttgagaaaagctgcagctgggacaagctcccccggaatggtcttttgtagcgagagtgatgtggagtgaagcatacagggcaaaacatccgtgaaacggacgaactagtgtactgggtacaggagagataaggttaggttaaggttgaagtttatatgcaatgcatcaattaacgtctcgttcttttctaatctaattaagacaaattttatctcagttttcgtttacatacttttttaaactgctaaatggtttataaaaaatacagaataacaacatccgctcctcaaatcttaaatagacaccaccacagatgcttggactaaatccccccatcatgtgagaaagggcctatagcctagtggttataagagtctcagtaacaccataggtcttgggttcaactccacatgggagcaaatttttcaggatttaacggctttgtgctttcaatggtaggcgatgtacccgtcgacagcgaggcgcctatgatgacttcgttaatctccaggatggatttgccgacccagtattcaaagatgctcataggggtagcgtttgcgtgcgtgcgttcataggggtgagtgcgcgtatgttgtgagtgtctgcgttgtattgtataattctcaaaaaaaaaatccccccatcatgtagttcaccgctattttactccaaccttatcaagtgtcggcctacggtgacttcatcaatctccaggatgatttgctggcccagtcttcgaagatgctcataggggtagggtttacgtgcgtacgttcataggggtgagtgcgcgtatgttgtgagtgtctacgttgtactgtgtaattctccaaaaaaaaaaatccccccatcatgtagttcaccgctaatttactcctaccttatcaagtgtcgtaccagtacgaggtagtactactatctctctgcagctgctcctcctcaagaggcgcgcgtggcaattgcaacagcggcgacaacagtcatgcatggaggaggtggtagacatagacgagcacgacgaggaggcgatcgtcgtgggcgccagcgtggcgcagctgcctggaccgtgacggttgtgtcggctcgctgtggtggcgccgcgcctacgaccgcctccgtgtccacctccccaagcagtaccgcacgggtgatggtgtccgctcccgcctccgccgcaaggtccgggaggtgcggttcgacgccgtcgaccttgccaccagtaagtaacttagagcggtatgtggcgaggtaccgccgccgccagtgagaacgatgagcaggtggtccccatgaccgggatcgatggagacgttctcggggaagacgatgcacaccgccgactacatattttggttgtgtgtatatatatatatatatatatatatatatatatatatatatatatatatatatatatagaatgtatgtaacgttcttgtggtgttcggcttggatgtaatatggggtgttcagtgttcttgtgatgttcggattaagatctgagctgagtgggcttgatctgagcgtagtggggctaaacgtgatatggacctaaactaatataggaagagaattggaaattgtggagcgatctgggaggaattggaaaaaaaaaatcgtgcgcactacacggggagggaatcagacttttttttgcgtttttttcttccctttttaccatacaatcatgcttctttttttcgctctttttttaaaaaaatttagattgacgacataaacctcggaaacctttttaattttttaagtagtagagatagagatagagatagagatagtgatgcacatattaaaaaaaagaaaaataaaccaaaaataaactagaaatgaaaaaagaccatatgcaaggaggcaacagattgagatcctctgcaatcaaatgcatggtgactttgggaccacatgttaataataaagtcacttgacttcttcaagtgtagaggattatgatccgaggcgccgccccctcccttccggagatgaccggggagacacccccggagtgagggggaacgattagctttttcgcatgaagggtgattgactgctcgtccatcatccatgcaagggataagagcaggtacaatagcaggctattagccagctataaatatattttaataagataaaagatgaaagagaagagcagcgggctacagatctgtagccagttgcagcacggactctaaaacgcagtgtgtatatgacatgtgggaccatatattaatagtatagtaagcaactattgtataaattggctattagataaattggagtttgtaatgggctaagtttaagacgccgcggccgcgcgcaaattaaaaggggttaatttcgcggaggtcggtaggattattcgcgagtttgttggggatcgagatagatttcgatgaatgattggttcgatctgagactcccgccatcaatcaaaacccttataaaatccccccttctgttcatcctcctcctcatgttggtggtttgcattggcgacggtggagagagcagaagccactccatatgccaccctcttccgcagccgcagccgcagctgcttctgctcgtcgtctgctagctccgccgccgccgccgccgccgttgattttgccggctgctagcgagctagctgctcactctcgtcgagagcaaatggatatcgttggctatcgtcgtgcctcggtgaatcgagacgtgatgatcatcagtggtatgaagtactccctccatttcaaaatgtttggctgatcattcgtcttattaaaaaaatttaagtaattatttattcttttcataaaatttgatttattgttaaatatattttcatgtgcacgtatagttttacatatttcacaaattttttttgaaagacaaacggttaaagatgtgctaaaaaattaacggtgtcgaatattttgaaacggaggtagtatgatatcgttctaagggacacagcgacttgttgttgttgttcgtgcttcatcgactcatcgtcacggatcttattgattaacggctccgttggcacggtcgtgacttgtaagaaaaaaaaatttcgattccctttctttacatcagattcgtacgataaattttaagattttataagagtttatttatatctattccatattaaaaggtggtcaaagtggaaagtaaataaaattgcactttacgcatgataaagtgtacattgtttcactttgcactaagtttaacacatatttttactttacaccagggttcactgatttaggtttcacttaactacatcatcaaatatataggattttcatgacatttcataaattttttgaatgaatcctcatcaaacatagtctaaattaaaaagtttatttaataatttttaatcatattttacaagatttatgatacaacacctagtgtaaagtgcaaagtgagagttatttcaatatactctggtgtaaagtgagtatatattaaacctggtgcaaagtgaaataagatacactttagttggtgtaatgtgtaatttactctttattatattgtcttccaaagtgtgtaatttggataattttaccatatcaaattactttatatcttttcatatacgggagtgttaaattcgtttaatttgggaatttatcttacttgagacatattttttcgcccaacataaacccgttaaagacagtacaatctcgtatgaccgagacaaaaacttcgatacttcaaaccgggcggccaatatattccaattttaccttggcagtagaatagagcttaactaatttcaaaatggtttaccagtgtttgtctagtaaaggaaacattccggcacaatctatactcattaaaagagaaggtattagtgaatttgtcaccccacctcttgttaatcttaaaacttagttgaactttttatcattagaaaacaagctaattacatagctacgtataaaacaagcaaattcatgttgtgcaagaggattgataacacattgcacaacatgaattttaatttattttagacagtattataatatattttctattatctctgtaacaaaattacaactatccgttcatattgtattaggcgatattagtctccagttaaatactacctccgtcccctaatacaagggacattcactattttcttataacgtttgaccacccatcttattcaaaaatttgtgcaaatataaaaaacgaaaagttgtgcttaaagtactttagataataaagtaagtcacaaataaaataaataataattttaaatttttttaataagatgaatggtcaaacagagtaagtaaaatgttaaaatctcttatattagaggacggagagagtagttagttatattagaaaaaaagtaggtcatgaactcatgatggtttgttactttgtttggtcaatcgtatattgagatggattgctcagtctcagattatcccttaatctccatcatgttactttgttatcaccttgacgtgtcagcgtcattgtagtcgtctatcggacaaatcaccctctcttttttcttcatctctgattagaaaaacaaatcatacactttgaccaaataagcttttgagaccatgcgtgatgtgaaatcgttctagaaaatggtaattacggcactgatgggaacgaccgcacatttattgtcttgcacacgagaaactcttaaattccggtttgcccctggaaagtaagttcagtgatatctgcatccttaaaatagacgaaagggtacacatccaaatgaattcagatagaccaatgatggtgaaaggggtctttagtttatatgggataaaatgacgaaattgtaaagtgagatgattctcaaattttatgaaatatacatatatttttcgatatattaacgtttatccgctcatacatagatgttggcgtgtttttgtctcgatgtattatcgtacatcttagatcggagaaacactttcctttctaccagtttgtagaagacaaacaacctatcgctagcatgcgagatttctctagcttcaccaatactttatcaattgattcaaaatgtggacgcttcattgctttttaagtgattaagccatgtggctttatttctgcctcaccctacttttttgtcatgtccataaaccacataggcacaggcccaaccaaaacaggttgttagctagtcaagtttgtaagatcaagagtggcctccaagaggttcagtcaaaattagaaatagccagtttatccagggatgtgaatgcaatttnnnntgaattaaattagacccctaatttaattctcaattaaccaggtactgtcctaataattttctcccaacatccccatcgatcctgactttgtctgatccccactgttttttcttttccttttggccactctttgatttcttttttcaattctattgcgggtggagactttttggtttggccgcaatccaccaccccattcctatccatcctccttcagcttcttctttcttctcctcctcctccttgactgtcctaacaaaaaaatcgattttttgttctcctcttgatggttgctgcgaccttcgatgtccctatgcggaatgaaatctcctgctggggcggctaaaaatcggagattttctgtctttttgatccgtctttagtggagctttttgagcctgatttatgcgatgggcttcttggcgtgcttgttcccatgtcctcaagaggtgagagatgaggatgaggaaccaagaagcggccagagagtcagctcaggtggatttaattattctttttgttggaattcgttcttatgttcttgcaatcttgcttaaaaattggagtagaaatgtttggtgctgattggttagtgtcacttgtagcagttcttgtggagctaaatatgctctcaggtataagaggggcttttctttcatgcagtggaaggaaaaaagaatcgagttatttgtgatctattgatcttaatgattgtgctgttgggttcgggatgattcaggctggggttgtacattaatttaattttttatttagatactagacttattgtagtcaaccatcaggatttttcaattgtttgctcatttccccttttggtttgtggtgggagcaattatttgtgcaattcatctgaagtcacacgagaggatccaaaattagaagtttgtttgtaagtttggactttggagtgcgtaatttcaccgggagaagaggatagaaagaacatgaattagtttaagcggaattaaaattatgaagaagacgaacactgtggtagaaaaggaaacagtctgggtggactcgaagaaaatcgctaattttctactattcttgttttcgatttccaactctgtttctctttcaggatgtatcgagtctatcttcattaacagtggacgtgttcttttcttcccttgaaatttctcaataacagtggaatattcaaagtcgtcagagagttgcccactgaagactgaagggtcgatagatatggttggaattcggcgaaataaggggcatggtgaagcaacgatcttcactttgcgcgagcttgctgatgctaccaacaacttcagcacggagtgccttttgggccgaggaggattcggcagtgtgtataaagcatttctcaatgatagacaggtttgtattttctactcaagcacccaactccttatgcacttcgagtcccaagctatgccgcgagcatgaaacaagctttttcaacaacactgctttgaatactttgtgatattgataaaagaaactgttcctttggtcaaaattgatgggaatgcttagactattgatgttaacagaaagtattgttatgctatataccctttgtataaatttctaatttggttccagcatttgctgcatcgcaggttgttgcagttaaacagcttgatctaaatgggcttcagggaaacagagaattccttgtggaggttctcatgctcagtctcttgcatcatcctaatttagtcaagttgtttggttactgtgtggatggagatcagcgcctgcttatttatgaatatatgccattgggatcactagaagaccgccttcacggttagtattttattggaaattgtataatatcctctgttagctcctagaaaaacctgaaagttccctaagaatctgtagttgtgttagaaaacattttatatttttcattgttacatcatcgtgatttaaagcacatctaaccacttgaacatggtgaaaagaactgtcttctaggtgagaagaaataaaaaaaaataaagagctgataatttggcacctctttcagcattttaaagatcagtagctgatagtacataataacttcaatatagaaagagttcacaacttctgtacttttggatttccctgaattcgaagtgtgttttctgcattctatcttggcaaagaaaacaattggttttcttcaatgttccatccatcatattttctaaatttgaatttctattataatctgttgtatctgaagatggcttgaagtaattcctttaaatgataaacatcgcaaccttttaccttcaaatggctattactatgccttgctaaaacatcatttgacctttttattatgtatgatgaaggtgctattgtttttggcattgaaaattattatccagtattttggtagacctgtctaggatccagattagttttgtttccattgtcttatgcatctgatcaaaagctaaagctagcatggaatgttcaactttaggcagatctgtctagaattcagtgaggattcgagggcataacttttcataaccatccataaccacttttttttttttggtttgacgagaggaccctgcagtgtatattcaataataaagagatagattcagcatgtcgctgtttatcacccttcatgtccgtttctaccattagaccacatggttcaaaaagaattaaattgttctttacattccagtaagctacttaatttccttaagtattattactggataccctgttaaaaatttgctgccgatgctttttacagatctcagacccggccaagaaccactagattggacaacacggatgaagattgctgctgatgcagctgctggtttggagtatctgcatgatgaggccattccagcagttatttaccgggatattaaaccgtcaaacattcttcttggcgaagggtataatgcaaagttgtctgactttggacttgctaaacttggtcctgttggtgataagactcatgtgacaactcgtgtcatggggacacatggttattgtgctcctgagtacctctcgactggaaagcttacgatca

SEQ ID NO: 68717 - DNA, 6798 bp, Oryza sativa
tgagctaattactggacgaagagcgcttgacagcaatcggccacctgatgaacaagacttggttgcatgggtatgtttctatcaataccagaatgttacgaaaggtcacaatgatcatattttcacaaagaaaaacaaaatgaggataaaagatgtattgtttaaagggcaacattgaaacaataatggcgtactggaattatagaaaatgctacaatacattttcttctgtgattaatttttatactacagctatcattaacaacattgtgctgtgtggataaggatcaaaaatggtatttggtcgaagttagtaacatttaattaacggtgcaagggtgggggtactggtgctatgtacaccttttcaaatatatagtgtgagctatgttctgagaacaaagtaaattatattattaattaacctccctgtatgcatcctaatgcctatggaacaggaagtaaatgtctcaatcttgtgtgtccaggagtttcctcgttctaggaaatgaatcttatctgtttcttaacataccccctcagtaccagttaaatgaccgttcatctaacttattgggtgtcctactaaattggatctgtccctttttcatcatttgatcccttgaatactattatgtttttaatgttaaatgttctatttgtctgcaggctcgtccattgttcaaagaccaaaggaaatttccaaagatggcggacccctcattacacggccacttcccgaaaaggggtctgttccaggctttggctattgcagcaatgtgtctgcaggagaaagcgaagaaccgcccttccattagggaggttgctgttgctctctcttatttagcatcacaaacacatgaaagtcagaacactgctgctcgccataccctgcctggcccttctgtaccaagagtgctggataatcagattaaccaagacacttccttgcccagtcaacatggagttcatatgccaccgcttgccgggacggatcacatggtacaagaagtcaaggagaattgccggagcagttcgcatcgaccgggaaggggcagagttaccccgaacggcgctgatagagagcgtgcgcttgcagaggcaaatgtatgggtcgaggcttggagacgtcaagagaagacgagcaaaatgcggtaatcaacgaaaagcttctcgctgctagcttcatttgatcataggaacagaattgacaaggtatgccacagattgcatacgttttgaagaaaccgcggaccgaataataactgttagaagacgatagcgaataataatgatcagtgagttcttctgtggacctacaccagagtgagcgcttgggagatttcaccggtgaagtctactaaatttacatccagacttgtttcactacatacatggattcttatttctcatcatatagataatttagcttctataggttaaagtcgcaggaggggatatgtacatgtaaataaccccctcataacagaagtggcagatgcagagcatacatatatttcttttctgtagttggatgtctcttgtgaatccatgtacatgagctggtaccataagtgctacagcttatacatttttcagatgattcttggtgttaactctcccttgcaattctctgttctcatcatgcagcacaggtaaatgtgtgatagatttgtgaaaaaaaaacaaagagatgaggagagatgctgaatggtgatgctttgcataacaggcatgcagtgtggaaggagatctgttcctctgcagtgtttgtttcagagctgttgctattcatccttgtcatgcaaaaactttctataaacaaattcctttacaaactgttttaaatcaattttttcaactttataatagtcaatgaatttgtttgtagcctccaataattatcacaaaaccatttagctattaaagtaaaggaaaaaaaaaggtaggtgtaaccagcagaggctgtgaattagtcagggaatcgctgtaaaaacactggtttttcgcatgtggattgacgacggagcagtggacgattcttaatttgcttaatctgtcattacattatactcccgccgtttctaaatactacctctatattttaatgacgccgttgactttttgtccaacgtttgaccgttcgtcttatttaaaaaatttatgtaattatcatttattttattgtgacttgattcgttattaaatattctttaagcacgacataaatattttcatatttgcacaaaaattttaaataaaacgaatggtcaaacgttggttgaaaagtcaatggcatcatacattaaaatacggagggagtatttgacgccgttgacttttttaaatatgtttaaccgtttgtcttattcaaaaaatttaagtaattattaattattttcctatcatttgatttattgttaaatatacttatatgcatacatatagttttacatattttataaaaaaatttaaataagatgagcagtcaaacatgtgttaaaaagttaatggtatcaaatatttagaaatggaggtagtgttaaactacacgaattaatcaaattttgcaaaatttatgtggcatggttcaaattttcccattaattaatttaatcaattgctcgctcgtgaaaacgatgtggaaatctgtggtcggacttagctatgaaacttctccttttcttttgaacgaaaacttgctataaattcatcaaatgacaaaacctttttcaccaaacgatcattgtagagctagcagctctatggaacacatcaaaatgcattataccgttatgcaccaagagaaaaccgctcttaaaaaataacacatgaaccgtgtattacttctaggagatcacacaaacaactgttattcaataatactccatccatcccaaattataaaagatttcggataaatgtgacatattctaatactacggatatagatataaaatttatccagattcacagtagatgtgtcacattcatttaaaattgtttatattttggtacagaaggagaagtggtttatgttggtgttgatggaaaaaatcaaattttatcgttaacagttgggtcacataaaccactattattcaaagaaatcaatacaaagtaactaacccataagcctgtaagatgcaatgaatctcaaataaatatccgttgttactatatacaatatatattgatacaaattacacaacaattctacagagagaccaccgttgccacttgccaccaacaactcaacttttttttttaccaaaaaaaaaaagttatgaactgcaaactcctccaagacatgccctgatcaaacagaaaatccttcacatatatttctacacaagaacacgttaattaattactcccgaaaacatgaagaagaagaaatcacgagctagcttcatcgcacggacaaaagaaaaagaaaaaaaaaggagaaaaaaaaaacacaaattaaaagcttagaaatcaagctcgacctgcacctgcagtgttgttcatggtttcactcgccggccggtcagtcagtacacgcagaagccgcggcggcgcggcggcggcgcgccgccgccggcgagcagcatgaacatgatgacgacgatggcgacgaggaggatgccattgaagaggttctcgtcgatgacgagaaggcacaccttccccatgaagcccaagctgataatttgctaatgatctcctccgatttgattaattacttcgatggcgaagaagcagatcgaatgctaataatgatctctctctacactaatcatcttactctatttatatcgacttatcgaggtgtgtgtgagagaatggatgctttctgtctctctttctgggtcaacttccagaaccaagtccagttagttttaactaaattggtaatctcgattagcaataaaattatgtgattagcaaaagtaaaacacgttttttgcagttaggtgatgcgtggttagtgtatttttaatattttatggtgtgtgatcacatagtggttgtggtctaaccgtgtgacgaaatggtacggcgttttggttggtttttgctcgagtttggtggtatttcaattccgggctgaattgtgggaactgttcattgacatatcaagcctagatagtgggaagatttcattggagattatatgtagttggtagtttatacttttgaaagagttttttttttttttagtgtgtgtatggacaaaatcactcttgatagaggccagttcaccgaacataacaagtacaagtatatagtcatcaagaaaaaaaagttgattggtgtttgattcgatacaaatctaaacatacttccagctgttttttttaaaaaaaaaattttggagaggaaatctttccagctgtttattaaatttagagaaatggagaaaataaatttcttgtggatctttccacttgtaacctgtcagtctcatggaccacacgtctcttttatttatttacacctgtctaaataactgttcttttgtattcatggatcatatgaaatcaccaagaaaaatcactcccctagcaatttgacaaggacgtagctaattaattatcatgtattattatggagaaaaaggttggtgtggtacgattattattatcacaaatttcatagcacataggcaagttgcaacaacggcttgaagaaattaaatccggtggcatgtgcgtatacaatcctcattatgtcacaccgttgacatcataaaaaatgtaaaaaagaaaaatcctctaaaaaaagatgacatgagatcgagttgtaatattacaaaaatatatggtgcaaagcacgcttgaacaaacatataccctgcgtttgatcttgatcgatccctaccatagctaattaatcgtgattaacaaactaatttaatggacacgcgtgatccaacacaagcttgctgatataatacaataagaatctgtggttaatggacgattagtcaagtgatcagtccaaattaaggctcaacgtttgtataccaaatacacggcctggacttcactggcttaatttatgagtcaaattgtggacgaaatttcactaggcacggttactgaactaccgtggacaaagaagctctccctagattttattcatctttctcaatggccatttgtcactccggttcaaactaaatcaactaaaaatacaaatattttctactacaagtcgctctcagttgattctattcaactcttgtaaccacaggggcaggtcattctcaaggaccagttttgtgaagaaaaaaaatcagtcgaattgtggaaacaaacaaatgtgtggaagatgcagtgcaaatgagggagaaaagacctgcctatgtcaaaaagttatattctgggacggagacgagatcaactcaactgtgcactcgtcatctttgatcttgagatacacatatataataaagacctggaagatgcattatatggtcagatttcagagtcgccgtcttctgctgctccacacaccacacaccacacgtatgcagaacggcaaaaagaggtggacagggttcaaacatgaatgccaagttcttgtctgatctttgttgtcttaactttgttattagtactaacttttacacaaacgtgataagggagatgaggggaaaaatgcattagctatgttcttagaacattattattgtcgtgttatagaaagaggaatcatgtacgtcacggtcacatagcatattgttcaattccaggtaaataatcatctgaaaaaaaatggtatgatcaaaactcagaagagaaaaggttggccagtgatgattatataatcaccgtagattttcctaaccgagaacactggaattatctagtaaaagggaccattagacagcggcagctaggttgatagcaccatgctccaatatagtcctgttggttcacagattcacagagctttacaggcattcataacaataaatttccaccccgttgcttggtaaagtaaaagggagtgtacaaatatacatgattttaagggctatgaaactctacagcattacatggtgagaaactgaaaaccgatgaaacgccaaccaaaattggcacaggggaaatacaggaagggttttggccacaagctgcctctccagatttggccagaaatggtatactgaaagaacagcagctccacgttgcatatagataaatgatcacacagccaatcggatggttcatcagtcatcacttcggatggtgagaacccatgatcatagcttggtgcaagaaacggtgaagaaatacaaggctgaggccctctcttatgatccctatgaacatcacttgcacaatgccaaccaagccagcacctgaccaaacttcggctcaaccacagcgaggtaaacgctgcagttcagcgcccaaatatgaggcggcgtcagcaaggcagccatcatgtgaacccttgaatgccgacacgagtgcttctactcgcatcaaggctgacaaagatatcgacacgatcattccttgcgctagatattgcctgcaggagaaggccaggcaatacagcaggcgagtcagccttaggcaggtgccatgcttcagcaggtccagaacaacgctcagtttaggaagattggtcagcaagcccaccgtagcctcccgaggtgctgctttgagtaacagcaccaagcagtctgatgccaaatcgcttatatgtggatctgaacttccaactaggtcgaggaaaatgcccatgttgccaccaaagtcgcatatatccatgacgcatgattgttgatcgacagca

SEQ ID NO: 68718 - DNA, 2063 bp, Oryza sativa
tttctgggcatatataggtattggatcttcatcctctgcaaatgatggatacatggggagaaaatacttctgagagatcttttccaggtcagatactgtttgctcattagacgtcaatgaagagtcactgaagatcacaatcatcacatcggacagtatctttaaacataggaatctggcatcaccatctttattgcccttgtacaagacggataagcttggaaggattcgacttgtgaatattttgtgttcattaagtataacagaaggctcctccgtggctgcctcaagaaccctcaatagtgtcatttgaaaatcatcccgagcctggatgtataagacacgtaaataatcagataaggtcaagatatgttaaaaaatacagtagtaatgcaaaactgttaaggcaagagccacagcgcagcatcaaaacaaaggatgggattgatttgacacttaagtgcagttacaaaatgaatgtggtcgtcatgttttttcatcatggcataaccgtgcgtgaagttcttagatcatacctgaaatggtgcttccaaaattttcataagatttgccaactgaagcaatacatggctcgtcacaactctgtgattgaatgaaacactcccaagaagatgaaggataacaggaaacaaatgaattatgctctttggatgagctcgtccagttaaagcagtagcagctccatgacgcttgcctcccataacctgttgtatatcactagagacagtgtcaaggatgcctgggaccaatgaagcaaccaactgcacaaatgcttctgtgcattgatgaatgaagccttccttctcctttcccaatctatcaactgctgatagtagttttgcattgcaaaagaaatgaggaagccatcttcgactgttcttgcaaagaagagcaacaaatagaagggttttgccacgcagaacatcagttccctgttcaataagagagatgagtccaggaaccaactgcttctcttctgttaacgactgaatgtagcggttcatggttggtatgatttggctgttaactagtgctgaattcagaagattcaaactgatctgctgctcacgtgaattgcctttaatgagtgtgcatgcgatatccttgaaggccagcctctccagtattaaatgaatacaagatgagctgaagcgagctaagcgtgccaaacaagatcctgcaataagtcttgtattctcctgcttaccagttgctctatagatgtagcacaggtgactgattacatcttgggaagcgaaacgtgaagtccaatctgtcccttggctacagatgttatcaatggttcgtaaagcataaagctgggctagatcatcttcacctttacgcaagattgatgacaccagcgcaattacagaacttggaacctgcacaacttgcaaagtaaaatcattaataaaacacaataattaatgtcatagttgtgaatcaagataaaaggattcctcacatgtatgtatatatatatgatatatatactacttgaccagtaagatatgaaagtaaaggtctcattaattcattaacactattacatagctgacctatatatggttccacaaatacaagaatatagtcattaaaaggaaagcaggttaaaacacttgaaagaaaattggtatggaattatgtcccttaagttcatcaggccctttggagaggcaaagttcaacctataggtgagagcaaggttatcaagttgcagaaacagaaattgacaaagagatccaccctcaattcatggacatacaatcactaaaactaacggatagatgtaatttgaatcactcctgattaggctagccattgaacaggattggtatgtggttttctgtaaaatcatacaggtttgactaacaataaacatgtgcatagacacaaaatcaaagaaaagagcatgtatataaacataatttagtccatatattatagtaatagttatgaaggtgggcagtgtgattatgtggttatgtgaaaaattcaataatgcagtatatactttcaactgaaagaagcttccactt

SEQ ID NO: 68719 - DNA, 2535 bp, Oryza sativa
tgaaatgagatacaaaaggaaaatggaagctcacatctccaggattggtcttctctatgtctttcaaacgccttgctaatccaaaatcgcacagctagaaaattaaagaaatatatatcgttagttacaagctattgcctcactgtatgaattatttgatccagtaagtaccttcatgcacccagattcatcaagtaaaacatttgatggtttcagatcacaatatataattccttgtgaatgcaagaacctaaagtccaaattgttttgacaaataagatttcacacatcatacagtagaaataatgaaacaaggaaagaactttactgaagagctttcacaagatcataagccaagtcatgtatagaattttcaggcagcttcttatcctgcaggtcattgaagaaatgtaaaatgttcatatgcaaatatactaacacaaaatactaaaaatttgggtacatattagagcatacttaaatgtgacatgtacataaatagacagccaaagcaaaagtttttaacctgtcagtttgacaatgaattttccttccattctactacctccatcccaaaatataagaagttttagggttaagcccgtatgaagattgagggggaggggaggctgtgattggttgagaaaagaaagtaaatagagaaattaaatgggggaaggttgtgattggttaagaagagaatgtaggtgaagaagttgttatattttgggatggaaggagtaccagctataagctaaaaaaaatgaacatgtttttttaaaaaatttcttaaggagcaaacaaaagacatctcagcatgcacagagagagagagagagagaaatatttgtaaatgaagcaaatgcaaatcaaatacaaacgtgtgctattgtacaagtaaacagctgacagcgtgctttgaactagaaaatggtatgctgcttaaactgacaagcgagatacctgctcaagcaagccctttaggtctccaccaacgcagtactccagtattaaccaaaaatgagctgaggtttcgtacctggtacaacaggtacaggcataagtatggtttgtagtacaatgttaagggaacaataacgatgattgcaaccaaactgccagactatacttgtcattattgttctaaaaagtgaactgcttgccattattgcaccacaacactagtcccctagaaacgtaccatgagtaaaatttcagaacattcggatgatctaaggaatgaagcattcggacctgcaaagaaaagttcagaagtactattagtggagtaagcaaacatcctcattcctcaggctcattaactatttttcttaccatgctagctaaaagattattttttaattgaagactagaacatgtgctcatcttctatccagaaaatattatctaaactactgatcttcacccttaagcgctttgctcaaagagaaggtacattcctgaccaaataacataacatttgacagcacaccaaatgtaacttatgttgcctcatttcatcttctctagaaatggctataagaaatagattgtttcgcacgattatcaggaaatcaaaatctaaacagcatcccagcttaagcatgtaaagtgctttttcccaggaaataaatagcgatccactagtacatcaagatactatataacgaacaatgtaacattctgcccatttaaacaacatcagcttacaaggaaactctgcactctgcatgcccagaaaacagcggttaacgaaagccacggtatccacacagtctaaaacagtcacttaaactatcaaatcaatcttggatatcatatcacgatttgcttccgggaaatccataggcacccgcagatcaaatcactccaaggaccatttcacggaccaaattaaccaggcccgccaggagccaagccctccgattcaaaatatccccacccaaaatcgcggcggcgcatgcctaccagctactactgatgaaagagcagggagacgacggcgccgcgctcacctcattgaggaccttggaccgctgcgacttgtcgacgctcttgacggcgaagtactcgatgctcttcttcttccgccccttgtacaccgtcttccggaccaccgcacccaaaaaaaaaaaaacaccaaaaacaaatcagaaatctcacccatctgcacccaatccgagcggatccgggggcgcggggaacacagggaagacgaggagaggaaggcggagaggggggttaccgagtgcttgccgcggccgatggcctcgtagacgtggaagttgttcatggcggagcaccaccaccaccagcagcagcttctcctcctcctcttctcgtcgacttctcgtcgacctctcgtcgacggcgacggctagggtttgcgatttgaggcggaggaatggggggggagagagagagagagagagagagcgggatttcgatttgagattggcgctcgctcgatcggctagttttggagttttggggcgttccgtttcggcgtagttttttcaaactttttttttttcg

SEQ ID NO: 68720 - DNA, 4111 bp, Oryza sativa
gtcccatatggttatgattatgtgacaattatgtggatttggtctaaacctaatgtgactgatgtacccatttttagtgttttaagataaaatttaagctctcttggatagattagtttttttactccctattttcagcttattaaaccaaaaacaaattctaaaggagagattatacgtaatctcttgttgatacctgtttggattaatgtcaaaatgtgcccatatgtagcttataaatagtaaatgtgttagtttgatttgaagccaaatgattggtaatgcccatgcttaaattggcaataattctagaactctattcacagtaatatatatatgggttaattagatacatgccatgaaaattttgccggttttgaaatatgccattactatttacgtatttggaatgatgccattgctatttgttgtaatcttagtggtgccgctaagatacgtattttgcatgtattggacgaaaatgccctcatcttctacctctctccctcttctctcatcttctagctctttccccgctgcttctactctggcgccgtcaccgccgctgttgctgtcgctgccgctcgccgctccgccgccgccgctcgctccaccgctgctgctcgctgttgctgccgctccgccaccgccgccgcagctcgcgccgctcgccgccgccgccggtcgcttcgccgccgccgctcgcgccacttcgccgccgccgctcgctccaccgccgccgctcgcgccgctcgccgttgccgccgattgctccgctcgttgttgccgccgctccgccgccgcgccgctcgctccaccgctgcagccgcttgctccgctcgctgctgccgccgctccgccgccaccagttctctgagctgtggaagaaaggagggggagaaaaagaaggaaagaagggtaatttggtccaaattttttcataaatggttggtagtggcatatcttaaatatttgtaaaattgcaatggtatggttccaaatacgcgaacactgatagcatatttcaaatccggcaaatttttaatggcatatatctaattaaccctatatatattgtctcccaataacatcaatgcaaacacattcacctttaatactaccctaccaaaacattagtagtgtcaaaatttgcttaaattttggtacggtactaagccaaacaagcccataatcttccacatcttccctgatttgaacgtgcttatcgtaaaaaaaaaaccatgattaaattattgaactatggaggactggaggctataaattataatctaatttgagtttaattccaaaagaatattacgagcccttagcccggtcaaaatatcgggcgtggaaagccgccattctatatcagcttcatgctagagcacctctgctgttgattcagtaattcacttctaaatttctaggacaaaatttctatgtttcctttcctaaataatatgtggagctccagagtccagattccggccattggatcaagccatccgagcaccgtatagcggcattagccatgcacgatctctaaacttccggcaggaatatcacggattcactatataagtgcgtattcacatagcttattcgcgtcctgtcatggtcccatcagtgaccttcacagctattagtcagcctctcggcatgtgcttataccctatgattgtcgtgaaattaaggtaaatacatggactctgtcaaactactgctatggggaattagatgtaggactccagtactggaaatgcatactccctccatcccaaaataaatcaacctaaggcgggatgtaacatgacctagtacgatgaatctgggctagggcatatccggattcgttgtactaagtagtgtcacatcatagcatagattagctagaaactaaggtgtcccattagtgcacaaacaggacaagcttacatctgtatgcaaattagttgttggtggttaacgattgtctttgctttgattaaaacaagggtgccaaaaaagtacataacttctcttatgttatttccaaagaactcgtaaagacaaaagttttacatgctagtatgctgttctgcggaataaatggagtctgctacaaagagatcgagcacataccttcccaataaaactcacaaccaaaggcccagatcttgagatccgataacaacctgcacgtcaaaaacattaaccaccagatcagaaattttgcaaaatcatttcccacaaagaaaataatgggagcatcaaatcatacctatgtatacatcagaaaaatctatgcatagttttgcaaccactggggcaattttaacctgaaaaagaacacagtaaaagtttatcagatactgagatacataatgaagtacttctccaaaagtaaaagttccaattaacttgctagttaattggagaaaattttctccaagaagtgagaaaattccctacaggattttccaagaagttttttttttctttttgagaattaatggataaggtggatactaaacgtaaaaatggaattaacaagtgtgcaatatttatccaatagttgccaggaaagtaacatctaggattgaaggaaggtaaagacaaatagtgaaatataaacagctacacaaagaaacaatcgcgaggcatagcatttggtcaaaatcaagattattgagatactacatcaataggggtcatattacattgttctatcttaatgaattgataagtgaaattatttaagaccaaacatactataatgatctattttggaactgacagggataaaatatgaaggaactgattctgataacgcaactagaataagaacaaagctaattctgactgagtcgaagagacatacatctaatagcgacgtgcagagatgctttgacacaaaagatttagccatcactaaaccgctctcttgtgtgtctagaagacaaccccactccgtttcaagctcatccacattagttgcagcgagaatgaccacatttttgcatttgatctgcataagaaaccagttatctataagacaaatgaaaaaaaaaggaagcaatttccgactctcttttcatagtttacagtaggcattttcgtcacttcctaattggatgtcaggcttttcattcaggcatacttactaaactttggatatatgttaatacctctgtcccgaaatataagggattttggtatgcgacttaataaatgtgcatggaccttgttactacatcagattatatcattggcacatgctaactttggagaaattacaccccttgtaaagccaaaaatatgttcaccaaatatgtatttcagaagtaattcaaagaaatgcattaaaacaacataacgtaccaatggcaacggtagcattttgtgatgcaataattccgtaataccttctggcaacaaagccatctgaaagagatgtggagttaaatgataatactgcagcttgcactatgctagaataaacatgcacagcactagatattcaagaatttaattgtatttgcgaaccagattacctcatttcgatcaccagtgtaattgtctcctatcagttgactaaggtattcttcaaactcttcatcaggagcctatgaaaattcaaattaaacatgttgataacagtaaatggcatttgtgatttgttcagtcaaattcatgaagcaaccatttagtgtatgacaacagttcaaggctatgcacatttttccaacagaaccagcaagagagctgaaagctatgcacactgaggactttctatatttcaaagggctgtcataagaatattttcatgtgaaactgcaaccaatagagcaacaagctttcgatttgtcatctgaaataagaaatgcagcaaatgcacaaaacaatactaggaacaatgattttatacaaagacaaacatgaatgaccactctaataagacattgctgaattacttgtatcactagaagcaagatgattttagaataaaggaacactgaagagcagaagctcagcacaaagtagaggcacagcagaactagagcagaaggataaaggtgatcatgactaacaattaggctgggaacctactataacaaatcctacagcg

SEQ ID NO: 68721 - DNA, 1336 bp, Oryza sativa
ggagcactcaagtagtcaagtgatgccacaacagatctagtatattcggattatggacaataacatacattttctctgtgaacctcgtctctattgtgttaaggaggtgttgcattggactagcaggtcaacaacttcttatcgtgcatactgatcaagaatagagcgtaccttgttcaggtaaactaactggacagctatgcatgtaattgaaatcactgcaaacagccacgtctgaaagtagccagcctggtttatgccctcaattgtaagcttaatggcaatgcccacagccttaatgctcattacctgacaaaacaacatagcgtgcaaaagtcatattagtgacaaaacgacaagataacataagcacaaactcatataaaacatttaccgtcaatgatccaatcactgagcaaattccaacatacaccattatgttcatctgcccataccgtggagcacaatatatcatcaggaacagagatactgctactgcagcggtagcatagcaaaggaagtctgcaccaatattacaggacatttgtgaaacataagtcaattccaatgccatgtagctaacggagaaagtatggaaacttaccaggttgtatcgccaagtgccaaatctcatccactgagcttggggtcctctcttggggagcatggaggatgatcaccgtcgacccaacaatacaaagaacacatcccagcacgcccacccgctgtaacttctcattcagtgtaaaatgtgccagaacagcactactccccaacaaatcaccagaagcatacacatgcacataccagtaattcagtacaaatccacacaaagaaacaatgaattacaaatgatgtggacaccaactaaaacaatttcaattctagtattctacctcacaattatgctgagtgctcctagcggcgtgacgaggacagcaggtgcaaacatgtaagcaatgaagttggcaatctccccaacaagcactgataagatttcaattttaccaaaatattcaaacctattcccacatgaatatcaagaaacaagtccaagataaccatgaaatttcacttactagtgaccatcccgacccaccagagcggctccaagaggtacccatatcctccaacacctgaaatttccaacaagacaaacgaaggtcacgacgcgtgcgacatgaaatcgacccggattttggacacaaaagtagcttagcttcctttcatgcaacccacagcatgtaggttcgaattagcatccagcaaccagaaaaagacctagcaatagcacctgctcgggagcccgcggcgccggcgcggaggagccccttct

SEQ ID NO: 68722 - DNA, 5011 bp, Oryza sativa
agggctccaacaccaactccagcccgtcgcccctcccagtccagccgcactggaacccgtggaccagctagattcaactctggcccaccgcaggtcttcttgggccacgtcctggcgctgtcccacggcctgctgcaccccagtcctacatgaacacaccagggcatgcagcccatgccgttcggcctccaaccaccaacaggtctgcccatgcatgccatgcagcacccgccgccggcgccgatggacttcgctgccccagtgcacgccggcactccgtctactccgacatgggacgccaacagcatcgccaactccctcaatgccatgacgctgcagcagccgtccgaccagtggtacatggacaccagcgccaccgcgcatatgtcatccggctctggtaatatatccatctctgacaagccccctccacacacatgaattgttgttggtaatggtgcttctcttcctgttactgccactggttcccataaaatatccaccctctcccagcctttccacctccacaatatcttggtcacacctcacatcatcaagaacctcatctctggcaccgtcacctcggacatcccggacatcacacacaacatcacctagctggccactccagtattgcgtctagctcaaataaagatagcatgctttgccatgcttgtcaattagggcgacaagttcgcctctcattttcgttgtcttcttcaaagaccactgttgcttttgaaataattcattgtgatgtctggacctcgccgtttccagtgtttctgggttcaaatattatcttctacttttagttgattttactcatcacctatggacgttccccttgcgtttaaaatccgaagtttttcagattctgtccaatttccactctcttgtacgcacccagttctccactgtcctgcgtgccattcagtgtgacaatggtagggaatttgataactcatccatgcaccaatttgctgctactcacggcatccaacttcggttttcctgcccctacacatcgcagcaaaacggcaaggctgaacggatgatacgcaccaccaatgaggtcgtccgttccctgctgttccaagcacatctaccaccaagcttttgggttgaggcactcaccacagctacacacgttctgaacataaactttctccccgttcgacggcttgcgtcttccttggctacccgcccaaccaccgtggttaccgctgcatggatctcgcctctcgccgcgtcatcatctctcggcatgtcgtctttgacgaaaacatgttcccttttgcagctaccaccactgcctcgcctgatgaaacatatgactttcttgatatcctagcagtacctgcaccgccagttgcaacccagccagcagcagccactgccatgctgccgaccgcgccgatcgcacccaacaccaccgctgcataggggtgaaaacggtacggaaacggacggaaacaacctttatcgttttcgttttcattttttttttcggaatcggaatcgaaatcggaaaccccggaaacgaaaacggaaacgaatattatcgaaaccgaaaacggagcaaaaacgaaccggcgcggatacggtaacgaaaatttatcggaatacataaacccctcaaactgagcctcacagcaaaatatattcttctataacttcaaataatttgcataacaaatattctaaaagaatacagcaaaacaaaatggtataagcctataaggtatacacaattcaggtgctatactgctatcagcctatcactccaggaaatgggtttgagaacaacaacagaacatcagtccatcaacacttagttcatcaatcatcacagaacagcaatagttcatcaatcatcacagaacagcaacgcacatcagtccatcagtgtttcagtacatagttcaatcacaaaacacatcaccctataaatacatagttcatcacaaaacatagttcaatcacaaaacacatcagtacatggttcaaacatatctcatccacttgtgcagcaggagtacactaatttgaaatggaaacttgaaattagatgtaacttgaaaattaaattgaccaacattttcttcaaacatccattggcgcaatgccatcctcattagaacattccgcttctactgtctctgtctcttgttccgttccattagccttcaaaaaaaatgatagagcattagtaaaagtgcaaagtcaatcactatatacacctgctgctgctggttgctcagatgctgccgctgggctgctggctgctgcgaggcgaggagccgtcggcgttggtggcggtgaggaagagactgcagtggtggtgtcgtcgtcgcctcgtcggtgtggtggttgttccgtcgtcggcggcggtggtggcgacggtgaaacggcgagacgcggtgggacggcgccttgagatggcggggaccgagcagaccggcggaggtgcgagatggtggcggcggccggcggcgaaacgacgaagagcaagggcggcgcgagatggtgggggcgaggacggcgggggccagccggccaggcgaccagcagtgggcggtggggcgccggcgccacgggcggtgggcgtgagggcacgccggcgccgcgatgccgcgatctggacgccgcagccgccgctccgcctccaactcgcgagtcgcgtctgagttctgagtctgacggtctctctcctatagggttagccggttagggtagatgccgccgcgatttgggttgggctgggaagctagggagaattatggactattgaatctatgggatttttaacttcggaaattccgacaatttttccggaatgtttccgatcgtttccgggttccgacggaaactgcttttatcatattcgattccgtttccgagaaaatatttccgttttcgattccgattccgagaaattccgaaaaaattccgaccggccgattccgtttccgaaaacatgaccggaatccggaaaaattccgtactgttttcacccctaccgctgcaccatctgcgctgatcgcacccaacaccactgctgcaccatctactcctacagctgccgcagcacctcgcatgcaaacccggtctcactctggcattcaccgcagcccgcgcgagcggctcaacctccacacttcggtcactgctttgtctcttattcccaagtctgttcgttcaatgttgaatgatcccaattggtatgcagccatggttgaggaatttcaggctctcacctccaacaatacctaggaacttgtctctccaccaccccgagggaatataatcactgggaaatgggttttcaaacacaaattccatcctgatggtttccttgaacgctacaaagcacgatgagttcttcgtggtttctcccaaaaggccggtgttgattttggagaaacttttagccccgtcatcaaacctgccactattcgggccgtcctctctctagcccttacatccaaatggccaatacaccaactggacgttaaaaatgcctttctccatggccatctctcagaaacggtctactgtcgccaacctaccggcttcgtcgacgccaagcaccccgacgtcgtatgttgcctgaatcgttctctctacggcctcaaacaggctccccgggcctggttcgagcgcttcaaagcgtttgttcttggacttggcttcacggcggcaaaatcggattcttcactgttcatctttcggagctctctcggtactgcgtaccttctactgtacgttgatgacataatattgacagcatcaagcgcctctttgctgcaacgcatcatcacagccctcagctcggaattttcaatgaaggacatgggccctctacaccacttcctcggcgtccaagtccaccgcagtggttatacaatgctcctgcatcaggagaaatatgccaccgatctccttgatcgcgccggcatgacgtcgtgcaagccatgctcaactccggtcgacacttcgtccaagttgtcttccgccgtcggcgctgccgttgcagacccgacagcatatcgcagcatggccggagctctccaatatctgacattcacaaggccagacatagcatatgcagtacaacaaatatgtctacacatgcatgatccacgtgaaggtcacttgaacctggtgaagcgagttcttcgctatatcgaaggtacactttgtcacggcatacttctgtcggcttcgtcgccacacgagctcaccgcttactcggatgccgactgggctgggtgccctgacactcgccgatcgatgtcgggcttctgcgtcttcctcggctccaatttgctgtcttggtctgccaagcgccagcctaccgtctcgcgatcaagtgccgaagctgagtaccgcgccgtcgctaacgcggtcgccgaaacaacctggattcgacaactcctccgcgagcttcatcaaccgcttcaccgagctacggtcgtcttctgcgacagcatctctgccgtctacatgtcagctaatcctgtgcagcaccaacaaacaaaacacattaaacttgatctgcactttgtccgtgagcgcgttgctctcggccaagttcgagttcttcatgtcccgtcgtccgcctagttcgtcgacgtcttcaccaaaggactgccgtcgtcgctcttcctcgacttcaggtccagcctcaacgtccgtgaactcccggctgagtctgcgggggtgtgttagcgtactgtacatcttgtatagcatagtagtctgtttgcatggatagatagcagcccaatcaacctaaactacttgtttctagtcatacgtaccgtaccgagtctctcgttcggttgttatgaggctatactctcctgctatatatatatgaatgagatacgccaccaaatgtgtggcttcaccctcaaaccctttcaatatgtatcattaacgataaaaacttaatcactttaaaattaagtttaaaaatttaaatgtatctcataaaagcatccac

SEQ ID NO: 68723 - DNA, 2164 bp, Oryza sativa
actgtgggaattattatagttataatctatttatatgggtttgatatatatatatatatatattaaatttgttaggggcaccatggtgcccgggctccatggccatccaccgtccaaatgctttaggatccgtgcaacgctaatagaggatactatcacatataagcgggtcttacccgataagagttgcatgcatatactttccttagaacatgcatgcgggtatttccatttttgctgtataccgtgcatgtatttccaaatttgcgccctctaatcacgcctacacattttgattagcactttccattttctatatcacatttccataaatacaacgtttgcatgcagatacttacctattgaaacatgattctgtttttgaaaattgacgccattccactaattgcgattattgccatctattttcaaggttatattccattttcaagatacacatataaccggctacagtagtccttttttttatttttcttggccacactgtttcacggtcgaagagctagctatccacctcgtcttcactgagttacctcgccgggattgctcgccccgccgtgaagagggccgacgtccgtggttttcgtcactgacgacgttcgtcacgatcctcttgctggaaaccagacctcctcaaccatttttgtcaagccattacagcgccggacgtccatgtgccttttcactgccgtcgctggttgttcgtgagattcggaacatgcattattcaccagcgagctacattacgtgaaaggtatggtcctcagtttttatcactcacacagtttacattcacatgcagtccctgttatgtatagatgatttgccatttctctttcttttatctactaactgagcacatgatgaatcacctggaacctaaattttagattttttgttgaaatgcagttcaatttagattgtcttaggtatataacgcgtgtgtttgaatatcttggtttgcacatccaatgaacagaatttagctaggtagtgaaacagcagcgatgtcccttgtacatgatcatctcacttctggtgctctctctggttctcgccaacaaccattcgtgttccaggtatgtgctccaacttatctgtacttatatgtacttctcatatatgttgacatcttcatagtattctgaaatttatattaatattgccagtagctatggacaagatgaatggtgcccggagcgagaagatcaatcagtcgctgcagaagtatgatcacccacgctgcagttggcacatattatttggcacgaggtcagaactacacaacttatgcacgcacatatacttaaaatccatggtatagaaaacatatacttggattaatttatattaagttaaatataccgtcagtccaagtaaagcgagttttaaattctaataatatacagtacacagatttaaaatttcgatatacttaagttttacatccggacataacgactaaaatatccttggttccaaatttaattagattccaaatttactatatacaacaatattaaatgacaataataaaatataccgtgtacacaaattgtaaatttagatacacttagattcctaatataattaaattaacgtaactttgtacaagttagctaagtatatagaaaatataatgcgtgtatacatagccattacattattacataaatgagtaaacattttctgaattttgaaagtgcaaaacgcactaatttagctaggtgtacataagcataccatatatatgattccatatatacttatattccaactgcaacgttcatggtgtattataatatctcggtttccatatataattattttcaaaataaccgcgggataacatttccatatatactacatcgtatacgtatactcaggttttcatataccctaataaagttaaatttgagttgttttgttgatagatatatgtatgaatcgaattattataactaggtatatactcacaatttaaaatttttaaaaaatttgagtaattttgtgcatttgaaaccatggtgccccatatgagtgtcctatatatatatatatatatatatacatacatatatacatacatacatatacatacatacatatatatatacatacatatatatatatatatatatat

SEQ ID NO: 68724 - DNA, 2205 bp, Oryza sativa
acgtaccaaccaactaaacattaattgcacctggtgaaagaagtcaagaaatgaagaacaagagatcaccttgagaagtccaggacgttcctgtagatggtccaaaattgttcaaagacgaatagtcaggcgaccccttcatgtcattcatctacaagtatttttcagatgattcagcttgcaaaattgtggccagtgtagttaagttgtcaaaacataattgtaattaacattgttctattatgtcaggtacccagctaggagaagccgcactccctgtcgggctatcccaacctatgtgcgtgacatgcttgacgtcggttggataaccaatctccatttggtgttccttcaccactgcaagatggtttaagcaagatcaagaaagaaattaggttgtgcaaatcaaatgaactgactattcatgccttgtgtaacattgtagaaaagaaagtaaaatctacttgatggtcacataccgaagatctgagagatgaccttgaggcccttgaaaacccctttcatcttgtacgccattggtagatgttgttcacaaccagaatcccactggaaacagaagacaagaagcaaaggttagcaatgagctctggtttcacaacagttccattgctgaaagaatatgtatcagccagataattatgatatgttttgtccgatatgattatcgatgaatttacttacctcaagatgttatgatgggaggtgatgatgatgatgttgataccctccttggatgttctcaatggaaggatttggagtaagcaacaggtccatcacctcccattctatttctctagtatggcgtcaggaacatccatgagaagattgtatttgttaggattttatgaaggttggcagctggaatgaagcaaggaaaggaaaatatttgtttttttatggatacatttaatctggcagcaaaatcataacaatgagcaaaatgggtctccagaacttttgagttgtcagaaaatggttataataacagacaaatatgtgcaggctttcctgcctttgccagacaaatgaaaaaaaataaaaatcatatatatgaaaagtattcagaagcaatctaactgtacaagaatacaggtacattggagttccagaccactaagtcttcagctgcatacgtgctgttgtccctaaacacaaagttataataagcatgagatgcagtcacgttaaggacaggcttacaggcttgtgaatcagtcaagaaccgcgtcttgagatgctgctggtaatttgcatagttagacacagctaataatatttggaaagatcagccttgaattagctatcaaagatggataaattgggagatacgcaaacacacaaaaagctaggttgaggatatcaatgtgattcagaaaggatgtaaggggaggtatcaatcattcaaacaattacaaatcacacttttgctgctattaattcctccacaaaatatagttcacttttgctgttatcaattcctccacaaaatatagttgttatgtccctacaaaaatatatagttatgaatcaaattaagaaggttgcatagtgggagactgttgacaatttaggccatgtagatactagtgcaacattccctattcatatatatatatatatatatatatatatatatatatatatatatatatgctctatgtctttatggagttagatatgaaattatccatctttgaaactggtattacggtagtcgattttttagctccttatcagcgtggtagaaaagttggacttttgagggaactggagtaagtaaatgcatagcgcaaagaaatcaaacccaaataaagatgagaaaaataagaaacggttaaagaaaaaaaaactttatcgatctgtgatcctgagacaaaacatgaaattaaggaacatttcatttgcatttgcagctgggtcacataatttcttacaaagtatagttaggacgtatcaatgaaggaagtgaaactggaacatacattataccagatacagctttaccatgttacattcttgagactggatcagattgtgaaggtgaccttatcagtggagctacaaatatgtaggctgcacacaatgtcactgcactgagatgacctttttcctatgttcatacattttagcaaagtataagaaacaggccagggacaaagcattgagcacggtaataagcaagta

SEQ ID NO: 68725 - DNA, 13431 bp, Oryza sativa
  unsure (1)..(13431): unsure at all n locations
cctttttacctataaagggaaaactgtattttctagttgcacttttgccgggttcttttttgtttctgcggatttcaccaatccattcgttcgccgtgaaactgacagctactcgtgtagtccctctctgaaacgtcacaatacacgtctgtgctagtagtaggtgctattcttttcagatgaaatgttgattgatgatctacttaaataaagaagaaccaaatattatactccctccttcccattttaagtgcaactatgagttttcgtgtccaactttaatcatccgtcttatttgaaaattttttataattaatagttttgttgttaagagatagtaaaacataaatagtactttatgcacgacttagtatgttataaaccgaacaaatagcttaaaataagtggtctacgtatataaagttgttggaaaaatcatattttgatgcaaataatctaccagtaattaataagtagtatcactgtctactctactatggtctatatatacaggcaaaataagggcctgtttattttgatgccaaaaaaaaccttatcaaattttggtggcatagttgctaaaattttggcaacttgccaaaattttagtagaatttcttatacagttaccaaaatttgataacaaactaaatgtagctattttttttttaactttactaaaatttggtaaggttaaaatggcatcaaagtgaacacgtcctaagattatacatacttacatacttggttggcttattcagggaaaaaaccaaacgacatatttgcnnaaacgaaaannaantanantncntnngtgnannattnnanannannantnntnntnttntttnaantttttacgtgttttttagcgatttaaaagcaaatgctaaaaaaacaaactacgatgaaaaaaccacaaaatcaactctaaatttaaagtcaactctaaatttaaagttgaaacttttaaattttagtttataatataagtataagcatataaacgaaaaaaaatgaggatagtcatggtacacgtaccaagatgtagaggagggaggcgcagacgatggtgcggtagcggccgagccatgagtcggcgacggccgagccgagcagcggcagcagcatcgaggtgcccatccacacgttcaccgccgccgccgccgccgccgtcggctgccggagcggcccggtcaggtagatcaccaggttccccatgatgcccgagtatgcgaacctctcgcctacctccgctcctgcacctcacaacacaacacgcctcgttacatgctactttttttttctcttcttttctttttccaaaaaaaaaaggataaggcggcggcgaacgtacgtaccgatgaggaagaacgcggcgggccaccggccggagctgccgcgggaggccgggccgccgaggtggtcgacggcgagcagcggcggcgactccggctccggctccggcaggagagcctccgcctccattgccatggctgctaacctcccaaccgttttgagtgtgatttttcaattagcgtgcgtgcaacacaaacatcaccagccgaaagagatgataatatatatatattgatatgatatccttgtagtatcaaacgccagccatttgaagggaaagggaaaaatggtggtagcatctctcaccttcaaatcatcgacggacgcgtgcaaatatacgtcgcgatcgcacgggcgtcgaggcgatgaggacaaggcaccaaaatgcgaaagaaaaaaatcaccatagtacacaactatactgctggaaattttgcaaaactgtcacattgatgctttttaatattatttataactgccataactttcacagtccacaaattgtacaaccacccctgaaaaaagaaaatcaacatttctccacagcaatttttacttgctgtggcacctaggctagatctccttctccatgcgaatcgttcaaggcttcaagcagcaacagaaaagcatcgtacgggcattcactcttgaaggcactgtacagcactactacagcagcataagcaagctgcaagccttttaccgcctgaaggtcttcgaaagtgatatgccaacaaccaacatgtgatagccaatgcattttcagcatcttttgacacatcctcactgtactgagatgcccttcttcttgtggacatacactcgcgaaaagtgtagataagcagctaaaccaagaacactgagcacagccaatagccagtagaagtaatcaagatgacctcggttcagattgtccgagaaccagctatccccagtcatgctggtcaccttgtcaattgcatacacaagaaagctgctgatgaagctcccaatcccaaatatgctcaggtacaaagcaaggcccaaactgcgcaaaccatctggtacttggtcatagaagaattcttgcaggccaaccattgtgaacatatcagccaaaccagtcaggatgaactgagggaccacccaccagaagctcatggggattgtggcttcaggattgtccaccaggccaaaatctcttgctaccatgagccttctgtctccacaagggcagagacaaccatcagaattactgagataatcaatccaattccaatcctttgcaacgttgtgataccgcgagggttctttgagtacctcctagtaagtggaacaaggattcggtcatatataggaacagagatgacgatcgacacactgatcaagctttgtagggcagcagctggtatgtgtactttacctatccacctgtctagtgtgcttgcttgcttagtgaacagtgttatccactgggcaaaaacaattgcgtaaatcaggcaggttgcccctattgggaacaatttaagcacagcggtggcttcatcaggaaagcatgccttttctgcatcattgtgatctccctgggatgatgatgcttgggtgcagtgaagatcccctgatgatctgcatgccagaggaagaacgagcaagtaaggttgtagtttgcaacggatgggctctgcgggtggtttcattgcatacatactttgaacaccatgatgcgcaccaccatcgtatctttgctagaagcgatttcccaacctggtcgaataggcttgtgttacttcttagaggatagaagcggtaactcttggtcccaagcaagaatactgcaagagaaagagacatggcaatgcaagggattccaaacccaagctgccagcctatgttatcttgaatgtaattcaagattgaaactgtaatgacattgccgccatatatcccaaagtaccaccaattgaaaaatgagctccttgaggcacattcttcagggtcattctcatcaaattggtcggccccaaatgcttggacacaaggtttgtggccaccttgagcaaaggccacgatatacagggacaagtagaagaaagctacatgaatgtccatactggaggatgcattattatctgcattatctccagattctgcttgttgatgaggtacaagaaccggtgatagcgtgagcatgccaagcccctatattgtggatacaattcagtgagaaatctacataataaaaaacatccaagaaactccacaatatcattgtcttacacagaaactgaatagtatcattttatcacagtgatgcataattgcatagtatgcccattatgatggtgatagccatatatcatgtggatggaaaggacaatatttagctgaattattgcctgaaattcctccgtgcttcagatctaaacacatcaaacttgcccctatggttaatcctttacccggagaaagtagaaactatatcaggaaaaatcattgttagcagagctaattactctgaaaattccaggtgaactcacagaatcagagtagcatatgttcagcattgtcacaggttcatcataaaagtggcagttgagtaagccacacaagaacagccgacagcgagagcactgcactgcacataccaggatgtagaggagggaggcgcagatgatgatgcggtagcggccgagccaggagtcggcgacggcggcgccgagcagcgggagcagcagcgcagctccgttccacgcgttgatggcggcggcggcggacgccgtggactgccccagcgggccggtcaggtaggtgatcaggttcccggagatgccgccgaaggcgaaccgctccgagatctccacgcctgcgatggcgaccgacggcaactgcacgcggattagttcgggagagagagagagagagagtgcggtgagagcgcggcggcgcttgctcgttgactcgccgccgccgccgccgccgccctggtttctcggggggagttttttggaggtaccgatgatgaagagggcggcgagccaccggccggaggtgcggcgggaggccggacggccgaggtggtccaccgcggaagccggcggcggcaggaggggctccgcccccgcgtccatggtggctcggtcgccgtcccgttcagatattttttcctcttctcagtaaacgatctaacggagtttcaaaaagaaagtaaacgatctgacatatttaactaattgccacttttagatgttgcaattaactatttgccaccatatttaattgccatatctaaaagtggcaaatatttaaataccctagcgcgcacgttactctcgttactatatatttgtctataaatttatatatgtctaaagttaaaacgacttataatttgaaacggagggagcactttgttggcggttgctagttgctataatnccgttccttgaaccaaacctnnaacatgntnngacacngtnnngacanantnanntnantngnccnananantnntntntnantnnntnnantgtngngnngnaantnaaaaaaactgtaaaaaaaaagttcatagaagtttgacattccacctaagttataggcaaagtgacatatttcagattaaaagttatagtttgactaaagtaacttagtacaaaacacattaacagttcacaacttacaaaaacaagttgattcggttaagcacataagcattttgggtggttttacaacaaaattgattaggttgacagtcatttgtagcaaaataacttatgagatagaataccaaaattcaaataatttatgcgatgaattttataaatttccctttattattttctgaaccttactaaatctaaaatttaaaaataaacctcacaaaaattattttaaaaatatactccctctgttccataatataagggattttaaggttttacttgcactgtttaatcactcgtcttattaaaataatttaaaattatttttttacttactttattatctaaagtattttaaggacaactttttattttttatatttacacaactttttaaataaaacgagtgatcaagaccgaccaagccatagcacggtatgctcgctaagctaagtgtttcttcttttatttttatttcttgttacagtaagagcctggcatgtattgtcaactagtactgcagattttcagaaacctcggctttgttcttgtagacatatcgctttgaaatgtacacgaacacggcgacctccaaagcgacgagtgcagtgagaatccagtagaagtagtcgaggtgggcgcggttgatgtcgtcggagaaccagctgtctactcctctcctcgtcgctcagtcgatcgccgacacgagcgcgccgctggcgtagctaccgacgccctgcgcgctcacggacatggcgagcccgacgctgcggagggcgtcggccgcctggccgtagaagaacaaataaaggatttgcaaaaacaactttacgcttctttcaaccttacattaaacacctaaattcccgtgacttgctaagtacaaaagtactcacccttactctctctctctctatatatatatcctccgtcttgaagagaagatgaagtgaagtgaaaaatagggtttcgttctggttcccagccgtcacatgtggtgttgggtgttagtccgttgattccgctactgttgctgttgctgttggtgtttgcctcgtctgtgtcgccgattgcattctcgtgttgttctgagctacaatctaagttaagataaataagtcctctatttattttaagcatcacaatgattcatatttatcaccagcgctatgtcctgagattggtactggaatcgcggtttcgtaggaagcagtgcgagaatcgcggtttcgtaggaagcggttcgcactgttttttctacgatacgttcctgtcgggtgccgttgtacggcggtgccggatcgaggagtgacaataaggtaaaccctgttcacaccacaccgctatacatcttctccataccaaccattttccagatttataaacttcaaaagaattattgctcgcctttgttcttgtagacatatcgctttgcaatgtacacgaaaatggcgacctccaatgcggcaagtgtggcaaggatccagtagaagtagtcgaggtgcgcgcggttgaggttatcggagaaccagctctctccttctccccttgtcacccagtcgatcgctgacacgagcacgccactggcgtagctcccgacgcccagcacgctcagggacacggcgagcccgacgctgcagagctcgacgggcacctggtcgtagaagaactcctcgaggccgatgaggccgaacaccttcgatgtgccgaggaggacgaattgcggcaccagccaccacacgctcgtcggcaccgtcgcgtctggcctgtcgaccagcccggcgtcgctcgcggcgcggagccgtttggcctcgacgagcgccgccacggccatggcgaggcccgacatggccatgccggcgccgacgcgctggagcgtggtgatgcccgcgaggtgccttgtgagacgcctcgcgagcggcacgagggcacggtcgtagaccggcaacagcgtgacgatggtgacgctgatggcgaactgcagcgcggcgggcggcacgacgaggcccccgccgacgttccggttcatcgtgctgccctgcttggtgaacagggtgatatcctgcgaggcgatgatggcgaacactatgctggtcatccagattttttttttcgccggaaaaggcagaaggagaccatccgagtatattaagaagaagtaaagttacaaaaaaaaaaaacacgacagaagctgtcgaggacggatgtgcacgagacaccacacgctaaccacacaagcacaaaccactgaaaaatgaaaccaagcaccaaaacgacccccgctaagcgtggccgatcgccgcccggcctacaacaacaccacaaaggcgagactccaaaaaaacgatgtccccaaggaggtcatgacatcaaggacgccgccatcgcccatctaagaaagatgtggttttcacccagagagaactcgccaagaaaggggaagaggtacccacaacagcgcccccaagagggttacgacacccgaaggcgtagccgctgctagcccggtgatcaccgagcgaggcttacgcctggaacccctgcaacctttcaagtagtttgtcgcccatcaactcattaaccactacacaagcattggcagcgcgtggcttccaccaagaccgcaccggcgcccctccaccggccgacttccgaacttgctgcagaaccctgccgccagctcgctgcatcccaccgctcctcccctgagagctggcccaggccacctccgtcccgccgcccgccggcctctcgccatgttcggccaaaggagaacccgggactagacaacatcgcttcggccgcttgagcttcctccactgaccagcagccgcctcaacccaaccgaaactccccacaaagaaggggagaagctcaagaagggagagggtgctgaccggcaacgagaaaaacgacgcaccgccgccagctctctttgcacagccgcttctcccataagcactgacaccggacctgcaatgccgaaaccggccgccgctcgaggtctccagctccaccaccgtcaagcgtcctagccgcccgcccactgcgcctcctcgtcgccggcagcggaagccaaggaacaaggcgccgccgacgccaccggctgcggcagcctcggggcgtcccgccgccgtccggcagccatggcggccgcgagctgctccggccagatacgcctgcagcggcgcccgcgccggcgcccagtctcggccgccgcaacagtgccgacgcccctccggccgccgcggtgacgccagcgaaaccaccgccgcagccgctctgccgccgagccctcaaggccccgggccgccgcgccctcgccgtcgcgttgtcgcgccgccgtaccggccagatccggcctcagaggcgccggatccgccgcctccccacgccggcctgctgtctccgcctccggccgctgaggtcgccgtcgtcggctatgccccatcctccccgcgctgagttagtggcctccgagcttgaaaggcctcgccgccgccttcccagctcgccaccggcttggaggaggagggggcggggttgtggcggcgcgggcggctagggttttcgccccccgagccgcccgcgcgagagcgacgcgggggtattctcctcgtcgttgggcttggtcatccagattggaagcacgttgacgagaaatcccttgccatccaccacttctttggatagaagcctgcacgaataacgttaagagaaatttgatgtcacgcgaagattgcaatttgcatccgtgcgcgcgtgctcaccgttctgtgcaaatggcatccttgcggcaaaacaccctcttcgtccacgcgcgcgcggccgcggcggacgtctcggcgagtcgcgcgagcggcgcgccgtcgatgggtcgctcggcagtggcacggtacgtccccgtgccgagcaggaagacggcgaggtacaacaccatcgtggcccagcacacggcgaacccgacggtccagctgacgttgtcctcgacgtagctcagcaatgtcgtggcgacggcgtagccccaggatgtggagaagtggaaccagttgaagtaggagctccgcgacgcgttcgcgccggggtcggcgtcgtcggcgaactggtcggcgccgatggcctcggagcagggcttgtggaagccctgcgccagcgccagcaggtagagcgcggcgtagaagaaggcgaggcgggaggtgggagacggcggcggcaggcaggcggtggctccgccattgcagctcgccgggcgagggtgctttggttgcagcgtggatgagaccgtcagcatccctaagctctgtagcagacattgtagttgggtaaggagtgtcagaaatggcgatgatgtgtccaatggcaatggcaatcaccctttttttttttgaacggaaaaaaaagttgaggcaatcaccttgaaaaatctgttcaatttaggtaaaacaaagtcttatagaaactatcttacaaaattcaaggttgattttatatctcaaaattattgtctagaagtttcagattcagttttattgaggtgtacttgataatgcagtggcaaaaggtgtgtggtttcaatcccgaggtcatcttacaatctcttcttagaaaatgtcgaataaaaaaaatttagtttgctccctctaaattcgttgtattaattagtatcatactccattctagttttatttattattctagttttatttattttgaggtgaatgaagtagctttcacctacagctgttggactggaccaatgtaccagacttaagcgctacgctcatactccaatttcttgccaaaaaggggagtagtttactcctccaacttaagcgaaccggatcatgatcatgacatgactaacgaagatgacaggcttgggtatccgagaggatcgaaatagggaggtgcagagcggcgacgcgcgacggagcactgaccagaaggtagagcacgccggcggccacgacggcgcgataccggccgaggtgcgagtcggcggcgagcgcgccgacgagcgtcagcaccatcaccgtcccgccccaggcgttgtccgccgcggccgccgccgccatggacatgcccatcagccccgtcaggtacatcatcaggttgccctgcacgccgtagaacccgacgcgctccaggaacccgacggctgcagatcagtgcagatcgatcacgccgcagcaaaagttagtagaatgacagccgcatgcatgggcgaggtttaccgatgatgaagagcgcggcgcgccagccgccgcggccgtcgccgtgtttggaggcggcggacgatggctcgtcggaatgtgcaagtagccggccggactccatggctgattggctggctctgcccccctctgacctttatagttacgaagtacaacttatagctgacatatgaagatatatttcttttatcagattaattgctcttgaacgagaactccctcatgccgaaaatgtggagcacacatatcgataacataaagaaacaagtatgggtcagtgtcacgatcttcagaaatttttggcacaataaaaagaagcattggtagcactcacctttctaaaaaaagatctggtaccactccatctcgtgcactaaatatttgagagtaacctaagtactcctatttttaaagttattgatggtcaaagttataaaacttttgacctcagccttgtctaaaacgtcaattaatatggaaccgaagggagtaagagcaactttaatggtaggtgataaagctaactatatatttatgtgcaatcgaataagaaaaaatgagtagtgttaactagctctatacatattcctagataaatgcattaattatataagcgagagagatattacctccgtagtcgtaaagaaagtcgtttaggacaatgtttaagtcaaacattgggaatataaatcatgaataactctcaagttgttgagtttaaaaatgtaaaatctatatgaatagatttatcttgaaaaatactttcataaaagtatacatatattactttttaataaatatttttatagaaataagaagtcaaagttgtgttttagagaccgtgtcgttgtccaaaacgactttctttatgaatacggagggagtaagagataaaagattagaaataattttatactccctccgtttcacaatgtaagtctttctagcattgcccacatacatatagatgttaatgaatctagacatacatgaatgtgggcaatgctagaaagtcttacattgtgaaacggaggaagtagctaatttattatattttttggggggaatttattatatatgttagctctaattctacttttgtattagcttatagtttgtagttagctctactactaaacttactgtaacaatgtttgtctaacttgttctcctgcaatccaaagatccaaacccaatctatgaggttatccccttttggccttttggattttttttattaaactttgtcagttgatttcacaacaaaattaatcacaatcgtatcaaacatttcaaaatgatttcaaatctaaatctaacggtattgcttttgtcacagaacccacatattattcactaattgttgttggaaaatcaaaaaagattatttctttctggaaaattcaacgcagagagagaaaatccactttggtaaatccattgcagagtactactaaatatatcaagtagaagtattgcagtaagaaatgcaaattgcaagttggtttgctccttttaatgcacatttggaacacaagattttcgaaacatgcgaacaggaaaaaaaaaatagcattggattgtcctagcatgtcaaattatacaaccacatgcattttcaataggactataattatacatgcaaatgctgcgaaaatgcaatgtatgttcaaactacactagcatacatcttctgatcttccccatgcgaaccatttttcagatatatatataaaaaaaacagaagaatcattgctcgtctttgttcctgtagacatatcgctttgcaatgtacacgaaaacggcgacatccaatgcggcgagtgcggcgaggagccagtagaagtagtcgaggtgcgcgcggttgatgtcgtcggagaaccagctctctcctcctctcctcgtcgtcgcccagtcgatcgccgacacgagcgcgctgctggcgtagctcccgacgccctgcgcgctcagcgacatggcgagcccgacgctgcggaggtcgtcgggcacctggtcgtagaagaactcctggagcccgatgacgccgaacaccttcgatagcccgacgagggcgtactgcggcaccagccaccacacgctcatcggcacggtggcgtccgccggcagcccggcgtcgctcgcggcgcggagccgtttggcctcgacgagcgccgccacgaccatgtggaggcagcacgtggccatgccggcgccgacgcgctggagcgtggtgatgcccgcggggtggcccgtgaagcgcctcgcgagcggcacgagggcgcggtcgtaggccggcagcacggtgagcatggtggcgctgatgacgtcctgcagcgcggcgggcggcaggacgaagacgcccccgcccacggcgacgcggcggtccatcgtgctgccctgcttggtgaacagcgttacctgctgcgagatgacggcggcgaacactatgctggtcacccagatcggaagcagcttgacgacgaaacccttgccatgttctacctcttcttctttcgccagcagaagcctgcaagattagcgttaaatttaaacctacgccattagaatttagcaagagtttagacaatgcacgagtcaagaacgcagtctgtaccgttccgtgcaaatggcgtccttccggggaaacaccctcgccgtccacacgcgcgtggctgacaaggacttcttggcgagcagcgcgagcagcgcgccgtcgatgggttgctcggcgcggtacgccgccgtgccgagcaagaagacggggaggtacaccgccgtggtggccaagcacgcggcgaacccgacggtccagctgacgttgtcctcgacgtagctcatggcggtgttggagatggcgtagccgcaggaactggagaagttgtaccagttgaagtaggagctccgggacgcgcgcgcgccagggtcgctcggcggcgtgaactggtcggcgccgaaggcttccgagcacgggttgtggaagccctgcgccagcgcaagcaggtagagcgcggcgtggaagaagacgaggcggccgagagatggcgatggcggtggcggcggcgagcaggcggcggcggcgtcatggcagctcaccgggtgttggtgcgttggttgcatcactgatgagatcgtcagcatgcccaagctctactttttttcataaaagaaatggctataaaacgtagggctgcaggaat

SEQ ID NO: 68726 - DNA, 2371 bp, Oryza sativa
tccttaatcaagtatcagcaaactcgataaatcccattttataacgactatgttctcttatacagtaatatctcaaaatgataataactaaacatttaaataatacacatgcattaggaggaaaaaaaaaggctaagcagcattttaataaccatcagcattcgaggtccggacagaaatatctatgttctgctcggctataagttgtagccactgaattcagatacataataatgccaatatttgcttacagcagcacaactgccttgccattcgcttccccctaatcaatccatcaacaatctctcataccaatcaacaaatcgaacaaagagactgagtccttgtctccaaatctcagctaaaccccacttcctctccttagtcacccctaacgaatcacaatcacaaacaattctaattccaccacacagaagcgctcgctccaatggtattctagctcgaattccccgctcccaaccgttaaaatcctagcaaaatcccaaactcttataaccctgcgactcgatcaggaacagctacaccagaaactcaacaaatcgcgaacgcattgctgaacaactcgacgcatcacatcatcaatcgcgcgggaacgcactccgaaccgaagttcagggagagagagagagagagagagagagagagagagagagagagagagagagagagagagctcacggggacgaggatgggaggagggcggggagcgaggcgggggagtcggtggggacggggagggagcccacccggaggtagcgcgccggcggcggcgcggcgacctccagcctccccacgcactgcagctcgctcgacgcgtccatcgccgccgtagccgtacccctcgccgccgccgccgccgccgccgatcgccgcggttttttctcgggcgtttggatgctttggctaatggcctagcggtttggtgggcccgcgaattccctcggagtcagtggatggtcgcttcctgtggttgcatcgccatcgatcggtcggagccggacgcggacgggacgggataaaaaagacgaatctgattttttttttcttaggaagtctgatttttagggtgtattttattttctataagaaaagaaataatttttgatcaatgcttgtagaatattttttcgacaaacaggggctcttaaaatgagcacactcaactctataagcgcacatcctattataatatgactactattcgttcaaaacaaaattataatatgactatctctgaaaattagaccgacatatcttaaaattaatgaagtcattacaacttaaaaattaggctggcatatcttgagattaatgaagacaataaatgtctcgttattgatgggtatatcgtctattattgaaagaaatacaagcacacgtaccaagtttaggactttaatcccggtggacaggtttcaccgtaaagaatttaaccagttaagttacgcttacttcacaattcttttataatattatgttatcaaataccaacaacagttataaactatgtaatattacgtggaaaacactttggcataagaatttatttaatgatgtagtttttccgtaattgatttacttgcacttcgactaaacattagtcaaaatttacataattcgacattttttttaaaaaaagggaaccatttggtgtaatgccgaaatcaaccggattagttctagatttaattaaatgcacaactaattagtccgaaatcaaccggattaccaacgaagctaatgtatgcacatttaattgaagtacagaaagtaattaaatgcacggtgatgtagtcatttcttcccacaactaattagtcctagatttcctagaagtgatgtctttgggtgacggaggaggtattggatctgtgtggaaagcttctggtctagtttttgtagctacaacttttctcaaaactaaaagctctctaaataaatctagcttttcattcagattctaaaaagttagttataaaacctagaaattgagtacatgtcagaaaattcttataagttggccatcaaccaactgcttacccattacgtgggacaaagaaaatattagggtggatgtgttatcaggtgtaggattgcgatgtgttgtgcgtgtacattttccatgtaatcatgaaaaaaatatttttaaggatagaggtgtaatagcatgcttgatttaaagttacaacattttttttggtgtgttttgatacgtttacttgtgaagttaccaaactttggtacattatgtatgtctagagcatgtttagtttgttgcatcattaaattttgcaaggttaaaaatgttagcaaactaaacatgccttagtagttaataagccctaaaaca

SEQ ID NO: 68727 - DNA, 8555 bp, Oryza sativa
  unsure (1)..(8555): unsure at all n locations
catagaaaatgctccgttaaacttgcacaaaaattctattggatgtctcaaatagcaaggaaatgcatgcctgagagtgcgaaatttgacctcttggaaaacaatttccatagtgaaagcgggaaaccttttcacagatttctgactccaataggatgtatcactaggtctgaaacgtgtcgactcccaagtcccaacagtgcaaaggtactaacgaaataccgcaacaaacttaatactatgacagtagagtgatttgcacatagacatggtactcacaacaattctattgttagctcaaaaggcaaacaaccatggatgggaagatacacaaaagatgagacaaggacagccttccaatcaaaataagaaggtggtatacataccaaaaaggcaactttttcaccatgtgtcattgaagcaattatctcgttcatcatcatcaccatgatggcattggcaatacaatagatgaatagacagatcaaacttaaccgtatcagctcgatcaatatccaatagctaaaccttactcccaaaattcagattgatgaatgcaattgcaaggacaaatattgccaccaagccccaaaattgagtctaaaatttctatataagcatatgcagattgcagagtatagtagagccacttcccctagttgcgagttcatgtcagtcttcgaaggcggacaccaactccggcaccggctccggcacggtggggagcaccgggtaattccgcgagaagcaggcgtcgcagagctcatgcgcctcgtcgccatagatggtgtggagcttgtcgagcgagaggaacgcgagggagtcgcagccgatcgccctgcggactccctcgaggtccatcctgtttgatatcagctcgccctcgctgggcgtgtcgatgccgtagaggcaggagccgatgaccggcgggctggcgatccgcatgtgcacctcgcgcgcgccggcgtcgcggagcaggcgcacgatctnnnnnnnnnnnnnnnnnnnnnnnnnnnnnnnnnnnnnnnccaccacgctcttgcccctgatgacgccgtgcacgggcgcgagcttgagcttgacggcgaggtcgcggatcgcctgcgacggctggatgaagctgcggccgctgtagtgccaccggatgaggccttgctggaactcgagccccgacgtctgcgagaatcccagcgcggcgtagaaccccgagtccggaacggggatgacgacgtcggcggtgggggcgggggactcctcggcgagcgcgcggccgtaggcgttgcggcgctcgtggacggcgtggccgaacaccacggagtttgggagcgcgaagtagatgtgctcgaagacgcacgacttgcgggggcggtgcgggacgaggcaggcggaggacaccgacatgtcgcggcggtcgacgacgacgacctcccctggctccacctcgcgctcgtacgtggcgtcgatgaggtcgagcgcgcaggtctccgacgcgaacacgatggcgccgttggcgcggcggcccatcaccaggggcctgaagccgaacgggtcgcgcacggccaggagcttgtccgccgtcaggaacagcagcgagtaggccccggcgaggcgctcgcaggcgtcgcagatgcgcgcgagcagagggcgcgagagcgaggtggcgatgaggtgcaggatcacctccgtgtccgacgacgtgctaaagatggagccctgcgcctccagcttgttccgcagcgcctggtagttcaccaggttgccgttgtgcgccacggcgagctgcccgaacctgtacccggcgaggaacggctgcacgttgcgcagggaggcggcggcgccggcggtggagtacctcacgtggccgatggcggcctggccggggagcttgccgaggcgggccgggtcgccgaacacgtccccgacgagccccagccccctctccagcttgatcgtgccgtcgtcccccgcggcggcgatgccagccccctcctccccgcggtgctgcagcttctgcaggccgaggtagcagagcgacgtggcgtccgggtccccgacgacgccgaacacgccgcactcctcgcgcgggtggtcgtcgccgtcgccgccgtccacctcaccgtcatagtcgaaaggcgtgacgcggtcgtattcggggaaggcctgcagcggcgcggggcggcccgcgcggtggcgcagcgcgagaggggacggcttggcggcggagcacctgaacacctggtggtggccgtgcgccggcgcgcctcccgtggcgcagcggatgaggccggaggaggcggtggcggtggcggcggcggcggcggcggccattggtggtgtgcgtgggagttttgggagggtgagggcttccgaggatgccctcccgaacgtaagtgaagggacgagatttaaggaggcccaggtgggcgtgtggcgatcgtatttcttactaaatttttttttatacgtacgcagtgtgtattgtaccgtataatatacggtccgtgttatccggaatggtatctttgggcctcgtatttcccagttcatcccagcgaaaagaaatggaatcgtttaattgtagtcttggatatggaaatttttaatcggttttccatctgctgtgcgtgatttttaaggggtttttggctgtcaatgttttgaatcaatttacagctgtgcccaaggcttgctgccgtccgagtctcttttatgggtgtgtttagttcctgaaaaaagttgaaagtttgaagaaagttgggagtttgaaaaaatagttgaaagtttatatgtgtacagtggcggagccaccatgattcttgggtattcccgggaatacccaacattttttatcaaaaaataaatatacttatagtatatacacatgtacacatatttgtacacctaaatcctcaactctttgatccaaacacagcccaactagtctcttgcgatgcttccaaccaacccgacccactccgtcatgacccatcagacatcagttgacccacttagccaccactcttccagacagccccctctcgctctccctccatgacccatccctccctggctcggctccctcgcgccactccccatttgcaaaccctaggtggtggcgcggcgagacggcaatcggcggcgggagctggaccgtgctaccacggagggggaggccattgccacggcgggcggtgcccgacacttcgccaagctaaggcggtcaggtcggttgggtggccggcggctgcgaggggcagggacgggcaacggcacagcgcttagacaagaatatccaactttgaaatcctggcgccgccactatatgtgtaggaaagtttttaatgtgatatgatgtgatggaaagttaggaataagggaaactaaacacggcctatatcccgtttgggcatgctgatagctaaactaaggcaaattttgctacaggacatcgtgactttgcggttttagctgtaggacaccgcgcgaaatgacttttggggaaacacactctcaaaatgtggttatttgctggtggacactacacccattaaattaataatttccgtgctgactagatgagagggccccacttttttacatgccttgaacaaattgccctttctctctctctctctatcttcttcctctctctccccctcctctctctctctcttccttgatggcgcggctcgcggtgattgtgtggcgtagcaccgcgcgcgatacgggcggccggcgacgcggcagagggcagcgggaaggtggagtagcagccggcgcggctcgcggtgaccgtgcgacgcgatgcaggcggctggcgacgtcctctctctctccctcgacggcgcggctcgcggtgaccgtgcggcgcagggcggcgcgcgatacaggcggccggcgacgcggcagagggcggcgggaaggtacagtagcggttgacgcggctcgcggtgaccgtagacgaccgccgcccctacgcccagctcttctctgccccgctgccggcgacgcggcagagggcagcgggaaggtggagtagcggccggcgcggctcgcggtgaccatgcggcgtagggcggcactcgatacgggcggccggcgacgcggcagagggcggcgggaaggtggaatagcggccgatgcgtctcgcggcgaccgtagacaaccgccgcccccacgcccagctcttctttgccccgctccctaaccccacgcggctgcccggcggcatcatggcgcttcctcactcgtcgcgccaccacacttctacgtggacgtccagcacgcagacgtcgctggtcaggcatggcgcggccggcacacagccccgacgacgacgacgtgtcgtccgtcctaggcagccgcgcaccgagcgaagaacggcatgcccccgccccgcgcctcctcctcctccccctccccctcccacgagacctccacgcgccgccactcacctgtggtgaggtccgccgcagccagtgcgcactccgtcgctgtcggccccttcccgtctcccccacgcgcgggtgtggcctggatgaggagcacgacctccttgcccgccccggtcgagctgcgccacccgcggtgcatcgcctaaaagcaaggatggattgagtcgaccattggggcattttggtccagacgcgtcaaaatgtgggtccgctcaatcctagtcagtgcaaatatactaaataaatgggtgcggtgtccgctggcaaaaagtgttttccccaaaagcgactttgtgcggtgtcttagagctaaaaccacgaagtcgcgatgtcctgcaacaaaatttaccctaaactaatgtagtcaagcaaaaatgtggaatgttaaaagaaacaatttaacctggaatattattagaaggcgattacatgtcaatttaataattgaacctaggccaacgcaaactattttgtatctctctgtcgaccgagctatgctccatttttaaccataataaaagaatattgggaaatgaaaatttcaagctcgatcggtttcacacaaagtcaacagatgttaccatgatttatcacaccactctcttttcaccatgggactatcacatctaaagtttcgctaccacaaagcgccacgtcatcagaaatttaggaccgttggatgcagcagggaattaaaccgatgccattgtatctaaaataaacatgagtgaaaaatcatggtcaatggtagaatccttgggagttttcacatagccaacggtccatgttccacgcagcagacaaagggtctgtttgggggagctttcagctgcagcagcttctctcagaatcagaagctatctcaaatagtacagtttttggtccagatgttgagaagttgtaattgtcgaatccaaaaattatactagaagctagaagctagaaaacccaatttttccagattctcagaagttggctatcaaccagctgcttctcagaatctcagtctccctcaaacatgcccaaaaggtcacgaaaaaggagaagcccacgttcatggtagaatatatatacaagaatcactaagcaggtataaaaaaacgcagaacccatctactcccagcagccagaacacatccaccgctgcctgtcgacctcctcgcttccatcgccacctccctgcctcttccccattccggtcgcctcctctgcctccacttccaccacacatccacatcgaccacctcctcccccgttgcagctagctgttcagttcagttgcaatgttctaactcttttcgattagatattcgtacaatgtataacccttacgatattacatatactttgcatcagcatacacctacggtgcgtgggtgagcagcaagcggcgctgcagctagcagtagatacccggggcttctctagacgggccggcacaccgagcataggtgacggccggtgtgccggccgcggttgcgcgaagcagcctagcacggaaagaagcattcgaccgagccggccgggagcgagcaggcggtgaaggaagctccgacggcagcggcttatggtgaatgtgatgaatatttttggaagattttttcaccctttgcaggtttgtgaaaacctgtcaaaaatcggtcggagtttggttacatttaacgaaatatacaatttttattataaaagtatgggtaagtgttaaaggatgtacgtgtagttttataacggagttgacacttttaagtcatcttaacatagtaggagcaaaccggtgtttcatttaaaagacgtaagagcaaaatcataaatcctagaaaaacaaaatcacaattgtatgttttagataatagaataaaacatcacgacatttgctcaacgagttacagccaattattacaacgtaacattcaaaacaagtgtagttcaataaataaaagaagataccaatcatgaagaagaaacaatccaaaaactaccaacctaaaacaaggagtacacaattattgatttatatttgtgaatctccatctaaaattgacaacaaattgtataaccatttgtttcaagattacgacatgcaacttttaaaagttcgccatctttatcacacttttatgttgtgcccaggacctgagccaattgtcaaaagtcatgacattcctattcacccataaagcacaacatataacatatgctctaagttttatacttttcttgtccacccccaaaagccaatcataaaaaatactacatctgtcccaaaataagtgcagccgtggatatccgtgcccaacgtttgaccgtccgtcttatttaaaaaatttatgaaaaatttgaaaatatttagttacacataaaagtactattcatattttatcatctaatagcaataaaaatactaatcataaaaaattttcaaataagacgaacggtcaaacgttgaacgtgaatagtgcaaaactgcacttattttgggacggagggagtatgagatatgatatatttttaaagaaaatatgagatatgctattaggaagatatagaccaaaagaaaactgaattgctctccaaataaactatgcataatgacattccataattagatgctgaatagtctcatttttcatacataaacaacctctcaaactatcattccaatttctccttgccaaattattcttagctaacacaattcctccatatgaaagtatggttatgaacattattgcctcaaataaaaactggtatgattgaaagtggaagcaagtaaaacatgccgtactgttcaaattactgccaaaatcaaccttactaaaatttggcattgccaaattgttggcaagtaggtagaattgctaaattttgtcatgatgaaataaatacattatgccaaaattttatatgagttaccaatatttgataacaaactaaatacaactatatatttatcaatttttaaaatggcaccaatcttagataggcccgtcatgtcttgtatgctgtatccttctcctgcaaacgacaaggcaaatcgatgaagaaaaaaaaagcatgacggtgctatctctaaaagagagataaaacacaatggcaatgtgaagaatgaggatttcaacaatagattatgcatatgcaaaatgcgccgtttcattctcgcgaccactcctacatctacacaataattgcctttttgacttagcaagtctgatttgccagagaatttccaatgaactatacttttcttttcttttttttttacagccgccaagctagaagactgtaaaccgactttgatttgtgtgactcgctcggtcctttgcttcagctgtccaacaaagattcagccgccggccgtgcatctaaaattcggcgagctcgaaactaaactggtggctggttcagcaatacacgtaccttgaggtatctgttttgatttacacaatttcactgtatttaagacgaattttaatttccgtataaatcagaaaatttcacttataccaaccctcccaaactagaaagtcagcaacatgggcactttcgtcttcctgtatgccaattatggatagggattagtctgttctctttgggggtgggctcgagaacagggggccacctagcgctgactcatggggcccatcactgagccgacctgacctctacagggtgggccatggtactatggaccgtggtcctttcatgtataaaggccaggccccaccaccgatcacaacttggttcgggccttctcgcgtcgcggtcagggccaagtggggatacggggcacacgtcccacgtcacgtacaatacaagtatacaaaaactatggtgacgcaaattctacattgctctgctagttcactcccttgcagctaccttgggttacctctttcaaccacaaaaatctctcataacatgctgctgctagtcaactcaaaagttgacagatatctagccggatggttgcctctttcaaaggggggaagtctaactatgatcaacgcaatcatgtcagctatcccgacatactacatgtcatgttgtatctggccggaaaaaatctatcgaagcactggacaagataaggcgtgctttctt

SEQ ID NO: 68728 - DNA, 1035 bp, Oryza sativa
cctctttgcccggcactagaatcagctgaccacatcatccagagatgcaaaaatgctaatagcctatgggaaaaaatgaacctcctgcacctggcaaaccattctgaatcgtcctcagcttttctgcaagcagtcgttgacagaaatcattcaaatagaggaattgaacctatctggtttgcagcttgtgcatacacgttgtggaaagcacgcaacaacatgatttttgagagacaaaatgacaacttgtaattcatcattcaacaaatctcagacacactaaagctctggagcatgagagccaatgaagcaaccaaagaacgaattctctcctggtgtgcagggctgtagttgtgactttactttgtatatacccttgtaattccagccccctgttttgtttcttttcttttcttttatctattttaattttcccttttcccctttcttaatacccctctacccccttgctataacctgtaacttgtaaacctcatttctcttaatgaaatgactataaggtagaacatgctctaccttcttgcgtcaaaaaaatacaagtatacaacagcctgataatcccgatggcacgtactactaccgtagtaccgttcaccgttgtgcgagctactagcttctccgtggaatctatggcacccaaaattctcggtttgtcattgactctgatacgattagtaatgttacagactgcataagttcgcttatccttgagaccttgacccaagcatcatgttctttcctcagctgtttgatgactgaatctgagaagaggtttcatgcgaacacatgtcaccgtcgaatctgaagctgttctccccatccgaacagagaaattccgctccgtgcgtgtcgagcaccgtccggttacggcttgattgtcaacttgagggaaggggattgagagtttacatgagagaattgatggtgagattaagatgggaatttgatttttcatcccagtctcttgtttggtagaggtggtggaaattgatagggagtttagttggagattag

SEQ ID NO: 68729 - DNA, 2133 bp, Oryza sativa
tatatatatatatatatatacatacatatatacatacatacatatacatacatacatatatatatacatacatatatatatatatatatagtaatttgtttggtgctccatggtgcccgggcaccattgttgaaattgagtatatacccaattcaaatgagtatgaaactttttcaattacttaggtattaacattaactactttactaactagtttaaagcaagtttgaactgaatttgaacttgtttttgttagattttgattctaggtatatagcatccatacatataattagttaggtatgtaatcatggattgtgaaataaagttaaatttgagttgttttgttgataagtataggtatgaatcaaattattataactaggtatatactcacaatttgaaaattttgaaaaatttgagtgattttgtgcattagataccatggtgcccgggcaccatggtgccccatatgagtgtcctatatatatatatatatgtatatatatatatatatatatatatatatatatatatatgtggggatcattttacgatagggtcccaggctcccagctgcgaccgtctgctcagtaggtcccgcggtcccgccacgcgccactcgtcttgaccgcgcgctcggctgccgggccagcgcgccgaaccgccaatcaagcaggaggcgcggcgcgggcctttggctgcctccctttcccaagccgaaacgcacgattcgcgcccgcgcgcgcgcgcgtgccccctgtgcgtgttggtttcaggttttggcctctttctgcccggggaatgtgggatccgccgcgtcgccctgcgctcgacagacaccgaccccggtgggggcatggaggccatgtccatatgagcaacgcaacgtcgtggcctcgtgggtagggcaagggttggcttccgttttcccgccggcgcttttcggtgttcttctgatttttggccgccgtgcggtgcgatcgccaaatgtctcggactcttggttgattctgttgtgttgtccaaccacaagtgccaactgacaactgccaaagcccggttgttgtcacaacgtaacgtaccaatacggcgggcgcgggtaggacgtggatatgagttacccacaatttttgccatctcttctacggatgagttcgtgcttaccaagcaaacagtgtgtgatggattacttaaatccgtggaactattctactggttttttaaccttagctttcaaggtcgatccgcccccaatgaacaaggcgggcgcacgcaagtccgagcgagaagaagctctgatgtaaacgctcgtcactatcgagtttttcggctttcggccgcgggatcttgcgttgcttcgttcgggaggtaaataaataacggccccaaacgaccagtccatggaaaattctgggccgctactgacagcataaggcgggccaatatagctgggtactatcaggctgtcaccgttgtggcccaagcccaacattttattcagccttttgtccttttcgaaacgtacgttgcgtagaggaaccaatccggcgactgggcggccatttccgtccgccaccatattggaaattggatgatttcttctgtcgtgatatacaaagagtacttcctccgtcaaaaacaaacatactttttgttcaaatctagatatatagaagttgatttgttttgttttaagatagagagtatctttattacttcaaaaaagaaatgttgaagtctagtcggtgttgtatttacgtgtgggcggacgagagagtgccacgaatattcttcgtcctggagaggccggccatcgacgacgtctgagcttttgagaatcttatccgagcaagcaaaacgacgtgagtagcaaccggcatcgcactcgattcccttggctcacgtacgcagcacgctgcccgccacgtattccacgctgcacgcacagcccccgaccacccccgagccgtgaacgtgaacgcgatcaccacccgggcggccggccgcctcatccgctcgtctcgtatatggacaaaatcgcagaaacaccaaaagcgaacaggggaaaaaaaaacggggagtcgagtcgcttcgccgcgcggatgagacgcgcgctgaccaccacccgac

SEQ ID NO: 68730 - DNA, 2281 bp, Oryza sativa
ggcgcgccgcgcgcttcctcatcggtaacgtcgtcgctgacctctcgctgtactcgcgcgcgtccctgcgccgcgcgcaggtcgatcgattctttgcctcgcctgagcgtttctcggattcatggatgccgcagccgtcgggttcctggagcgcatcgggttcaacggcgtgcagggcaatctggtgatgtacctgaccgggccgatgggcatgtcgacggcggcggcggccgccggcgccaacgcctggggcgggaccgtgctggtgctgacgctcgtcggcgcgctcgccgccgactcgcgcctcgggcggtaccgcgccatcgtggccgccggcgtgctccatctcctggtcagttcgatcttccgcttctctcgatctgtacctgtcgaacaactctgtcatcggatgatcgagttcatcgatgttccaacaaagagtcgcaattttacagagtttgggaatgctgacgatctcatcagtgatgcaaccaaatcatcctcacccggcgagctgccatgacgcagccgccgcctgctcgccgtcgccgccgccgccgccatctctcgcccgcctcgtcttcttccacgccgcgctctacctgctagcgctggcgcagggcttccacaacccgtgctccgaagccttcggcgccgaccagttcgcggcgagcgaccccggcgcgcgcgcgtcccggagctcctacttcaactggtaccagttcttcaattccttcggctatggcatctccaacaccgcgctcagctacgtcgaggacagcgtcagctgcaccgtcgggttcgccgtgtgcttggccacgacggcggtgtacctccccatcttcttgctcggcacgcgggcgtaccgcgccgagcaacccgtcgacggcgccctgctcgcgcgcctcgccaagacgtcctcctcggcggcgcgtgcgtggacggcgagggtgtttcgccggaaggatacctcttgcacagaacggtgagctcgccgcgccagcgaaagcaaaacgtgcgttcttgatgagttgatctgataaccttcctaatggcgaatgttttacactaatcgtgcaggcttctggcgagggaagaggtaggcgagaaggggttccttgccaagttgcttccgatctgggtgaccagcatagtgttcgccatcgtcagcgcgcaagaggtcaccctgttcatcaagcagggcagcacaatggaccggcgcatcggcgcgcgcgggggcctcgtcgtgccgcccgctgctctgcagtccattgtcagcgtcatcttcctcaccttcgtgccggtctacgaccgcgccctcgtgccgctcgcgaggcgcttcacggggcaccccgcgggcatcaccacgctccagcgcgtcggcgtcggcatggccatgtcctgcctcgccatggccgtggcggcgctcgtcgaggccaaacggctccgcgccgcgagcgacgccggcctgatcgaccggccggacgcgacggtgccgatgggcgtgtggtggctggtgccgcagtacgccctcgtcggcctatcgaaggtgttcggcatcatcgggctcgacgagttcttctacgaccaggtgcccgacgacctgcgcagcgtcgggctcgccatgtccctgagcgtgcgcggcgtcgggagctacgctagcggcgtgctcgtgtcggcgatcgactgcgcgacgaggagcgggggagagagctggttctccgacaacctcaaccgcgcgcacctcgactacttctactggatcctcgccgcgctcgccgctttggaggtcgccgtgttcgtctacatcgcgaagcgatacgtctacaagaacaaaggcgagccatgattcttccgagttcggattagagtgtgtaataagtctgaaaaatggtccacatgctcaaagatgtgtactctttcccgtttcataattcttacattttacataaggttaaggttaaacttttataactttaattatcaataactttaaagtatttagtttaaagaaactataacaatgtatatagaattatctttcaaagtactatgagaaaagtaaacaatatttatttatttatgtatatattataatagaaaaatcaagttaaacatgtattttgaacaccgtgtcattatctaaatgttaagaattatggaacgagagggactatagtatttatagtgagagaatgcaacataaagattatggtacctctctagcagcaagatggagtacaagtacttggtggctggggcatgcttggattgtatccat

SEQ ID NO: 68731 - DNA, 5264 bp, Oryza sativa
acgtaaaacgaaggtcctattattgcgtgattaattaagtattagctaatttttttcagaaatggatcaatatgatttttttaaacaactttcgtatagattttttttgcaaaaaaaacaccatttagcagtttgaaaagcgtgcgcatggaaaacgaggcggaggagttgggaacaggcagcaacgaacagagccttagagcaagcctaataacatagccagctactggctctatactaataccatgtcacctatagccatcaggcccatcactaatataataggctgactgttaggttggctgtttgtttaactctattgaagatttagatatttaatattagcatgtgcacctgatctcctcgcatctgattggaagaaagcaatatttcctcgtgtgttgtgcttcagccgggcgatagatggagcgcccgctccatcctttttcttcccttctcactcctccacgtcggattttgctgacgggtaacgtgctagcgccggctgattaggatgtattaaacctgctcttaggagtactactctctagtcaaattgctttgacgttgaaaaagtggacatcattttttttttgctagtgggagtaattctgtgacaaaaaacagtatcattaggtttaggtttcaatttatttttgatataatcatgattttgtggaaaaatcaatcggcaaagtttgattgtaagttaccaccttcttcggtatttacaacggtgggtagaaatcccatcgcccgaacgcgtgcacacagtcgcacacgatttttggtgcactttcttttttaataacattaattaatgacggaaacaattatgctcgggcgctctgtacctaacaaaatatcgggcgtcttatcagtcaaccattccacattcctccgtggcggtggtcgggccatggtttgttgtgaccggcgagggttcatgcagctgcggtggcttgctagcacatcggcgtagctcgaggccatgagatgggaggaagacagcaacccgtgcacaaattttgataatttgaccctttacagaaactcagcctgttcatctacggttaagacgggtttccgccataacccagcccaacccggagctggctggtattagacggtttggtctagcggtttgaacgggttaaaccgtttgtcgtcttcttcgtatgagaacgaacagagagcaggacgacagccatggcagctgtcctttgcaagcagataaaaattcctgcagatgatgcgcaagcacttctgtagatgaacgaacaggctgacctggcttcgtgcggcgctttcctcgttggtcgatgagcacggccggggcgaggaggatgacgagacgaaagcggcggtgagagggatgcggagccggcggggacgacgcgcgacgctttcctcgttggtcgatgagcacggccggggcgaggaggatgacgagactaaagcggcggcgagagggatgcggagccggcggggacgacggcggtttcaacgggttgtaggttaaagcagcccaacccgtgcagaaccggccgtgcggttcggtctggttcggtttgatggtttgaccgggttgtgcccaacccgtgaacagcctgaacagaaacttattaaaaaataaaccgtgttaaaaacttattttaaaaatgaaccgtgacctcagcgccaattccgatggcgctgcgccaccaattttagcgctaacctccgagttgtcataagttagccacattatcaaggccctctaaagcaaaggtcatgggaggtcatgggtttgaatccgcgcctgtgattttcaaccgttatatgcctaaaaaatttgctagcttaaggcttcgaacccaagacctagtgctaaaaaccaatagagctaaccactgcactagtagtatatttcaggtaggcatcaccaatagagccttttaggctttgaaaaggtcagcgccaatgagagtggcgctgacccatgatgatgtggctaatttatgacacctcggacggaggttagcgctaaaattagtggcgctgagatgttggatctcagcgccacttccgatggcactgaggtcgcggttcatttttaaaataagtttttaacacgatttattcttgtaataagtttttacaaagggttaaattgtcaaaatttatggcatcccgtgtatggatctggagatggcgcggtttccgttttgcccaagtgatgacgatggcatagcgagctcccaatagcaaacgatgacagggtggtgagggcctagggaaacgacggctgctcgcctcagaggagcagaagggcgttgtaccttctcggcgtggatctccagcgaagaacggaggagagcactgagccgacaacccttggcaatcctgtgttcgtcggagggaagaagatacagtccaaaccggatatattttatttcatttttttttatgttttagctagtgtacttatgatgtttctttgtgtttggatcaaatgttgatagtatgccatattttcatctttgatgcacacggttttgtttatgtttcaataattcaaacctaaaaaaaattcaaaattaatgtaccatatgttgtagtggaatgtttcaagtgtgatttggttatgtttcatcatttaaaatgttgtgaaatattttcgtataaaaaggtgaaacaacaccaaattttttttttggaaaaccgggcgttcaatttgtagtcgtatcccactaatgatgcttgttttcattttcagcgccgctaatccctgtatcgctggacacgacacgtgccctagagcgagcttgagctttagctcgtgtgagtttgggcgcacgaactgcctaccggtgagcgaatcatcctttcacgcttagctggattatgtgacagccggaagaagatacctaaagaatagagaagagggttcgatactatcgtaacttttgaagcctgctctatctctagaaagaacacaatgactgagttttcaaccaacgacaatggaacaggatcgatattgcgaagacgatgacaaaggaagcatctctttagcctttgacaaaggttgtggttcggcagctagctacttatgtagccactatagtcctaggtcagcccatctgattagatagagtgcactcagtcccttcccctacttcctctttttttttttctgttcagttgtaattggcaactttactcgtcttattgcaaagatatgtaagtcttttacgtattaaaaaattgctcgcgagctttgcgctgggtgggcttgcatttttgggtctaccgtttaattgggtcaatttatgcctaataaaaagtttaaagaacactgtttcttctttgattaaattttacattagactatttttttcacataagtttcaagtagagattttatacatttattcagttcatccgtttgaaggaggcatctatctttatacgccatcactctctactctctattactccgaattactattgagtatattgatctagacatctagccacaatcaggcaaggccatcagcccattacgacacagaaaaatatcttgatatctgcccacgtcagctataaaaaagtatcgagagttcttccaaaaaaaagaagaagaggcggctaaaagtatccaagcatctgtctgcaactctgcatcatagcggccggggtgccactctgcagtctctcactgtgctggacatggagtccggcgggatactcccaccatccgagacatgcgccggctccggttcaccggacggccgcggcggctggcgcgccgcgcgcttcctcatcggtaacgccgtcgctgacctctcgccgtactcgcgcgcgtcaccgcacgcacgcaggtcgatcgattctttgcctcgcctgagcgtttctcggatggatggatgcagccgtcgggttcctggagcgcatcgggttcaacggcgtgcagggcaacctggtgatgtacctgagcgggccgatgggcatgtcgacggcggcggcggccgccggcgccaacgcctggggcgggacggtgctggtgctgacgctcgtcggcgcgctcgccgccgactcgcggctcgggcggtaccgggcaatcgtggccgccggcgtgctccatctgctggtcagttctttgcttccgatccccacctgtaagttagttaattaccaacatctcgagcatctatccatgtcgtgatcaagttcgcgttctcaatttgatattccccggcccggcaacactgtttttgtgaatggattgtttcacttttcttgggtatgttcttgatagcgagggatggcactaactttatcacaattagatggtagtcgtttgtattgaagataaagataaatttaggacataagaaacaagacatttttatcgcattataaattgagttttaattattttaaacctaaaaatattatatgatatttaaaaaaatcgaatgaaatgtattgtttagcggtttgaaagacatgttaatgacaatcaagataaaatatgcattttaatgttgttgatagaagcagatggattaaattaaatattagaaagttgatacgaattataattttttttaaggaaactttatgaaaaacatttttctgaaagaactactctctccgtccctaaatataagatattttggttagatgtgatgcatcccagtacaatgaatctagataattgttagcaaccaaatcaccaaacaataagaattttaccacgaacaactattcagtcaacaatgctgttttggaggtggaagatggggaaatacatggggctagaaggttctggaagctagggaatgggaggtggaggagggaataggtactcgacaaggatccagcccggacccaagccgcctaggttggtcgccgtcctgtcttttctgttcgtctttgagtgagcagtagctattgcgttatgtattgctcttcctgggtttgcttgggccgggatttgcgtagcggaccagctgtggtgcagcccaacaaggtgtctaacaatcccctctccttgaattcggcttgtctccatgccgatgaattaaaacctcccggatcccatggttgctccaaatatttggtgttagacaatagaacattattgaagaagaatagagcaagtagctttagcctcgataacttcttactccatgcgaagtcctcatgtgtcatgcctgacaatggcactgttatgaattgcttgccaacaatgattcccaacaatttgatatgat

SEQ ID NO: 68732 - DNA, 1583 bp, Oryza sativa
gcccaaacgctctcgccgtccacgcacgcgcagccaaggaggacgactcggcgagccgcgcgagggtggcgccgccgccgtggacgggttgctcggcgcggtacgtccccgtgccgagcaagaagacggggaggtacaccgccgtcatggccaagcacgcggcgaacccgagtgcggctcacgctgtcctcgacgtagctgagcgcgctgttggagatggcgtagccgcaggaattgaagaagtggtaccagttgaagtaggagctccgcgacgcgcgcgcgccggggtcgctcggcggcgcgaactggtcggcgccgaaggcctccgagcacgggttgtggaagccctgcgccagcgcaaggaggtagagcgcggcgtggaagaaggcgaggcgggcggttgatggcggcgccgccgccgcctccgccggcggggagcaggcggtggctgcgtcatggcagctcaccgggtgtgggtgcgttgctcgcgtcactgatgagatcgtcagcatccccaagctctgtaatttttcttaaggatcaaaggttaaatgtaaagcaacatcgaagaaagagaatgtgtttgctccctcaaatcatttctattcggattccctgtaatatgatatatatcacattcgacacttgctagcaagatcatagatgagcttcgtttgtgggaaatggcaggtgccaagggagtgaagtatattatgttaagagattaggcttttgttttttagggagtgcaggcaggaagagttcctccgggaacgcccccactgtcttctgttatgtacagtttctctcacttcttctataatataaaaccagctcgctgggttcttttaatatatatatatgtatatatatatatatatatatatatatatatatatatatatatatatatatatatatatatatatatgtatgtatgtatatatatatatatgtgtgtatatatatatatgtatgtgtgtatatatatatatgtatgtgtgtatatatatatatatgtatgtatatatatatatatatatgtatgtatatatatgtatgtatgtatgtatatatatatatatatatgtatatatatatgtatatatatgtatataggatactcatatggggcaccatggtgcccgggcaccatggtttcaaatgcacaaaattactcaaatttttcaaaatttttaaattgtgagtatttacctagttataagaattcgattcatacatatatctatcaacaaaataactcaaatttaactttatttcacaattcatgattacatacctaactaattatatgtatggatgctatatacctagaatcaaaatctaacaaaaacaagttcaaattcagttcaaacttgctttgaactagttagtaaagtagttaatgttaatacctaaataattgaaaaagtttcatactcatttgaattagttatatactcaatttcaacaatggtgcccgggcaccatggagcaccaaacaaatttactatatatatatatgtatatatatatatatatatgtatatatatatatatatgtatatatgtatatatatata

SEQ ID NO: 68733 - DNA, 11214 bp, Oryza sativa
  unsure (1)..(11214): unsure at all n locations
atccgttgatcctccgtgatctaacgatctgcaacaaaaggtagctaagagaaggtactaaaaatcgtgggccaagtattaacttttaaattaggtggagggtcagtttcaaaacaaactagagagaaaagcccagtaactttgcttgacaatagtcaataggaatccgtcaaatttgtgctttaatatcttggtgagactttgtaagtagaaacccgttaacgtaactaaccaaagaagagaatcaaataataatatactagaattaattaagtaatcaactttgcattgatccgttctgtaaaaaaaaaaatcaactaccatctaccttctgtaaaaaaaaagaaggtatatataagatggaagaaaagattgttttcagattttgtactgtttttttggtaaagatttagtaccgttatatggcactataaatgaaaattagtgatgaaaagcgattgatcgccatggagggaatatataaggccagtgatgagcgtcaactaacaatgaaatgggaaaagttagagtagtttgttggttaagaataattagaatattaataatttgctgcgcttatgttattttctgtaccgaaaataccctttcaaattaacggtagataattcagtaagagaaaggtacctactctcactttcaagcactgtaaaagctctccacttgggtacgaatgtataccacctgcgtgactcagcctagatctcgcgtgaggacctttttatttttttaaaaaaatattattattaagatctaaaccttttagctatcctcatgacagacgtgataaacaacgctgctgcgaagccaaccagactggtatggtcaaacaacactactacgctaacaaaacgggtgtataaaaaaaatagtaatcgcaagtattggtagctaacaaattcactagcacggacagtgctagctcccgagaacatccagggaacctcgggcttaattacagttacagctacaggggcaaggaaagcaaggagaactaactaaccagcaggtggagcacgccggcggccacgatggcccggtaccgcccgaggcgcgagtcggcggcaagcgcgccgacgagcgtcagcaccagcaccgtcccggcccacgcgttcgcgccggcggcggccgccgccgtcgacatgcccatcggcccggccaggtacatcaccaggttgctctgcacgccgttgaacccgacgcgctccaggaacccgacggctgcacgcacacgcagcagcagcagcaaagccatggcgagcgtggtcttgtcagttgtaagaacgattcgcgagcgagcacggcgagaggtcggcgagatttaccgatgaggaagcgcgcggcgcgccacccgccgcggcggccgtcggcgtcggcgtcgggcttggagccggcgtcgcatggctcgtcggaatgtgcaaggagaccggactccatggctagcacggtgacactgtggcactccctctctaatgctttgatgtggacaaatgcttggatacctatatatatctatatatttttttgacaaaaagcgatgctcacttgtcctagctgacgtgtggaattagcaagatattttcgtgcacctattgctttgcagcgagtcgtgtgtgcaattgtgtcctcgccattaatggctagatgtcgggatcagaaaatcaagataatatagagtacagagtgattatagaaagagataagttcatcggggttaccagcttcgtactaaaaagtaaaaactgggccaccacaaatcacaatctacgatgttgatgcatttccttacttgtacggttctctaaattaaactttgatgaggtttttaaaaaaatgaactttgatggccaattttccattgaatgggacacgcttgaaatgcaccattatggttttgtttgatgaaaaattcaccagtatggttgcaggcttgcagcttaattataagctgaaaacagaatgaacaaagggaaaatttactgtagtgttaaaacttttgtacttctactcttaccattccaaaagacaaagcgaaaaatagaatacgagaaaaaaaaaacccagattaatttaaaattcagaattaactgccacgcctgaaataagtcggtcccatgattaaattggaagttcttctgaatatgatccgacaataccactttctataaaaactgtatattattattccagatattgttaaacataaactaaagttgcatttcatgattagattataactgcttgtatttttttcattgctattcttataacatcaactttagcatttgaactcatcaagtatctaaagattaacatatagcaattattagtaatcctaaaaactaatacaagtatgtcacatcaacccgctaaacactaaaggttaatatgcaagcatagtaacatatctataatttattactctctctgtttcatattttaagattttctagtattttccacgctctcatgtctagattcattaacatctatatgaatatgggcaatgctaaaaagtcttataatatgaaattacattatgcaactcagcatatatatataaacaagctaaattatcattcctcacatcatttccagacaatatttcaacctaaattcatccatcatttctataacatttgacatttattagcgcgcgcgggatgtgccattgagacgaaaagatccatctacaattaaatatcaactgataagactttgttcttagtgtagacataaccctttgcaaaatacaagaacaccagcacatctaaagcactaattccggccaaaagccagtagaagtagtcaaggtgagcacggttgagattgtcggagaaccagctctctcccctactcctcgtcgccgacacgagcatgccactcgcgtagctccccacgccgacgacgctcatgcacgctgccacgccgacgctgcggagctcgtcgggcacctggtcgtagaagaactcctcgaggccgaccatggtgaacgtggtggcgacgccgagcaggacgaactgcggcgccagccaccacacgctcattggcaccgcgacgcccggctcgtccaggaggccggcgtccctggcggcgcggagccgcgcggcctcgaccagcgccgcgacggccatggcgaggcacgccgtgaccatgcccgtgccgacgcgccgcagcgtcgtgatcccggaggggtgcttggtgacgcgcctcgcgagcggcaccagggcgcggtcgtaggccgggatggtgaccatgacggcgaagctgaccaagctcttcagcgccgccggcgggacgagtaggacgccgccgccgccgcccgtgccgatgacgatgcgccggtccatggtgctgccctgctttgtgaaaagggtggccacctgagattacaccaccgcgtacatcacggtggtcatccatatgggaagcagcctagcgacaatccccttgtcatcgccatggcctctcggcggcgtgggcaagctgcgccggtagaacatgtcaatggcgatggcatttgcagcctctccaaaatcattcgcgagcgagctcaccttgccgtgtcgtccatggcgtcgccacgacgcgtctcggcgaacgttcgcggttgctccgggcggtaggttcccgtgccgagcaagaagacgaacaacgacacgagcatcatggcccagcacgcgccgaacccgatgccccagctgacgttgtcctgcacgtagctgatcccggcggttgagagaacgtagccacacgacacggcgaagttgatccagttgaagaaggagctccgcgacgcgagcccgcctgggttgctctccgagaactggtcggcgcccatggcttgcacgcacggcctgtggaagccctgcccgagcgcaagcaggtacagcgcgacgtagcagaacgccacgcggcccgccggtgctgccgccggcgacgagcacacggcggctgtatcctggcacaccattgtcgcttgtggtggtgctaccatggatgagaccgtcagcatgccaaggctctgtccaaccccaaataatttgttcaccatggtgactgaaatgaaatgttagagctcaaaattcagaagaggttagaggagattcaccaaccaggagatagagaacgccggaggccacgacggcgcggggccggccgatccacgagtcggcggcgagcgcgccgagtagtggcagcataaacgcggtccctccccacgcgttcacgccggcggccgccgccgccgtggacatgcccagctggccggtgaggtacatgatcaggttgccctgcacgccgttgaacccgacgcgctcggcgaacacagccgctgcattgatcatcacgaagaaaaccgcaatatttgcagaaaccagaaagtgagaaagagaaccaaaagcctcagtgtttgatcagctagatagtgttaccgtcttaccgaggaggaagaacgcggccggccacccgccgcggccaccggatttggagccggtggacggctcagcctcaggcaggagggcgcattgttcgctggattccatatcactcgttctgagttcttactcgttcacgcgagaactgcaaagtgtttggtttggcctcgtgccctcatggcgaatataaaaaggaggctttgaaatttggtttggtgacaccaatagtttgctagttcattcgtcattgtttgtaattttaagagtgaagtacacgtacggacactctcttatgcaagtgtgacatctaagttcatgaacttttaaaatatatttttgggtctctaaatttatcttgggtgttatacagatcaaaacgtcgtgcaaccatactggcacatacatatcagggagacccacatatcagtcataggaaaaacagattttaaaaacatcttttcgttttggatccgtagtacacccgagaaaagtttaggaacccaaaatacatttcgagagtttagaggtctatataacaaacctgcataattttagaatattgttcaacaacaagaagaaaatacatactcgaccgatctgatgtaatttcatatcagcgggctacatcatattctttttcacatgacaacatcataccttagatcttaatccggctcaccatggttagctcacccttttactctgttgatattgatatgcgggaaaatgattttaaggggtttgctgataaaagagtcggtgggcgattggcataggcgagccatgagcatcgaggtgtcagtgttggtgccagagccgtaggctggtgtcagtggcggggagccacctaagatggaagaaatagcgtggcggggcatcttgccgccgacggcttgagttagagcaatctatctattattttattaaacgaatagaaaaaggagtctagaaattctcacattaatcagagaaaaagaaaaagcagagtccatatagaaatacaatttaaaaatagcttaaattcaaaattaaaaaataagtaatattagaagaggagaccagagtccatatagaaatacaatttagaagtaactgaaatccggaattaaaaaataagtaatattaaaagaggagactagagtctctcctctagagtccatatagaaatacaattaggaaataaatgaaattcggaattaaaaataagaaatattagaagtagagtatagagtacatatagaaatacaattaggaaataactgaaattcggaattaaaaataaggaatattagaagtagagtatagagtccatatagaaatacaattaggaaatatctgaaattcggaattaaaaataaggaatattagaagtagagtatagagtccatatagaaatacaattaggaaatatctgaaattcggaattaaaaataaggaatattagaagtagagtatagagtccatatagaaatacaattaggaaataatagaaattcggaattaaaaataaggaatattagaagtagtgtatagagtccatatagaaatacaattaggaaataatagaaattcagaattaaaaataaggaatattagaagtagagtatagagttcatataggaatttaaaactaactaaaatttggaataaacataataaaattaaaagtagagtttagagtccgtataaaaatacaatttataaataactaaaattcaaaattaagaaaaacatgggaagaagaggagtttaaggtcaatataggaatacaatttagaagtaattataattcgaaattaaaattgaagaatattgaaagatgagtttataattagaaataataaaaattcagaaataaaaataaataatattgaaagaagagcatagagtctatatagaaatacaatttacagaaaatttggaattaaaaaagaaatattaaaagacaagtctaaagtccatataggaatatatatatatatatatatatatatatatatatatataatttacaaataactaaaatttgatattaaaaataattaataactaacacatatataaaatatatgaatattacacattagtagttttgtaaagttattgcaaaatttaaaattatgttatcattttaatatatttgaataatataatgagaaaacatatatgctattatatgtgagaaaatataatgatgctagccgcgcaatctgcgcgggccaccatgctagttttaatagtatagcccactactggctccgattcatctatagttcatctaatagccaattcatacaatagttacttactatactattaatatatggtcccatttgtcatacacatattgcgttttagagtccgtactgcagctggctacatatttgtagcccgctgctcttctctctcatcttttatctcattaaaatatgtttgcagctggctaatagtctgctattgtacctgctccaagagaatagaggggaaggaggctggctcgagaacggcgctgttcacactttccagccaatcaataaggttggggggaggaagagaaaatgataaggttattgtgcgaacggaccttaaagcacatccaacatttcataatttgtattatgtggaatgggattttctgttaaaaattgtatagacagtcaggtgtaaacagataattcgcatactaacttacatgttaaaataaataggtccgcaacctattttgacttataagtaaattcacaggttaaccacctacacacttaggcagcccatagtctaaaaactaaaaacaaggcttgttcgaagctaagatttggttgatatttggtatagtcacttcgatagtttattaagactaattctatcgtcattgtttgtatttttaaatgcatattgtaatacttcctccggttctataataattgacgttttagataaggttgtggtcaaacttttataactttgactattaataactttaaaaatatttagtttaaagaaactaataacaacgtatatagaagcactataataaaaataaacatgcatttattcattgtatatattataatagaaaaataaggtcaaagatatattttgtagtccgtgtcattgttcaaaacgtcaattaaaatgaaactggagggaatattgttcaacaacatgaagagaatgtgttcgcaggcccatccgatgaattttgttcacctcggtccaccatgctcatcagctcgccatctttgctctgattactgatcacttgatcatcagagtatatgataacgcactacaacaattcgagatttttttgtgtacactcgcgagcaatgaagcaacagagcacaaatcggaggtttacacgcagatgccatcatcatcaactcccctgtaatcacaattgccatcagcatcgttgcccttcttcttgtaggtgtacacccgcgagaagaggaagaaggcgacgagctcgacggcacagaggccggcgaggagccagtagaagtagtcgaggtgggcgcggttgaggttgttggcgaaccagctgccgccggcgcgcctcgccgtcgcgccgtcgatcaccgagatgaggaggctgctgaggaggtggccgacgccgaagatgctgaggaacagcgcgaggccgaggctgcgcacggcgtcggggacctggtcgtagaagaactcctgcaggccgatcatggcgaacacgtcggcgacgccgacgagaacgtactgcggcaccatccaccacaggctcatcgggagccgcgccttgggggcgtccgccatgccggcgccggcggcgacgcggaggcgccgcgtctccacgagcgcggacaggacgacggcgacgagggagagggcgaggccggcgcccaccctctgcagcatggtgatccccgacggcctccccgtgtagcggcgggcgagcggcacgaagaggcggtcgtacaccgggatgaagacgacgatgctgacgctgatgaacgtctgcagcgccgccggcggcacgttgaagctccggccgatccgccggtccagcgtcgccgcctgcttggtgaagaacgtcgacgtctgggagaagattatcgcgtagattatgcacgacgcccatatcggcagcagccggagcacgctcttcacctcctccacgaggtcaccggcgtcgccgtcgccgtctcctttgccgccgctcgccggactgcatccaccgtctcacatcaggacatgcacaaacagtcaaaacacacaaagaaaaacactactaaaatcgatcgaactattcttctttacgcacttggtgcgacggtttgatctccagctcttgatcaatgtcaagaacgccttggcgacgcgggcgacggggctggccgtcctggctgtgtagaacctgtacgagcgggtgccgaggaggaacgcggcgagggagacgacgatgacgatgcaggggatgccgaagccgaggccccagccgacgttgtcctgcacgtagctggacaccatggtggtgacggcggtgccggcgcacatgccgaagtaccaccagttgaagaaggagctccgggcggcgcactccccgccgtccttctcgtcgaactggtccgccgcgaacgcctgcgcgcacggcttgtgcgcgccctcgcccagcgccaccatgtacagcgccacgtagaagacggcgacgtggccggcgcgcgacaccgggaacgccgacgacatcgacagcgtgcccatgctctgcatccatggaaacaattaattctcagtgtacgcgccatggttgggaagaagaaccgaaggagattgcaccgaccaggacgaagatgacggaggcgaggacgatggcgcggtagcggccgagccaggcgtcggcgacgcaggcgagcggcagcggcagcatctgggagacgcccttccacgcgtcgatggacgcggcggcgcgcgccatcggctgccccagcggcccggtcaggtacgtgatcaggttcgccgccacgcccttgtacgcgaacctctccgcgatctccatggctgcacgcaccaacacaaacacaagatcatcatcgacacattcatccaatcgctcaaatcactaaaaaacaaggaagatttaagcatacccatgacgaacaccgacgacttccagccgccggtggcggcgcgggaggccggccggccacggtaatcgacggctccggcgacggtgtccgccatgccggagtccaagaggtgagacaccagcttgctccggtgatcggccatggtacagcttgttagggctttatacgaaaccgaaatcgacacgcggctgcttaggcagatgtaatccccctttcttaactctgaaattactgctaatcaccttccctaaaaccccctctactcttcccaaatttacccgatcttgcaatcctagttgaaaattatcgtacaaaaccccctcgaattaggacgctcttgctaatcaacccctgtcttacgctaatgcagcggggcacgtgtcacgcacgcgtggcccgtgtcgcggcgtgtacggacgagagtcgccacgtgcggagcacggttccctatcgtgcatttaggacaggcttctggtgatgcgggccggtggatcatggatggacggctgagatttcacggcttcgaagaggataggttcttcccgcgaatcaataccgacggcgactaggcgattactagtatagagatgagatgagccgttattgctgctttgatctttgaacttttggaaaagcaacggacaggaaactgttgccaaccagaccacgaaacaagctgtcctggatacgtttttcagcagcaccgcatcgtaaattttgcggtgttgaaagaaaatgtttatttacctattttctaaccatacgatttcaatacaactaaaattattttatgtatgccattatataagcatgagatgtatttttataccgtgtttgcaactttgcatatggatcaaaatgctcccgctaactctttctccccacctcattgacatgtgggcccacgcatcatcccccttcctatgttcctcatcccactcatctcctagtcgttctcgtgacattatcgccctctttggaagacactaatgacgagttcccggtggggagttggaggtcatgctctggtgacttagatactcggaaccctttgacaactcgagaatgagcaacatgactgggaggaggcagcggagaggagcagcagtagcacttgtggaccatttgacaacaagggtgcgagtgatggctcgttgatgatgccaacgggtcgagctgggcgagggtgtggttgtccggcgctggtgcaggatcacgttgataagctccacgttagatccagtgcctcctcatccacgatgcttgcgaagatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggctgcaggaat

SEQ ID NO: 68734 - DNA, 2500 bp, Oryza sativa
aattttatgttccccttcaccaggaacattggcatcagaaagaataaccttcaaaagaatttaaccagaacacacatgactttttcatacttgcctttccaatcaatgtaaaccttagagtttgtgaagttaacatatggaacatactgacagaatgtaatgccaaaacaaaactgataggcttaaaaccatgcttactttaacttgtttccatccaggatcataattcaacctgagatggatgtagtactgcaaagcaatcgataaaacagccataaactctgttcctggagtaataacgttagaatcacatgtttgagattgctgttttggtggaagttttctgccttccctctcaaactcttcacgcaacctctcttcttctgcggcctggagatagaaaaataataagccataaatgcaattctaccccttgaagccgtcgatgaatgggaatttaaatgtcgacatattatcatacactgcataaaggaagataatttcactagaatactgaccgcatcagcagcatcttttgcagctctgaatcgtctagagcgttgctggttcatcttggcacgaggagcaacaccatctgtaaaaccattgtaagataatacaaaatatcaacaagaaaccatcgacaagaacaaaacatatgtggtaaaaaacaggaccctggacagcaaaagtttacaagcacaggtactatgctgccaaataaatagtttacgggtgaggattatgcctgattcaaaactcatgtaaatgactcgtcatagtatatagctaacttcaacaaaggcattagttggcagtatggcaagctgttctatgatgatgaccaacaggtaaaagagcaatgacactaaacactcctaatcctttaggaaggaaaaaggtagtaagagaattcctacacatcagatgttatacgtaccaatggccatatacataagcttccgagggcgaaccatgacaaatagcctatcgatataatcaaacatgcactggaaaacctcagcgaatgttgtcggagagggctgtaaaagataacacaatagcaagaaatcatggtcagcagagaaatcagaaagcacttgagcaatcagtaaacattaaaatatttgttcgaagagaaatgcagggcaatgacagagtagcatcatgcagtctaaactggtgcgtccaccgaatgaaaataaacataactcaaaaaggcaaattaacaaatttgcgatgcagagtttgaagattaaactacagcagcatcctcatcctaagatggctcatgtggcaatttagcagtttgtggttatttgcaaaattatgtttaacgctcaggtaaattacaaaacaggaagctacaaaatcatttcaccaaactatctcctctgccacagctccgtcgtacatcaatcaggcatacacaaatccatcacctgtacagcggagggacaccatacgaacacccaaacaaaccccagagctacgcaaacagaaacgcccaaaaaaaaaacatcgacgtaccctatcctcggggtggaagcaggggtgaatgatcccgttcatgtcgaggtagaggttgtcgaactcgaggccgttggggttgggcttggaggtgtcgacgggcaccttgacgccctcgatctccaccgcctcctcctccaccacgtccaccaccaccatcgggtacttctccgccagccaccggtagaacgccggcacacccatctcctcctcctccgccgccggaaccctaaccctaaccctagaaagcgagccgccgccgccgccgccgcgaggagccgggccgacggccgaggggaagggagagagggaagagggcgcgaaaccctaacgaagggggtaggccacgcgggcggggaggggaggggggtatatgccttttccggtctgaaaatatcttgttcgaggacgaagatagggagagagagagagagagagagaggcggttttgcggtttcgaccctggtaaactggggtaatttttggggggtgaaaaagagttttgttttttttttgtttttttatatgtacagagacgatttgatttgtccgacgcgtcaaggtgttgactacgacgaggctacgaatagtggtcgggcgggctggctcgggccggtcgcaggctaagattagtaaaattttgggccgagtattagttaggcccaagcccagtgctttgctttgtgggcttagtgaacttgtcagctgatgatgatgatgagatgttcgttacaaggaaaaagtgtttcttgttgatttggtactctcttttttttggtaaacttcaaacacttgatgacctgacccgactctaggaaagaatggctctttggaacacatgaattcttcaaaattcatgtaaaatccttccattgaaaaggaggcctgactataatgcgatgccaaatgctaaccatctgcctgaatattaatgaatgaactgtgaggactgaggacgggctgcaggaat

SEQ ID NO: 68735 - DNA, 800 bp, Oryza sativa
catgtagtttcctgtgtaaatgtttcaagtgcaaacgttttcaatcatcctgaattcctgatgctatctgctgcaccaaattacaaaacaaacgagcaaaattgtttgctataagagaatttagcagggccggaaaagaaaacaaaaaaatgtaggaacatccatcgatgtgccaactgttgagacttcgttgcaatcgggcacagatgcaggagaccaggaacaatagtctcccccatgttcctccaggcgaaaaggatggctatggtgtatacacaatgcttaatatcaccattttgacgtcttgagttggtcatggtcagttcttctggcagcgttgtaggtcttcgatcgccttcttccattgccaggcgcgctgttttgcatcctcaaacgatgacaccttctttggctgtaaacgaactgcgttagtcatcatcataggagcaaggataataccaagggatggtaacaacaaagaagaataccgtgcatatcctgaaatgcgaagagtttgatacttgcacattgagttcacttgggtcatcagaccacatgatgttccctttagtcaccatttttccaggatctacacagatcagctgtggtttgtcggtgaggatcaactgaaccttcttgttcgttagcttgtttatcttcttcagttttgatattagaacgacagattcgccaggctccaggaagtcctgcctgtcacattgttaaaagcaatatgcaccaacatgaatcacctcttgtggaaaaatttgagcatgatgccggtcatttcccctctttta

SEQ ID NO: 68736 - DNA, 955 bp, Oryza sativa
ttatccctgcataagtcaggctacaatagcacctggactacatgcagggattacaaaataggtggtaaccacatttaccgcgttaaccctatcaaattcaaataaattttaaaagtaatttgatttttttaataaattttgtatggtttctcaagctttattttgggtaccgtgcttactgccggaggcaatgggaaaccctcactagaagttgcacctgttcttgtctgtgcaccatatcatgttgaatcatgtgcgttgtgtcctttcggaagaaccgatttactacatgactcatcaattccactttacgtatcaaaaggtttgttatgggggcaatgcttttgtgaaattaaatttttattttgcgtcacgttgtatctagttaaacactacctacctaccattacaaaacctcattccacaaaacgatgcatctagataaaaaatatgacatgtaaagtgagtaatgactcatgtttattatcaaaaatcgataacaatcaaatgatataggtagtaaagtacctttgaaatggcatgtccaagtatgtgtagctccacctagcacaatatcccaagtgatcatcataaaaggcatacaaatacaagcagccgatgatgcacacaagaaacaacacaaattgcacaaaaccaaaagcaaccgatgccttgagcatagagatcatgctattcccactataaatacaaatgcaccatatcaagatgctcctcacccttactgaaaaatcacaaacatcaaaacgttataagagttctctagcatccatcacatagccatgaagatctttgtcatcctctctctcctcgccctcgcagcgagcagcgcctcggcacagtttgatgcttgcacctatgggcaatgccagcagcagccgtttatgcaaccgatcatgaacccgtgcaatgagttcgtgaggcaacagtgcagccc

SEQ ID NO: 68737 - DNA, 25541 bp, Oryza sativa
aaatcatgtaaattcatatctaagttaacattagtgtaattatactatagttacaatgtagttacactaaatttatactacagatacattagaaagttttttatccaaaagcttgcgatattattttagcaatttaaaaaacaataatttgcaagaaaactttatgttgaaaaacctaaataatgtgaatttgttcaaatatatatatttatattcaaaatcactttaaaaacaatgagctggcatctctaagcccaatgccgcacagggtgcacaatcgtaacaataatccatgttacataagcagatgataaaaatattaaaacatttataccatgcaaccacacatttagtattttccgtgttgtatatcctcgtttccttttcaaccaagtagtggttggtagcctctcatattggaattctccaacattatgtatctctctgacattttgtatctccagtagtcgcgaaaaaatgcatgaaaattagtattttgcttgttgcatatcctcttcccctttttaacctggtagtgatcagtagcctcacacgttggaattctttcacattttgttactctcttcaatagccacgcaaaaagaaaaaagtattaatgtctgtgacccacttaactgcgcaaattcgtattttacttgttcttatcctcttttccttttcaacctggtagcggttggttgcctcagacgttggaattcttcgacaatatgcatctccagtagttgcgtaaaaagaaaaaaaagtatttaagcatgtgcccccactcaaccatgcaaactctgtgttgtatattatatttctctttttaatctggtagcggtcggtaacctcacaggttggaattctctatcattcttatctctagtagtcgcgtaaaaagaaagagtattaaaacgtgtgacccactcaactgcataaactagtatttccagggtggtataatattatctttatgttttcaacttgctgcggtcgatagccttatgctttggaattctattcattcttatgtatagtagtcgcacaaaaagaaaaaaaaaggtattaaagcatgtaccccactcaaccgtgaaaactagtatttttcatgtggtataatattatctttcccttttcaacctggtagaataaatatttttcttgtaaaaaccacatcattcatgcataaccatagggaccaacacatgcaggggcggatccaacgtgggtgcagggggggcttcagtcccccctacaccccacagacccatggatacctcccagagcacccccttcaattttttcactatgaatgataaactaaaggtccctatatggcttttttttgaagaaactgttttttaatccccttcaattttttgttcatggatccgcccctgaacacatgggggccgctcctatcatgacttgaggtctcatatctttggaaagtggcaacaaccaactcccaaacaaacgtgaaacactacgcggtggacatatgtttgaagctatatgaataatagaccacaatggatgagcaaaatggcattggaagaataaatgtttaattgccttctctttgtgacaaaaaacaacatttcttattacctcgctaatttatatttgggacaccattatgaaccagagctagatagaaagatttaatggagaacttgccatttggggagagactccagtgaaaatcaacttgatcctatgttaacataatattagcgatacggggtaacaagttgctccacgccactaattttgagcgaatcaagcccatgggtatgtttggaagacctctaaaatggttgattatttatgcctaacaatattatatataggaagggatattgatcccgcaaggttgcagtgcctaaccatttgtcttcccaaattctaatttgagagccatatttaattatgaaggacccacattggagaaaaatcatatttggccttcataaagctagcccaaaaatgtgaatccccatctttcaatagggcttgtgataaatgctaaaatcccaaatatttattgcgtatcatttgttgccacataccactagttgtaagcaacttatgaagccatttactaactaacacattatcctttacttgcagatcatgaattcctaacccccccccccccgatctttttggcggcacattatatccctcttagctagttgatacttcttcttcttgcgaccgtcactctgccaatcaacttgtctaaccccatgaaataacattatcaaaatacctttacccttcacaatttcacttgaagattaaatttagcattcatattaatagagtgataaagtcatactacagtcaatctttatatattaattgagggtcatactagaaaccccactttaatcctaccataggtagaaagctagaaattatcactaatcaaaagagctagaaataacgttaatacaaaaatgatgaaatcaaatgtgtccacagtcaagatcttctatcacacaatatatagacttatccattggaatgaataaatatgcagttataccaggtttggattttttttctatgactcaataattataaaattcagaattaataaactaacaacaaattgcacttgctctagagtctcaatcttagtttaaacgatttaatagttctaaaattaaaaattagcaaataaggtttgaagccgtaattctatttttataatttaatcattcttaaatttagaattactaaaaagtaattaattaataatgcgttgtacttgatctagagtctcaaatcgtttttatgatgatttaataatttcaaacataaatacagtaaagtgctcagtttctaatctgaaatataatataatgattctaatctttaaattaataaataccaagttgatattgataaattaaaatatatagcatgtgcagcactgcttgatgcctagtctagaatctttaatcgcggtaagctgggttaactacggtgcgggccacgtacccaaatttctttcacagttggattgactagtgtagtcaaacgagggcatgtgacgaaggctagctattttaaattttccgattgtccctacataaatcaggctataatagcccccagactacacgcagggactacaaaatcggtggtacccccatcctcctcccccttctttctcccctcctctcccttctcttatttctcaatccggtttttcttgaagtggcagcggcgtggagttctcaacggcgcgcggcggtgctgcggtgcgacggctcgacgcagcggtgaggaggcgaggaggaggtgaacggcggcgccgcggcctccatccccgaccgccgggggccacctccatcccccaactgacgggcgccacctccgaccgcctggcgctagatccgtcctccacaaggtcaggggacgcggatccggccaccgggcgtcgtctcctccgtccgccggctgcgtccccaactgacgagtgcagaactgcagattcccccgtcggctgcttccgggtgcagaaggcgaagagggcggcgtcgaggagcagtaatagggacgaggtcatccgcaaggaggaggagcaaggtcgcctccaggccgagctcaagaaggtctagtgcgccaaggagttcaagcccaccgtggtatgaagaagccctgcccggcaaaacccacaaccatttattcccttcgtttttgttgctcgtcaggtgattgatgaattgcttgcttgccatggctgttttatgtgtgatgaaatgttcgtgaagacttttctgtgtgatgaaatgttgtgtgtgatgaatgcgatggcaactacccagaagcactttttttttgtttttttttatcgaaatctacatcagtgacgggtgttgagctgtggttgtggctcttttttccttttttttttgggtgatttttctcatctgtgacgggtcacatgacacaacccgtcaaaggtgtttgtcacctctgacggacctacacccgtcaaaggtgagttaagtcatcagtgaccattgatctgtgacgagggagtctatccgtcacagaagagggtttgagcccgtcactgctagcttgttctgctgtagtgtgtgcgttatgtcctttctgaggaaccgatttagtttatgactcatcaattccactttacatatcaaaaggtttattatgggggcaatgcttttgtgaaattgaatttgtattttgtgtcacgttgtggacatacatatcttcaatttataaataatattacaaataggtggaactgaagtaacttcgtttgtaaggatcaaaatctgatagtggcatgagcttggagtttcaaaaactttttggtcaaatccgtttttataaggctggtgtattgctacagaagtaaggaagaatgtcatctcgtgttccaaagcccaaaatgacaaactaaagcttggagttgatccatacttaagtgtcagaaaatcttttgagtgtacaacagatatgtgtattctgaagttaaacactacctacctaacgttacaaaacgtcatttcacaaaacaatgtatctagataaaaaaatatgacatgtaaagtgagtaatgactcatatttataatcaaaaactgataacaataagatgagatagttactaaagtacctttgacgatggcatgtccaagtatgtgtacctccacctagcacaacatcccaaatgatcatattaaaaggcatatgaatacaagcaaccccaagatgcacacaagaaacaacacaaattgcacaaaaccaaaagcaaccgatgtcttgagcgtagagatcatgctatccccactataaatacaaatgaactatatcaaagatgctccttatccttatggaaaaatcacaaacatcaaaacggtataagagttctctaacatcaatctcatagctataaagatctttgtcatcctctctctcctcgccctcgcagcgagcagcgcctcagcacagtttgatgcttgcacctatgggcaaagccaacagcagccgttcatgcaaccgatcatgaactcgtgcaatgagttcgtgaggcgacagtgcagcccagtgagcctgccttgggagcagtcacacaggctaaaactgagcagctgccaggtgatgcgacaacaatgctgtcggcggatgaggctgatggcgcagcaatatcgctgccaggctattttcaccatggtgcaggcgatcatgcaacaggtgcaattagatgctagcttatttggtgtgccccaagctcaggcccaggcccaggtggctctcaacttaccctccatgtgtggtgtctaccctaggtactgcaacactccgtgtatcgttgctactagtcgttgcggttcttggtagtgtgtactagcatatatactttgataaataaagtgtcgcacattatcgtgtgtgtcacgtaatggaaatttggaatagtgtttggttgttcgtatgaataaatgaaaataacatggacatttgaatgattttgtctgcttttccagtgagcctcgaggtgttcaaagaatttcacatgctagttgttgtgtgtttttcaattactagtcaaatgcccttttgttacaatagaatttaaaaatcacataattaccatttcagatattaatattcatatttttgttggtttaatatattttaatatatagcacaatagttcaggtcactcatcaaacagagcttattgttctgtatctcaggaaatagttatggcaggtaaaggcagattcactattcttcaccaccattccaatcttttcaaaggagtacatatctccgcaaaataagaatgcatgcctcccgaagcatatattcttgctatgccgggaattgtgtttgttggaggcttgccacggagggccttcggctgaacctgccgaaaccaaaaagtttaagcaacaggctcacgccgaaggtgggcggcgaaggacaagagtgaagccatacgggcgaaagccgtgactggggtaacaccaccttcgccgagtggagttctcgccagaaggcggcacgggcgaagatgatgtggcgaaagcctcggcacacaggcacgggcttcgccatagcaccaaaccccgttgacgggaggcttggtgggccattacgccctcgggggatttcgccagatagatgggccgagctatttgccctccataatgtccctatcataagggtaaccatgtaaattcccctgtataacctaaaccctagtagtgggaacctgtaatggggctataaatagccccctagggccatgtaatagggggatctcaagaaaaaaatcccaattcaatacactataactgttttccaaccactgttgagtaactacctctttcgacgtatgcggttgtcgtttcgacaacagctagcgccgaccgtagggacctccgagcgaaaccactgagagcgaatgctaccaaagagggtcgtgaaagagaaggttaccaggcgaaaggcgagcgaagtaggaggggagatggccgccgaagatggagcagagccttcggcgccaatcgccgaagataggggagccccatcggcttcagcacccgcgccacaaccaccgtcttcagctcctgctgcctcgtcggggcaggtaccgaacacggtcgacgcggcgaaggcagccgcagcggctagcgcgctccagaccagggcggagaccctttcgacaggccagctgctggtgccccaagccgcttcgtcatagccggcaacggtttcgaccgcgctcgccgccgcacaagtcaaccccgacctctaagcacatgtcgaagccgacatggaggccatgcgccggaacatgacgcgactccaagacatggttcgtcagatgcaagaacagcagcaggcgtataagacggcgaggcaggccaaggtcgcttcggctccaatcctccagtattcggcgggctacatcccaccccaagtctacccgcaagcaccaatccagccccatccgccacaagccatgcaaatgccagtatacttcactgggcagcctccaaccacagcaatgcaaccggcccctcatgtgcagccgcaagctcagccggtcgctgcccaagtacatcctccaccacttggccaaatgtcacaagcaatggcagaaggggcttcggccttgcaggcacagcttcaagctttccttcagcatctcagccaaccccacagcatttcaggaacagccccctcggcccagccggagaggaacacgagtcaaggtgcacccaattggttgccgtcgaatcagcctggtccgggggcttcgccttggagttaaggaccacaattcgacttcaccaacgctgctcaagcaccaaccgttcggccataggcaccaacactaggctttggagcaaaccaagaaccaaactaggtcaccatggcatggacccagccgacgttcgacccatccatggcggcccaccaagcatcaccgatcagggctaggcagccgaacactgtggcccagccgcatgcgcaagccatgacctcgcccttcgccacgccatatccacagcaaggtgccgcgaacagggcggggggcgaaaaggggctaccactgagtgggggaatcaagatccgtccaatcccaccccagttcaagttcccacccgtcccacgctattcgggcgaaacggatctaaaagagttcttgtccatctacgagtccgcgatcgaagccgctcatggagacgaaaataccaaggcgaaggtaatacatctcgctctagacggcatcgcccgttctttgtacttcaatttaccagctaacagcatttactcatagaagcaattgcgcgatgtctttgtccttaactttcgaggcacctacgaggagccgaagacgcagcagcatctactcggtattcgcaagaggcctggggaattgataagggagtacatgcgtcgcttctcgcaagcccgatgtcaagtgcaggacataactgaggcgtccgtcatcaacgccgcttcggccgggctgctcgagggcaaactcacaagaaaaatcgccaacaaagagccgcaaacgcttgagcacctacttcgcatcattgacgggtacgtgtcacgcccggaatttctatccaaaattccaaacgcttacatgtgtgttaagccctcgtccaggaatcaaccgaggcacacaatgacaatattgataatagagtacaaataactatcaaatattcgcaaataataaattattacagaggtggatagttcctctcaaagaaaaataacattctacgcagcggaaagataaaactataacaaacgacggaacagctatggcaactccactccacaggcaacttaaccaagaacaagcctattcctccagatcatcaccttcactgaaaaactcctcttctgatgaatgaatattgcaagaatgagcatataacatactcaacaagccacacagcaaatatgcaagtgcacaggataacaaaggatggcataatatagctcatttgcagaaacagcatttaataaatatttaagagaacagtaaaacagttgaataattaatcagtattaaacaaacactatacaacacacccgtgttgcataggcccaaccacctttgaacaaccaaccccagttgaacaaattaaccctccaaaccaggaatttgccattccaaaccaggaattaaattaattaacacattattaccattaatgagtagtgtgagactaatcacgaaaaacattgctcaacttacccttaaccgcgggtacggctattcgaatagattaaactctgatcagaggtgtaccactgtacccacaagacacaaccccacatcatgttaccatgtgcctcaataccaccacggtatctcggaaaggaattgtgacaatatcccttgcataacacaactcaccacagtgcacctttcctggatcataatcacccccttataaacaaggcatggactccccagcgacccccatggacttctcgccacttctcagtctggcacactataatgaatcatactatacaaaagataaagccgttgcccacgctggcttgtggttggcacgataaatgtttcacaacagtagctcgcgaaccggtccttaattgtcatgagcacaaccatcaataccatatgctcacaacccaccttagccaggttttaattatcaaataattaacatcacacgatcaaccatcgtgagctaccattgaatataaccataattaaataataattatgtaatttaattatatttacccccttttagttagctaatgtttctaagcatggctaagcaaacctatatatagcatttagccgaaccaatccaatatataaggttcatgctaatcaaattataacccataggaaaataaagtcatcttcggccataatttaattgggaaaggttcaccacccgataacattcgaaaacaatgcatagttgaaataaaataatagctttaaacgggatcaacatgctcaaagggttgtttgggatctgtgtgacttgccttgggcttccacaaacgcttcggaaccttcctcaacagaaacgctctcctccggaacgacggaaactaaagcaaataaacaaaatcaacaaaacagtacaaaaacaagcataaacagtacatgtgaatatttttaacatgtagatcttgattttagaaaaatttagaaacttgaaccacctaaaacggatctacggttatttagttatgattttccaaatttttaatctattagaaaatcgagaaaaaagaaaaagagagagatgacgtcagccctgaccctgatgacgtcagccctagggttgacgtcatgctgacgtcagcacgacggccggctcgggtcgacgagctcgccggcgctagggacaacggcggcgggattggagaccacctacgcgtagagggcaacgaggcgaacccgttggtactcaccactacggcaaacggtgcacgacggcggccggcgacgagcaaaggcggcgcggcggctcgggttagcggcgacggcggcgctccgatggtcggcggcgaaaacggaggggcggccgagcttctccacaccacggcgcacctaacggcggtggcggcgaccaaaggcgacggcggagacggcggcgcgacgcgaccgaagatggccggcggcggcggcggacttcgtgcacgcggcggcgacgctacggggcacgggagagcacgggaaagggggcaaacggaagaggagaacacgaggaagctttatatgagctcggattgaagagatcaagccgcaaacgggaggaatcgaatcgggaagaaatcaaactcggtttttagggataaaaaacaaacgaactcgattcgaatccaaatcgcaacggatttctttgattcttgggggaaaagaaagaggagaccgagaggaacaaaacccctcaatcaatcgaaggaattgggctcggatttgggcggaaacgatggcgcaaaacggcgctagggttcggctcggcggcggccggccggaggtgggagacgaatctgacaggtaggccccacctgtcagcctccgcgagagagacgcgggcggcagcggcttgggccggcgtgggccgcgcgcggaagagagagaaaaagggagagactgggccgaaaacggcccaaggaccaagaagggggaacttttgaacttttttgaataaaacaatttatgaaatgttgtttcaattattaaaaatacttcccttgctcaaataattcccagaaaattctagaaaatagaggagcaagcatagtatttaataaaattttatctagctcatttttatgttgaaaattttcctagaaaattagggtttagcttgtaggctttttttaaataatttctaaaaattccaattaatcaacaatttatatatttaagattttcagggtgtgacagtacgcaaggggcgaagaggatttcaagcgatggcaggcaatccaggctgagtatgataaagcctctgtcgccgctgctcaagcccaagtacaagcccaagtcgtcgaaccggctcctctcactgttcgccagcctcagccggcgaaccaaggtcaaccgccaaggcaaggccaagcccccatgacttggagaaaattcagaactgaccatgcaggcaaggctgtgatggttgtcgaagaagttcaagctctccgcaaggagttcaacgcccagcaggcaagcagccatcagcagcccgttcgcaagaaggttaggaaagacccaaggccgcaaccaggagcagctgttgaagcaccttgcgaagccgttcaagaacaggcacccccggccgaacagcgccaagatgtgcagcgcagagtaatccaggtgattacaagggccgacccgccgaatcaactgtcaaaacggcaaaagaagatgcagctgcgaatggtgcacaacatcacttcggcgggcgaaggggccccgcaatatttgaaccagcagatctccttcggaccagaagatgaccaaggagtgatgttcccacatcaagaccccctggtgatcttggccgaaatagctggcttcgaagtccggcgaatcttagtcgacggagggagtttggccgatgtcatcttcgccgaagcatacgccaagatggggttgcctaccctagcccttaccccagcacaggcctcgcttcgaggtttcggcggagaagcagttcaaatcctaggccaagcgcaattgatggtagccttcgacacaagcgaaaacagatgcgaagagcaaatactgttcgacgttgtcaacatcccgtacaactacaatgccatcttcggccgtgcgaccttaaacaagtttgaagccatctcccaccacaattatctcaagctcaagatgcctggccctgcaggaatgatcatggtcaaggggcttcaaccttcggctacatcgaagggcgatttggccgtaatcaacggagcagtgtgcaatgttgaggccgaaccgcatgaccgggcgaagcacgcgccgaagcccgcccctcacggcagggtaatcaagatgtagatcgacgatgccaatcccacaaggcttgtattgctggggggcgacatgggcaaaagagaagttgagaacatcctagaggtgctcaagaaaaacattggcatcttcgcctggggccccgatgaggtgggaggtgtttcgacagaccttatcatgcatcacctggcggtcaagccgaatgccaagccaagaaaacagaagctacgcaagatatccactgatcgccaagaagcagcgaaagctgaagtccaaaagctgctcaaggctggggtgatccaggagatcgaccaccccgagtggctggcgaatccggtactggtgcggaaatcgaatggcaaatggcgcatgtgtgtcgatttcacagacctcaacaaggcgtgcccgaaggactgacggagctcgtggctcctcaccgggagaccgcacaggcccccctttgccggttcggccgggggcttagggtgaaatctcaagctctctcggtatgtggaaagatcgccagctaggaagaaacgcgagacacgggcgatgtatacaggttcgggccgctgagaagcgtaataccctactcctgtgttttggtggatctgtgtatgaatgagctacaaagtgtgagccgacctctccctcgttctaggctctgaatctggaaagcatccaaccctttctctatgggcaaggtcctccttttatacttcaaggggataccacatgcacccctccctttccaaactggacttttcttcttttcataaatggacggagatttgcacggtcgtcctccgaacatcctcctgacgggacggcacatacctacctccacttctgcctgaggcgggcacgtcgtgggaaggtggctgtgtgctgacgacatgagcagtgtcagaccggtcacaaatcggtcattcttgtccaccacacgtcggctcagcaacgtgcatgtttgcccttcttcaaacaacatcttgcttgtaatggttaggatgaagcctggcatatatcgatcggggctaacgtgtcatctctgggatgtaacacgccagctccagccggggacgagtgcctagaagctctcgtctagacaggatggggcgtagcatgcgtctgaccgcctgtcgccacctaacccgtgatttgaccggtctgtgactggtcacagaccggataatcgagtgcactgcactgcacttcgtgcggcgtgacacgcttagccgaggcgcaataaatgcggttaggtgagccctgctgtgctgacctaacccatacacgtggagcagaaaacgcgaggggtcggggcgcctcggccctcgggggcgaggctggagtggtccgaccccccccccttgggaagaccaagaggtgggcgcgcacatcaccctcgggcccgacgtcccccgagggtgccaggccacgtgggcgattgtgtctgcctcaagcctcgagtcatgatactcccggtcccatgtcaccgacagtagcccccggcgttatgccagggcgatcgcccttcttatgggaagcggccgggcgtgacgccactcctaaagcctggtgacagatgggaccggtctccatggttgggcaaaaacccaacggtctcaaaccatgcacaccggtaatggtaatttggctgtcaataatgggcggtctcttcaagactgccacatcacctgagcggcgcacgaatctgggcgagccgatttgcctcgcctggagatatggtaatgtcgcttcggtcggcgagcgtaattaacgcgcgcacgatacgatctatctcgactgccgcaaccgcatatccatcttacgcgccgcaagcgggcgaatgggattagtggaagcgtgggcgcgagaaacgagggggcgaaataatgggcgcgagaaacgaggagccgggcacagcgttggcaagggtataaaggcactgaggatgggatttgtctccttcctttcgccatcatttcccttgccttcgccgcttgcgtcctaactccttcttccctgcgcccttctttcgccacacgcgctcgctcttcatcttctcttcgtccggcgccatggcacggggctccgcactgcttgatggtagcgtgctgccgccttctcgcattgtgagcgagaagcaggctgggttgccgcgccgcttcatgccggaatctgccaccggccgtgagatagtaatgctgggtgagggacgcccggcgccagactacccggggcggtccgtcttctttctccccttcgcaatggcagggctggttccgccattttcttctttcttcatggatgtcctggagttctacgatctccagatggcgcaccttacccccaacgcagtgatgacattgggcatctttgcacacctgtgcgagatgttcattggggtgcgcccatctctccggctgttccggtggttctttaccgtgcagtcggtatcgccaccgtcggtggtcggcggctgctatttcctgccgcgggggccggtgttgaaccgctacatcccctgcgtcctccgtaaaaagtgggatgactggaagagcgactggttctacacccccctcgccgatgaagcgcatctccgacttccgagccagcccccggcgcaggcctccagctggcgggcgccggtagatctgggggatggctatgacgccgtcctcgaccgcctcgcgggcctgcgatcccaggggctcaccggggccatggtgtacggcgactacctccgtcgtcggattgcgccgctccagcggcgcgctcgggccgcctgggagtacaccgggtccgaagactacatgcggacccaccagggagtcagatgggattgggcccccgaggacttcaagatactggtccaacgggtgctaaatctcaactccgtggaggcgtccctcatcccccacggtatcctccccctcttcagcgacccagatcgcgcctccatcttgaccattatgacggcggtcggggcctcagaggagcaggctcctaagggccatgacggcgcaggtgggagccgccggggggatcaatctacccccggagggggtcgtgcttctgggccccgcgtcgggggctcggggagcaaccgccctaccgacgcccgggggaagaggaaactaggaggaacacctcccccatctcctccccgagggggcggggcggtgcgtgccagcagcaggcgcccggagggggccgcgccaacatcgcagcccgagggggagcgcaagaagaagcggctgcgcaagatgggggagacagaaccatcccggggaaacctaatttcccctccaaggtggtcatttaaccgaccccctcgcaggttcgtcccacgctcattgcgaccgtcttttcttctatcccaaaagcaagttttctcttacccatcttgtttgccttctggtttttctttctgcttcagtgatatcccatcgcgttcctcccaccatcccaagtccggccagtccgaggccgaagatccggcggccgcagaggcacggaggcgggaatctgaccggcgagaggccgcagaccgcctacgggaagctgaagaggccgcccgggaagccgcccgggctcgccaggctgaggataccgctcgggaggaggccgcccgggcccgccaaggcgaggaagccgctcgggaggaggccgcccgggttcgccaggccgaagaagccgctcgggaggaggccgcccgagttcgccgggctgaggcgatggcggcttccgaggcagttcacgacgaggccacggacgcctcgcttgggcccaccccttcgggcgacgcccaggaccaaacaggtccgggggtggcccgcgatgaggccggcgcgtccattggcgggccgagccgcgcggcgtcttcttcaaggcagctcttccccacgccttccgccgccccgctgagcgcagagccccttctgcaggccttagccgccgcaaataccgcggtgttggatgggttcaatgcccaggtggaggccctgcaggcggagcgtgcggagctcgacgccgcatgggcgcgtgtcgaggaggggcgacgctcggtggaggccatggtagaagcgggccgcaaggcacaccgccggcacgtctcagatcttgaggcccgcaagacggcactggcggagatcgctcgagaggtggaggaggagcggggggctgccctcatcgccaccactgtgatgatcgaggcgcaggtgtcgcgtcccaaatcgactctaaaatctatcctcaaaattgtgcaaaagaataagtaaaattcaatgtgaaagcctccaacaattaaaatgtgcaaagataaaagtcaaatgaggcttgtaggatttttgtatatttcctaaaagcctaaaatgcgtaaataaattttagtggaattttcagagcacaaataataagtgaaaagaaataaacaaagttaaaaaggttttataaaaagaaaaaccctaaaagaagttcttttttccccctcccttccctcttgggccggctcggcccacttctccctccctctctctctctcctcccccgcggcccatcggctccccgcgcgcgcgcgccgctgacaggcgggcccgcccgccactctcgctgacgggtggggcccacctgtcatctccctcctcccgccgcgccgccgcccgcccgtgccctagcgccgccgccgccgcggattccgccgcatcccgtcgtctccgcgcgcattaaagagaggggaatcattccccgcgatcccctctcccgtttcccccttttttccctctctctctccctcggattcgttcgaatcaagcccgtaatcgtcgccggcgcaatcaatggcggccgaaatccccgcggccggtttccttcctcctcggccgccctctctccttcccgacgctataaaaacgttgcccgagctccgctcttccgtttccgccgttcgccgctcgctctcgccgtcggtttcgtgctcgcgccgtgctccgctctctccgccatcgccgccgagctccgttccgccgccgccgccgctccggacttcctccttactcggcgacccctccatccgcttcgccgtgttgccgccgaccccgtccgccgctccgctccgtccgccgactgccggagcgccgtcgccatcgtcatcccgaaccgcgccgccgtcttcctccgctccggccgccattctcgtcgtcgtcgttgtcccggggtgagccgaagaccgccgttcgccttccccctttcctcctctctctcgggtgccactccgccgcgccgttggtcgccggcggcgaccatcggggcgcgggtgcgcgccactcccgtcggccgcgccggcgaggccgccctcgggtgcgccctcgcggctgccaagtgggcccggccgtcagccgcccgcgcccgcgggtgcggctgacgcgcgggacccacggcgccgacagccgccagccgcgtgcgcccggtccaccgtggaccgtggggctgacgcgtgggccccacttcccgtggacccggtccgcgcgtccgctccctcggctgacgcaataaatgggattttttaattaaaatttaaatgaagaaattcgcaaatatccatttaaagagcatataaacttcaaatggccatatcttgtccatttgaactcggaattggaccgttcaagtctctaatttttccttaagatgtaaagaacccatttttgtgctttgtttctgctgttatgtggagttatttagtgttaaagcctttttcttttccgttggtcgtgtagacgctgcagcttcggaagatccgctcttcgtggaagtcgaagccgtcgattgggaaaacgagcaaggcaagacacatcatcttgatcatattgaatcccattttataaaattatgttgatttaaattattgcattatcgctttatttaaattcccgcgttatcactgttttacttagccatgcctatttacctttgttatgaccatattattattgttattgttattattattaccttgttcaccctagacaaacaaaacctcaactagtggacactctactcatggtatccctagtatgattttaggtagatgcttcgcaatctaattaggtaaccttaggtggttttacaactttagactttgggaaatattcatatcacctggatactctggaattgttggcttatgttggaattggacacacacctctcttcctctttcaaaacccctaaaacctgttttcggtggggtttgggtgcatgccagttgtgggaagtagcaccccggccactataaggattaagctcgggcctctgttgcaaagcactaccgtacttccacatgtctagtgggtaaggcttagtttgtggctcaggctagtcataaacaaaagtacacgaattggagatggatgaagtcgggggtcgatggacattctccagggcaaatgaaggctacacgagctgcggcccggtagtcgagatgtcatacggcagagggttggtgccctgctgctaggggctcagtcctgcctgcctgtcccgggggttccggccgtaggcgggattgggtcggtactcttgtctatggctaggatgggttggaaactatgtcacgtcttccgtccgtataccgtggtggtatgtggcacgtggttacacgtgaggaagatgtgtcttgtgggtaaagatgtacacctctgatcagagtaaaacctattcgaatagccgcgccctcggttatgggcaagccgagcaatgtacccaagtcagtgttttaattcttaaaatttgctcaacaactaaaatgtggaatggttggcctgggttggcttgggacgagctgggacccagggtcgggttgccagttcggtctgaatcatcgtaggccttgggttaaggcaggttcgtgtgggttcacggccttgattaataatattggatagttctaggatcgtgtttacaaagtagctttgagcaactaaacgtctttaaatgctgtttactgcaaccctaaccctttatgttataattccttgtactcccttgcatttattctgcatttgtgggtgtgtcttgttgagtacggtggttgtactcagtcttgctcaattttccccaagcccagatgaggagttcctggaagatgaaggctttggtgtctagctcgtgcctgccgtcaagcgcctgtggtcgtcgccctagtcttccgctgtctttcgttgtctttgtgtgtgctgggccttcgttgcccgtgtaataattttatatacgcttccgcttgttaaactctgatttgtatcaacttttggtgtaccttgcctcctgggacaaggattaatgcacgcacgtcaggaaagcccgttgggttatttccggtcgtgacaagttggtatcagagcctcccttgaccctaggacgagccgtagatcccaagccttagctatattttcaaaaataaaaatcctttgttatttgtgaaaactgtctagtctctctctgtcttgctgcttcatttatcgtcaaaatctgatctttgaaaatgttgcttttcttttctttgtttttagatggccggcagcgtcacccgtcgtggtttggacatgactggcttcgtcttggagctgcggggcatgtgcgtggtcttggggtatccacatggagtggattaccaggccaggccgctcccggagcaggagggtgaggatgcagagcctcacgctggttgggaggtcactgcagtgatcctctccggctctcccgagcggacttcgctggcagtcaccgcgggtggggattccttccccgccgcttgccagaacgccgctctcctcgccatcggcacccttcaccagcgctacccggacgagttgcagcactcgccctaccgctaccaccctcgtcgcggaggagcccgcgactacgccaccttccgagacgccagctcggaggatgacgctaccgtcgtgcatctggcacgcatggtggaggcgtacgacgcggctcgtatcgacttccaccagatggtgcgccgtggcatggtcgagaacaacctgaagatcttggagctgcgtcaggagaatctgcagctcaagaaggacctcgacgcgttggaggcgcagctgcatcagctcaagatcgcccagggagaggacagccgccccaagcgtcgccgcgtctgtcgcagccagaagatcaccgcccgcaagagcacctccaggcccgagcttgttcgtcagtccctggcgtggacctgcttcgtcgagacccctcgtgccgagcctgcgcccgtggttccccaggagggggaagcctccggcgttggtagctcggagggtgcgctgttgctcaccttccgtcctggcccgtcgcagcggtagacgagcagttagtaggcttgcgcgtgtgtttttctctcgtttgtcttgttgagttgtgtggggcatggttacaccggtgtgtggtgtaactatgtcggagcctgtcttattttatttgcctaagcaacttgaaccttaatgaaccaatttaatagcagtgataaatttaagaataatggtagtcgtgggtggttagttttaatcgtcagctctccttctctgtttgctggttctgtgtggggttttcagatggtgacgaccaggagaaatgttaacaccggtgaaggcaaccaacccgaaggcagcaaccccaaccaccaaggcaatccacctccacctccacctccgcctccaccaccaccaccagacaccaacgccattctcacccaaatcctcgcccaacaagccaacatgatgaatgctttcctccaccacctccaaaacccgccacaacagaatgctccaccaccccctccccaacactccaaactcgccgaattcctccgtatccgcccacccaccttctctagctccaacaatcccgtggatgcgttggactggttgcatgccgtggggaagaagctagacacggtgcagtgcagtgatgaggagaaagtcgtcttcgccgcccatcagctgcagggacccgcatctctatggtgggaccatttccaggctgcgcagccagaggggcagccgattacttgggctcgcttcaccgccgctttccggagaacccatgtgcccgctggagtcgtggctcttaagaaaagggaattccgggagttgaagcaaggcaaccgctccgtgatggagtatttgcatgagttcaacaatctagcccgttatgccccggaggatgtgcgggaagatgaggagaagcaggagaagttcttggcgggaatggaccctgagctgtccgtccgtctagtctctggggactatcctgattttcaacgactggtggacaagagcatccgcttggaagccaagcacaaggagctggaatcgcacaagcgccgcttggcgaatttccgcagtcagcagggtgctaaccagagggtccgctacaccaatccctatccagggggatcctcctcgcagcagcagcagcagcagcaacctcgcccagcgcctcgacctcaattcgtggtgcgcgtcccacagccgcagcagcaacagaatcagcaagggactcgtgcgccccgtcctcctacgccagctgtgcagcctggtcaaggccgcagggacgctcaaggtcagcagcgtctgtgcttcaactgcttcgagcccgggcactttgcggataaatgcccgaagccaaggcgtcagcaaggccaagcgcctccccgctccaacaacggcgggaaggatgtcattcggggccgtgtgaatcatgtgacggccgaggacgtgctgacaactccagacgtcatcgttggtacgttcctcgttcattccatccctgctaccattttgttcgactctggagcttcccactcgtttatatctgtgccattcgtggggagaaatcagttgggggtagaaaggcttagaaaccctctgctcatcaccacccctggcggggttatgacagcaaagtattatagccctgccgtccctatagaaattcaggggattccttttccctcggatctgattcttctagacaccaagaatttggatgtgatccttgggatggattggttggctcaattccaaggagtagtggattgcgcgaggcgcactgtcactctgtaccgagggccagaacaaccggttgttttctttgcacctccaacctctgtcagaagttcagaacttcatcagataggtctgtcagaaatccccatcgtcagagagttcggagacgtgtttccggaagaactacctggtatgccgcccaagcgagagattgagttccggatagatcttgttccaggaaccactcctctgcacaagcgaccctaccgtatggcagcaaatgaactggccgaagttaagaaacagttggaagagttgaaagaaaaggggtatatacgtccgagtacttccccatggggtgctcctgtgattttcgtagagaagaaagacaagacgaagaggatgtgcgtcgactacagagctctcaatgaagtcaccatcaaaaacaagtaccctcttccccggatcgatgatctgttcgatcagcttaaaggtgccactgtattctccaagattgatcttcgttccggatatcaccaattacgtattcgtgaagaagatattccgaagaccgcattcactacgcgatatggactgtatgaattcacggtgatgtcgttcggcttaaccaatgctcctgccttcttcatgaacttaatgaacaaagtgttcatggaatacttggataagttcgttgtggttttcatcgatgcgacattctgatatactcacaatcagaggaagaccatcagcaccatctccgtctggtgttgggaaagttgcgggaacatcaattgtatgccaagcttagcaagtgtgagttctggttgtccgaagtcaaattcttggggcacgtgatatctgctaaaggagttgctgtggaccccgaaacagtgaccgccgtcaccgattggaagcaacccaagacagtcactcagattcgcagtttcttaggtttggcaggatattaccggagattcattgagaacttctccaaaatcgctcgacccatgacacagttgttgaagaaagaagagaaatttgtgtggagcccgcaatgcgagaaggcgtttcaaactctcaaagaaaagctggtttcctcgccagtattaatcttgccggatactcgcaaggatttcatggtgtattgtgatgcttcgcgccaaggattggggtgcgtgctcatgcaggacggtcatgtggtagcctatgcctcacgtcagctacgacctcatgaaggcaactaccctacacatgacttggagttagccgcagtagttcatgctctaaaaatctggcggcactatctcattgggaatcgctgcgaaatatatactgatcataagagtttgaaatacatcttcactcagtcggacctgaatcttcggcaaaggagatggttagaactcatcaaggattatgatgtgggaattcactatcatcctggtaaggctaacgtggttgccgacgctctaagtcgaaaaggccattgcaacgctctcaacgtccgtagcattccgcccgagcttaatcaacagatggaagccctgaacctaagcatagttggtcgcggattcttggctgcgttggaagccaagcccaccttgctcgatcaaatccgcgaggctcagaagaatgatccggacatgcatggactcctcaagaatatgaaacaaggtaaagccgcaggtttcacagaggatgaacacggaaccttatggaacggaaagcgggtatgcgttccagatagcagagaacttaaacagctgatacttcaggaagctcacgaaagtccttattccattcacccgggcagtaccaagatgtacttagacttgaaggagaaatactggtgggtcagcatgaagcgggaaattgcagagtttgtggctctatgtgatgtgtgccagcgtgtcaaggcagaacaccagcgaccggccggacttctccaacctctccaagtgccggagtggaaatgggatgaaattgggatggatttcatcaccggacttccaaaaacccaaggtgggtatgattctatatgggtaatagtggatcgattaaccaaggtagctcgattcattcctgtgaagaccacctatggagggaataaactagcggagctctacttcgctaggatcgtgagtctccatggcgttcccaagaaaatcgtatctgataggggaagccaattcacctctcacttttggaagaagctccaagaagagcttggtacccgactaaatttcagcaccgcatatcacccgcagacagatggacagaccgaacgtctaaatcagatcctagaagatatgctccgcgcatgtgtcctagatttcgggaagacctgggataagagtctcccctatgccgagttctcctacaataacagctatcaagccagcatacaaatggcaccatatgaagcgttgtacgggcgcaaatgccggacaccactattgtgggaccaagttggggaaagccaagtgttcgggactgatatcctgagagaagctgaagctaaagtcagaatcattcgggataatctaaaggtggcacagtctcggcagaaaagttatgcagataaccgtcgccgtgatctggaattcgcagtggatgactttgtgtatcttcgggtcacgccattgcgaggggtgcacaggtttcggacaaaagggaagctcgcacctcggtatgtgggtccctttcgtatcactgctcgacgcggagaagtcgcctaccagctggagttgcccgcctccttgggcaacgtgcatgatgtgttccatgtgtcgcaactcaagaaatgtcttcgagtgccatccgagcaggccgactcagagcaaattgaagttcgcgaagacttgacctacgtggagaggccagtaaaaatcctggacgccatggagcgcagaaccaggaaccgggtaatccgtttttgcaaggtccagtggagcaaccacgccgaagaagaagctacttgggagcgcgaagacgagctgaaggcagcccatcccgatctcttcgccagttcttccgaatctcggggtcgagattccgtttaaggggggtaggtttgtcgcgtcccaaatcgactctaaaatctatcctcaaaattgtgcaaaagaataagtaaaattcaatgtgaaagcctccaacaattaaaatgtgcaaagataaaagtcaaatgaggcttgtaggatttttgtatatttcctaaaagcctaaaatgcgtaaataaattttagtggaattttcagagcacaaataataagtgaaaagaaataaacaaagttaaaaaggttttattaaaagaaaaaccctaaaagaagttcttttttccccctcccttccctcttgggccggctcggcccacttctccctccctctctctct

SEQ ID NO: 68738 - DNA, 12259 bp, Oryza sativa
aactaaaatgtggaatggttggcctgggttggcttgggacgagctgggacccagggtcgggttgccagttcggtctgaatcatcgtaggccttgggttaaggcaggttcgtgtgggttcacggccttgattaataatattggatagttctaggatcgtgtttacaaagtagctttgagcaactaaacgtctttaaatgctgtttactgcaaccctaaccctttatgttataattccttgtactcccttgcatttattctgcatttgtgggtgtgtcttgttgagtacggtggttgtactcagtcttgctcaattttccccaagcccagatgaggagttcctggaagatgaaggctttggtgtctagctcgtgcctgccgtcaagcgcctgtggtcgtcgccctagtcttccgctgtctttcgttgtctttgtgtgtgctgggccttcgttgcccgtgtaataattttatatacgcttccgcttgttaaactctgatttgtatcaacttttggtgtaccttgcctcctgggacaaggattaatgcacgcacgtcaggaaagcccgttgggttatttccggtcgtgacagcaggactccctccgccttcagcacgggaactgggaggcggagctgaagaaaaagctcgacgccgcccaggggtttcttgatgccgccgctgcccgagagcagcgagcgacggagaccgaagcggcgctccggcggcgtgaagaggcccttgaggcgcgcgccatggcgctggaggagcgcgcctgcgtcgcggagaaagtcctggcggaccgcgaggctgccgtcacctcccgggaggcaacgctggcggcgcacgagtctgcctgcgccgaagaggagtccgcactccgcctccgcgaagacgcgcttgccgagcgagagcgagctctcgaagaggccgaggccgaagcgcaacggttggcggactccctgtccctccgtgaggcagcactgacggagcaggcccgccgcaatttggaatccgtccgcgccgagagagccgcactggagcagcgggctgccgatctcgaggcgcgggaaaaagagctggacgcgagggcgtgcatcggcggggcggctgcgggcgaaagcgacttagccgcccgcctcgcagatgccgaacacaccgtcgcggacatgcagcgcgcgctagactcatccgccggggaagccgaggccctccgcttggtgggcgagatagggcccggcatgctccgggatgcagtctcccgtctggatcgcgctggtcggcaggcgggactctggaaagggcagacaataaagcctgccgccaacctgggaggccttgcccagcgcctgtcgaagatggccggggctctccagcagctccccgaggagctcgagaagaccatcaagtcatcctcgagagacctcgcccaaggagcagtggagctcgtcctggcgagctaccaggccagggaccccaacttctctccgtggatggcgctggacgagttcccacctgggactgaagacagcgcgcgcgcgcaggtccgggatgccgccgaccacatcgtccacagcttcgagggttcggcccctcggctcgcgttcgcccccaacccgacgaggagggcgatgtcagcggtgcagacgacgtggaagacgaggccggcgacccgggcgcatcggattgagcccccaggcccccgccaatcttcaattttcttctttttctttcttctaaggccctcgggcctgttttctgtataaatcaacttacaatctgcaatcaaaaatgatgaaaaaattctttgtgttaattttattttgctatgcgaatgagatgaggatgatctgtgccgtgatcctttttttgtgtcttagcttgatttaagggcccgtgcccaagtcccagtcctctaatggctcgggtcggggctagtgcctggggagatccgcatgtcgaggctggccaggccgggaacgtggtgaccgagggttatgggtgacccgattgtgggtttttgccgattcccccccggagttcaccacgccccggggcacggctcggttctgggccccgtttggcgattttagctgaccgaaccgagcccccgagggcaaggttgagcacgagtgaccttatttcaagtcaaaattcttcaaaaggaaaaaacggcacagacacaacctttaggaaattgaaactgcttttattgaaatgctgaaataagagaagtaagaatgtgcatgcgtggtagcccccggctaaccctgcacacccgagggggttgcggggttggcccgagccaaaacctgacactcgacccccccctcaggggtagaagcgacgaaggtgttcgatattccacgggttaggcagctccgtgccgtcgcccgtggccagccgtatggagcccggccgggggacaccgatcactcgatacggaccctcccacattggtgagagcttgctcaatccagcacgcgtttggacgcggcgtaagacgaggtcgtcgacgcagagtgatcgggcccggacgtggcgctgatggtagcgccgcaggctctgctggtagcgcgcggctcggagggccgcgcgcctccttcgctcttccaagtagtcgaggtcatctctgcgaagctgatcttgatcagtttcgcagtacatggtggcccgaggagacctcagggtgagctcggatgggagaaccgcttctgcgccgtagacgaggaagaaaggcgtttccccggttgctcggcttggtgtggttcggtttgcccagagcaccgctggcaactcctcgatccacgaatcgccatgcttcttgagaatattgaaggtcttggttttaaggcctttgaggatttctgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggcactccaaaacgggccgtgatgcccttaatgaatttaagtgcagagtgcttatcgatcttgacgaccggataagcctcgggccacttagtgaacttgtcgatcgcgacatacagatactcaaacccgcccggggcccgcttaaacggtcccaggatatcgagcccccagacagcaaatggccacgaaagtggtatgatctgcagggcctgggccggctgatggatttgcttggcgtgaaactgacacgctctgcatcgccggaccagatcaactgcatcattgagagctgtcggccaatagaacccttgacgaaaggccttgccaaccaaggtgcgcgaggcggaatgggctccgcactcgccttcatggatgtcggcaagaagctcaacgccttgttcctgaggaatgcacttcaggaggattccattagccgcgcgccgatagagggtcccttctaccagcacgtagcgtttggaaatgcgttggacgcgttcactcccttcacggtcctcaggtagagtcttatctgtgaggtatgcttggatctcagagatccaagcaatcaatctaagggagcttggagcgctcccttcgggtcccgaggcctggactccgacgggcctcgggggccggtcaggcgcatccgtctcccctaaggggtcgggtcgcgccgacggctgggtaagcctttcttcaaaggcgcccggtggggtctgggctcgcgaggacgcgagccgtgagagttcgtcggcaaccatgttatcccgtctgggtacatgccgaagctctatcccgtcaaaatggcgctccatacgccgcacttggcgtacgtaagcgtccatctgtgggtcagagcaccggtactccttacagacctggttaacgaccagctgggagtcgcctaacaccaagaggcggcggatccccagtccagctgccactctgagtccggcaaggagtccctcgtactctgccatattattagtcgctcgaaagtcgagacggaccaagtatctgaggacgtctccgttcggagaggtcaacgtgacccccgcaccggcgccctggagagacagagaaccgtcgaactgcatcacccagtgggcggtgtgaggcagctgagaggggtccgtgctggcatcggggattgagacggtctctggagccggggtccactctgccacaaaatcggcgagggcctggctcttgatagcgtggcgtggttcaaagtgcagatcgaactcagaaagctcgattgcccattttaccactcgtcctgtaccctctcgattatgcaagatttgaccgagggggtaagacgtaaccacagtgacccgatgcgcctggaaataatggcgcagtttcctcgaggccatcagaatagcgtaaagcatcttctgggcctgagggtatcgggtcttggcgtcccggagggcctcactaacaaagtagacaggccgctgcacctttcggcggggccgatcctcttcgctaggggccgcatccccggggcgttcttcgtccaagtggcctctcggggcgcactcgtcttctgtgccgatgacctcggggtcggaggatgacaggagcggccttcccacagtggcctcggggccgtcctgggggtcgggggctcctggcgtcgtcggacaagcgggcaaagggccaactctggtcgtcaggggccttaggcctccgttcggctcgggggcctcttctccctgctttctcccgggtcgagtcagcacagggttagcctcggggccaaacggcgataggtgcggccttcccgcagtggcctcggggccttcctgagggtcgggggcacccagcactgtcacgtcctgataaattcatcccgaaataaaaatcatcttctaaaaggaataatagaattaattaaaattcgaaaagaaattggcaaaccctaaaatacgtacaagaaaaattcaaatgtggcccggagaatttttgttaaattctccttggtctaaaaagagccctcaaattttagtggaattttcagagcacaaataataattgagaagaaataaacaaagttgaaaaggtttataaaaagaaaaatctctaaaagtcttcttttcccccccccttcctctcttgggccggctcggcccaactctccctctctctctcctctcccgcggcccatcggctccccgcgcgcgcgcgcgccgctgacaggcgggcccgcccgccactctcgctgacgggtggggcccacctgtcatcgccttcctcccgccgcgcccgccgccgcgcccgtgccctagcgccgccgccgccgcggattccgccgcatcccgccttccccgcgcgccttaatgaggggggaatcaatccccgcgattccctctcccgtttcccccgctttcccctctctctctccctcggattcgctcggatttaatcccgtaatcgtcgccggcgcatctatggaacccgagaactccgcggccggtttccttcctccccggccgccttctctcccttccgacgctataaaatcgtccctcgtgcttcgctcttccgtttccgccgctcgccgctcgctctcgccgtcggtttcgtgcccgcgccgtgctcctctctctccgccgtcgccgccgagctccgtttcgccgccgtcgtcgctccggtcctcctcccgactcggcgccacctccatcggcttcgccgagtggttgccgaccccgtccgccgctccgcttcgcccgccgaccgccggagcaccgtcgtcatcgtcatcccgaaccgcgccgccgctttcctccactccgaccgccgttctcgtcgtcgtcgttgtcccggggtgagccgaagaccgccgttcgctttcccccttctctccgctctctcgggcgccgctccaccgcgctgatggtcgccggcggtgaccatcggggcgcgggcgcgccgctcccgtcggccgtgccggcgaggccgccttcgggcgcgccctcgcggctgccaggtgggcccggccgtcagccgcccgcgcccgcgggacccacggcgccgaccgccgccagccgcgtgcgcccggtccaccgtggaccgagcggctgacgcgtgggcccccacccccgtggacccggtccgcgcgtcccctccctcggctgacgcaataaatgggattttttaattaaaatttaaatgaagaaattcgtaaatatccatttaaagagcatataaacttcaaatggccatatcttggccatttgaactcggaattggaccgttcaagtctctaatttttccttaagaagtcaagaacccatttttgtgctttgtttctgctgttatgtggagtttagtagtgaaaaagccttttcttttccgttggtcgtgtagacgctgcagcttcggaagatccgctcttcgtggaaattgaagccggcgtttgggaaagcgagcaaggcaagtcacatcatccttgagcatattgaatcccagtttacaaaattatttttttaatttaaattaatgcattatcgctttatttaaattcccgcgttatcactgttttatttagccatgcctatttacctttgttatgaccatactattattgttattgttattattaccttgttcaccctagaataaacaaaaccccaactagtggacactctatttatggttccactagtatgaatttaggtagatgcttcgctgattaatagaacaacattaggtggttttataactttagactttgggaaattctcatatcttttggacactatggaattgttggtttatggaagaattggacatacacctctcttcctctttcaaaacccctaaaacctgttttcggtggggtttgggtgcatgccagttgtgggaagtagcaccccggccactataaggattaagctcgggcctctgttgcaaagcactaccgtacttccacatgtctagtgggtaaggcttagtttgtggctcagtctggtcataaacaaaagtacacggattggagatggatgaagtcgggggtcgatggacattctccagggcaaatgaaggctacacgagctgcggcccggtagtcgagatgtcgaatggcagagggttggtgccctgctgctagggggctcagtcctgcctgcctgtcccgggtgtcccggccgtagggggattgggtcggtactcttgtttatggctaggatgggttgggaactatgtcacgtcttccgtccgtataccgtggtggtatgtggcacgtggttgcacgtgaggaagatgtgtcttgtgggtaaagatgtacacctctgatcagagtaaatctattcgaatagccgagccctcggatatgggcaagccgagcaatgtacccaagtcagtgttataattcttaaaatttgctcaacaactaaaatgtggaatggttggcctgggttggcttgggacgagctgggacccagggtcgggttgccagttcggtctgaatcatcgtaggccttgggttaaggcaggttcgtgagggttcacggccgtgattaataatactgtatagctctaggatcgtctttataaaatggctttgggcaactaagtgacttttaaatgctgtttactgcaaaacttaacccctatattattatccccttgtacccccttgcattaatcatgcatctgtcggtgtggcttgctgagtactgtggttgtactcattcttgctcaatctttcccctcttcagtaagagaagctttggagaagatgtcttaggtggagtcctggcttataccccagttgagcgcctgtgaagatggagccgtaggcccgctagtccgctgctgtttatttttgattgtcaggcctgaaccgcctttgtaataatgtaaatattatcgatataataaagatgagtcttttatatcatgtttgtgtggtgtaccccggctcttcctgggacggggattaatacactagcgttcgggaaaaggcaaattttcccggtcgcgacaagcaccgtctgacaagcgggcagagggccgactccggtcgtcaggggccttaggccaccgttcgactcgggggcttctcctccctgctcgctcccgggccaagtcagcacagggcgggggtgcgcgaaatgaggattgtcttcatcgcgctccacaaccaacgctgcactaactacttggggggtcgccgctaagtagagtagtaggggctcatttggccccggggcgactagaactgggggagagctgagatatgtcttcaactgagtgagggcactttcagcttcctccgtccaagtaaacggccccgagcgcttgaggagcttaaataagggtagcgccttctctcccagcctcgatatgaaacgacttagggcggcaatgcaaccggtgacgcattgcacatccctaagtttgctgggggggcgcatccgctctatagctcgtatcttctcggggttggcctcgatgcctcgggcagagaccaagaacccgagaagcttgcccgcaggtacaccaaacacgcatttatcggggttcagttttatgcgggcggagcggagattttcaaaagtttccgctagatctaagagtaaagtctcttggttgcgcgtctttacaaccaagtcatcgacataagcctcaacattacgccctatttggctacccaaagaaattcgagtagtacgttgaaaagtaggacctgcattctttaacccgaagggcattgatgtataacaataggttcctacgggggtaatgaacgcagtttttttctcatcctccctagccatgcgaatctgatggtaaccagagtatgcatctagaaaacacaaaaggtcgcaccccgcggtggagtcgacaatctgatctatgcgaggcagggggtaagggtccttaggacatgccttgttaaggtcggtgtagtcgatgcacatccgaagcttgccgttcgcctttggaacgaccaccgggttcgccagccactccggatggatgacttcacggatgaatccggcctccagaagtcttgccacctcctcgcggatgaaggcttgacgttccggggcctgccgccgcactttctgccggaccggccttgcgcccggccgcacggcgagacggtgctcaatcacctccctggggaccccgggcatatccgccggtctccatgcgaagacgtcagcgtttgcccgcaggaaggagacgagcgcgtcttcctatttgccatccagaagaccaccgatccgtgtggtcttggatgggccgtcgcccagggcaacctccttgaccgggacctcggcgcatgtgacaatccgctgcctcggggcggtgggggcggaggtgccaagcctctcgtcaccaccctcgggcttggacgcagcagcgaggtggtccgcgcgctgctccatgcaagcgagcgcgactttcaggtcgccatggacagagatggggccaccggggcccggcatcttcatctggaggtaggcgtagtggaccgccgccatgaacttcaccaacgcgggcctccccaggaccgcgttgtagggcagactgaggtccgccacatcgaagttcacccgctccgtgcggaagttggctgatccaccaaaggtgaccggtaggtcgatgtgacccaacggccatgtgtgccccggcgtcacaccgataatcggttgggacggctggagcaccatccccggggccttgatggcatcaaaagccgcgggggaaatgatgttgagggccgctcccccatctatgaggacacgccccaacttcacgttgcagatggtgggggaaaccaccatcgcaatctgccctccccgggcgacgcacggtgggtggtcggtctggtcgaaagtgagggcaacctccgaccaccgcgcccggcgcgtcgcctcatgagtaggggccgcggccagaagctctcgcttcatggccttgaggctccggcgagagacgtgagcacacgctcccccatcgacagtggcaatggtggccccaggttcttggaaacctaggtcattatcgccatcatcgatgtcctcggcgggggccttctgcttggcctcacttcgccgacggccggaaggaaccgccggggacttaccttcccggcgctcctgcctcctctcctcctcccacttccttgtccgctcagccaagcttttgactgcgcgacagtccgcaaggtcatggagggaggtgttgtggacggtgcaccacttgccggtagggcgctccctgctgggaacgctggcctccttctttttgtcgctcgcaggcctcccctttcgggtggcccgtgaagcgccctcgacggcgaggacatgaccctcgtcgtcggaacggactgacctcttcttcctcctcctgtcacgccgccctgactgagcggcggatccgggggcggccgaagctgccactccggaaccggaggggttccaagtccaggcctcctccttgcgagccactcggtccgcgagctaaaaaagctctgcggtagtctggggctctttggaggcgatcttttcgagcatgcggttgtgccgcacaccccccctgaacgcgtagattactgcgtgtgcagggatgcatggtatggtattgcggacttgacaaaaccgctgaatgtacgatcgaagcgactcatcgtcccttcgctgtacagcgtgcaagtccgcttcctcaccggggcgcggatacgtgccttggaagttcatggtgaactgctggcacaaatcctcccaggagtggacagacgcgggtggcaagttcattagccaaccccgtgcttgccccttcagggccatgggaaagaaattcgccatgaccctgtcgtcacccccggcggcctcaatcccggttgtgtagacctggagaaactcggcggggttgacgctgccatcatatttttcggcgatggtgggccggaaccttgggggccaacggacattccgaagactcgccacgaaggctctacagccaacaccaccaaccgggggcacggagggctgattcccacgtccgtgtcgaggtgacactctggacgaggaagcgccttccattgcgtgggcagcacttcggtcattacgccggcgctcgaggctggcgcgggcgccctgctccctacgcagatcttctcgggtcgaaggagtcgatgagggagtggctaccgaacggcgaacagcggctgctgctcgtcgtgcccttcgtcttgacgacgcggagccagtggtagcagcaccagaggtcttggtggcggaggaccgcccaccagcatctaggcgctgccgcgccgtcatgaccaatttggccacgtcgtccagccatcgttgggctggagattccgggtcagggacgacaggcgggtggcgtaagagcacgcccgcagcttggagcgcgccctggggcgtgctgccgtcgccgtagacgaggaggcgacgctccccatctcgccgttctcctccatcgcccgcgatcggtgaagccgcggatctttcgaccctttcgagcgcctccccctgcttaggactttggcgaggaggaggtgggggagtacgagctcgacggcgtgggtttggctccccgtcgtcgccgctcacactcggagagaggtcgtgcacctttgcttgctcggccattaggctgaacaagaaaaacttggcgcacacggaggaggacgagagctcagaaaacacacgctgagccccctacctggcgcgccagatgacggagctcgtggctcctcaccgggagaccgcacaggcccccctttgccggttcggccgggggcttagggttcaatctcaagctctctcggtatgtggaaagatcgccagctaggaagaaacgcgagacacgggcgatgtatacaggttcgggccgctgagaagcgtaataccctactcctgtgttttggtggatctgtgtatgaatgagctacaaagtgtgagccgacctctccctcgttctaggctctgaatctggaaagcatccaaccctttctctatgggcaaggtcctccttttatacttcaaggggataccacatgcacccctccctttccaaactggacttttcttcttttcataaatagacggagatttgcacggtcgtcctccgaacatcctcctgacgggacggcacatacctacctccacttctgcctgaggcgggcacgtcgtgggaaggtggctgtgtgctgacgacatgagcagtgtcagaccggcacaaatcggtcattcttgtccacc

SEQ ID NO: 68739 - DNA, 8058 bp, Oryza sativa
aaaacgcgaggggtcggggcgcctcggccctcgggggcgaggctggagtggtccgaccccccccccctcgggaagaccaagaggtgggcgcgcacatcaccctcgggcccgacgtcccccgagggtgccaggccacgtgggcgattgtgtctgcctcaagcctcgagtcatgatactcccggtcccatgtcaccgacaaggacgatttccccttgccacggatcgaccaactcgtggattcgacagctggctgcgaactcatgagctttttggatgcctactccggctaccatcagatccacatgaatccggccaacatcctcaagacagccttcatcacaccattcggcaccttttgccacctcaggatgccattcggcctgaggaacaccggggcaaccttcgccaggctggtgtacaaggtcctttacaaacagttggggcgaaatgtggaggcttatgtcgacgatatcaccgtaaaaagccacaaggctttcgaccatgcgtccgacttgcaggagaccttcgacaacttacgcgcggcgggtatgaaactaaatcctaagaagtgtgtttttggtgttcacgtgggcaaattgttgggtttccttgtttccgaaaggggtatcgaggcgaaccccaagaaaatcgatgcctttcagcaaatgaagcccccgtcgagcgtacgcgaagtacgaaagctcgcaagcagaattgcggcactcaatcgattcctctcaaaggcagccaaaagaggcttgcccttcttcaagaccctccggggcgcgggaaagtttacctggacacctgaatgccaagcagtgttcgacgaactgaagtaatatctgcaaagcccaccagctttgatcagcccagcaccgagaagcgaactgctactttacctagcagcttcgtcggtggcggtcagtgcagccctcgtccaagagacagagtcaggcaagaaaccagtttatttcgtctccgaagccttgcatggagcaaagataagatacattgaaatggagaagcttgcttacgccctggtgatggcttcgcgcaagcttaaacattactttcaggcccacaaagtcacggtgccatcacagtaccctttgggcgaaatactccggggcaaggaagttactagccggctcagcaagtgggcggcggagctatctcccttcgacttacattttgtcgcccgcactaccatcaagtcccaagtcctagctgacttcgtggccgaatggacaccggcattcgccctcgagcccgagcctgtcgaacaactctgggtgatgtactccgacggctcgtagtcgcacaagggggcggacgctgcagcagtgctttcttcgctagggggcgtgccgattcggtacaccgcaagactgcagtttgacacaaccaacaacgcagcataatacgaagctattctgttgagcctaaaaaaggcgaaagcattgggggttcgacgcttgctcatccgaactgactccaaattggtggcaagtcatgttgacaaatccttggaggcaaaagaagaaggaatgaagaggtatctggaggctgttcgatctatggaaaaatgcttcgccagcataacggtcaaacacttacctagaggccagaacgaggaagcagacgccctggcgaaatctgctgcttgtgggccacattcgcctggcatcttctttgaggtcctatacacaccaagtgtgcccatagagagcctggacatcatggcaatcgaccagacagagctgggcgaagacccagaggactggcgaaccccgttcgtaaagtacctcaagaaaggctggctcctggaggacaaagcagaagaaaagcgcctacagctcagggccgcaaaatacaagcgggtctcgggacagctatatcggggtgctccaacccttgcttcgctgcatctcctttgccgaaggtgaggaaatggcgaaagaaatacaccaggggctctatggtgcacaccaggccgcaagaacagtcgcctccaaagtgtttcaacagggtgtatactagcccaccatgctgaaagtctgtgtcgagcaagtcaggaagtgtgaaagctgccagcgccatggccgaagccaaaccgcgccccaatacgagctgcagcctatcgcaccaatctggccattcgccagatgggggctggacatcatcggcccattccctgtggcgcgaaacgggtacaagttcgcaattgtggccattgaatacttctcccgatggatcgaggccaaaccacttgggtcgatcacttcaacggcagtacagaggttcgtatggaacaacattatttgtcgtttcggagtaccaaaagaattcatcactgacaacggcaagcaattcgactctaacagattcagagaaatgtgcgaagggctaaatctggaaatcaggttcgcttcagtcgcgcacccgcagtcgaatagggcagcaaaacgcacgaatggcaagattcttgaggcgctcaaaaaaaggcttgagggggcggcgaagggtaaatggccagacgaaatgctatctgttctctgggctcttctaatgacccccacaaggccaaccaagttcagcccgttcatgcttctctatggcgacgaagcaatgaccccaacagagctaggggctaataattcaccaagggtgatgttctctgggggcgaagaggggcgcgaggtgtcgctcgaactcttggagggggtgagagtcgaagcactagaacacatgcgcaagtacgccacaggcacttcggcaacttacaacaaaaaagatcgaccgacggagctgttgcctggccatctcgtcctaaggaagaaggcgaacccagtggtggtcggcaagcttgaatcgaagtgggaagggccgtacctcatcaagcacaagtccagaacaggctcctttcgcctagcgacactggaaggcgaagagttcgaccattcctggaacgcttcctcccttaagcgtttctatgtgtagaacgggtggcacccaaatcgccaacttgtaaaaatgtacatactgttatgtaagcctttcggcactatgtaagcccttcggcacaaaaatacaaaaaaaaagaaaaaagaaaaaagacaaaaaaaaactggatatagggctattatccatcccggaggcccgaaccagtataaagtcttcgtgtctttcgcctttttatttgtgtgaatgataatttgtggaaaaatcccaaggcaaacgcctcatcagtgaaaatgccaggggggcgaaacgaatcggccgaagcaccgctcaccgaatgttgaaatcgcaacagcttgtttcgggaaacaattaaccgaacaccgttaaattcgaccaatatgaaaacacaagcgctcctttcagcgcggaatacaacagatcgaaaacggaagccgaaagctgaaaagtcagcaaacctatttcgctaatatacgcaaaggggccgacacgttccgacctaacaaaagcacgaagagtgacaatgcgagaaatagcgaaaaggaagtaaagcacatctttattaacttcaaaaaaaaataatcgaagatcccaagtcttacaatatgatacaggcgaaggaagcaacggctttacagccgagcttaaagataaattataccttcgccaacacaacaatcctcaccccctaaggaatggtttggcgaatcgggtttgtcgtcactactgatatcgtaaacaaccctcaaaggggatggaggacaaacacaagctaaactataacggcgacgggcgatcgcctcttggcgaaccgatcttctaaagtttcgacaaaagctcaaactatcttcgcgacgtgatacacgatagcgaccgtaatcctctaaggttcggcctggatgcacgcgcatccatttagcaacgcttacaaccttatagttgttgccattaatcaacatctcacggtaaacaggccgaaatgggcacttaatcttcagcaggctttttattgccacgaaattctcgtttttgtttcgccatttttcagcgggaggtcaaacgcatacctttcggccacaagcctgctagcaaagcacaaagggaaaaggtgcaaaacggggggaaatatagacgagatcagttccactttcaaacggaacaattagatcagcgaaaggataatactttatcagtagaacagagttcatattgattacaaggcgaaagcagctcaaagccgaacatgcaaaaagcctatatacaaacctaggctaccaaaaagcccgaaaggactaaagaaaaaaaataaagcacacgagggcgaagggcctcacacctcaaggtggtcttggcctccgttgccttcgccctcgtgctcggtggcctgttccgacggcccgggatcccctccggtgttggcagcagcggcttcctcgtccctcgtgatcctttcaaggttctcacggagtcgagttttcacacaatcccgaccaccatcctcccaaaacccttttcgaaaggcccttaaggcagccccagaacactgcgtgttgctaggccattcttctttcacgaagtcgggaaaattcccgatgtggtcacagccgtgcgcatgcaaaaggctaaggacaaatcccgccgaaacacaagcgcagcagtccccgtaggcaccagccacttcaacgaccgagcccgctgcttcctgcgtccattcggagaagtcgaacgcggtcccgccttcgcctggagcaccttccgcccgcgccccaaggtcattgagggccggccggaaagtgtaacaggcctacttggcagactctgtggccgataccaaggtcgcggcagcagcttcggccgagacaagacgagcttcgagggatttgatcttctcttcggccaaagcaagttgttggtctcgttcggcatcccgcttgttcgccgcttcaaggtcagcacggagagacttgttgtcccccgaaaaaaccttgttttcagcattcgccttctttagagtctccgccacgacgcgtctttcatcttccttgtggcgaaggtcttcttcggtctttcgaaggcgaaggcggtacccgtctagcctctctaaggcagatttcttcgcacttaagtgcgcggcaaggccctggacaaggagaaacaaaaaacattacggcaggacactagcgaaaggacaaagttcggcacacagaaaattcatacccgcacaaataggctttccacggccacgcagctttcaccgaactcgtttagctcggtgaagagcccaaggccgtcggtcggtgcaatgacctggcacacaccgtccacgaacggagtgatctccggccgcgtggcaaaatcagcggggacgaaatgtggggcgatgagcgtcacgtccgaaatggccgcttcgaccgccagagcttttccctctcgttgacgggcaggcgaaggaatcgcctcaacccgttcgtcctcggaaacattcgccttagtggctggtgccaaggcactcccacctgtcgccgcttcagcatcgctggcaggtggcggagacatacgcctaccacgagaaggtgcgcgccgcaaaaccggcgaagtaggcgtcccatcggacccttcactgtccaaaaagccacggccgacttgcacaaccttccctttctttttcttcctcctagcagtcatcaccggtttcgctgctgtactggaaatcgccaggagggtgttcgccacaacgatatcttgcggccgcgtaggcgaaacatgagaacctacccgggatttcgcaagagtaggactgggggtgtagccatgggacccatcatcctcagaaccaacctccccatcttcttcttcctcctcctccccatcactttcgaccgcaaccttcgcgctgcggcgagttcgaacttggccacctttcacaaccgcacgcttgcgtttcttcgaagtgccaactttgtcatcctcagctctggaggggttcgatcgacttggcaattcgccaatatgaacccaattcacccggccgtcggtctggcgctggagcaagcgggcgaattcggccgtggttagagctcctatcatcttcgacgcctctatttcggcgtcttccaaagtccgtgctgcgaaaaaagtagaacaaaaatgagtgtttagcctaaagggcacttccataaaggaaatatgcggcttagagcaaaaaaaaatctcactttcgaccccagtggggagaacaaggtggggaagcccgagaacctcttcgccctcgttcatggaaacatcccaaacacgggcgagaggggaaatccaaaggaggcaaaactcctcacaaaggtcctgggtgcttagccgccgagcgaccttacgaaggagtataagccgggactcgagagtcccatcgatcttcatgttcggcttcacgatatggagacggcggaacgctcaaaaaggagccaattcgccttgacatcctcggcagggtaggggctggcgatgtagaaccatttttgcatccagttcctatcccacttggccattgacgtgggtaccggccaagcgtctgagcgctccggccgcagcatgaagttcacacagccgaaaacagttttcctcggaccggccggtgtctgcacgtctttggtcgaggcgcatgctgtaaacaaaatagcgaatagctcggcggtaggggcgaacccacaggttcgacacatccaagcgaaaaccgccagcttcgggaatgctgatgggctaagctggggaagactaacctcatacgtcgcgagcacagacgacaagaagtcgtcacatgggaggcgaagcccggcggcgaagtaggcagcgaagacaaccgttcgtccatcactaggcaaagggacaatggcttcgcccccacatgatccttggccctccacgagaacaccggaggataccaactcgcctaagtcggcctccttgacaagcgatttgccaaggaagcacgaccacccttcgccaaggctgccagggtcttcaccagttgacccggctttagtgggcttgcgaggagccatcaggctcacggccaaggaaaaagccgaaaggctaaagcacgacggtggcgaagaagctaaggggcgggcaaacgaagaaagcacagagcgcgtcaagcggtaaaaaagtgaagagtgcggggggtgagaaaacagcaggccggcttggggttatataaccccgtcgcgagaccgttcgcctgccaaccaattaaaccctgacacttgtccaggggcagacgaaacggtaaattcccatcgggccggagccgaacagtgaaaaggccgattgcgggaaaggagaggcccacggggcccattagtattcatagtaataaaagagacaagctaacccttttttacactttgtaacaaatgcgaggaagggattttctcaagaatcttttgtaagcatgaaaacaagttatttatttcgcaggactatatcacagatttcggcaggaacatcggccgaaagggggtgcctcgtggtataccatttgatctgcacggtctcagccgaagctccctactcacccttgcccgtgaggggcttgttggaggcttgccacggaaggccttcggccgaacctgccgaaaccaaaaagttcaagcagcaggctcacgccgaaggtggggggcgaagggcaagagtgaagccatacgggcgaaagccgtgactagggtaacaccaccttcgccgagtggagttctcgctagaaggcggcacgggcgaagatgatgtggcgaaagcctcggcacacaggcacgggcttcgccatagcaccaaaccccgttgacgggggaggcttggtgggccgctacgccctcgggggatttcgccagatagatgggccgagctatttaggcccagtaggggcccgtatgtgtaaaggacacagtgtgccctccataatatccctatcataagggtaaccatgtaaattcccatgtataacttaaaccctagtagtgggaacctgtaatggggctataaatagccccctagggccatgtaatagggggatctcaagaaaaaaat

SEQ ID NO: 68740 - DNA, 3406 bp, Oryza sativa
ttccacaacctcttctctctccccgctcattttcctcctctctccctcagcttctcttctaacgattgatgggcatggggcgcaggagcggagtagctgacgggcacatgacccgttgccgccgacgaaggagtgggggtgatgagccaaaaaaccctagctagatctgttggccatgggattggtcggggcagatccagtagtggcaggaggtggcgggcttgggtgatggcgggagcagtggtggtggcgtcaacgagggctatggtgggctcggcctcggaccgcgtggatctcgtcttctctcctccctctttccctcggcttctcctctcatgatggccaacggccgtgggattttccgccatccaccactactagaaaaacgatttttcatggtgtcaccctacgattttcgctggcttaagacgactaccagcaaaaatgaattatcgctggcggccgataatcgctagcgaagatcttgatcttcactggcctttactttgtggcggctccaaattccaccagcgaaaacccaaaatggccaccacggaagatggttttcgtagttgtgcacgaaggagtggggacggtgggatggagtgcaacggtgactggttagcaacggatctttctagggttccgattttagtagtttttttcaccgaaattattttcatgcggtcggtataggtgacgacatgtaaaaattctgtttttcgcatgcagatgtggtgcccgcatggaaaaatattgattttttcaaacacctgattgcaggtggttgctttgcctacatgcgaaaaaaagtttgcctgggtagcccgacgagttacccacttatttacctataggtgggttcacgggtctactccattgcagccttaatgtttgtgcatcaaaattaacggataagttcttgtcacaatgcgtaatgggctggatcgttgtgggccggacctttgtcatcacgcgattatacagcaaattagacgggcgcccgattaatcgctaatgatatgatttatgcgtaactgattaacgtaacagactgccagcctacccgtattaatggctgttaaaaccgttttccattttttaacataatggaacgtaacatcccggtttttctcaaaaagttacaaccaattattacagtctaaactctaaaagtgtgtagttcaaacaaaacatcaaaaacatccaccaaaaattaaagaaagaccaaacttagataaggtgaacacatttattgaaggctatttatgtggcaaagagttgcataatcgtcgtatcaagcttacgacatgcaacttttataaactcaccatcttcatcagatctttgtagttgaacccagagccggagccaatatgttgccttgaaaattacctacatatatgaaatagatggtcaaaaaccatatcattcctagcttcctgcacaaccacaaaacccaacatatagtagaaacttctacaagaataaacttgctctcttccttgtccaccctaaaagccaaccaccaaaaaccgttttccatagtatagaggtctcaaaaaccattcgaaattttgttcgaatctactttttgtcatgtcgaaacctccaatttttatgatttttttatcgatttttattgaaaacataaaccatgccctgtgttagccattttatgcaatatgttgattttacttgtttctactttaacatagagggtgtttagatctaggggtgtaaaattttggcgtgtcacatcggatattatatagggtgtcgcatggggtgttcggacactaataaaaaactaattacagaatccgtcagtaaaacacgagataaatttattaagcttaattaatccgtcattagcaaatatttactgtagcaccgaattgtcaaattatggagcaattaggtttaaaaaattcgtcttgcaaattagtcgccatatgtacaattagttatttttagcctatatttaatacttcatattggagtttaaacgtttgatgagactaggtgaaaaattttggggtgggagcggattattattgtgaattatccgcttggttatggggtaaggtaaaattgcataatccgatcagacttaattccttggcgggccataccagctagttgtccagcgtagttatgtctcgagctttttcttaaccaaagaatgatgttacttccagctgacagcaaacacacctttcactcgaccttattcgagaactagtttaacttggctgatatagtccactacaaatccatgtgaaaagaaaataggctgaatgacctactcacgtgtgcggagggatcaatttcggtctaacaatattaaggtgggtgagcttttataataaaatatgttatggggttgaatctcaaaataaaggtaatgattaggatggtttatataattttgtcataaataaaatattttaagcaatatcgttttggcggaaatgtatttttcaaagcgtttagcgaacaatctgaaatatttttatttttagaaaaagaacaagtccattgtcgtttcgtggaatttaattaaatttattttaaggattttcagcatatcacatatccgcatagctattttatacgggactacttagaaaaaaccgcaacaaattttttaaacaatttttcactatattatactataactaccatacaactttatgtaagtattaaataaaatacaatttcatactgagttatgtagagatacattgtcattatagttatgtagttataatgtaactataatataattatattttacaagttactagttataccacaaaacttaattatattgttacatataaaagttttctcaaaagtaacttcccattttatatacccaccctctctcacgacaacatcatcacttcattatcacatgacagaccaacatataatgatgattaagaaaaaaaataaaattgttaacagaatacggaaggaaaaaaaataaaaaaaaaaccggcttctccgcctatcgtgcccaggtgtgcgcggctctcttctcctccatcggcgacgagccactcctgcgatgagatgagattgcccgcatcgtcgtcgtcggcggcggggctgcaggagcgcatctgggacctccacgacaatctcagccacgccatcctctccctctccgcctccgcccaccgctgctgccgccgccgcgcccccgaagggcgcgtggtcgtcaaggggtggcggcggcagggaggatgtggggactgcggcctggagcaggaggcggctgcggcggccaccatggcggacgcgcggagccttcacgccgtccgcgccgcgctcgaggacctcgagggccacctccatttcctccacgtcagtatcctcctctcctccttaattcttg

SEQ ID NO: 68741 - DNA, 6630 bp, Oryza sativa
tgacctgctagatactagattatggagttctccagcaccatctaattaaattatccaaaaaataacatggtgcctattgtgtcaacaatacttgcagaacattcaattatgtcaggtggcagaacgagatgccgcgattgctaggctgcagcaaagtcgtattctgcttgctacaagattggctgaacataggtggaagaagcatgaagttattgaggaggccttagcttttgttgatgatgcgcttgacaagagtcgatttgtctcaccagaagatgtccgtgggacgcatacacacagccaatcagtagagaaccagtgccccaagatacatgattcaaacttcttggtgcgttttttatcctgtacattagctatagctaagaattctttaagatttgagaggattggtggtgcactcggtaataccgcgatgtttgcagtaagtatgcttgcattcttgcagctgcaacaagtggcctttggtaaacaaactccagcagtacaatgtagacgagtcaattattttcattctcagatgtctgtaaagaacactaaagaaaagcatctggtcgtattgttagctagaggatgaggaaatcatcattgtttgatgtatagataagttttgttctgttcacatttcttgaaagttttgttaggacactaatcatttcactcccttggattggctggtctacagcatatctttgataggaagttgtaccacatgagttgtaaatggttttagattggcaatagatgaactggcagggcttgtaagcttgtttctttttctgcagctgaacgacaaccaccatttatggacaacagatttcgtaattgccatgtttatgtgaaaccatggtatcagatttgatctttgggttgccatgttacatgaatttcttgtcaggggcttgtggatgttcatatacatcacaggctgaggcactacaccaaaatgaccccataaagacgtttttctctagatgctttgaaacacgtctctgaatatggtatgagatagaaaaaaaaaaagacgcttcgggagacatttttatgaatcgccacaaaatttctatggtaaagatgtctttttcagggatcttaatcaccaaaacagcgttcttgttatccttccgagcagctcaattccgacagtccaaagcccaactgttcgcggttgttcgtgattttgtccttctaattgtcccactatatatccatcccacaatataactgattttgtccttctaattgccccactatatgaggaattttggcatactacttatcatatataagtgactttattctacattctagtatgtgaaaaattcctgaatttgaattgatatatggatgctatgtgaatatgaaaaatgcttgcatgatgtgattattgttttttttctcttttttttgggctaaaaataattcttccatgcaagtgacttaagatgctgcctgcgaaaatacgcggtgctcttagtgcagccgtatgtgaaaacgatttttgtagatagtcaaaggtccgctgcaggtctttagtacaggtggagtatttggccgcctgaaaaacgtgttttggccacgacaaaaattgtttttctaatagtgatagttagtcagccatcaactccaattcaaatttctacatatttttaaccctcaactatccactcacccacaaacatatctcaccccaactatacattatttttttcatgattttatcttgcactagttattttttagaaattaactaagattaagtttacatataagttcctattgtaaaaatgtatttaggtgattgtaaaatttatattgaattgtactatgggtcggttattattgcccgagtttcattttagactaggttatatctaatgttttcactttggttcaggttttcttactttctgttgcacattggactattttttttgtgatttcattagcgagcttaccagcaacataataaaccaatcaatattccatctgaccttgatttcttttactccttgatttagctgcttgacttctaccattttccccttaaaaaaatcaagtgagcttagagcaaatcactgtattgagcttgcaagcgacactgcgacagctacaacaaccagctatcaccaggcttgattttgctggttcctcaagctcaggaacagagcagagagagaagggatcccagtgttttgattgatcatccacggcgcagctgcttaatagagaaaaggagggaagagaagagatggagaagaagggtggtccaatttgaaatttttgtaaatttatctagtccaaagtgataagataacttcaccccttgttcaaagtgaaacttaggtaaaaattcctagcccaaagtgcaattgactcttttctatatctctttgcgtaagactattatgtttcttttatatataaaactaggtgaaaccccacacattgctgtgtgagtttagtatgatagcactaagttaagtaatgtgtaagatagctagacaatataaacttatataagttaacatggttcatgatagtttaaatttaaatagtatatagaacgataatttaaatgtaaaagtaagttgttatagtcttatgagaaaagaaaaggagatagagagagtttggataatagaataatcatctaatggctaaaaacaattgagatgatatgacttaataaaagaaaaaaataagggagataatttggaccataggacaaaaacaattgatgtgatattgcttagtgagagaagagagagaacattaactaagttaggagttataataaactatatatgtatataagatgttataaaaaaagatgaagagacatttaaatattatatgaattatgtgtgatgatgatataatatgcttgcatttgaaaagctataaaatttaataaattataaaattatagataatataagcatgatgtttatatgtaatagagtaaataaagaacaaaaaagaaagagcactacaaaaatggtaaccaatcagcaactaattaaaaagctcacatcttgtccgttctctcccgatcggacggctgctacgccatcagagcagctccagaagccaccgcgccagtgcgccactgctaagtggccccctcccaactccgacgaccccgccgccgccaccgccgccgccgccgatgcagaaccccaacggcaccatcctccagctctaccacgccggcaggctcgccgccgccctccgcgccttcgagtcgctcccctcctcctcccccgcctccgccgccgccgccccagcccctctcaccgccgcgacctacgccgccctcgtctccgcgtgctcccgcctgcgctccctcccgcaaggccgccgcgtccaccgccacctcgtggcctcctcatcctcctcgccggatgcacagctcgctgggaacaccgtcctcggcaaccacctcatcaccatgtacgggcggtgcgccgccccggactccgcccgccaggtgttcgacgaaatgcccgccaggaaccccgtctcctgggcctccgtcatcgccgcgcacgtgcagaacggccgcgccggtgacgctctcgggttgttctcgtccatgctacggtcaggaactgccgcagaccagtttgccctcggcagtgccgtgcgtgcttgcacggagcttggggacgtcggcaccgggaggcaggtgcatgcgcatgcgttgaagtcagagagaggcagtgacctgattgtgcagaacgcactcgtcacaatgtactccaagaatggcttggttgacgatggattcatgctctttgagaggattaaagataaagacttaatttcctgggggtcaattatcgctgggtttgctcaacaaggttttgaaatggaggcactacaggttttcagggagatgattgttgagggctcgcatcatccgaacgagtttcattttggtagtgcctttcgtgcatgtggggctgtgggcagctgggagtatggagagcagattcatggcttatccatcaagtataggttggaccgtatttatatgtaggatgctcactgagcgacatgtatgcgcgatgcaagaatctggactctgcaagggtagcattttacaggattgaggcaccggatttagtttcttggaattccatagtaaatgcatactctgttgagggcctacttagtgaggccttggtcctgttctctgagatgagagactctggtttgaggcctgatggtattactgttaggggcctgttgtgtgcatgtgttggccgtgatgccctatatcatggtaggctgatccactcctacttggtcaaattgggtttagatggggatgtttcagtctgcaattctttactcagcatgtatgcaaggtgttcagatttatcctctgcgatggatgtttttcatgagataaaggatcaggacgttgtaacctggaacagcattcttactgcctgtgcccaacacaaccatccggaagaagtcctgaagttgtttagtctcttgaacaagtctgaaccgagtctggataggattagtttaaacaatgtactgagtgcttctgctgaattgggttactttgaaatggtgaaacaggttcatgcatatgctttcaaggcaggactagtggatgatagaatgcttagtaatactctaattgacacttatgctaaatgtgggagtttagatgatgccatgagactctttgaaataatgggaaacaatcgtgatgtgttctcttggagcagcttgattgttggatatgcccaatttggttatgcaaaggaagcatttgatttattttcgaggatgagaagcctaggaatcaggccaaaccatgtaacgtttatcggagttcttacagcatgcagccgagtcggttttgttaacgaaggctgctattactacagcattatggagcctgagtatggcattgttccaacacgagagcattgttcatgtatcgttgatttgttggctcgtgctgggaaactaactgaggcagcaaattttattgaccaaatgccatttgagcctgatattataatgtggaagaccctgctggctgctagcaaaatgcacaatgatatggagatgggaaagagggcagcagaaggtattctgaatattgatccttcccattcagcggcctatgtcttgctgtgcaacatatatgctgcttctggcaattggaatgagtttgcaagattgaagaaggcgatgagaactagcggcgttaagaaatcacctgggaagagttgggttaagctgaaaggggagctaaaagtctttatagtggaggacaggtcacatccagagtctgaggaaatatacgcaatgctggagttaattggaatggaaatgataaaagctggttatgttccaaagcattcatggaaacatgctattgttgatcatattgatagtgatttgttcaatgaagagatgctagctgaatatggttgagtgggagataaagaaaacagtaattgctgactctggggtattcgcatgtcttccttgttgtaagaaatacttgttaatcaccaagataattattaaagctttgtcagaattacaatgcaacatacagaagttgcataagcttggcatcatgcaccatttgagaacttaccagtatgttatagattatattttgcctaaataatttgaaagaagaagtaagtctgacctggatctttcctttccctcgcttcactgctcatttatttggctttcagatgtgaactgcctaacatgaggaaatatgttttgcaaggtgggttcgacaaatcatgcatagtcagcctgctgaaggagctaagctattcatgtaatcttgctaatgatatgcgaagcacaactggggcttatgtatttgtttgatctgtcacatatttctgccaagtaagatttaatccagtgagccatacacaaggtaagagtttgacctattctagaatctccaaattcctgtttctattaatctactctgagaagacctttttatctgtagccacttgtcaatatcgattttgtgaacagggggcattccttttcctcatccagcttgctactcctttctttggcttccagatatgaacttggctaacctgaggaaatgcgttttgcaaggttcgttgacagtgatcttgctatttgatacatgaaggcaggctgtatttgttttatcagccagatatttctgctatgtaggtttcagttcagtgcgctatacacaagatgagaacttgatctcttgcagaaaggtcaaaaacctgtcttttaatctagggttaattgtattcatgccattacaaatttgcccgttttgaaaattatcattacaaatctgttgaaatcggaaatatgtcactacttacgttctatatgcactgattcctttatggaccaaattacccttatgttctacctcagtcccctcctctatctctctctccctgtccaagtatcgtcaacgagactggcgtcggtggaaggtgggagcagcagcagcctgatggctggatccgccgcgtcacactgctcatcgacgaactcacctgtggggcttgaggatctggtgagtaggtcggctttgcgagc

SEQ ID NO: 68742 - DNA, 3886 bp, Oryza sativa
tttgtcagcaagtacaattgctactataccttcaccggtggaaaggcggttggataccggaatctatttgcaattccatggtcatcgttcatggctgatgacagcctcttcttcatcgagggggtactacacttgagagctgaattaaccataaaacaaccctagatagtggacggcgtttaactaacagcgtctctgttcttgctgtgtccaaattagtgtgaaaaatgttgtgtgattcggacttactgttgttttctacttgagcaacctaaatagacagtttggaaacggcaagtaaaatcccttttgtttttacatcaaaagaggatcatgacatgtaacgcattgttatcgaactgtgaaaagtgattcttctaatcaaagttatgctgaatggtccacatcgtcaatgacattaagtgatggaagccataatagtattttcaacacaaaataaatgtaataatacatttaatgttagatttagtgaaactaatttggtcttttagatgttattttttttcctatagatttagttaaattttaaaaagtttggttcttaaccaggaggctcaatgtcaatgaaatgcgtctggctgagcaagtctgactttgttgagctgcctgcgctactttgctaatctcgcgctcatttcgtaatctggagattagctttattattatatttgtagagtaatagataataatagtaatctgggtagttgaagtttctattgattttcatagcaatttcctgtctctattggacggggctgatttaaggttacgtgggtgtgcttgagaagaaggggattggggagattgtgaagatacgcaaaacgaggtgagctattagcacatgattaattgagtattaattattttaaacttcagaaatagattaatatgattttttaaaacaactttcttatagaaattttttacaaaaaacacaccgtttagtagttcggaaaacgtgcacgcggaaaatgaaacgatatttctctctttctcctgcgctcgaacgcacccttaaacgggctttaaggtagaaagtacacgtggactgcaagcttctatttagaaactgcaatgctgtgccttctccaaagatcgataaacaagagatatttaaccatttgccatatttagatgtggcaattaattttttatcactagacccatatgtcatagacacatgtggacccacatgtcattgagatatgggtggcaaatagttatttgccaaatctaaaagtggcaaataattaaaagccccgataaacaatgcttcctccgtttcacaatgtaagttattttagtatttttatattcatattgatattgatgttaatgaattcagttaatataaatgtggaaaatgttcgaatgacttacatcgtgaaatggagggagtatatcagtttatatagtcctgatcaatgttggcggttaaggataatacttaaggagggactaatttacttaagtcggtgcaaaaatggtcaacaattttgactggcttgcacaagtataacgtgagctgtgacgtgttggtcctagtcccaagtcggttaacttttgactataaaatgcacatctaacattcatctttcagcactactgtctcgcgagaaaacttctttcattgttttgtaactaagcggtgtcactcctcaaagctacacaagctagctcatcctgaaattctcagacaacctgagctcagctagcgctgagctgagctccatggcgtccaaggaccaaaccgcatcctcgtcggagacgacgacggcggtggcggatgatacctccagccaacaagacgcaccgccccacccgctgcaggtgacttcgccggattcttcgttgccgtcgccgtcgccgcggcaacgccggtgcgtggcggcgtacatggacctgacgcgggaggagtgcggccgcctcttcccgtcggggcggctccgctcgcagccgctccgcctcgccgggcggccgttctacctcacggcgcgctgcaacatggaccagcgggacaccttccgctgcttcggcctcttcctcgccatggaggtcgacgacgaggaggaggaagaggagggctcgccgtcgccggcggcgagcgtcaccgtggaatacgacttcgccgcgaggacgaggcagcagtcaggggatgagttcgtcagcatgtacaaggggcactacaccttcgccgccgggaagtcgtgtggataccggaatctgcttgggatgccatgggcgtcgttcatgggtgatggtggtggtgacagcgtgttcttcatcgatggggtgctgcacttgagggctgaattatgtgtcaaagaagatgcttaattagatcgatcgaattaatatggatatattgtacggcgttcgtgaattgagaatgcttcatagccttttgaaaatttgagcatgagagatcatagggcatatgataatggtgtttgacggagcgtggggctcctcaccgggagaccgcgcaggcccctctttgccggttcggccgggggcgctaagtgaggttcttcgccctcgatcgatctggggaatgttcgcgagagagcaaaacgcacgagacacgggcgatgtagacaggttcgggccgctgagaagcgtaataccctactcctgtgttctgggggaccggagctcggggaggagagaaaaagaggaaaagagtctctagagtttgaactctcttgctctccagctctttgtaactccttcacacacgccagatgacggagcgtggggctcctcaccgggagaccgcgcaggcccccctttgccagttcggccgggggcgctaagtgaggttcttcgtcctcgatcgatctggggaatgttcgcgagagagcaaaacgcacgagacacgggcgatgtagacaggttcgggccgctgagaagcgtaataccctactcctgtgttcaggtggatctgtgtgtgaaggagttacaaagagctggagagcaagagagttcaaactctagagactcttttcctctttttctctcctctccgagctccggtcccctcccttcggtgggcaaggtcctccttttatatctcaaggggataccacatgcaccacttctacctactcttcttttgggtggggacctaccctatcttgaccaaaacttggcttgccccttcgcctggaagctaaatcacaacttgtccttgagtgaggctcagcgccgtcactcgcgactaccctgtcatcccttcattaatgggcggagatttgcaatggccgctatccaaatgaccatccgacgagatgggtcatacctacctccactccaccggaggcagatgcatcgtgggagcacggttgtctgccgatgacgcgaccggcgtcagaccagtcacagaccggtcattcttgtccaccacgtgtcagtttagcatgctacacgtctgcccttcttcatacaataacttccttgcaatggttgcgatgaagcctggaatgtatctggccggggctgacgtgccaactccaggagttcccacgccggctccggctagggacgagtgcctgaaggctctcatcattccgacgggacggggcgaggcgtgcgaaaggccgcctgttgccacctaacccgcgatctgaccggtctgtgaccggtcacacactgtgacctgtcacggaccgagtgtgctgcgctgcattaaatgcggcgtggggcgctcgtccaacccgcaataaacgcggttaggtgagcgccgctgtgctcacctaacccacacacgtggcgccaaacccacagggggtcggggcgccccaaccctcggggccgaaacgggagcggcccgacccctcagggagacagagggaggggcggccac

SEQ ID NO: 68743 - DNA, 2234 bp, Oryza sativa
  unsure (1)..(2234): unsure at all n locations
ggttaggattaaatggaagagggagaatgaatggttaggatttaaagatgggtgaaatcatttcccttttccatttgccaaacattgcccacgtctaagggcctgtgtagttctcaccctaaaattttacaccttatcacatcgaacatttgaacacatgcatgaagtatattaaatataggctaaaaaataattaattgtacagattacgactaatttacgagacgaatctattaagcctcattgctctatgatttgacaatatgatgctatagtaaacatttgctaatcacagattaattaggcttaataaattcgtctcgctgtttactgacggattctataattggtttttttattagcgccaaacactccgtgcgacaccttataaaatattcgatatgacacgttaaaactttacacccttatatttaaacaccccctaaccttttttttcttttgatttcgacagcgagataatgttacgattgtttgatgactgttcccttggtagactcagcatatttccacgcaccaaattccaaaataattatgcaaggatgcagaatgccgaagaagaaattaaggtgtaaattacagtgagtgctttgtatacagctagtggaacgtatggaaacacaggaaccgaagccaacagcaataattaaaaaaacatgtttcttccgctcgttttcagggcctttcaccctatcacatcgaccgtttgaacacctctataaaatattaaatatagacttaaaaaataattgcacagattgtgactaatttacgaggcgaatcttttaagcctaattacttcatgatttgacaatgtggtgctacattaaacatttgctaatgacggattaaataggcttaataaatttatctcacggtttattgacggattctgtaattagttttttattagtgcccgaacaccccatacaacaccctatatagtacccgacatgacacgccaaaactttacacccctaaatccaaacaccccctgaactctacctcaagcatttcgaacttcagtgccattgacctaggttcaaatatgaggaacatccattcccatatgaacggaagacctccaaacagtggaaccttcaatgccattcgacttctcattttttgaaagataatgtaaacttgattgaacttagccaataacattaaggtggtacaacagtactaagaacataatggatcaataaagcacaataaaaatgcacacaaccaaaacaccacttacataatagtttgaaaagaaggaaaaaaaacaaggacaattaagggccaacaatccgtagaatagatcaccacccatgttcctatataaaaaactcattgaccacttgctccaaatatcgacttgccactgcaataaagtctcatcaataacccatgaatggtgccagtggataagtaaggagataaccaacaaagaagaaatatttttcttgtcaaaaccgcatcattcatgcataaccatagggaccacacatggtggtcgctcatagcaggacttgaggtctcgtatgtttggaaactagcaacaaccaactcccaaataaacgtgaaacactatacggtggacactatattaataatagaccacactgaatgaacaaaacaacattggaagaataaatgtttaattgcctcctctttgtgacaaaaacaacatttcttacaatcttgctaatttttcttggctagattatcttttgttcagactacatcacgatgcaattaccaaaggaaaatcaaggaaaatccaacgaaaatcatcttgctcctatgttaacacaatattagcggcacggggtaacaagttgttccacgccactaatttttagccaatcaaacccttctctatgaaaagttgaatgggtatgtttggaagacatttgaaatggtagattgtttatgcctaactatattatatataggcagggatattgatccaacaaggccgcattacccaaccatttgtcttcccaaaatctgatttgagatccatccttaattatgaaggacccatatcgaagaaaatcatgtttggccttcataaagctacctagaaatgtgaattcncccagctttcaatagggggcttgtgataaatgctgaaatccaaatattgcgtatcatttcttgccacgtaccatttgttgtaagcaacttatgaagccatttactaactaaaacattattcttta

SEQ ID NO: 68744 - DNA, 10523 bp, Oryza sativa
gtgttgcaaggagttgggaccaagataagaaaaggcacagagtgatggtcccaggaagataccacagaacccaaaggaggtaactatagtggtgcatgtgggtgtagaagcgaactaacttagaatgtgaacacgtgagctgttaggatgagtggtgcaaggtaaatcaatgcccccaacaaggtggcaatagcaacaagaaagtaggcttctttacacaggtaccagtgataggtcaaagctgaacgaaccactcactgagatgtttctccaccaagtcaatgtagtagcccctgcggtggatagggttagggtttgggtagggaagggctatttgatgcgatattggagtcaagattcttttccagcctatggctaatggtcatcatcatatatataaagcacgcatattctgtacagaacatcagagtggcattaagccaaaccaatatttcaggtgtatttactaagcgccgatcttttgagtggaatgtaccttaaaacccttacttttcatcgcttgataaaaatacattgtatgcacaagataatccagaatgtttgttctgtataagcccactacacttccatttcacacttccacacgtgcattactacatttgactattgtatttgtttcattttcactaagaaatttttgttaataacttttagctacaactattctatagttaagtagcccacatatgtttgctatcttatatatttccaatgttttctttttcaagctaccttctcatcatcttccatatcttgcatatattttccatatcttatatattgcatatcttgcatatatgaatctagatgacaaatgtctagattcattaacatttatatgaacgtgggtaatgctagaaagtcttataacctgaaacggaggtagtagtaaagatttgtccttttacaaataaatatttacctgcaaaaagaacacccacgataaagccagaccaatccgtaatttctttgcattggctccatttgctggaattgaaaaaacaaggaacattacactcaatgcacatgatcatggactattcatacacccaaactaatttgttcatatgtaaaatagtctgcatacttaggccaggtttggatccagggactaaactttagtccatgatttgacaatgtagtgctacagtaaatatgtgttaatcatggactaattaggcttaatagattcgtctcgcaaattagcctccatctgtgtaattagttttgtaagtagtctatgtttaatactccaaattagtgtccaagcatccgatgtgacagggactaaactaggatccaaacaccaccttaaactagcaatatttttataaagtgtgtcataggttatatagcaaaaaaaatctaagcatttcagaaaataaagaaagtaatgcttcgtctccagtattgggaatgctagttcccatacattatgaggcaagaacataaccaaaaggatcaatgtttgttttctatacaatactagttgagaatgacaaagctcaataacaggttgaataactatggttggattgacatttcagtaagcacataatgtaactggcacgtttaactttctgcctttcaagatgctctcatgatagtttcctttctgaaaaggaaaaatgttcatatgatcggatagcaaaaattggtatcatttgagtttggctacaaaaatgtaaacattcatgtatttaggtgtttttaatcatatgacaggattcagtttacctctgacaaatggtaaaatcaaatgcttctgtagaccatcatcaaatttctttccagaagtgctttgctttttcactcctttctttacctatcaatgcaatcatatataaataaaccggtaagaaacagttaggaaaaatgtaaatttcgcacacctgagcatctgggttaaccgcaagagcaagcaaggaaccaagcgcttccgcaaatgaatctctaactgctgacacattatcctccaagccctttagcatgtcattaatcaacgaacagtatcaggactatcagcttaaaaaaacatagcaacaactagctctcaacatgcattaagaatgagaaacaaggttagcaaataccttaacgcaacaagacatagaagtatcaatttcagccatccccaacccaggcccaccgatattagcgaaggccttcaagcatcgagcagccgctactctgacaatgaatgatttatcactcacacctcctcgcatgataatgcggaaagcctccaaataagctgcaccactaccaccaccaccagaaccttccaatgcattctcaagcaagaggagtgcatcttgtctcacaaagtcctgatgtttcatttaagagaactgtcaaaatccttttacaggtagaaatgaggcatgaccaacaaaaacaaaaaggctgacatcaatcacaatagtttttaagagttttatggttccactgggatacaaaaaaagaatgaaagaaaattttccacaagtaaatgcattgaagatttgtggtaagttccaccatattgtttcaatccttatttacagaaaagaaaaatcaaaaaagatacatgcatcgtaacagatctgctgtactgcaagagaaatccacaaaaagacttatggatagaaaacaaagttaagatagtttttctatagaagaatatgaagacaccaaaaaaaggatgaaaagacagtaaagaaagtgcaggagaagataacctcatggtacttcatgagttttgctacaatatttgatgtctcaattaagcctgcagtaatcttgtgtccaaataagcggtaaatttctcccagacattgcgctacacctgttaggaaatattgagttttttttagaaggagaaaaaaagtggatgtgcttacttagatttcaacattgtacatcattaaatgtgttgcttgcccaagattgtttagtccaggatttgcaataactttagcatgggatcaagggcctagctaagaagatatggcagtataccagtatgaaacctagcttgtactagtctaattcattgaagttcaagcagtagttttaggcttaatacaatggtagccattatgtcagtctattttaggattatatttttaatagtttttgtaaacatatagtttgaaaaggtaatgataaaacatgcgcatttgagatttggagactgtcaatgtccaaagcatcaactaaaaaataatggaattctagtttccgatgcaatttaaaagaagttaagaaaaaactagacaatatgaattacaattgctgacctgcataggccatgggatccgttctttttccatctaccaaccacccttggagggtactcgctcttgagtataccgatattgcatcacctctctcgattatcctccccattgctgacgatgccaatcgccgaacagggcgacgagccccaaggaaaagcaaggattggagagcatcctcacatttcctttgccaaagctgtatggtctcctgaatattataggatgtcaggaccgccaaaacacaaatttcaacaccggagttactaatccagtatttctgcatattactgctttttaggtaaacataatccgaaattaagcctgcagatgttgactcacgcagtagaaatttgctctaagttgacttaatgcgggcaggaaaggagagactggtttttctttcactaagttctgaatatttttgagacatgctccatggttttggttaatttagaacacaagcacccgagcatggtcacataaaattgtttgttcgatacttcaattgccatcttatgatgttagtacaactgcacaagcctggaatactacgacgcaaccgccagggcaactcacaagagatccatccaatccacgcggctccaagaacaagaaagctccgcatacgcaacgccattcgttgcgccaccgagagagagagagagagagagagcatgggcgggcgtgggatctggggcgctagcgctagggatataatagagggagggagaggtggtatggtaagaatgaccttgggggcctcgtcgagggcggaggagagctcggagaggaggtcgaagcagaggagcgcgtcggggggcttctgcctggccgacgccaccacggactccagctgcgccaccagcgcgccgaaccgcgacagcgggatgggctcgccggcggcgccaccgcgcttcgccatggtggggaggagagaggaggagggtggtggtaacgggagggctaccggttcgatcgagatctaggtgtgctggtgctgtgatctgggaatcgtcggggggttgggggccgttgggcgacggaccgtctgctcgtcgagctcatcggacggtccaaacggtttacggactgtttattttgagctctttttttttattttgaccatgctttttcacgaagtgctttttataaaaactgtactccgtaataaagtaaatcaatattttaatattacaaaattattagttaatatttgagtcgttatatgctaatgatcacctatagtgttttccgtaccagtgagtaattgattggtcaagcatctgatttagctagggcttaccggctatagactttgtgcgtcagtgtgctcattaattacccaattaattcaccaggacagtaaggatggagcggctcattttacgattgacaaagctagaacgctcccgaaaatgagtctattgattatctcccaattggttggatcgtaggggcgatgatttacttcacgggcaaggtctttggttcaagtccaggatggcccagctgcgccagggcgattaccacgaaaaccatgtggttaccgcaagatatactgtggttttaaaaattgagaagattactgcatgtgataacctgataatcacacggttttataaaccctggatttaactatatttaactagggttatttgtctttttactcccaaatttaacagttaaggttagtaagaattaacggaacaagagcaaacggtttgatttgtttcaaagccattgtttagttcccaactttttcttcaaacttttaacttttccatcacatcaaaacttttctacacacataaacttccaactttttttttcaaacttccaattttagtctttaaacttccaattttggcgtggaactaaacacaccgaaaaaaaagtaggggtaaaaacgaaagaataaaaaacaagggcaaacaatattggacatcaaagcaagggaaaaaacaaaattgccccttttagaaaactccgaaaaacaccagtacgcaattctaagaaaagagaaccacttcaacaaagacttttgagcacttttcttattcctagacatttatgcagcatccccttaatagtatggctttcctattgacccaagtaaatgaaaatttacaatttaccaatagattttgtgccgctttcatcaaaactccattcataagaatattgcatcgaacatcatctcatggggggctaatgttccttcagactttctcaattgtaagcatttgtcctcactaatctgattgccattgaccatcaaaataggaggctagatgcacttccagttgcacaagttttaacttgttcatccgaaaggtaggagtattgcgggaattagtgacattatttattaacataagcatggtgcttaggttagttaaatgtcgttagatgtgggtatgctccacgaaaagtgaggtagacatctggtggtgacaaccatgtccgtcccttgtattcctccacgctctggtatgacctaagagttcgtaaattaccataaccacgttggtagactaatagggagtgatcgaactaagtcctagcctagtttgttagtacttcctccgtttcacaatgtaagactttctagcattagcatctatatgaatgtgagcaatgctattatgtatagattcattagcatctatatgaatgtgagcaatgctagaaagtcttacattgtgaaacggagggagtatgtgttaaatgtaaactaaacattagcaatatacaagtacacacgaaccttagctttctatagttcattattagagatgaatctcctgtgtgtcacgctagtccacatgagtagattggatctatatcagtgtaggtgcaacgcggcgtgtgaatagaacatggcgcatattgtcgaatgatcaacccccattacggtttcctgttgccccttatataggtgcggaggccaccggctagagatggtgaggtatcccttataatctgggtacctatcatctatttacattggataagactgactgtctaatcttcaatctttcttaaaacaagtgaacccgacggacccaaagcatatagtccatcccatacgacaagctccaagaaccatcccgtggatactcaggcatcatgtacccaacagtaatttttgagtactaagtttgatgaagactccgaaattgatgaagtccgctagaagaagaggtgagactagctaagtacacatccccagcctagccgagtcaatctccctcagccgagtaattgtttccttggggaggtattgtaaactttatcaaaaagatcttttgggcggaatttcaccaatgcggttcggctgtcaataacgccatactccaaaccaggcttgaagaacacgatgttttcatgatgccacggcacaatattttggtgtgatcctacacaatatgcccgagaatcctgtctttaactcgaccgtagcctaagtaaaggctatggtcaaagccgccgtcgtccaacaccaagagatggcgccaaccgtcttcaacacagaagctgagtcgtcaagacaattattctgtggattccatggtgccatgtgccctacagggttggcaattttgctacggaatagctatatttatggtgttatatattttttttaaaaaagtcaacatgtatttacattgtaagtccctaaatcacgtatgtaattttattatttttttaatgtaagtcacaaaattacacatgtaaatagaaaatagagtgtaaagtagggtgtaagtaataaggtgtaaattagcaaaaaagaatgtaatacttgatttcctcggagaaggtagtaaagcaatttactgttaaacgctagtaacaaagcaaagaagattggatagtcacagtgtgtggagaaattgaacgaccgaaaagaggcacagccgaatacttgcggatcaatcggacggctagtaataccgaccgtaatcagctcagaaatctgtcgaaatcttgttagcaattccgtttccgttttgctacagttagttttgtgttgggttggattctagcaggcccgcgtgccagtgggtgtgcgctcgtcaaacccgagaggaagaagaaggcgaggccagataggcaggcaggcagattagaggcaaggcaggcaggcaggcagggctcgagctcccccttcccacacccatgtcctcctccgcctcctgcctcgcccctccccctcttcgtctcccgtgctcctcctcctcctccccctctcccgccgccgccgcgaggttcggttctcggaggagggcggtagccgcggctgctccggccaaggtacgccgcgcccgcccctcgattccggcttgatgcgtgcgtgccggggagtaatttgaggttctcttgtctctctctcagggatggaggctggtgcgcgtctcctgcttcaggcaggaggatgtcccgacgacgtctgacgacgggcccggcttcgagcacatctcgcggccggagagctcgcggggcgcggaggcgagtggggaggagggggaaggggaaggggaaggctcgagcgggcagcgtgagcgcggttccggggaaagggatgattggttcctcagagcgcaagaggttagccctgattgtttttttctagttgcaaagcattccattcgagctcctttttgtgttatgaggaatggtagtcaattcagatttagaaatgctatttactccctccgtttcatgttataagacgctttgattttctttcctagtcaaacttctttaggtttgattaagtttgtagaaaaaaaatagcaacatctacaacatcaaattagtttcattaaatctaacattgagtgtcaaaagtttcaatgcatgtttgttttgtcttaaaaatattactatatttttctataaacttggtcaaacttaaataagttaaactaggaaatgtcaaaatgtcttataatatgaaacgcacggagtagttagatgctagcaaatggactgtgcaaggtaccagctggctgaaccagtttctaactctcgtttcacgtcacgatgccgcaattgtgcaattaccattagaaacccatgaatccatagttgcattctctcagtggcttggatgttttattacagcggcacatagatcagtgttaaaacttaatctatttagttagatggagttggtccacatttacatatactgtccaattcttctaatgcataataactgaaatatggggtacacatgaaacacactcttatgttatcctctatatggtctgtaaaattttaattttctatctacttgccttaaaacacagaagcaagggaaagagcaccttttatacattcaaagggagaaaagttgtacatctgtctgcttaacctctaaaaatgagagatctgctggataggaaccttaacctatagagtagaaggatcatatgcaaccacaagagagaagttgctacacttcctgatgttgggagaattagcagtatcaccacccacttgcaactcatatttaagaacctctgacgaacattacaatcatgccaattcttgcatttcgacttctcttaaaggaaataagaatcttgaacttaccctatgtaaaatatttgtactttcacgagtttatggtactggtgatgttccacatcttagtccttcttaaccaagtagatctaggcttgtaggcttacttccgaaccaagcttaagccaaggactaaatactgtacctatcctcatgaaaaaagctgaagcctgttgtgggattatagctgcagcttgcttcacccagcattttgggattaactaagaaacttgtttattaatcttaacaccgagctgtataagttactttttatgatgagcacagtcaaagtgcaatcgaggctttagcaggcaatctttttccttgttatcaaaatgaacaaaaatctagatcactttatttttattttttttctcactagcaaccttttcctttacactttgcgttgtacctagagaaaataattaatatttttcattaaaaatcagcttttcatgactgccaacagaaggataaatgaaagcttaataaattagcaacaaatctcccaaaagaataacttaatcaataggtttagccctgaattgtgattctttttttttatgtatatatagtggacgtagcagaacattctaatcttcttgctaaaaaagttacttgtgcatactgtcccatcactagtttacaatgcaatttactcatacatacattgtcagctagtcttgatattgtattttcttgtcttcagtgtttgtctttgtcgactccttatcatcacgtaggctttgtttttatcttaattttataatttgtcttgcagataaagagaaatttacgagaaagaatattcagatttcagactcaacgatggactgtaccttggaccggaaaaaccattgctcaggttaattctttacttcttcaatccatgctctcggtgctcctttgtctattgcagtaatagacactagtagacagctagcttacaactgattttatcttaaatgtgcatcatctacttaaaatgggagtatgctataaagatgtattgcgcatctagtgttgatatggattgaaacatgctatctgttatgatcctaggatcatcaaagggtaaacatccatccagagggaggccggaagtagaacagcggtatgatggagggcctccaactggagaggaatagatctagaatagctggccatatgagaggccagaactgcaattagaggctagaaacatgttcagtcatctttccttgcttaatgaacatagatacaacctcatccttgtatagatggatgatttctctaaaaaatataaatagatctgatgattgacccttaagaaacttatctctaagatacaggaaatagatgattactcaatctaatcttaactctgaaataagatacctaaaattgctgtacaggaaatctgaggctgtgttcatgcacatgaaattttacacatgaattgtaattcctgtaagcgacacttaatgtgctgaatgaatggagatccaattcaagatttttattttagcattgtactgatttgtttacatatggcttcttagttgttaggttgtagatgatatcactatcttttatttaatatttatgcaaacaaactaacacttttttccttcaatgcatgttcca

SEQ ID NO: 68745 - DNA, 4602 bp, Oryza sativa
ttgagtccccgttttggcatcatcaccacgcagtccatcccgcgggcagtctttgttggtggctggctgaccacgcggctgaagcgttgaacggcgaaccgatgcgaggagacgtggacggaagcaaggaatccctcgacggcccgcatggactcgtgggctctcctgccgtgccgtggccgtgacccaaacaaacccagaccgcgtgcgcgcctggaagcttccagagcccaccaccaccttcgattcccccaacccaatctatttattcgcgccgtcgcccgccgctctccgcctccccacctcgcgttccctcccctctcccctccggccatggcgtccaagcggatcctcaaggagctcaaggacctgcagaaggatcccccaacctcctgcagcgctggtaggtatcctcctcttcttcttcttcgctgtcccccaattccagggttcacgggcgattttgtttcttgtcgattcatcgacttcttagcgtgccggctgctggatagtggaatcctctgttgactctttagctttcgaaaaaattttgaaccaagggaaggggaggagggggaggtcatactgtgcagtgctgcaattttgtgtttgtttatggttttgctaccaatttcgtgcatattattatcccctgagcgggtgtggagctgcgttttgttataattctggagctgttaattgttcttctttcgcaaatttaacgcttattacggctggctggatagaaggatagagagctcaagcagagacgctggatagagggatatacggttttagaggttattgttcgttcaacctgcttagttaggagtataccttcgttgttttagtaatttgtggaagcatggggtagcatatctaggacatggataagtctcgttggcaatgataccaggccacaatcgttgtttacaactcaacaatttgtgtaactggaactaattcttgtgtaccgatgaaataataataccctcaatatgtgtgtgatgataattgttcttgtctacatgctagtgtaccccaaacaagacatgtggatgttgtagaattgttttgatatttctaactgaatgtgacaacttgtgtggcgaatattggtttcatgatatgttctgttcaaatgcattgcaacaattgagattggattggagtacctttgtatgactaacacgcgaaatacgcctaacaggccctgtgggagaagatatgttccactggcaagctacgattatgggtccagcagatagtccatatgcaggtggcgtcttcttggtttctattcacttccctccagactatccgttcaaaccgcccaaggtatacattccttccacttctttttgtgttgttcaggaaactgtttgtttttaggacttgtggaagtttattataagagcatcacttgcttcaattttatataatcttaaggcccttgagtaactgattacaagatatttgctgttagggctctgctctaagcattcatagctagggataaaatgtcctgttaatttcagtctcaaagtggagttctaactgatcctttacaaagcataatatacctgtaaatgttagttttgtaaaggtcctgattcactttggcaaatgtgcgttaccaattcaacaaactatgaaaatgcttgtttcttccaccaccataaaaaaaaatgcttcacttgagttcaacggtcactgtagctttgttctgataacaatcatttttcaggttgcatttaagacaaaggttttccacccaaacatcaacagtaacggaagcatctgccttgatatcctgaaggaacagtggagccctgcattgacagtgtcaaaggtgaattgatcctctccctctccaactaagtcaagaaaccctttgagacagcttgtgcatgtgcaaaagcttagcttctttgaagttgtcacatagaaactacttacttgagaagttaggcactttggcaccatagaaatgttaggaagttggagctctcatagtctctagggcttaacaaatgcccaacaccgtatatcacctgcgtgctaatctggttggagtaacttttgttttccagttgcacgaattatctaacgtttgacacaattttcaggtactcctctcaatttgttctctactgacggacccaaacccagacgacccgctagttccggagattgcgcacatgtacaagactgatcgggccaaatatgaatcaactgcgaggggctggacccagaaatatgcaatgggctgaacgacgtaggccgatagtgttctctagcgatatatgttatcttgttgatctagtgttcatgtcctgctacatgcctacatggggtgtaatttcttctgtcactgaatttatgtcaaattctcgattgatggtagaagttattgagaaaaatttcaattacctgcaatattaattgcttccttatgagcttgttcggttaatttaattcccatcaggaatgaataagagaatcagaggggaatgaatatgagaatcagaggagattgaggggatcaatttcacaactagatgtgaaaaaattctcctctatcccttttgaagaggaactaaccgaacaagaacaagacctatcgtggttactgctttggtgtatgcaaatctggagcttcgtgtgatttattttggtttcaactgtaaatagaaattttgctgctgtatttcacttgttaggggttgtgggtggatcaaaatggcagatactcttcaagttacagaaacaatagttcttctcttgaaagttactactccgtaaaaaaaaaaaaaaagacaactcctagtaataaacctagactaaaaaaagataacccctagtaataaacttggacaagtgttcgtaggtaggattgggttttttcttatggagcgggtacataggcaaattttactttatctgttatttaaattgcacaactattttcttagtcaaatttgtttgattaagtttgtagataaattagcaatatttactaaatcaaattaattttactaaaattagtatttaatatattttgataatatatttattttgtgttgaaaatattattatatttttaagtttagcttaaaaaattaaaacgatttataatatgaaacaaacgggaagagtaccatttttttcataaattacataattacttgcatgatcattatgactttatgaggggctgtactgagaggccgtacttcggaaggcctttttacggccacaatttataaacctaaagacacatgattgaagcaaaataaaaataattataactatagggttggacttctgtacttctacggttgtaggtttaaaagttaaactaagattgaagttaactcatattgataggacatatataaaacattgtacttcatacacaggtattaagaaagtagctctaaataaaggaaagttgtgattagttaagaaaagaaagtagtgaaggaattaaatataaaataattatggttagttgagatgagaaggtaggtgaagagatggcttcgttttgggataagacaccgtgctagaaataactttattttagaacggaggtagtattatgtgaccggacaaagtactacattgtggtgtgttaccattttataacttattatgtgattgatgttagtaccaaaccaatctaccacggatttttttcgtcgcttggtttgcaaggctctgtacttatgttttttccaaaaaatatcaagaagacaaaataaaatgtcttttcaaaactattctaatccgtcgcttggtttgcaaggctctgtacttattttatttttttccaaaaaatatcaagaagacaaaataaaatgccttttcaaaactattcttaaatagtagtacaaaatatgaaaatccttgcataatcaaaaggtgagcaagcagcaacgatcagattcgagggctgcataacggaaactcttttatgaaatttaactattcataacaaggtttggaaattctccaaatagcttttagatttgtcattttccctcggaggagatggcttcttaattatttgtcatttttttctcagatgacaacccatgtttaaaaatagtgtgggtctactagtcactctccactccccttatctttccctctgctagttgaccaggcggtggcgccgcacggaaaggcagatcgatgactgcgcggccctcttcctggcgcgcgctcgtcagccttcatggcatcaatcaagttctgtgataacgaccgggtgctgatgtggaccaaggtgttaatcagggtgcttagtctgtctttccactccggcctcttcgccagcggcgaccctacaataggagcatgctcctcgtgatgacccacatcctggatagcagtgtgctgaccccgctgctcttccttgccacgaaccttttctgctaaacgagaatgccttgttgttcagctcgtgctcatggtcgtcgctgtctgagacctcgctaaccataccaaggcaggggcaggggtagtaaggagcagaggatgagaagtcaccgggctgcggcttagaggaggtggagaggttggggctgcaggaat

SEQ ID NO: 68746 - DNA, 2495 bp, Oryza sativa
acttgatcgatgccatgaaggcggacgggggcgtgatggggatagggctgtcacagccaccgacctccactccaggccccgcatgggcctctccgcatggcaccgccgcctagtcaactacggaagagcaaagactagcaaatgcgtaccacaccgtttttcactatatgtagccatgctttgatatgtcatgtgggtaaaagtgctaaatagtaaaatcatatctttagagaataaaataagagcaactctaataaggtatttgaattattgtcaaatctaatacagaaaaattgtggaacggtgtcccgtcaatacaggataaattaaatgagtggatcaatcttatcccttccctttctcttctctatccaaaccttcctcaccgccttcgcgttcgggcaagccagcgaggtagacttggtggcggcgatggtgctgcagcagcagtacgccgtggcgggggagcactggccgcggaaggcagcggaggtcaacacaagctgggactcgtgcatcagggagtaggtatccctagccaactcctcctcgccgaccatcctctcctcgacggccacaccgaagccgccgcattgttcgtcagcggcgcactggcgcagagcgccttgtactacagcggcagcgccggcgctgccttggagcccaagcaagaggtggacatggcagttgcgcccttctcctaggcacgcccggtcaagcggagctatcatgctcctcgccggagtgtgtgcaggtatatcgtgaaatgcaacctccacagtcgatacttgtaagtaccatgtccgatactggtatctttggtatcatggctgatacctaggtatcagaccccggtacttgtgggtatcatggcctcaaggttgtcatgcagacgacgctcgaagctatcgtgcttgccatcccatcgcttctgctcgctagtgttatgttcagatacggcacgactgatctggtacctcgagggtataatgcctagtacctaggtaccagctagtattcatggtaccaggtgcatggtatcagatactaggtacctataggtatcaggtggtacctgatacctgatacctatggtaccacaggtaccatgtcaaagatgtgggaaggggagcatgccgtcaccgcttggttgaccgccagccacatgtcattgcctcctcttttgttctcccttcctcagttcctctcctcaacgtatctctcctcttatttgttgttgatgtcggtgggggcaaaaaggtgaggggtcgccgctagcatgggaacaagaaaaacgggggaattagattcataatgtattccgttacaacaggatcctgttgtgtagttgccctcatctaatagtaataaaatagttaaatttcctaagatgaactgctcgagcgaatagtgaccatcacgttttctccatcttgctttggcccaaagtgacgagcaaacgaaggaaagaatgaagggaagcctctccagaagcagtaagtagtattagcatctcctgtaaagaccatttacggtagtattttgttcctattcaagtttcggcatagccgtaatactttgtttctagaagcagcagataattacaagttttctttcttatgtttcaaccatgttagaatgcatatatttcaactaaaaaataatttatttactattagagtcgcggaatttttctcgtgtcccaaatggacatgagattgcatgctccctccattttcaagtagctatcaattctgactttaccatgaatttaactaattactctaaaatggttagactaaattaatggagtaatacaatttaagaatttatcatcctttcaagacttcgcaaatatttcgtaaaaatgatgagttgtcaaatttcgaactgaataattatttaaaaagagaagggactacaaagatcggcccttaatctaaaatcaaattttgttcgtttcaatgataacctctttatagtgagcttattgaaacagtgtagcaaaatttacaaaaaggagagagtgaggccgaagtttcaccaaacaacaatttgcagaaatcaaaatgtaatggagctgctctgctcttgtcatcaccgggtgtacgtgcagctgtggttgggccattgccgttgcttgcattgccgggaagcctttgatgcttttacaaccacctatcccctccttccaagcttgtgccccaagtgacaaaagcaaggcagacaaaattttttatgcaaaattatattatatattgtgtattattattacaacatgttttggtgatcctttttagcttggcttgatttaatttgttgattagatgtgatgttatgtccctttgttaggtcgatgcaacagccaacagctctccggcatatgatgcatctgacaacaggttgatgtgttgcacttgtacagtgtgcctcggctgattggtcatcttgagtttcttttttggggctgccttgtatttgttttcccttttttg

SEQ ID NO: 68747 - DNA, 1391 bp, Oryza sativa
tcagcagcgagaggagttctggcgttcccgaggtctttagagagaactggttgagagacccccgtcatcccaaccaggttttcacaatacacacacagcgcgcaataatcaatatatttacctgcgcctcggtaaatattacaatcgccctgctcggcgtaaatttgcctcctacgcgaggacttaaagaagaaccattgtacagaggtaccacctttgctagataacttactttgcaaggtctgtccccattctagaattgcggtcatactcgttcgttcttcacatgtacttggcaatcttatgtcggttggaacagtactagccacccggaaatcaaccatttctaccgtactgttccaatctaagttcattatgttttatgcaatctaactaggcatgactaagcaaaatctagcatatatctggtttgctatgttcaggttatgcatttaaaatcatgtatgactaatgcatagaatagagatatagaatatagggcatttatgctcaaaggagaggaataataacttgccttgctccaacgcaaacaaatccgagataggcaacctgattatccgatcctcgaaacatcacaggttgccatccaaaagataatagactctactaagaaagacgaagaactaaattcaataaaagccataaaataacaagaaaacgataaatggttaggagggatagggtttggttgtgtgctagtcgatgctagagcataacgactaggtttggtatcttctctagctggtgtcaacagacaacataacggctagagggataggaggtttgtatgggtttagtggggcggaagtgttactctgacaaccgtgagtggcggcggagcggctaggatcacacagagcccgagagctaactgtgcggcgtgctgtggatgtcgagggaatagtgaagctccgaccgttgtacgcatcaaggcgtggggtgccaggagcagcacttcgaccttgggtttgggctttgccgggctttataaccaacggttcgacgttggggatagaaaaccacgaacgtccccatggaaggcataaagttccaaccggcggctttttagtggctaaaagggtaatttgggacaaaagaaaatatttgaaaaggcaatataaattcaaacgatatttgaataaattcaaataaaattataaaatagcaaatttggtgtcaaaagatagggtttgaatttagataaatttaggtccaagttttatcggaatcggatctatggtttggaaatatgggcttctaaagattgggttttgaattaaatctagaaaatatgaaaatgtactgttcatggacccacatgtcagtacctgctcttttccttttctctctctccttctcgtcttcttctt

SEQ ID NO: 68748 - DNA, 8103 bp, Oryza sativa
agccagtccttttcttgcgctgaaatatcaggaagggcctggtcgtaagaaagactaggaaccagaagggagtgcaaaacattttttttctgaacaaaatgcatcaaagtggtttgggaggaaaaaacgatagggaacacaatccaacattctacaccagaattttccagtctttcaaaaaaaaagggggcatgtcttcacatgaattacaatccaacgaaaaaaggaaacaaaattcagaggggcctgggcctgaatgggaagttttatattcgtgctgcgtctaaattggaaatttaagactatgactatccattttagcacaactcaataaattataaagtaaatatttcttacaaataaacagagccgtcctagctcagtggtagagcgcgtggcttttaaccacgtggtcgtgggttcgatccccacggacggcgattcagaattttttgaaattattttgtagttctaattggaatggaatgtttgcaaacagtaaaatatggataacccagaggcaacaataattctcaaaagttccaaaacttaacagttgcagacaggctaccaaatgaaaattatctacttcaacattgactgaatttttgccccacaacagaggcgcaaataataaaaaagtcgctatccgagacaggaaaataattcttacagccttacactacaattacaggcaaacaaaagaaaacgatcaacctgaacattgaccgaaaaatttttttggcccacagcagagatcagccatgacaggggtgggacaaagcaaccacatggttggtagcttatacagcatgcaaactacaagaaccccaatctactccatatcacaagcacatggcaagtagcacaaagcaggtgggatacacacatataatagccagaacaggggcagaagcaaatcacaatcgaatggcagaatcattcccagccaatgaaatcaccaccaaacatgttgataaccattatgtcacgcgtacaaaaaaaaaatcagagcactcctcaacctcacctaaattctgtttatcctcacatagctagctctactggtacaaggattagaggattgtaggtgcttaaaatagcttgtatggagataaggcgtccagcggatggatgaggtaggtgagcacaagggccaccagcatcagcacatatgcaattccctggtcaattgatgtgcctgcgtgaatatattattagcagcaggtatttgcagggttagcctgatggctcgagaaaacaaaagaaaaactggccacgaaaggacaaaacagaaatgtaagaagtttggatcattgactgtcagtttagaaattcactaatttagacacgtggaaatgagctcaacatttgaaatcgggcgccttgaagagacatgcactctagatgttctgggtgaaaaataacttttaggactaaaataattcaggctgcttgaaaatttctgcatagcatccctaaggtttgaatgtcctgtaccaagtcatccaaataataattcaagttccaacaagacgtcactaatccgaaattgtcgtgatgagtagcatgaccgatagcaattgttttttgaggcaaaccaagagcatttttttctgtaacacgttgcaagagaactaatcctaaaagaaaacgaatcaaatgttttgcatatggtaaaacaggaaaacctatcggatttagagacatttaacttctggagaacctgaagtcacttttaggcaaacaaaattcccggcatccttcaaatacaagagtgtaaacgagcagatgctaggtatcatgcattcagtggaagctactcaatgaagagcgaatactaccaatgaaaatgaagcgcaaactaacccaacaagtacagcagaacaaaatacaagattcttgagaggtggacagcaagcacccttctagtgtgatctatcacagcatttgtgctcactgctcatcgatgaatagcactttcacatatggacacacaatgtgaggattctcctagctgttcctttcaatcagtattgcccataatatgtaccagaatacgtacaatgaacacgcacaaaacatttggcaagaacaaaacttaagtgaaaaacttgacagagacacattcagggattccatgtatatcacaaaaactgaactttctcaggaaattacagcagaggccatattcattttgtgcaaataatgaatcaattattacattagtaaaaaacagtgttttagcggcaacattatttgatcccataaaaacagttgcttgtgaaatttgacacgctaaaaatactgaggtgttcaccatcataaaaatattcgtaaacagtcgcgacccatctaggccttccgaatcaacgtgtacgagtcagagatgtcaagcatcataagatcatagaagatcttctatataccaccaaaagctgcagccttaaaggtctaatgtaattaatttatcaaataattccgaagaattcattagaattccacgttaacttttacacgaaacatggaaaatttcaatactctgtagttccatggaaatccttatcaagcttttatcggatgcgcggacaaaacatgctcccaaacaacaaactaccttgtaaattactacatccatcctaaaataaattcatttgtcactcacctcacatatatcaatacgaaccaaaaatactataatacccctgttttatcaaatcccaatgcaactatttattactttatctacttctaatataattattttttttattttcacaagctccgatgcaatgattactctagaaataagtttattttggaacgaatggaacgatctaaaaatgaacttattacaggagggagaaaatctttgatcgtgcaacattagtttttttttaagaacaagtataataatgagctataagtctactgtaagcttatgtggaggagagaggtaacaaaaaattatcattttgaaacttactccatgtcgtttcgaaaaacgaaacctactcctacatcaacaacgagaaggtcctaagaagcagaattaaactacgtttttttataaaaaaaaaagtttcatcgcactccggatgcatcctttagtaccttcgtttcgcgagtctcagatgatttttttttctttcgtggacgagaatcgaattatggcgtggggcccacgcgccagccacatacacaaatgaggaacagggggtggattgaaactgccgagggagttctcaccgtcgctggagggcgcgggggcgggcggctgcgcgggggcggcggcggaggcggaggctggcattgcgattcccaccaccaccacggccaccgccgctagccccagcgaggtccacgccgctgccattccccctcctcctcctcctcttcctcctcctcctctccgcggcacgcacgcacgctcgcgctcacgcaagggcggcgcggcgaaccggaccggacacaccgtccaccaccggaggagagcagcggcggcggcgcggcgcctttccccctctctctctctctgtctcctctccgcccagaatttcagaacttgtacgaatttgctatctgctcccctgaaatctcgggctcgggaacgccaccaacgtgcgcgccgcgcctcgcctcgcctcgtctttataggcggcggcatcagtagcagacgacccaatgacatgtgggcccaggaggcggtcggcactgtccccacccaatgacacgcgggaccaccctgccagcgaatcagtgaccgacgggtggggggcctctgccagcgaatcagcgattgacgggtgggggcggcatgacacgacgcgagtcacgcgtaggggtggcaatggggccccggtacccgacggggaattcctctattagggggagttaatggggtgaaatcctcccccacggggtaaagaacggccaaatttaggccccatcgggtggggcgggggtaggagcgctccactgctcccaggccccgtatccccatgggggcccaagccatatcagcccatgagcaaattccttaggtgtcagtccattttagaaaataatagcccaactctaggtccaatgagagaccatatatatatggagaaaccctaatcccgtccccactcccactcccactcccggccgctcgtcacagagaattttcagaatatgccatcgaattcgcactactttcagaatatgccatccaattcatgctactttcaaaatacgccatcggagcacgaatttcctttgttccgtgccactccgtctcttccgtccgtagcaccgtcgtcttctccgcccggcaccgccatcgtcagtccgccaccgcccgcgccgacgccagtccgtcgccggcatcgtccatcctcgttggtgtccatcctcgttggcgtccatcgtcgtcgtccacggcatggcgtgggcgcggagggaggcgagcgcgacgcgagtgctagcagcggggcgagcgcggccgcgagtgctagcagcggctgcggcagcgggcaaagctgactgtctgcgtctgtgtctactaccgcccgggactggacctcgtgtgcgcgccttgtgaattttgagagtagagggcggccggtaaaaactccctgtatgttgttgctgctgcacgtacttggtccagatgatgagtgtgaattggcaaggacggaagggaacggaatgggtaggtagtagttggatacttggattgttcagaggaggacgtcggacttggcggggagtcgcttgtagaagttgaaggggacggatggcgagcgcggccgcgagtgctagcaacggctgcggcggcgggcgaagcggcggctgcggctgcgggcgaagcggctgcggctgcagaatggggcggctgcggcggcggggaaggggtgggggagaagccccttgtggatggtggggcgaggcggaatgcggcggctgtgtacaatggggggcggcgtccgtggtggtggggaggaagttgaggaggacgagggcagggcaccctcgccgacatgctccagccggaggacgcgatgcgcgggcggtggaggacgacgatggcggtgacggcgaacagacaacgctgtggctgacacgggcgcgcgcggcgcgggcggtggacaacgacgatgccgacgactgacgccggcgcgggcggtggcggactccttccctccgcgcccaccgagccgtggacgacgacgacggacgtcgacgaggatggacgatgccggtgacggacggacgccggcgcggctgacacgggcaccggcgcgggcggagaagacgacggagctatggacggaagagacggagtggcacggaacgaaggaaatttgtgctccgatggcgtattctgaaagtagcacgaattgggtggcatatcctgaaagtagtgcgaattcgatgacatattctgaaaattctcctggtcacaaaacacaggcgcacagagaagaacacatcgcgtttttctttctatccactgatccccaattcccccattcctctctttctctgaacaagtccgatcggccagggcgagggaggccgccaggacgccagcgaggcagcgacgtgcctccaggctgcgcgcccgcccccacgccatcgccgcctcaaagctccgtcgtcgtcaccgaggagtgacgccttcaggctcccgcgccgcgccctgaccctctgccgttgtgcgccttgctcatcggccgagtcgccgcctgccaatgcaacgcacagcgtgagagctgcacaacagccacatgcaatcttttgatttggttctaccgcttgatcttgggaattggaatgaatcatgtaactgctctcttttgatttatggatctgatgtatgtctttattaaaacaaaaagacaatagatttgtcatctgtgtgtgcatgtgtaagcattttattctcaattcgtacgggacttctgtgtatccattatctctaattctctacttccaaattcctaaaattttctcaatttgtattcgtgtctcccttctctctattcccaaattgatgcacagtgctgccccgtgtttcctctcctcgggtgtgcgcccccgtcggagccccgcaaccccggtgggggcggggatgggggaaagattgcccccgatgacggggatggggacagggggcgggggatttccaactgcccggggacggggacgggtggtcacaatccgtcgtgccatccctagtcacgcgacacgagtcacacacgagaggcatatcaccccgcgcgccgcggccccatttgcccgggctccagctcgatattaatctcgagccaatcttatggcagtcctaacctaactccacaacactacttgtttaatacaaacaccatttttatatacttaaattcaatgctacttgctcacatgatgtcttggatgttgtgtataaaccatgtcccatgtaagatttgatttccttctctttcctcatttactcacttgatacatcattttttattttaggtgacagcttatttaatattttctccattccaaattgatctacatatagttttttttaggttattcctaaatgattaatatatttatgttcattcattaagtttattcgttatttgtgcattgaagtaaatagacattgatgcatgcatctatgcacacaagtattttattacccacatgcaatatcttgatttgctgttggctaggaaatagtggggatggtgcatgcattgagtttattgttagaataaatatagtatgagagagttattagcttttcttggtcttagtgtacctataaaatatgtagatcaatttggaatggagggagtactatgaacaccatctagttattgggttgggaatagtttaattattacactttcaggcttttaagctactccctccgttttctaatgtaagactttctagcattaatcacattcatatagatgctaacggcacccgcaatggttatctataagctctctacaagagatccatgtcaccatattttcctacttgaaagagattaaatgaagagagagagcaaagctatctactaacctggagatagtctatagagaaaaacgaggcaatggattagagagctatagatacccatgtagacatactattgaggtggtttactattaatctattctattgctgagatgtacatattttatagagagcaccttactttaccattgcgggtgctctaatgaatctagacacatatatatgtctaatgcatctagattcattagcatctatatgaatgtgggcaatgccagaatgacttgcattatgaaatggaggaagtagcttggttcgaggtcaagctcaacataagcaatataatatacttcctccgtttcacaatataagactttctagcattgtccatattcatacatatgttaataaatctagacgcatatttgtgtttaaatttattaatatatatatgaatatgggtaatgctagaaagtcttatattgtgaaacggagagagtatatattaatgataatctcttgataaatataattattttttatttgatcacactaataaaaaaatagaagaaagactaagataaatctattatgctaacacatgctaatttattgtgtaaataaatattaatagatacttagaaaaaaggcccatgcattgcaacgagaaaaacagcgccaacggctaggtcaacagttgtcagctacgagagtgtcgtacggaagacccgacgaaggtgggtccattggagcagtagagctacgggctggcagagactattcgggtgatgaagctctgggatggtgatggcaggtacgagagagggtgctataggcttagttcagggttccgtgagccaacaactacaatggctctgggcaccatgaaccccccttgcggtgttgtcgagtggctgcctccttcttggcatgactctcctagtgaaaacccagttcggatggacggatgacggtggcgctaaaggcatcatgaccttcttggagatgttgtataatgtataggaggtccttgttccctgtctttgccgccttccctcggttttgttgctagtggtt

SEQ ID NO: 68749 - DNA, 10728 bp, Oryza sativa
attcctgcagccctcctacttgcttaatgccctcatctagctgcttgcaattgcccaccggccagctactagctaccaagtactaccaagtggatttggcatcattgtaacattgcagcacactgcactagagtgcatatgcatgcatgaaacactgcacaatgcctcctcctcctagctgtcactgcaatagccaatctcatgcagggtatcagagtgtactggtgctgatgcaggaggagtagatccaaaaattcttgagctgactcaacagatcagcggtccatacggcagggcacgccattgaagatggcattcaagctagtactcccagtagtattcaactcttgactttcacacagatcagtgagcagcgtcgtcgtctcagctgctgaagctgacagatgaggagttgaagactttgatctttactcaaaactctgaagacacgctctgtgttgctgtatttattgtcgtctaaatctctgaacctctctctctatcttcttctttgattagtattaatttctctcgctgcatgccataaaactcgcttgtacctgcagctgttacggaacgagaggagaggaaaaaaatggcgatgctaagctagcccaagatcgaagccaaagcttggaagctggtgaagttaactgaacgagaggttttcgcacatgcagcgtttgtcaaaggtgacaccaccgtgtttaactacgcctgaatgcgacaatcttgggagcaaaattttggcctgcagattagctcgacgtggagtggctagagcaaagccgtactaatgctttacttactcgcgtaatctcgcagatcatgacaagtctgattaatcttgattgatcctgcaaccacgcacgcgagcgggcgatccatcgatcggtcccttttctgaacctgaatatggacgatcggaaacaagattttcttaacctgaatattgacgatcagaaacaagaaacgctgcatcctttcaagccacatctgaaagacagattgattgcttcgatttaatttactgcgatgctattacatctcaacagattgattaattgctctgctcgattgatcgagatcgttgaatctgaacattattcagagtccttgccgttgattttttctgctgcagtcggtggcgtcagacaaggggcatgtactgctgcgcagtgctaggtaattccgtgcgagtgcatgtagacgtcgtcgccgccatcgtatgtacggtcgtcctacacaacttgtttagatgttgcagcatagtcctgtacctgtaaaaatacccagaacaaaaaatctctctttttggaggttgccatccaaaaagatcgagaaaaatttcccccagcctagatggctagctagaaatgcaacttgctggtcctcctccacctcgtcctcctcctcgttgttgtcctcgccattttaccagcgtatcacgggacaatgacgtccgccacgctttctcgcgcaggccaatggagctgctagctatggacttacaatggcttttatttctgttatctctcttcagactcggtaacagtagaatttgtcatatttcatattagtttatttcagactttcagtatgaaaaaagtacaatggcttgcctttcttttgtctctgtcgctaggacagagctcctatacacgtccaagattgttcctttcaaaaaaaaatttcagctttgtacttgaacaaatctgacaaagtgacaaagtgcacgcggatatatatccatgtttaatttcaacattgaccaatgcccgtgccgacacggtacaattgtacaaagagcttgttctagtttagtaggacaggtacagatcaagagattaattaatttctgggttcttttgtgcagaaagtttgtatatttttctatcataagggctttggatatatcgatcaagagcatgagcatctgcttggaagttcttatgtgtgacaagatgctctcgtctggtccgattccaacttgctactgattactggtactcacatagtcgtacatgccaagaagacgagatagagcataattgaaaagtataatcaaaatgatggtagtattaattaattagccaataagcaaacccctgtgtcctggatccaatcgccgtccaacaacagggtcagctgggattacaataagctgggtaatcatcgaacgtgtacggaacgaagaatctattgcgtcagatgatgcccctgccgttggatcgacgaacaacggtcaggaacgaccacagggttaagcggaataggtagagatcgatgaaggtgtcaatttttttaaaaatttccgatgtaagtactttgacagccgtacaaatgtacaaagcaaggagtgagtaggaaagcattaatcctctgttgcagtacaagtgacaacttatcttcagaaataatataatggttatattccagcctctgtcgtttataattaaggtgttaggacaacaaaccctaaaaacctgtttgttaatatgatcaattataaacggattttctaattaacctacattcagttgaaaactaaagtcaaaatcttgtagattcctagccttttaatattcttcacgatctcaatatacttcaataacggtggcgacaactcatactagctaattaggattcggggtggagggagagctagaaaaggggtagttccccagtttagagaaaggtagcataggcttggcagtgagcagtaatgagaagactaaggtggcatggtggcaccggcgtaaccaaagctgcagggatgaaagacggtggtaggcaatggaggtagcagaagcataagaaagcggcagttaggtgctttgtggtagtggtgacggatccaacggcaggagccatcaaaaacatatgtgaaaaacggtgcgaggcaccaactatatgaagaagatgagtgaggaaggttggaagaaatggagggagaaaggcgatggtgttgggggctaaccagaagacattgtcagcatagcctccggcgatagggaggcggacgagtagtggcacatggtgcgggagagagcggtggaccaaaaagatggcagcgacaacggaagttgcgtggttccgaggaagatgagcacgtgaagccaatggaggtggactagtgaagatcagcaaatcgtcaaatttgatagaggaattctttttgcaaatccaatgggtatataggtagtcccaattataaatgtgtgttgctttctttgaagaaatatctctttggacataagacacacatactatcttgataacgagctttctcgagccgaggctagacatatgagtgtgctctttcgaacccacgctatcgacaacttacagaaacataccaacactattaggatgggttcttttcagattattgaaacggattagttgctccatcctttaaaagatacattttctcaaaaacttttttatactgtataacttagataacttgctttgagttatttatctattaagtttattcagtaaaatgtttaactcattcctgtaatcaagtagaaaatcagctcattaatcttttccaaactgagcccaaaacaagcaaaccaaacaagttcaattaccatcatactcacaaaatccagggtaaagaaagcgtcaactctccaacacttctatgttgtcgtgtgtagacgattattcgggttgggtaaagtagtactctacatagtacatacacccctcgtactgtacaggccgtcctacataataattaaggaaaattggagccatgccattataattttgtaaagtttaagatatgccatcctaactcacatgttattgatttatgtgggtcctacatgtcattgagataccgatggcatatctcaaactttacaaaattataatggcatggttccaaattagcctaattattactacctcccacacgtactcctacaccactacgactactccagttaaatttaacagcagctccatttatatctcgctgaacgaaaccactgtagcccgtgcccggccggtcgtctaccgatgaaaaccacttgttcagatccaccctcgcggtcgtcacggtaaaagtacaaattttcccggccctccgcatgtaacctccgtacgtgtacgtgtgtgcgcggctcctcgatcgcctgatccccaactcggtcgccacaaacagcgcccggccccgcgcgcccgcggccacaaacgcaaaggccccaacccaaccgcgcgcgcgaggcgggcatggcagctatgcgcagtggagcgtgggggccagcctcgcgcgcgcgcggactggctacaccactgcacacacatacactgggtggcgcctaccacctgtcgcgtgtcgtctccctccgcgcgcgcgcactgcacgggtcgtcgcgggggcgcggctataaatacgcctcctcccccgctgcggagaggagaccagggcaagcagcagtagcaaagcagaagcagaggcagaggcagcacagcttgatcgttcttccatcgatcgatcggcagctagcgctcacagtactctcgatcgctcgctcgcgctggtccgttgattcgttgtcctagatagatagctaaaggggggccatggcatcgacgacagcgccgtcgaggaccaactctcgggtgaactactcgaacgagatccatgacctctccaccgtgcagagcgtctccgccgtccccagcgtctactaccccgagaaatccttcgccgacatcttccctcctaacctcctcaagaaggtatatatatataatcaagcaataatcctagctagttagcaacgatcgatcgatgatcatcaatcaggatcgagctagctagctagcaaatcaagaacaacaacaagaagaaggagaagataaagtatatatatggtgtacgatgatgtgtgcggcaggtgatatcggaggtggtggcgacgttcctgcttgtgttcgtgacgtgcggggcggcgtccatctacggcgaggacatgaagcgcatctcgcagctggggcagtcggtggtcggtggcctcatcgtcaccgtcatgatctacgccaccggccacatctccggcgcccacatgaacccggccgtcaccctctccttcgccttcttccggcatttcccctggattcaggtaacttaattcatgcacatgcatgaacacatcgatcactcatgcctgctggctatctatctcctttactttatttccattttccatatctcctctccctttctttcttgctttctttcttcctttttcatgggttgtttcggatgaaaaagaaaactctatttcctcaaaaaaaaaaagaaaagaaaaaaggagtttccattaattggttgagttctactaactagtactgttagttagtactcagctccttaatttactccttgtgtttggacatcgatgcaacctcatatattaaccagctacttttcatctccaaatatatactagtaccaaaattctttttcaaaaatcactgtacaaaaatatattttccattatctttcgaaaaaaaaaacttcccgtgaataggagttgtcagcatgtactcctggacgtgcacaggaattagtcacggcttaattaagcaaaactttggagcctacctggcatctaccactccttgaaaaataaatcgcatccactgtacacatggacgatgcataaccttctgacaactgaacatattcgaagcagccagccaaatagttcatcctattcatcaagtagctaggacacacaagttgataaaagagtatataggactggctcataataatgccataaaatatactttccttttttttttgcgaactataaaatatgttttctgcctcagcatatttgtccttacctagtctggcatgaggccagtagcatgcatgaggaattagcaagctgacaaaaaataattggcattactggcaacatgctgggctaatcacaacatgtgaacaagcccatcattcatcagatcgaaccaaggctctaggtaattaaaaaaggacaaaattagaacaaaaaaaaaggagaataagacaatcagtagtagtagtactttttagatgagaaggataaggcaacttgatgcatgatcctctcccatgattaattagctcataattaattcggcttaccatgaaagcctcaatgagttgccactaaccccaaccaccaccacgtaccagcctaagctaaggagagggggtttgacattcgcatggttcccttgttaaccatgtgatttttgatcattgatatccttaatatatttatatgcatacatacggccttgctccctagcaaccatattcccaattattgcgaagccgttcttgcttgtaggtcacaaatacaacatctcacgtacgtacttgagctaaccaaaccatcggccgtgccaacaatggcattaaagtggaatagttctggaatcagccatgatgatagaacccaaatttcaaaaaaagtataacttccagcctctgcaaaaccacgaccatagataataatgcctatatatgcttagaaagttgccgggctttagctatgaaaggcacgtgtgcacgcttctgaatcacgtacgtgccctcaatctgccgtgaaaccacgccggccgccctttcggcgagaagaaattattcgatccgatgcgatgcgatagatgctgtgctcgctcttgcgtgccagtctctcgccacacgcgagcatggctagctaaggatctatagctaattaagctacttgcagcatgtcgatcaatctgacccaacttgcccatacagttagccagccagccatattgcatacttgcatgtctgaatcctgatcgatctgagtgatgcccagagatagatagatagatagatagatacgattattcattctctgcagcgatagatttagatcaagagggggagttcaagaagactccaaagattcgtacgctcttttaattttttttctcccttttcttcccatgtctcgatcggccgtataatcgatcggtcgcgaggagcggcgtgcattgcgttcgcggtcacatcacgatcgtggagctagcaatatatatagctttggttgtgtggcgttttcgatcggatcctctaagcaaagcataatattattgagcgtagtacactacggccgtcggccgtgtggcttatacgtattcgcggctgtgtgactgtggtgtggtggtgtgtggtttgcaggtgccgttctactgggcggcgcagttcacgggggcgatgtgcgcggcgttcgtgctgcgggcggtgctgtacccgatcgaggtgttggggacgacgacgccgacggggccgcactggcacgccctcgtcatcgagatcgtcgtcaccttcaacatgatgttcgtcacctgcgccgttgccaccgactccagagcggtaaatataataatacatttactcacaagattaattaattggcttcttaaatctgctgtaaataattaattacaaaaaaattaattgagatttggtttaattttggttgcaggtgggtgagttggcggggttagcagtcggttccgcggtttgcattacgtcgatcttcgcagggtaattaatgaatcgattactaatgaccacccctaaacttgggaagaattaactagcaccggattagttatttaattaaccgtaatcaaaatattttagtaaccactagtacgctgcatgtagtgggtaatagctaaccatcgtggcttttcaacaaacctctggaaaatctagcttagctgacgacattctttggtagaatcttcgttgttcagcccacataattatttttttttctacagagaatttaaagcgccatatttataacaaggtgtcacacacagactgacgtagagcagagccggactcagatgacttatattagtatacacagtacttagatagttaggttcaaggcacatgcaccaagctagctatgtctctcacatcgatcagccattaagctactgtttaattatgtacttcacaaaacgacgttgctaacatggactcctgattagcctgtacaaaccattctttggacctcctaacactcacacacattattcctgaccgtatcactacaaggacacaacttgcatgtactgactgaaactaaaaaaacttctaaaaaatatataaaataagaaaaggggtaattaaccatagtataaagtagagacgagtagtgaaaaagatcagtatgtgttgattaatggggatgtatagctgattaagacgcggcgaaatacgacgcgagtggaaattgcaggccggtgtcaggaggatcgatgaacccggcgaggacgctggcgccggcggtggccagcaacgtctacaccggcctctggatctacttcctcggccccgtcgtcggcaccctctccggcgcatgggtctacacctacatccgcttcgaggaggcccccgccgccgccggcggcgccgccccccagaagctctcctccttcaagctccgccgcttgcagagccagtccatggccgccgacgagttcgacaacgtctaatcgccctgacgccatggacccacaccgtactgctatactgtatacgtatatacatatgtatgtatgtactgcacgcgtacgtacgtacgcacgtgcacgagcgcgggaagccattgtttgtacgatcgacgactctaccaagtcgaaatgtaatgtgtacggtgtctgtgtacgtgtggtggtgctgtgtgtacgtgggcccgctctgcttgaagaagaagagagagcttgagctagctatacgtgtatacatgtaccgtgtactatacgtacgtgcgtatttgtcttttttttttcctctcttccctgcgcctacgtgcgtatgtacgtacgctttctctcgctggtataatcagctggcgatcgatagcggcaaaaatatgttatgtgttcgtgtcagtctctttggctttgtattaaaaatcaatctgagttaatgaaggagctgagctttgcttgtcattgatttggggtgaaatttttgtgcggtattagttgagaatttgtgggctccattgaagatttaccttttggttttataacacttaccaatatagcactatgtccctagcctctcactatttatttttatggatgcatatgaacagcttttgtaaatagagatattactaattactttttgtctgcttattgttacctgaagatcaatcatagtgggtgctttgatcgatcatttggtgatgatagcaccatcatcaattaaaagcatgggtttaaacatatgttactgacagtttaattaattaattaagtcttgttgactataacttaaaggagtgaaataatttaaaatgacgactctgagatgggaattcaactactgcaagtaaccctgctggtttgctgctcttgttttcatcgatgcttgcaacacacacacaatcatgcacacatgtcgttaattcgtaggaagctgagagatttggttgttagaaaaaggtggatgaaggagaccagcagcaaagttgctttgcctaggcaacgtgaaagcacctgcagagtggtcaaaattctttccacttgacacagtaacattccaaaacagaaaaaaaaaagagaaaaggttaagaagcttcctcccactatatgaaaaaaagaaaagaacaacagtgtccactgaagtaaattacaaatagtcaaatactgtaccttcaataatacatgtgggacagaagcactacaagaaaagaattaagagcaggcaagtgattgttattttcatgttcgtgatttatatgttcttccactatacctcttgtcatccatgactcctgctacttgatgtacagggagaaagttatatccttttccttgactttttgacttggttaaaattttgtctctcttctccaaaatcacatcgtttgttatttatccgccaataactctataaactggataagagtttgtctcttcgcttgatgactattttgacttaaaaaaataaatattagggaaggacctaatatcaaataaactagcatggtgacccgcacagatagcgcagctaatatcactatattttttctcaaataatagcttaaatatttttcacatttatacttaaatatattaaaatggcaacaaaattttaaatctattatattattaaaggaatagaaaaaggagcctccatattcgctctcatggcctagaaattcccacattgatcggagaaaaagaaaaaaacagagtccatataggaatacaatttagaaatagctgaaattcggaattaaaaaacaagaaatattagaagagaggactagagtccatatagaaatacaatttagaaatagttgaaattcggaatttaaaaataaggaatattagaagaggagactagagtccatatagaaatacaattaggaaataactgaaattcggaattaaaaataaggaatattagaagtagagtatagagtacacatagtacatatagagtataagtaaattttatttcgggctactatattatatatgttcaccaaagttgcacaatagatcatgccagactcgccaagaagaattatatatgtcctgacgtaatgatttattatttttaactagaaaaaggaatctattaacttattaaaggaatagaaaaaggaacctccacgttcgctctca

SEQ ID NO: 68750 - DNA, 7579 bp, Oryza sativa
atgtagtaatacaattaagaaataatagaaattcggaattaaaaataagaaatattagaagtagggtatagagtccatgtagaaatacaattaagaaataatagaaattcgaaattaaaaataaggaatattagaagtagagtatagagtctatataggaatttaaaactaactaaaattagtaataaatataataaaattaaaagtagagtttagagtttgtataaaaatacaatttacaaataactaaaattcaaaatttaaaaaaacatgggaagaagaatctaaagtcaatacataatacatgaatacaatttagaagttactgaaatttaaaattaaaattaaagaatattgaaagattagtttagagtctacatagaaatacaattagaaataataaaaattcagaaataaacataaataatattggaagaagagcatagagtctatatagaaatataatttacagaaaattaggaattaaaaaaaagaaatattaaaagacgagtctagagtccatataggaatatatataatttacagataaataaaatttgatattaaaaataattaataactaacacgtatataaaatacaatatgaatatgacacattagtagttttgtaaagttattgcaaaatttaaaattatgtttaaatataaagttttaatatatttgaataatataatgagaaaacatatatgctattatatgagagaaaatataacaatgctagccgcgcaatctgcgcgggccaccatgctagttatgtagtaactcgatcaaactaacccatgcgtgacattcatattgaactatatatatatatatatatatatatataaaatatttattatgtattttttaattttaaattttagttacttttaaattgaaattctatatggactctagacttctctttcaatattccttatttttttaatttctattttccattatttataatttttattcctatgtggactctagactcctcttccaataatcctttttcttaattccgaattttgttatttgtgaattgtatttatatatgaactctaaatcttcttttaatattccttattttttaaaaaaattctaattttcataatttgtaaattgtattactatatgaactctatatattttctcaatattccttttttttattcagaattttagttatgtacaaattgtattgctatatggactctagactttttttttcctaatatttctttttttaaaaaaatgaattactgttatttatcaaatgtattcctatatggactctaaactcttcccccaatcttccttttttttcaatttcgaattttagttatttttaaattatatttttatatggactctaaattcatttttcaatattccttattttttattctaattttcagtttttttctaaattatattctatatggactatagactcctctttcaacattccttttttttaatttggaattgtagttatttctaaattgtatttatatgtggactctcacctgtactttaaattttcttattttttaattataaattttaattagctctaaattgtataccttatggactgtagtctctttttataatattccttattttaaaattctgaatttcagtaatttttaaattgtacttctatatgaactctatcttttctttttttctccgattaatatgagaatttctagaccaatgagagcgaacgtggtgactcctttttctattactatactaataagttaatagatagaaggggtgagttttcaaacccaggtcgactagcccaccaccttgtatagctagccgaaagacccctagtcttttctctctattttgacttccatggcacctaagtttcttgtcgttaatgtacaaatgagaaaagttgcatgtactttatacagatgattcgttgtagagatgactagttctgtagtagtatctgcccctcaactcattgacttggttaaaacatttttgtttggaaaaagtatgaattaccactcttaactatcgcggttgaccgaattaccctcctcaacccgaaaagcagatattactcacactgaactttcaatactggacgaattaccctcttgacccaatccagagcggttttatcctatttagcgtacgcgtggtaatccggtcaggattttcttttaaaataacggtgggacccacctatcgtacctcctcttcctctctctcgggcgcaaggtgtcgtgcccctcttcccccccccctcgctctctcgcgggcgcgcgggggcgggcaaagggagacagcgtgagacgcgggggcagaggccggagctaggtggtgagcggcggcgggcacggctgggtggctccgaccggcggcaggagagacgggcgtggctaggtggctccggttgatggctaacggcagcgtccgcccctcttcctctcttccccatgaggtgatgcaaaatccgacgaggagcctcaccgccgccattgcctcccctctactccttgggcatggcgggggcatggcggagaggcaggcggtggctgggaagctactgtgggagtggcgagggcacggcgggcggatctaagagacacttcacccgtcccccaccgaatctcccatcgccaacgccttctctccattttgcttccacctccaccgggccaccgtcgtcggccgccctacacaatatttgaccccgccggtgcgccgcaccctcctccgactccttctctaccgctggcctccctcgcccgagcctaggcagcatctccaccaccacctccctaggacaccaacgacgttgctctagctcctccatcccaaactcgagtagggatgcccgggtcatcgacggacgcctccgctcctccctccacgcctcttcatcagagttgcgactgccgccgactcctcctctccactttgcctcccaccccttcccggtggtgcgacgacgatgtcccgtggcatcaagatgggctcaagctcctccgccagcgtcgtccccaaccgagagctacccgccgtctccagtaccttcctcaaggggatctcgagctcctccccctcgtccccattgccgccgctgacggagaggccgcctcctccagtcctcaccgacgacggagagtccacctcctcctcctcatccgtctctcccattgagcattagagagagaggtagagatactatgaagagatatgacacatgggcccattaaatatttttattatttttttgttgatcgggtgccatgtgtacgctactgagatcttaaaccactccaatctatgttagggggtaacttatccggtttagaaagtttggggtatggaatattcggttttatagttcaggggttaattcgtactgtcacgatagttttttttagggggggagttaattcgtactttttttctttttgtttctacctaaaacacaaaaaattggataagactatagcatctccaccaatttcgtcgtccttttgattttaatgacaatcaggctggatggcaatggagagagtcataagtttctctcctattgtaacaagtgcccttcactgcaaacttaaattcaactccgcgttagccaaaaccaaaggtttaataggttgagggataaaatgtaactaattaatttgcagaggtggatgatcagttctaacgtgtttggaattaataacgaacagaaaattttaactcaaacaaagtcatgggatttctttatacaaatccttcctagtaaatgttttggcataatctaattaagctatcctctatatcttttttatcatcgttaatatataagctggtatgaaggaaaaaattccagaaaaatccttatgcaactatacaactatgttttacatagaagaaatcaccacatgcacattgattatgtgtatccttgattatttagtgcatagtccaaaggttatattttcttttatcataaaacaccattacacacatacacacatatgttacaaccagagttgcaagcagggttgtatcttaaaattttgggccccggtgcaaaatagacttgtagttaaaaaatacgagatagaagagtaaattttatttcgggctactatattatatatgttcaccaaagttgcacaatagatcatgccagactcgccaagaagaattatatatgtcctgacgtaatgatttattatttttaactagaaaaaggaatctattaacttattaaaggaatagaaaaaggagcctccacgttcgctctcacggcctagaaattcgcacattaatcggagaaaaagaaaaacagagtacatgtagaaatacaatttagaaatagttgaaattcggaattaaaaaaataaggaatattagaataggagactagagtccatacagaaatacaattgagaaacaatagaaattcggaattaaaaataaggaatattagaagtagagtatagagtccatatagaaatacaattaataaataatagaaattctgaattaaaaataaggaatattagaagtagggtacagtgtccatgtagtaatacaattaagaaataatagaaattcggaattaaaaataaggaatattagaagtagggtatagagtccatgtagaaatacaattaagaaataatagaaattcaaaattaaaaataaggaatattagaagtagagtatagagtctatataggaatttaaaactaactaaaattagtaataaatataataaaattaaaagtagagtttagagtttgtataaaaatacaatttacaaataactaaaattaaaaatttaaaaaaacatgggaagaagaatctaaagtcaatacataatacatgaatacaatttagaagttactgaaatttaaaattaaaattaaagaatattgaaagattagtttagagtctacatagaaatacaattagaaataataaaaattcagaattaaaaataaataatattggaagaagagcatagagtccatataggaatataatttacaaataatattgaaagacgagtctagagtccatataggaatataatttataaataactaaaatttgatattaaaaataattagtaactaagacgtacttcctccgtttcatattataagactttttagtattgcccacactcatacagatgctatttagattcattagcatctgtatgaatgtgtgcaatgctaaaaagtcttacattgtgaaacggaggaagtatataaaatacaatatgaatattacgcattagtagtttcataaagttagtacaaaatttaaaattatgttgtcattttaatatatttgaataatacgttgagaaaacatatatgctattatatgagagaaaatataatgatgctaaccgcgcaatttgtgcgggccaccatgcgaccatgttagttctttagtatttttagtattttgaatgcacgttcatatcatcattatgagctacagttctttttaggtagccatatatattaccattgaacacttatcaaaggtgaagaaaagaagcttgttttaaccaaatcggtaagtaagagagtgaaactttttaaaattagaacgagaggcctttaagcacgtttgaacgcattagcatggattaaaatttaaaaatactggaaccttgttccgtcgtccaactcgcgcgcacgtgcttatcccctcccctagatgcaatataatcgtgcatgcttttatcagctgacaatcctatatatgatcgacacaaatcacacacacatatatatactcgcaaaattgaaacactgggcgaacggagaggaaatatttctggaagacacagtggtaggcgttataagttggagaggaaaacgaaagcgcatgacaatgccaccaccacacgtgtacggcatttgtgatcaagtccacccaattaaagagcacggcttgttgctaacactgcagtggcaacaagtagtcttggccatgttctttcctcacctttcccaactcacctctggttttccacgcgcacgcttcccaaactactaaacggcgtatatttttttaaaaaaaattatatatgaaagttgctttaaaaaattatattaatctattttttaagtttattttagctaatacttaataaatcatgcactaatcgttgctccgttttacgtatcgggaatgagggttctgaacttggggtgcttggatcgagggactatacgtgtccatgtcacatcggatgtttggataataatttggagtattaagcatagactacttataaaactaattaaataaatgaaagctaattcgcgtgacaagttttttaaatctaattaatccataattagcacatgtttagcctaattaatctataattagcgtatgtttactgtagaatcacataggctaatcatagattaattaggctcaatagattcgtcttacgaattagtccatgttttgtcaatagtctacgtttaatacttctaattagtgtcaaacatccaatttgacagggactaaatattgtctcatccagccaaggtttattagtgggtacacccaaagcattttttcccctactgaggttgacccaaagctgctgaataaaatatatgaggaattgtgtagtgtactttgaaagcacagcgctcaatcttttaaccgaataagatcgagatagatgcagaaaataaactactgaaagtataattaaatatcattgttttaaaaaaatatgtttgttatgacttatgtttaaattaggcacaattaacgctagtttgatatacaccaaactctaatagtcagatataacacaaccttcacttcgagacgtgcgtgcatgtactatatcatttttcaataaggcgccagaaaatggttcctaatgatctagtaggaagaaataccacaattataagtggaaaaaaaggagaaaactccaaacagtccatcatagctgaatcaaattaattatagcagtataacattgatttttttaagtagcaaaaattaacatagttacatctctagcctttgacttcaagcatgcaaccaatgattctatgttaaaagtttaaagaaaacataacgaaattctaacttcctctcacaagccaaaataacgataaaaaatcacaactgcatatatagcatgctaaataccaaatattaccatcgttataaaatttagtaacctaatatcaaatatgatatatcacagtactacaaatttagacagagactgtacaaatttatagttctaatatatatctcatttagtattaggttattatattttgaaatagctagagatggtataattctttttcaggaaacctcacacgattatgtgtgggaaattcaaccataaatatgtcctcacaagaaaaagggcatccatatggtgatcaacatcatcgaattgaagtatttcctgttccagagttgaccggctagtgcagtccaatagtaaacacacatgcatatgcaggtcgcacatatctgcaggtccacatgaggcaaagggacaccaagacac

SEQ ID NO: 68751 - DNA, 6974 bp, Oryza sativa
  unsure (1)..(6974): unsure at all n locations
attcatcgtcccagacaaaggagctagctatagcctatagctgactgagctgagctgagtgcgccgaggcgtcacacaccgccatgccgcgcgcgcgagcgcgagcgatcgatcaaccgaagtgcgcccggctgggcgccgacccgcccgaaacactcgctgtcaccgatcgcgcgcgcgcgcgccgtccccacgccgccggagggggggggggggggggtcaattcaatcatgcgcgcgcgcacgcacgaatggacagaagaagcagctggatcgatcgagcgagcgagcgacctgcgagctagcgcacatcattcctttgcccccggccggctgccaacatcaccgggttacgtcgcaggagggatacagggtttctggtcggggttacagtgacggggatgtcgaaatgtccgcccaataatatccacattttcgatttcaggatttgcatgaaaacggtcggcacatgattttttttaataatatttagtacaataagaaatgaaattacttctggcctttgcacattaatggtaagggatgcacacgacttggaaaaaaaatactccctctattccaaattgatctacatatagtttttttaggttattcctaaatgatctatatatttgtgttcatttattaagtctattcgttatttgtgtattagagtaaatggacattgatgcatgcatccatgcacacaactatttataatccacatgcaatatcttgatttgctattggctaggaaatattggggatggtgaatgcatagagtttgttgatagagtaaatatagtatgagggagttattaacttttcttggtcttgatgtacttatgaaatatgtagatcaatttgaaatgaagggagtaataaatacaacgtgaatatatcatgttgacttatgctcctacatccagaactataacataatgtctatgacactaaacaatacggactactgcagaaaaggtcataggtgttcggagaccctcataggtgccggtttcgggtccgacatcaatgacccaagtcataatcgtcagaaccaacttaacggtcaccactagattttcatccatagatttctatgtggcaacacattaaataaagaaatgacaaatgaacatcgatatgatattgtcagatccaactaactggatcaaagttaccaatagaacaccatgctaacggccacaaccataaacataagtggtagtaataccaccagcggttgccatcgaccaagaagcaaacatccaaaataaccaatgcatgattattttagcaccaccaagacaccttgaattgtcgctaaacaattttcctgaccataacaaaggtcactacccatgtagcatcctcagtctgatcaccattagttgaaaccctagcgggaccagagacaccatcatcatcggacgaatagttgacctcttcgatatgcctccaccatgtggatggatggcgaaagccttgttgtcatgtatgtacggagcatatataccatcgccacccatcttgaaatcacaatcctagagaaggccctctctttgaagttacagagctatcgacgtcatggagtctatgatccacactcgcaattttctcttgaaaaacggaagctagacgatggtttatcgctcgctagtcacacacaaagagtgcatatgcattaattctcctacaccacttgaactctcgttcatatgacagaagcaccactgtagcaggatgatgcatgcacgatccatcaatctaggcttgcaaaccatgttgagactatgataggagcgccatcgcaaccacttgatgtagatatgtgcacagtccacgtgatgacatgagcgcatcgccaaatctccaatcctcaattgtcgatgagtgcgtctctaggtcacataccatagctagacagccccccccccgggggggtggtggtcggtcattgtgtgatccaacccaaacttccaatcaccttgtcgatctatgtccagttctttttccatctatttggatcttgcaagttggtggacaagagttgccgtgtctatgagaatggcattggcaacggttagggggagggaatattgtgagaggcatcattggggttccgttatcacgtagtgtttgttctacatattttggtctaaattttaccagtctaaaacaattattttattaagagttagatgaattcgatagtagtttttacaacattgtacatatagtccactatgacacattcttattattttttgttttcttggtttaacaatctcagaaagttgattaaataaaatgcaaatatatggtcttaattttagtttttttattgatttaataaataatgtagaatagatgcaaagttactatattttggagtcttagtttagtatttctattatttacttatttttgatattcagagttaaaaagtacccaagtgatattgaatttaaactcttctgttaatatgaaccatagtcacgttaagatggattgataaacgttaagattctttttcctcattctactaagtatgagtatgatgaggacacaactagctcagatatgaccatgactacctcatgtattcatcaaccaaaggtgcatatgttttatattagattcacttgttatatatttgaacaaccgttgctacacaatgagtttcctatgttttctttgcagcggtacatgcttgggtgatgaaaaagagaccaagcataaagaatgcatggatgatcaaagaagttgattggggaccaaatcaagaccttctccaaatccacttctacctcaccacgtcacttttggtccatagaaaacaagagataaagtcctacacgttttggattcggattcaggcctcctaacaacattaacttcgaacggatctaactgctgatctagaatgaatttcggagcccatgagtatttgttggaaagcttatggagtatacttttagatggttttggtccacatctaaattcctaccgagctgttgggaatatgaaaaataagccacgtacctcatccagtctgaatctgatttgggtcttgagccttgtaattgtgtcgtgggataagcccaaaggggtgtgcgccctaaggcaaccctaggacgtctctaatcatatttattcagaagtcgtcatcatttagagttgggttttgcttagattatttttgccattgcagtttcgccgctagatcggtttgtggaagcccaaattcgagtgcttaatcgttcatttgcaattgtgttgctatctatcttgttattgcttgtgttctttgatttgcatgcagtgattagccttatcggtgaggtcaaccgggtttcggcatggttgataaccagaggaaacgtggtgctgcgattgcagggttcgaatcggggttgatcggaagctggatcatgtgtgtcaagtttccaccaaatcgagagttatcaatacctatcggaatatcaggacctagtattctcatcaggtatagaacagagttacaattgaggatcttttaccttataagttgttgccaaaacttaattttagaattgattttgaggcttttttcatcataatagtgttttaattagtgcatgatacaaatatgatagttttttaaccacaaattcttatttagttgcttatatgtcgttttacaacttatcagctgtagactaatgatcatgctataagtacaaagcaacactattatataaaaaagtacaaagaaccattgaatttcaaactagtaatggcgagaaatatagttattgcctccatcttgtagcttagaactatcatgtattatctggcattctgacgcttgatcgattatatttccatcgcacatagggagagtgttatgtcgatctccactatctttttttcgtggattagtgggctctttcagaccccaatattctattgtccttgctcatcaccttgatgaaaaaaaagaacatagggcatatgcccatgcagtatagtttatagatgtccatcagcctcgtcaaccacatatagcacattctatggtccaagctgactcctcaaaaaatctcttacagtcgcaatttaaccattaacccatatttttattttaataattgcctcttgggtcgccttcctgcgactgtgggacacggggaggggagggaggagttacgatggggagattgcactagttgttctagacactgccgtcattggttgtaggttctcatcaccaagtggtagatcagtgctttgccttcatcgcctggtatgaccatgcctattgtaacgtctcgcctcccgcctctcccaggcgggcccgcttacatctgatagctttcataagtcataggttgccctcacagaccaacacaagtcttttctgcacactttgtcctcactcgtgcgcacccgggaagaatttcccgatcggtcacccatccntaaattgctccaagccaagcacgcttaaccctggagttctttggagatcggcttccggaaaaaagttgcaacttgttgatatgagtattctattaatcctattaagccctaggctgggatgtcacatcctcacccccttagaagatcgacgtcctcgtcgatcaaccccaggccaggaacgtcccctcttagccacgtccgacgtcctcgtcgatcaaccccaggccaggaacgtcccctcttagccacgtccgtgtgtccagtgccagcgcatgtgccatgctctgataccactttgtaacgtcccacctctcccaggcgggcccgcttacatatgatagctttcataggtcataggctgccctcatagaccaacacaagtcttttctacacactttgtcctcactcgtgagcacccgggaagaatttcccgatctgtcacccatccctaaattgttccaggccaagcacgcttaaccctggagttctttagagatcggcttccggaaaaaaaagttgcatgttgatatgagtattctattaatcctattaagccctaggctgggatgtcacacctattgaccaaggcagctattggaagagggacaaattaaactagtgggaggaatgcacaattttgtagactggtgttgtggtgcggaggcgcttcaccataatccaaacgaggttggttagcctggtcaatgatggagaatgctcctcataaatcaatgaatgactttctttgattctccaaaactaggagtttgcctttcctaaatcaaaaaaaataggaccttgtcctatatgacaaggttatcctatttgcccaaatggagacaaatagagaagactggtgttttatccatggtctttgcacattgttactgatttgtgtttgttattggtgattagataagggatgatgacttcccttttaatcaggaagattggttagtgacagccgaagttgtttcagcggctaagatcgatcgtgtccatgtaaacctttttcgagatagttttggcgggcaacaatcgatatatatggacatttgttttttctgacttgctagctttaagtagctggacggtagcatggagtactagacgatggctctagggtgaaaacactgatatagttcatctagcatatttgataatgtcaatgcttttctagtcggctcctttgttgaaggtgacatctcgtactttggatggaaagctagtccactgttagaggatagtagcagacaagtgttgggtcattctttaaagtgttgttctatagtaaacgtctagttagtattttttatgttttgtcttagttttatgagtgaattgatgtaagacaatatgatatgtttgtgtttatcttagttttttttccccttttcctttctagtttgtgtacattcatggtagataatacagaggtaggttataatttcattttagtgaaattctttcattgtataaaaatgtattaatatgcttagacacccaataactttagttgtagattcgccactggcattagcctaagttgatatgacaacccattttccttgtaccaacacgcacttccatcctacccttcaactagcacatataatacacacacatagagaaagagatcacaataatgcatatatttatagagaaagcacaacttttgacctctatgccaactaaggatccatacatctctatttgtgaacacattcttacgtacgtatctttctttggcctgtttggggaagtttaagattctgagaagcagctagttggtagccagcttctgagaatctagtaaattttgatcaaaagctgaattatttggagagcttctgattctggaagaaactgttgcagcgagaagctaccccaaacaagccctttatattccgatgaacattacggtttgaatagtagagccatgcacccgtacacccactactccactctcacactatattgcttccctgataatgcagatagatgatagaggaatatgctaatgcccatgcaattaatcactacatatatccatatagtatctaaaatatttgtgcacgttgttgtttgattgagtctcacatcgggtatccccggccgtcccatgcgctgccggccggcaggaggggggtccgcggccatgagcccataactaacgcatatatatgcaactgccaatatatccaccgtccgtcgtcgtcgtggtcgtcgccctcagatttgaggtcacggtggcgcgcggggcgccatttgcatatggtcgatcgcgtcgtcgccgccaatggtggtcgaccgaccggcggtcggatcgacagaccaaataccaacagtcgccatgacagggagatggtgcatgcatatcggattaggattaatcgatctagctagatgacacttctacaaaacgattttccaaacggagaaaactcatttttccaaaccgttgggcctctcgtctgtccgaaaagatctgcaaaaacagtgattatttt

SEQ ID NO: 68752 - DNA, 3837 bp, Oryza sativa
aggggtgcttggatttaatttcaatggaagtgtcgtgtgttcgactccgtggacttaccggtgtctatgtgtttcctcaatattttttgagaatacgtcaacttaatctagttcctctagggcactatgttttttcccaaaagacactccaaatttaattaaacatattagctcaatttaaatatttttaaaatatgtttattttcataatttaaacattttttgaatttaaaaaaaaatatgttgaaattcaacaaatatttgtttaatttaaatcttacatggtggcctaagggtaaattcatcttttataaagttttatctatctaatagaagaagatatattataattaataatggtaagagtgttttttctttagcaaagaaccataaaactaaagtttccttgaacaaagatacaaaattgtagtgtcttagagcatataacgaaatttagaatccctatagcaaatgttgctagaaaattaaaaagtactctctctctctctctctctctctctctctctccgtggctttttctggaatagaagaatttttcaagatttttaatgaatttaatttaatcataaaatacccctgttttacaggagccctaagaatttttaatgtaaaatgttagcaattatctgtccaattatgaagacaaattacctaagcaatttttacactctctcttttttaagaaacacgggataaacgcaagcacctatacacacgctcgcgtatattcaccccatatgataacctccaagagactggatcaatatattttaaaagttctatagttgccgcactatcgatgtggatatcaactagtatagaaattaattacgagtacatatgataggcttaggatttggactcgaatggataggttcatatgtatgataaacaaaccatgcagctcacttcgcgtggcattccctctttcgttatgaagtcaaatcaatactcacttcgtattgcattctcttttgttatgaggtcaaatcatctcaattacttttacctttgtatgatggattacgcatttacgggtgcgaaaatgtataaagcgcataaagtaaaactgtctgactgtaaaagttaatccgctttgcaaatcatatattaacatttttgtcttgcattcttgttgggcaatatatatatatatatattggcggggtttcatctgatatgaccctcgattgtctctcccgttgagggggatcaaaccccactatatatgcttcactgtgatttgttatgtcgcatttgccaaagcaaatcaaaatagccctgtcctgcaacgtgaatataaatggagacgtacactttttttctttcattgcttgtaggcaacgcatttcagatcaggatcaactggccatcatatctcttgcaaattttccatcattcaggtatggtcatatctgaatgcaatgagctataattcagtgcaattacccctttgaactttcatgcaacagagtacttagtgctcaatcatgcattgcacaaaatgaatcacgctgagctatgaaaaagtacaatgcatatctatctcaccgcaggaaataaatactctgccagctgctggctgtctttgtgatacggtgcagagttgtcctgttaaatgtctagtttgccttgtcgattggtcagaaatgtgtatgtacccaaagttgcacacacataatatcgcatcttgtaggcaaagtgcaatgcacacacactttctttctcttgcgtctagtatattgcaacgccaaaagatgacgagactactggatgttaagcttgtctacttgtataattttaatctatccgttcactgttcattttgagaaaacatatctaaatgtgtgtgtacacaaaattagctagcactcttcgatctttagtttcttaatttctttctctttccttctttgtttctatctgaaagaaaaggctagctcgcacaccccccaccatgataaactctttgatcatgaacctacccacgtgcacctaatcttttaagagtctatttgactcacaaatacactattccatccaactcgtgtaagccgtatacatgtattcgtacatgtaaacagggaattaaatttgaaaagatattgttcattcaatttctttttagaatattcgggatgtaaatttttttcagaaatataccgtcggtctcgcccaaccgttgtgtgaaaatgacatgagagtgacgttgcaggcggtatcgcgagatgaaagtgtgagaccgcgtggtcccgctgaaagagacagcgacaccgtcccaacgctaaaacagcgaacgccgaaacagtgactaatgacctagttaactattactccatgcgtcctaaaatataattatttttgaactgacacggtctccgagatgctgctttgaccaacaatatctataaaagtaagatgttttaaataaaaaatagttgcatattatgatagtttgtttaatgataaatctagtaacattaattttacatgattgctcttttttatatttttgttattaatagtcaaaatttaaaatatttgacttgtcactatgctaaaaatgtttatattttgggaccgatggagtaactaataataattagtgattaattatcatgattaccggttaaataataatggctaattatgataattaatcactaattaactattttgaaatccggtatcgctgattggttcagcaagacctcgctcttccattccacgagagcacatggtctcgcactttccccgcgcgataccgcccacgacgtcacgccacgttattttcgcacaaccagtatatttgtgcaaagaaaatttaaatcccgaatatttctaaaaaaaatgaatgaacaatatattttcaaatttaattctgtaaacaggagagtagcttgttattttctcaaaaaaattatattttactgcctcgtactattttagcagagcacttacccaacccactaaattacttttaagttcattgtaggtacaccaggttcgttttacttctaaatggtatttctcttctctctctctgtgcgcgcataaaattgatgttttgcactgaaattcggtagaatgaaaagacacattacaacttatgtcgtggtatttctttttagaatttttattagtgtttgcataggttggaaacacctcagattgatttaacatcgagattttagcttaaaatatttttaaatttgataatagtcacatatggctctaaaatatttcaacttaaaatacaatcataagaaataaaaaaaattattaaggagtaaagtgaatattttcaatagttttggggtaaaatgaacaaagcacgcacagaaccggaagcaccccttgtttcaaagagaggaggacgggttattcacatttaaattgatggtcagaggcgaattgaaaggttaaccgatccagtaaaatagttcgagtggttaaaataaacttatttttctctcatatactctctctgcccccaaaaatataattactacgagttgttcatggagatttaattaggagagaaatgaaaccaaatgaggaatgattgttatcgattcagataaaatagtagatgaagaaattaaaataaagatggttgttattggtttagatgagaaagtaggtagagacattgttattttgagacattctgaacgctagaagttaaatgtattttagggtggagggagtgatggttaatttcctaatcatccgacgtggattcaatggtcgaaacaagctctaacctttcatgatcctaataaaacacatccatgcacctttgacacacagtca

SEQ ID NO: 68753 - DNA, 1688 bp, Oryza sativa
tttaaagaccgccaatgcactttactcaatagttttttagtctttgactcattgcggaaagaatcaaaatgaccgcatgatagagataagcctactattttagagggttctatgccttcaatcaacaaaagtgtacttcagaacaatcaaagactcgttcaaaccatatcaaacaccccttcgaaccatcgaacacattgcacttgtagaccacttctttgacccaccaaagatccatattctaccatccaatacctctccagccagcaaaaaccgcacgccacggatcatcatagccctaaaagaatctcaagtagtgatcaataggcaaggaccgtaccaaaaagactccatgaatgtggtcgtactcctagagggcctttatttgtgttacacattgtacatttttttttctaaattttggtacacatccattgagagcacttttcattgtactactgtatcttaacggagtaaggctccgtttgaaagaactgtttggcttagctttttttttggtacgcgaaacaagaaatatcattagtgtatacttaattaagtattaagtattacaattatggaaaatgggtttgtttgattttttattaaaaaaacttctatataaaaagttttgtgcaaaaatacatcatttatattagcagttagaagcgtgctcatgataaacgagaaaaagttgtattgcaatagctaaatgagctttcaagctgagcctaaaatacatgaatcatcttgaaaggcacatccatatgatcacttcggcacgccacgccacgcatgtatagtcttcaccataaactcgatcaaatcgattacatacatatattcgtcccccgaaagctacatgccaccatggagatctatagctaataaaagctatagcagtaggcctctcgcgcatcactagcaacgcaagcacacgcactgcgcccaaaaactaaagaaacccacatggaaaaaacacacacacacatcgatcgatgcatgtacagtcaccgtcacgctcgccggccggcatgcacacgcaggcgatgatatgatccgtcgccgtcgtctacccgccggccgcgccgcatcgaactagctagagctatagctagtgcaaccccgtccaccaccatgatcgatcgatcgagctgatcgatgagagccccgctaagaccaagtttaatagtatagccaactgctagctccaatttatctatagtcaatttaatagctcattcacacaatagttgcatactatactattaatacctagtctcacctatcatacacacattgcgtcttagaatccgtgctacagctggctgcaaatctgtagcccgctgctcttctctctccttatttatctcattaaaatatgtttgcagctagcttatagcctgctattgtacctgctctaagagcaagtttaacagtatagcccactactagctccaattcatctatagccaattcatacaatagttgcttactatactattaatatatggtctcacatgtcatacacacactgtctcttggagttcgtgctgcagctagctacagatttgtagcccgctgcttttctttttcatcttttatatcattaaaatatgtttatagctggctaatagtatgctattgtacctgctctaatagtggtcacgatgtgtgtgttgcacttg

SEQ ID NO: 68754 - DNA, 8692 bp, Oryza sativa
ggatgtcacatgtaacggttcaggtatactttttaattttctttatttgatcaatgcgtgagtttctttttttcaccttttcatagaaatttccagccttttatctttcaaagattaatgcggagacttctagaagaacatgtcaatatgtactatatataaaaagaagattgttgcagtgttttcccacaattaagaaaatgacatgaacttttgaaacacaaacttaatgatttctcatatgcgtaaactttgtctctaaaggtgctaccataatattttaattgaactggctgttagtctagctttgctctctatttattttttgtaggtaggatatgatctcgtccacagatccaaatgttcccggttccaacagcaaggaactataagtgcgcctctcttttccaaagaaagtaaaaaatttaatatagattaaccattgatgggctaaattacctggtacttgatacactctctggtccacagatggagactgattaattctaagccactactttagcttgtcatgcgtttgtgtgtaggtgatttatacttcggtaaagcccacttagctcgaatcagaagctgtcatcttattcgacacgcagctagtatatatggatgtatctccatgatactgacctgcatctccattgttgttgccattttctgaaagcaatccccattaccattttcttctctcctggtgttggtcttagcaggccaacagcaaactaaccgtggagtttgttcgttttgagaaaccacgtacatatatataaactttgttcaaagaaattagccaatttctttgctagtggtgaggatactgtttagtttctacgcactttggtagcaaattctatgatcgatttgggtgcgtatgtgccattcgtgtaatcgtaaaagaaaaacatatatgattgactcagtatggatgtgcaaacacatataattcaagcctttcaatccactggtagtgatcaggatatatactatttagtttctacgtagtttggtagcaaattctacgaccgatttggatacgtatgtgcctttcgtgtaatcgtaaaaaaaacatatatgattgactcaggatagatgtgcaagcacatacttccttagttgatagatgatgccgtctttcgaatatatgtttaaccattcgttttattcaaaaaatttatataaatgtataagatatatatcatgtttaaagtattttgagtgctaaaacaactcacaacggaataaattataattacataatttttttaataacacaaattgtcaaacgtgtgataaaaagtcaatgacgtcatctattaaaaaacagatagtataattcaagccattccactggtggcgaggatactatttagtttctacgcactttggttgtaaattctatgattgatgcatgtacgtttgtgttttctattagcctcacctgttacacatgttccctaataagccaaaatagcttattaggaaataaaaaattaatttgtatgtaaaacttttgtatatatgtttttagtgatttaaaagctaatataaaaaaactatgttgaaatatcttaaaattaacttcaaaattaagtttaaaaatcaaattttgattttggttttagcttattaggccaaacggtggagccctatgtaatcgaaaaaaaatcaataattgacttggatgcatgcatacatatataactagccagatgggacaaacccccaacttatgccgatgatatgatctactaaaataatatttttttcaaaatcacatagatactatcacgaaattctgtaggtactacgccatccaaactggaataaaagttccttaactactaattccaagcgtgtagcaccattgcgcatagtatcctgttattcctgtgaaagcatcatacaccaagagtggagccaattggaacacatgaagataacttgcatgatgttaggcatttttttatggttaaaaactatatcattacggcaacgccaaattgaccaacataaagcactagctccaaacaaaatcgtttttttttttgtctaggcactccccttaactggtcaccaaaaatatcttttacattgtggggagggggatgttgaaggcaaagaagacacatcgccaagcaaaatgtgcaacatgacagtcaaaaaaaaaatgttggatggtctcttatgtattaaaaaacaacattgcttgtttcccctccaatttctctttataagattatctttcgttaagattactttatatggatatatacctgaaattgacgaatgaaagaggatacggagcagcacggacagggatcgagctagttggacaaccgttagcagctagctgagtgaaattggccggttcagtaagaaaattaagtagagtatgtggatttggagacagcagtaacctgcatgcattccctgtccgtgaggagaaggagtgcgtaccagacgaaaggcggcggcagctgctggatcgccgaagagacgagggcggcggtcggctgcggcgcttgcccgatggctccgtgagaaggcagatgccgccggctagctccgtggcgacgctggtccggcgagggcggcgaagatggcgccgcgatttccctcgctggctcgacaagaaagcggcgacgctggccgcaggctccgcaagaaggcggtgtcggcgccgacgaacctcacgaggaggcgatgaagatttggggattttgggacgatgggtgcgctgattggttaggagcgatgacggaggggatcggggtgatgcggctatgaggcgtagacggatggatcgatgaacccgtggacatcgtcccggacggtgcatcaagggtgaggtcctgtagtactgtagcaggctttctgggctgagaatcgtcgattcactgttggtagtgggtcacaaaaactaaagatttaatatgatatgatatgattcaagtcaatggttttttttttaagaagggcaagagctttgaggatctgaaaagctttcaagtcaatggtcttttggtgagcatactttttagtttctacacatttcagttgcaaattgtcctattgatttgagtgcacataagccttccatttcataaagaaaacatctgcaaatgactcggatgatatgcaaacccatataataattcaagccatcatgctgggacttggatgtcagcgacaaccactgtatagacagtactgcaagacagtccctatccatgtgtgttggtacttgtaatgaggatactattcagtttctacgcactttgtttacaaattctatgattgatttggatgcgcatgtgtttatgtatgcgttttccatataatataatcggaaaaaaaagttctacgattgactcgagccaatttgattcgagccaatttcctagtgggcaggatactgcttagtttcacggtttgattaattgcaaattctataaatggcgcttgttcgtgttcttgttccatgtaatcggaaaaaagaatatgatttgcacatatacattgtaatggatcaagctcatacaattgaagattgactgggtgggtgaattaagaataaaacactgcacgggtcagatatatatttcgggattggctcggtttgtggttacctaagaaaagtaccggatgacacttacggtgggaaaggggtgcaagaggatgactccgttttcaaaatagtagacaaatgatagaaaaggttgtgtgtgtgtgttttgggctagtttaccacacagaaatcagaaatgttaactttcggccttgctgcatggctgatggctagttgatacccagactgcccaggccgtcatcttatctgaagcaattggcccatatcaccacatgcatcggccgaaagggcccgacgtccaacaggaactcactatttttggcccaatattaaacacgagagtggcgactggctgctttgggccggctctatgggaaacaaaggccgtcttctaagcccaccacttatttaaaatttatttgcatctgattcatgatcaatttagggtgtataggtatgcaacattctgcaatttatttggttaaaaaactttcaaatgcaattatattataataaaatgtgatcagcagcatatttctctcaactaccccattgatatcttatttgtttcttgcatggctgcatgtatttttttttagaattacactgaacaatacagacactcacaacgcacgcacactcacccctatgaatgcacgcgcgtaaatcctacccctataaacattttcgaagactgggccagcaaatcctgtattggacagctgtgggagtgcatgtaggatcgaagaacatggagcgggaagaccaattaccaaagcgactccaggactgaatatcgatgcagagttatgaagtttgatcacgcccgcgttattttcgtagtctcgctgcccataacaaatgtgacgatcaaaaccgaatggaaaactatttgacagcttggttgcgctagcactatgagcttatactgaaatcaagggcatgtttggaaaacttaaaattctaagcaagaactggttggtagccagtttcagagaatataaaaaggttgggttttccagcttctgggtctgggttctagttcattttctagattctataactatggattcttcgaatttagaccaaatgctgaattatttgatgtagcttctgattttacgagaagctacagcagctagaaactcttccaaatatgcaacaaatcggatggataatcatcgaaactagaataataaattttattgtttgaaactgagatattagatcaccttggaacgctgatctggaggcaagtcggatggatggattagggatcgacttaccgccggtaaccgcgcggttaccgtggttaccgggcttaccgcgggggtacggtaatataaataccgcggtaacctccttaaattcaaataaatttaaaaaataatttatttttttgataaattttgcgcagtttcatacggttttcacggttaccgcggttaccgcgcagtaaccgtgcttaccgccggggcgcggtaaccccggctccggcggtttgggaaaccctggatggatattcatcgaaaccggaataaactttatttggtggatagatatccatcgttcattttgagtttttttaaacatttaaactattcgtcttattcaaaagattataaaattgttatctattatattattaaaatggctttgaaaggaggtaccacgttcgttgtgggggctagaaattctcacattaatcggagaaaaagaaaatgagagtccaagtagaaataaaatttaaaaatagctgaaattcagaattaaaaataagcaatattgagagaagagtccatataagaacccaatacaagattaatctaaattcgaaataaaaataaaataaaatccgaaattagaaaagaaaatgagagtccaagtaggaatacaattttaaaattactgaaattcggaattaaaaataaggaatattgagagaagagtcgatataagaacacaacacgagactaattaatattcggaataaaaataaaaataaaatccaaaattggaaaaaagaaaacaagagttcaagtaggaatacaatttaaaattaactaaaattcggaattaaaaataagcaatattgaaagaagaatccatataagagcccactacgagattaattaaaattgagaatgaaaattaaaataatatccaaaattagaaaaattataagagggttcaagtaggtacaattttgaaacaacttaaattcaaaaataaaaaaataaattatgaaattagaaaaataaaaaagatttcaattaggaatacaatttataaataactaaaattggtgataaaaaatagactattgaaaaaaaaaagaccatataaaacacatgatgagataaaataagtaacagatagggatagcaatcgggcgcgacgggcacgggtagtgcctacccatacctgtgcccatgagattatttgtgcccgtgggtatacccattactacatgacgggtaaggatgattgcccatgcccattgccagcgggcgccttgtgcccacgggcgtgtccgtttacccgacacaacaaaagcagtggaacaacaagtctacaagcttctaagttcgaatcgaacttaaaacatcaaatattctccgtctcaatgtggtgtctctcctctggcggcgatagagtaaggggaagagaaataataaggaaaataaaagggaaaccgtagaaaacaaagaacatggcttatgtattctagtggattttgctcctcgcctacatgtaagttagactttacgggtaaacgggcaaaacgggcatgggtagtgattacccatacacatacccatttacctatcgggcatagcttttgacccaataagatacccatgggtataaaatggagaacaaacccaaccctaatagagtttttacccacgggtaaacgggcaaacgggcagaattgccatccctagtaacaggcctataaaggagtagtgtggtggcggttgatacaacatataaaaactgttaataaaacaccaaatagaatcctaatgacgattaaaatgaggaacgacaggcaggctgtaaagctgacgggcaagacggttgcttgaacttctagaaagtaaaaaaattaaaagagagttcaagtaggaatacaattttgaaacaacttaaattcaaaaataaaaaataaattctgaaattagaaaaataaaaaagatttcgattaggaatacaatttataaataactaaaattggtgataagaaatagactattgaaaaaaaaagaccatctaaaacacatgatgagataaaataagtaacaggcctataaaggagtagtgtggtggcggttgatacaacatataaaaactgttaataaaacatcaaatagaatcctaatgacgattaaaatgaggaacgacaggcaggccgtaaagctgacgggcaaggcggttgctggaacttctagaaagtaaaaaaataaatcccattgataattataattgatttttaaattcttaatgacaataaaaaggagaaacagagcgtggggtgtataggagtgtagttgcagagccactaatggttggcaagacttctagaaaataaaaaatgaattccaatgatagatatgttcgatttttagaatctcaatgataataaagagtaggcggcggatgggctgtagaggagtatacaggcatcgtttgacgggacttctaaaaattataaaaaatgaaacccaacaagacaataaactctaaaaactacaaggagaaaatttttatatgttcggaacttctaaaaagtaaaaaaaacccaatgataatcatgttcgattttaaactctgtgacaataaaatagggaggtagcgggcgagccacaaaaggagtacaatggcaaagccgctgatggtttggctggacttctataaagtaaaaaatgaacccaaacaataattatgtttgatttttaaaatcccaataacaataaagagaaaagacagtgaacgggtcgtagagaagtataatgacagcgtttgacgggacttatagaaattataaaaacgaaacccaacgaaacaataaactctaaaaactataagatttaatttttagaggtttcaaggtgaatgaatagaaatagtggtagatcgagcaagcaaataaagaaggatatgacagaagtaaggggtagcagctggcgtgacttttgaaaactatataattagaaatacagggatggtaaggtttggtctttcaaaattttaagacaacgacatagctatttaataaatttgaagtaaaatcatactgaaaaatatatgattttgtttaggtgctagccgcgtaattgcacgggccacccagctagtttattttatttgtgacttgctttattattaaaagtatattaactatgatttatcttttttatatttatactaatttttaaataagacggataatccaacgttataactaaaacaaatcaaaatgacgaataatttatggcggaaggggtacaaagcactgagagatcccctcataatttccccaaagcgtaaccatgtgtgaataaattttgagctagtagggttgcagccacgagtaagtcttcccttgttattgtgtagccagaatgccgcaaaacttccatgcctaagcgaactgttgagagtacgtttcgatttctgactgtgttagcctggaagtgcttgtcccaaccttgtttctgagcatgaacgcccgcaagccaacatgttagttgaagcatcagggcgattagcagcatgatatcaaaacgctctgagctgctcgttcggctatggcgtaggcctagtccgtaggcaggacttttcaagtctcggaaggtttcttcaatctgcattcgcttcgaatagatattaacaagttgtttgggtgttcgaatttcaacaggtaagttagttgctagaacccatggctcctttgccgacgctgagtagattttaggtgacgggtggtgacaatgagtccgtgtcgagcgctgattttttcggcctttagagcgagatttatacaatagaatttggcatgagattggattgcttttagtcagc

SEQ ID NO: 68755 - DNA, 748 bp, Oryza sativa
gacggtgaacgacggcgcacgggggtgggcgggagggtgcgccggggcgtgcggggacagacggtggacggggacgggatgctgcggcggcaccattcatcgcagtcgcccaggtctccgccctcgcctccacggtcgccgctcgcaccgccccctcacccctgtcgcaagtccggtgctagccgtcactcccctaatcgcaagaggacgaggccctaatagtgagcttgacgagccggccacctcgccacctcctcacctcgcctcctccgccaccgcctcgcctcctccgcgccgcccgccgcccggcgtgccacatgtcccgccggcccctgcacgccgaccgcccatccacgcgccgccgacgccgcccactgcccgttcacgcatacccgagagagagagatagagagagaggggggagggggaagagaggtaatggcaggtgggccctttattttattttatttctttttgctgattggatttccacatcggcgccacgtgtatgccacgtaggagaaaaaccgctcaggattgagtccggggggtaattcatccggtatcaatagttcaaggtgtaatatgtctgattttgtggttcaggggggtaattcgtactgtcacaagagtttagggggtaattcgtacttttccttttctaaaaagtgaatttcattctagaccatcatttggactatctcttaacctgtatttttccctttagactatcatttcttaccgtttg

SEQ ID NO: 68756 - DNA, 8075 bp, Oryza sativa
  unsure (1)..(8075): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagctccagccaccggaacgagagatcgatacagctcgatcagctagccgcattcgccctcgccgccgccgacgatgtcgagccggaggtcgtcgcgctcctccgtgtcggaggaggagatcaacgagctcatctccaagctccagtccctcctccccagctcccgccgccgcggcgccaaccaggtactacatttcaccgttctcatcaccacaagttcacataaccaccatgcacactagcggcatgaacaagctagctacatgagtgatcgacgatgtgtagatttgtcggggttctaaatcttcggctacagctgtttgagaagggtctagctatttaaccactatagagggtctgccgttaaatgtgttagcccgctatttaaaactctctaattaattattgttgttaatggcggatgcaaaataaaatgcaggcgtcgacgacgaagctgctgaaggagacgtgcagctacatcaagagcctgcaccgggaggtggacgacctcagcgacaggctctccgacctcatggccggcatggatcacaacagcccaggcgccgagatcatccgcagcctcctccgctagctcatctcttctcatctgttcttcctcctcgatgatcgatcgatctcgtgttattctacgtacatgaaggatgatatgaatgcagctcgtgccctgtagctacgtataaatatacacatatgtatacatgcatacagtacatgatatgcatatgcctagatctgatctagctcagtagaaaatctactcatctcggtgtactactgatgatgatgatgattaaggcatgcagctggcttgatgatcggtactactactactacttcacttcagttcagtaggggcattagctagctagctagggccggctgcctaattaagtaattaagtaatttattatttgtagtagccagcttgatctcatctctcctcatgagccatatgacatgtggttaagttaattaatccttgatgcagtagagtcgtcccagctgtttcatcgatgatcgtcgtcatatgtgtgtatctcttgatctagctttgctgatctcctcttgtttcatttcctctttgttcttttcatgtgtttttctgtgagcttaattattgttgttttggcggttttggatcgagttgttttcctccagacaaccgaccgaccgctagctacccatcgatacaccgccatcagcgcatgtactactgtgtctgaaactctgaatcaatctaatcgaatttttgtgctgcgtacatgacacattctgagtatcattataccatgtgattagtcattactactgctcgatcgcttgaacacacacattaaaagccaatcgaaatcagaagaattatggtgttcacaccgttacgtttgtcctcgcgcgagtatgacctccagcccagaagatgtggaagctagctatttcttttcgtgccaaataacgacgatgctgattgatcggacactttaatttctatatagattgggttaatttgcaaccgtacggtagatgagatcaagtggctgcctgtgtggaaaagggaagaggaattgaccggccattggtgcaggactgcaggctgccagtgcactagttgtctactgctacatccgtctcgtaatataaagaattttttggctatacgacagagttagtacttgcccgctatatgttacactacggttacggttatttgcacgtgtcgttttgttctggcgaaagaaatgaaccgtttaaaaataagaaagttcgcaacaacggtgaccttttcgcgctggttgttattgttgttattattgttgttgccgttattgttatagtcgttattattgtttagcaatgtgcgtgtggactagactatgccgccttcttctgtacgtgatggggagcaggcacgcatgttatgatgttaccatcttcttttgctctcatctgtactgtatacgtgatggagagcaaagcatatgcatgttaggatgttaccatcaacggccacacaaaacgccagtacgttaattgacaggatggccgacaatgccgtcgtgttttcaactgtcgacgttttcaatttttgggccttttacacaatttttaagggtgttttccgatgatcatgttagagcaagtacaatagcaggctataagtcagctataactacatatcgagaagtaaagagaagagagaggaaaaaacgggttatagatttatagataactattgtatgaatgggctattaaattagctatagatgatttggagctaacatttggctatactattaaacttgctcttaggatatgctcatactgcacacaaaacggaatggctcattagtatatgataactaagtattagcttaacaaactttaaaaataaattaatttgttttttaaaaataacttttctatagactttgttatagaaaacactccattaaacagtttggaaaataagggagcagaagtcggaaatggcagtgtcaaaggaagcgaaagttcagcttaggcacagtaagagatgagtgaagatgagctaatgggaggatgctgactagtgtcacctgctgaaacagagatgaaaagaagaaagggagaaagttcaggtgcttggtgaccgatctgatcgctgacaggttgcagaaatgcagagatttgttcttagcccagacccactggaatcagattcgaatacttgatgaacagcttaccagctgtttatgttgtacaatgtgcacattgtggctctgtttggaaacttcatagggaagtcttaaataaattcaacgcaaattgagaactgtaaatcgggctgagttgaatgcaactgtctgtagtgagcttaacaaccaaacaaaatatgtcagcatccacctgttgtacagagatggaaagctgtgattaacagccaactccgtgtcaccgtcaggcatcaggcaagagttgatctagctgtactcaggtgaacaatgtgctatgtaatgacagagtagactgatcatgcaggggatgtcaacagctcctctgccttgcaagcagtagaatatagatatcaggactatttttgaattctggcccttctccaagaagggaaaaatataactgccaaccaagtccagaggttgtcactaccacgcaaggcagattaacagaattacataacatcatttaagaactaagggatattgtcaacactagcacctatttacaatagttcagccaatgcacaattggttctgggaactgggactgaatgacattcagtggatgcatgatgcatcaaagtacaaatcctgaagtcagatacatggaaagctttatcctcaacccagataagccggcaacctgggaagtagaggtgtaactctgtaagaccacatgtgatcctagattttgccaggtaccacaagtgcaaatactataattggtggtaaacgttatgctaacctgatgagtatgtggtcgtgaacaacagattgttctagcatcgataatttttatcatagaatggattttcgccccatgattctctttcagccctggccatgtgttcagattctacctcctccaagatagattgctttgtgcttcttttggaggttgaaggcctcgtagactgcaacaagagtgaataagcataggttaagaaagaggagcaacgtaaagatgagataaaccaacatgcctaacgaaagtaaaaagtatgatatctgtagcaattatacagtgatggaggaacacctaaaaagcattcctggaaaatactaaggaaagcactcagaagaaaggaaaattgacagcctatgttacaccaaataataattgcttgatgttaccaatgatcagattagaatgttgacaagcagcaagcactagaaaatgagaccatacatagaagtacagctgccttgcattgattagaggtaccgtttagaaatatattgctgcataaaagataatatatgcaccatccctgtacatttgttttccttgaggttgatgcaaactttcaaattcaaatcaacatctcatgttatatttattttaaagtcctcgcatagacctcaaacactttggagggatggaataaagcatgaacatccatatactagagttgcatttccctaatagttgtgatgattttagttttgaacaagaataccttgctgatgagtttctcaaatgcttctggtccattctgttcaatatatctctccgcagctgatagcacatcatcaggtttactcaggttttcttttcttggaacataccagacatttactatttgacgattcacaaacattggccgcacaaagtgatcataaacataagcagcaccatggaagcaaggtaagaccaaccagcagttgaagaacaactttgcataggaccaaaaaggaagcctgcaagcaaccgtcagaagtaagcatatctaatcctttgttatcctcttgatgtgtgaacatgtttatctccagcatcaatagtaaaaaaaaaatcacaaatattaccacaaaaaacaaggaaaacactagaccagggccaatcctgttttattggtcttctatattatgaactccctgctgcaagggactcacaggctatgttgctaaatctgaactttttgagggaaatcaaatgctaaacaaaaggaaatgagtaagacaaaaaaaaaatctcctgacccaggaaaatggtcattaccattcaattactggagcaaaagtaagctcaaacaaagtgataaacgagtacagcacccagtaagtgagccattgctgatcatcaacaggagattttgtttctattgctctcacagaggcatatctgcagaagtgcgaaaagtaaatatatatatatataataacagaaataatcaaacaatcaaaatggcaaaatattgaattacaacaaaataatacttacaatggataagcaagtgaaactaatggcctgcaaaggtaaaacaacagaattgcctcagaaccaatagcttcaaatatataattaacaaaaacaatatgttttaagttttttcataataaagaccacctgctctcgaagttttttcataatctctagataatgcatgtcatgatcactgatcacattgcactatagttaaccaagaggcattttttctattactttctcaaaacaacaaattacaatgcacataaagaccccagcttaccatgataataaaaaaaataacagacaatattgtagttcacatgacagcagagcagatagttcaatgaagctgcttttgcagaaaaataggaattcaaatttcatcttgtctgctacccaacatcaactaatatcactgcagaatttcctgccatgggcaagctaatttttggattttcatgagacccagcagtcgacaaacaattagtaaaaatgtttatcttatacttttttcctcaggaacatccatttctattatccccaactgcatggtagcacagcatgtaagccaccagtttgataactaaccaagttgtgcatatcaaaactactgactcagcaatgcatgatagtactactacacaaataagattatttcatgcttccagaggaagcatcactacaaggatatccattccatgttgatattaggacattgactgttatgatactatgctgaactctgctccattagtcacccataaaaaaatggcctttggattgacttcataataaacaatggagcaatagtatacacacaaaaaaaaatcttataaaacctttaccaatagtgaagtttcattcagcatcgtaaataggaactcagatgagagtagctgttggtaaaatttttgtaacaaaaataagcctaccatttctccaaataatcatattctaacttgctaaagttccacaaatcatacgacaagttctaaagattggtcgctttatgcagtgaagttcatttccattccacgaccaccatgcactgcataatcatacgcagatacgaagaatctttccctcgcaactctcacgcctaataccaatttcacatgtaccataacacctactgccatactgtcctacaaacaaattcaaaggaggatcctcaaatgaataacacgccccatattccatttctccgaaatatatttaggcctattttctagcgccagaaagatccctaaatgagtcaaacgcgtcctcgatcctcccacgacgacccaaaaaccgcccaaagattctccccccaactttccccacatcccccctcgttcttctcccaaatccccacacatcatcaaccaagaaccaccaccaaatcgacatcgacgagccacagccaacgaatcggcggcgaacgaaatcaagaagaggaaggaagaagaaaccccgcccgtacccggcgaggacgtcgaagttgttggccagcagcttgaggaaagatccagaccccatcctctccccttccgccgcctcctcgacctctctccctccccgatggatcgaccagctcaagaaatggcagagattcttgggagctgtgggctagtagtggagagccgttgctcgggagactcactcccccctttcctctttactacttttctcctcctttctctccgctgttcatggccatggctggtcggtcaggtcagctactctgccgctggtggtgtcagtgacagtgagattcgctgggccaaccatggaaggttccaggctgcttcttcttcttcgggaccagatttctcggcccatctaagaagtgggctagttgggccttaggcgacgtgaagcgggtggtccaaaggcccaacgatgatgtgctggacctgcaaatgctagcacaacgctcctcggcttccctccgtgtggcggcggcggcggtggcgccgtggcggtggtggcggcgaagcaccggaagccggcgactagcggagacggcgggcgcggacgatcaagcggcggcggcggcgtcggccggagaaccatggcgcaggtagatgagcgctcttgaattttttatctatatgcttgagtatttttttcccttttttcgtgttaaatatcttaggtcggcctgttgaatgtttgaatattgatttctacgagctagatcagatgtcgtcatctcgatcagattgttcatttggttgatggctgcggcactgccttccaaggcagaggttatctgtatctgacaatctgctacaagtctgaatatttatcgagttttcagacgtgaacagtgacaccccttttgaatttcagagaaactacatatcggctgtgtttagatccaaagtggatccaaacttcagtccttttctatcgcatcaacctgtcatatacacacaaattttcagtcacatcatctccaatttcaaccaaaatccaaactttgcgctgaactaaacacagccgataatgcattggcttggctggttgccgtccaaaaagttgatgacgaccaaaataggcaagaataagttcagaattcagaagcctcaggccagccaattcagccgcaaatctcaacgaacgaactaggaaattaaaccaaacaatgtgaagagcgagaagatgaacaagagccgaagattgtatatatgtcataagtttaattaatttggaagtcttagttagtgctatcaacaacgtgaaagagcgagagacgatgatcattactgaaacttgatggactctcagtaaactaatcgaagacagcctctcttctcactagtcacaagctgcgatgattagcatagcaccagtcgcagctg

SEQ ID NO: 68757 - DNA, 786 bp, Oryza sativa
atatgctcttgctttaacttacaatattcttgcttggcattttattggggaatatgaattatattccgccctgttgttatatacatcaggattaattacttttcaagctttgagatcatgccatgcatctcaatattatttttagatatatataatcatcactaggaacttaatgctagatcattaaaaatagtaatgctctaatgcacctaattcattagcttgtgcatcagtgctgataattaagcaacttgctgagccgattaaggaagctggtttccgtacatatgtgttggtttagtgagctagctgcagactgtttgcagcaatcatgctgttcaaactttgatagtaatattgttgtcgcacccagcaatattatgctgcaagtggcctttcggggacctaatttaagagagattccttctgaatttctgataatttgtacaggtcaaagatgtgcgggtgaacacttcttacaagtcaaagatggtccacccactcacccacaattcaggtacatgtccaaacctaaaataatgtggcactcagcttacaatattgctgccatttgcttgtagactatgtttttcctttttggaggctttggcaacttgtcttcctaattaagttttttaagcaatgtaatggagtatcaactatgctgctgctgctgctgctgctgctgctactattacagactgatggggtatcaaaagctgagaaactgtacatgtgtagattgcttccctcatcttttcctctttaccacccttttccacaaaa

SEQ ID NO: 68758 - DNA, 13186 bp, Oryza sativa
atcggatgtacacagccaagaatactcgtttttatacgccgacatgccaccacgacatcatagaaactgactatggaaggatccttctagtcttccctaaccattcaaaccaatctaaggttggagatcccgcacatggcacacctatcaggtaggctatcatccttgtgctacgttagattcggaagtcgattagcattgattctcggttcgccctaactccacatccatcctcgccttggtgcctatgagagagctgagctatactataagtctagccattatccacactgacttatggtaagtacaataatttctcacaagagttttcgtgaattgtggtaagtgagatagtatctcaaggccattccctatgagtcttaggtagcccggcgttgcctccccctcaatggatgccataaatcccctttaatgcacaataattcgatttagggttttttgtttataataaaaaaatagtgaatattctaaaaatcatgactaaattcatatgaactccagtaaattctaaaaatgccaaaagtccaactaattataaattggtttcatgtgttgtttcattatattctaacgtttccgaagcgccattgtacttcgagatcatcgcaaaggtccaagtgtagagcaaggcaagttatactattgttcttgactctattctacgtgaattaagcaaatgttttgcttacttgaagtaagcattcattgtttcacaatttcacatgggatgtcaatgacctatatgtagttgtaagctatagttcgaatactatcatttcctcgatgacttgggtaacatgtgactagatgtttgcctaggatggttagatcaactagctcactattgggataattacctctctattttatacctaggaattaattaatggtgacactttgcacatggttcatgaggatgactaatccaactaaaagatgactaaatggtgagttttcggtgcatggttttgttgacgcatctatagcaattaaggactaattcgtcagaaacccttgtaaaatattattgtacttagcacgccagcgtgatcaatggttgggcttataatacagctcgctcctctcccaggcaccaaggtgagggtgggcatgatggagttgcgttggaccagggaacaagtcctgtcaatttctatgttcggcaatataatttatagggtgcacaagatcaaagagagatggtgacacagatttatactggttcaggccctcgagtgaggtaataccctagtgcagttggtgtagattggatctatgtcgagaggtgcggagatcagcaatggagtggctgatggcacgtgtaatggagtgtgtgagtaactcttcagggttcttgccgaagccctttatataacgttagggcttccggcggcatgcatgtcacaatatcccttataatctgggtacgtgcaatctatttacatgggattggataatatttcttatctcttatcccttcctatacatttttttttgtggggacccttcctatacattaaggatagccgcatggacctggctactcggcctgctctatgtgacacggcacaaaggccttccgtgaggtacccgggtatcgtgccctccacaggtgttgatcgacttttaagtccacagtggtgcaagggatatttcatttactttgagtcgttatatgcatgtggtagcttgatagctacttagttaaagcagtttttatccatatcatctcggaacctccggagaattgactgaaacctaaggttccaaacaattgaccggagactttgagaaataatttaatccgctacaaaagtttgtttaaatttcagttttcgcctattcactcctctctaggctttacaagggactttcagcatccacacaataaaaggtagagttgagcctatcggttatatggagaaaacattaaaaaattgaggatgatgtagagaatataaacaaaagacaaggtagaaactaactgcaagtttatatgcaaatatagcatgtctaattccctcctcatatgtgcaccacacattataatcaacatccaacttggtatgatcatccaatcttggttcgcaaacaccagaagagattgtgcatacatgagcgttttataagtttgtacactaaattacatccaactaacaaattcatatgccatcaatgcaatttgctaacaatgagtttaatagcaaaatgctatactttctatgggtaaattgacactcattttgatgtttgtccattgacaatacaggaaactattctaaactctcgagagaatatcctctcattgtttgcatgtcatccaaatgattataattttctttttaaaaaataagcaagataaattaatatgtgataaatcactccacaagcatgcaaggttaaatttaacttcaacatgttgcaatgagaaaaaaaacaaatttgactatgaatatatgttaactagcttttttttttgcagattgtggaagttaaaatttaacttacatgtttatgcagtgatatatcatatattaatcaattttcttaatttttcataactatttgtatgacatgcaaacaataatgggatatcctttggagagtttaaaatccactccattgacgatatattgtaatactagcataatgctcatgctttgctccatgtaaaggaatatatattatgacagtattatagataaaacatattttttatcgaaaatatatcagtatcacttgtttgcttattatttacatatatggtattcacttatttaaaacgagaaccctagccctagcaaaaccgggccgggctgggccgggcttcactgctttacaagagccagcttagtgaacctaataattctgctcctgtcctccttatcctgatcagtcctcggtcggcttttcctctctctctctctctctctcataaaacagagacctttaatgcgtcgtgatctctcccctccaatcccgacaaagtacacacaccatcgtctccccctcctgcctcgatgctagctctcccattcccatctctccactctccctcctatcatatgctcctcccttctccactcttcttctcaaatcctctctcttcctcttcgtcctcctcctcttgcaaccaaaaaacaccataaaatagtaatcccaatccacaagctcacctctctcttgcacacacacacacctgacacaacacttacacatcataccagaagaaaaaccaattcgattttgccaaattacctagctatagcatataggtaggtagctaggtagcttggttttccctaatagctctagcttgatctctttctagctctaccggcggcgtggcggcggcggcggcggccgcaccactctacatcatcacgtacacctgaccagcttagcgggaagccccacaagaagagtttgtaggtcaccaatcagatcatcagttcatctttgtggttgtgtgggtgtgtgtgtatatatataccatggcgtgagagtagccatggatgtcaccggagacggcggaggaggagggcaacggcccaatttccccctgcagctcctcgggaagaaggaggagcagacgtgctcgacgtcgcagactgccggggcgggcggcggcggcgtcgtgggcgcgaatgggtcggcggcggcggcgccgccgaagcggacgtcgacgaaggaccggcacacgaaggtggacgggcgggggcggcgcatccggatgccggcgatctgcgccgcgcgggtgttccagctgacgcgggagctcgggcacaagaccgacggcgagaccatcgagtggctgctgcagcaggcggagccggcggtgatcgcggcgaccgggacgggcaccatcccggccaacttcacctccctcaacatctccctccgctcctccggctcgtcgctctccatcccttctcacctccgccttgccggcttggctggccctcgcttcggcggcggcgcgcgggcggcggacgcgtgggaccgcgtcgtcggcctcgggttcggcggtgcggccgacgccccgtcctccgccacctcctcctcctcgtcgccgcttctgctgagcttccactccggtagcgtcggccttgacgtgtcgccgccgtcggcgtcgacctccccggccgccgccgacctctcccggaagcggcggtgggagcaagaaatgcagcagcagcagcagtaccagcagcagatggccgggtacacgcagagccaaattcctgcgggcacggtgtggatggtgccgagcagcaacgcgcaggccgccggtggcggcgctccgccgggaggcggcggcgagtcgatttggacgttcccgcagtcagggagcggcggcggcggcggcgcggcgacagtgtaccgtggcgtgccaagcggactacatttcatgaacttcccggcgacaccaatggcgctgctccccggcgggcagcagctcggcctcgccggcgccggcgggggtggcgaggggcacccggggatcctcgccgcgctcaatgcctaccgcgcacaggccgcgcagccggacgccggcgcggcggcgcagaatggagcgcaaggctcaagtcagcatcgtcagcatcagcatcacggcggcggcggcggcggcggcgacgagcggcatgagagcatgagcgccagcgactcgtagggcttccgttccgtccggtgtgtgccccgcattttctctggttttgatctgttcttctttaattttctccgtttttgtttgagttgttgtctactaatgtctatggctttcttcctcgacccatcatatattcatgcaaggatcatacagttgcattccatgccatctgcataaaaatatcttattgtgtgctcttaagaatggatcaccaatttcaccatgataaagctcttgcaagttgcaagtggtagggtttggttagaatgctagagaaccttttttttaaaaaaaatgaaaatgagaatgctagagaacctagaatcattaatcaataaatcattgctttggtatattgatcgatcgatgaggattatccaccaactaatcctcatccaatgcatgcatgcaagctagctagcatccattcgatctgccactctaaataatttcttgttggttatctattgcgtacacatttcatacatcttttctctgtcaccgtatatagcttttgcaagacaaaagtttttcattcgaattgtactaccggcatgcatgcatataacctcgacaaagttcctttcatttgaatgcatatgcagtgcacggttctactagctagctagcggttggccgggcggcaaaggttgccaaaaaccaagacaaggtagcacggtagcaatcagggattgcattgggttaatccgagggtaagcatcgacgacgaacttcatcaatcaaatataatttttaaaatagtttaacagtgaagaaaaatagatctactttctacaatccagctactaccagtggcccactcctttacagtcgtgggaacacacgttttcaaatgtgggggcactcttactaatttgcagaatatgcttatatttatagtcacgtgtcaaagttccagtgggcataacactattagtatcataggagttagatagtgattttatgaagaaaaacatagccttaagttaaatagtactacctctactagcggtgacaattagtcaattagtcatccgctggtcagaggatgggttaatccatcgagagctaggaatatccttgacttgtttttaatcacctgtcaaacttgatacaaatagttaaaaaagttcaaaaacaacattgaaatatagacttcagcaaaattcaagtttacacttaatctacctacacatcaagaaaaatttgaacaaatttctgtgtgaatagcagctaggtattgttcatatatatgatgtatttgtttttttccttcctcggtgtgtcatcagtctagtttagacttgatatttttgttgctagcatgcatgtatatcttttccgcaaatacgtccataacacatttcactaaattcttattgaaagcacacctacatattcacaacattcatgtacaataaaatttgaatccgtggttgaaatcatgtacccacacgactttaccgtcacaccactagtacgtcccacaaccatacatgtatatatcaatgttacttcctccgtttcacaatgtaagtcattataatattttctacatttatattgatgccaataaatttagatagatatatatatatgtctagatttattggcatcaatataaatatggaaaatgctagaatgacttacattgtgaaacggagggagtaccaaatatttccagaacatctggaaattgtccgcgcgtcgtatcttcggagtggaggaacgtacgtacgtgggtggggattttgtaatatggagagctagcttaggttatatatccagtacccccgatcgaggcaccaaccaccaacaccaagccatccatccgactatccgtgagcacaccgaggcccccaacgccgactgatccccaccccccaccgcgaggcggcgcgcgtacgtctcaccgatcgagcgaaacgaaacgaaacgctgcctgccacggtgcatgcgcgcccggcggcccgtgcgcccgcgggatggatgggtagatgcgggcggccccgcgcgtacgtacgggacgggaggaagagatcgtacatcgcgcgagcgagcgcgaccggcccacgcgcgcctactggcgctggctggctgcaaaccgatctcgcgatcgatagcgcgcggggagatggagcgggaagcgcgtggtccacgcctttctccgccagcgcgcaagcgcaaacggagcccctgtgcccgcccgcctgcaggtgcaggggggcactgtcgcgccggtctcccccgcggctagctagcttcatcaatacaatcgcccgcctgcgcggacgtacactgcaggtggagggccggagcatgtaccccgcatcgcatcgcgcatgcatgctatgctatgctccaccaaagggtacgttacgtatatatatcagccgggcgagacacgtacgtttgcatatattttgcggacaattattacccctttggatcgatggaatttaattagtactgttttcatctcagaataaattaatatatttatagaagattggagatagattagcaacacacacacaaatgatcacaatgaacctatttaataaccacactgcattttctataatatatatacgtaaacttcttttattaggcgatgggaacggaaagatggtgggtaggagggagtatatcttcatctaattaatttgttgggttccacactttattaaaaaaataacttttttttataaattcgaatggtagaattcaattattccgggatggagctagtagggaatatgaaggaattgaatctgttggtaaaaaaaattctttgagaggcttttggatggtagggttccctcatagaaaattttgagaaactattactatatacatatatacgactcaaaccgtccaactggatttgatcaatggttgcagtgtatataaacatatgtttctttgttatttgcatatccctaattgtacatgagttatacaactaggttgtacatatagcagtactcgaaattttatatgttaggaaaaattctttcacattttgtataaattcttctagcaaattaattgctttgaaagtttcaatatacctatctctcccttctctctctctgataaatgaacacataatcttatattttctccacttttcgatcgtacgaggcatccaaataactattttgtgtaatacttgcggttttgtttcctgctacaagaaacaagttataacattttaatcatatatctttttatactaattcctgtattttaaggaacccggtttcttcgactagtgtggttggcactagcttgaccagctaattgaattggtgacacgtttgtgcatggatgcggtcattgatgaacatgaagacgatcgatcgagagactacgcgtcgttgcctcgttggggttggccacataatgagctacaatgtggtgactgcacaagtgcacagtttatgtgcgtgcaggtgggagggaggaaagaggggagagaggtgagaggatgaggccaataacgtgcgtgctggagctgtcggttgttctctgcgccaaattggagccgtcacatgtccggctgattggccgcattgagtggccttgcctagctagtggccgcagcacgtagcagcagcagctgctgcagcgccctaaacacaccagtgaagcacatgtgtcgtgcctcgccttgtctccctaatactgccactcgtttcgagctagcagcttagagctaacacatctctggaaaagtattagttcaaaaaaaaactctagaaaagtgattatgatcccatcaattaaccaagagttggttataaatcaaaacgggtggacggtgatggcaacacacccagggacatctaggaaaggagtccacactactaccctaatgttcctacttcctagtgacatgggagatctagaaaaaaaaacaaagggtatttcagctcaacgaactctcaatgctatccctctctgtgaagataaaagaagaggctagcccagatcatcccttagagcatctccagcagggacactaaatatagcccctaaacagattttggatgttgaggctaagagcatctccagcaatagctcctattttacagcccctaaaaatttaatgggggcttcccccattttctaagtacctaaaaaatatctttaactccagcagcagtcccttttctcgccccttatttcatttcatcttctattttaacatatactttaaagtacaaatctatagttctatactctagctactcctagtataaaaccataataatccaaccatatttaaattcacaattcaaattcgattcttttagaaaaaataaaatggaaatgcaaatcctagtagcatgtattcatagctcgggtgaaacgagcttctgctgctgtggcgcttccatgcattttctcacatgtgttgatttttcccgtcttctcatccaccaatagaccagctacttctctcacgaagcaacaaccaagcaaagcaacaaaaaagctgcatagcacatcgcatgtatcactttccccattcttctaagtcccacaatcgcagctgctagtgctaccctgctactactttctcaatttcgcagcctgcaacaacacttgaatcatccagtgcctcgacgccatcgcatgactcggccactgggccatgtttttcatcgagttcaggtagagggtgcaggctagaggagactccaggtacagcagacgcgtcggccgggaaggagcgttgggtagaggaatgcacctgagggatgacatggtaggcagggaggagccgcaccggccggggatgagcactgggcaggggaggtgccggtggaccaagaccacgtcgggcggctcccgcgcttttccaaccgtggatgggggctgtgcagtagagcccctgagactaggggctaggaaaggttatttgggtgcctacctaatttaggatccttgataggggctctgctggattgagttttttagcctcaacacccaaaatctgtttaggggctatatttagtgtccctgctagagatgctctaactgtttgcttggttgttgcttcgtgagagaagtagctggtctattggtggatgagaagacgggaaaaatcaacacatgtgagaaaatgcatggaagcgccacagcagcagaagctcgtttcacccgagctatgaatacatgctactaggatttgtatttccattttattttttttaaaagaatcgaatttgaattgtaaatttaaatatggttggattattatggttttatactaggagtagcgtagagtatagaactatagatttgtactttaaagtatatgttaaaatagaagatgaaatgaaataaggggcgagaaaagggactgctgctggagttaaaggtattttttaggtacttagaaaatggggaaagcccccattaaatttttaggggctataaaataggagctattgctggagatgctcttagtcttctccatgtgaatttacaattctttactttcgtacggttccttttcttccgctatgtttaatatgaaatatgcacattcgggtgccgatttgttaaaaataaataaatcaatacggtgtgtttacgatataaaataatttgtgagtaaaatatttacatatatactcttacccacctaacagtccaaattaattttataattaaattttaaaatttaaattttgactgcggttgatttctttaaggtaaacgacgagtcacatagcttagacgagatgagtgcactgtttgacgcaaattaatgcgcatgcaatcgtacacccgtacgagagggagagcatgtcatgtgatttcgagaggcctaggaacatgttggttcatcagtcatgccggggcgcatgcagaattagtactgctcggtaatttgtgcgactttatggtaatttagagagcagcagtactgcagtagtagtacgacattactacacttatttaatcgtctgactaattaaactagtgtcagtttattcagtatcagtatgatactaatgatagtatctgatctcaaggtcggcattactatgttgggagcatactccctccgtactcgtaaagaaaatcgtttagaacagcgacacggtctccaaaacacaactttgacttcttgtttctataaaaatatttattaaaaagtgatatatgtatacttttatgaaagtatttttcaagacaaatctattcatatattttttacattttcaaactcaataacttgagagttattcatgatttatatttccaaggtttgacttaaacattgtcctaaatgactttctttacgagtacagagggagtatatactttctccatcccatatactatatctatatatcctaaaaaagttatttctaacatgacagtttgtttcaaaataaaactatttctccatagcctctcctttcacccaactataaccattatttacttaatttcttcatctactttttttcttaacgaatcacaatgtttattcattattttaacttctttttaatatccgtgtttatctttaaaaaaaatacgtatattttaaaacagagttgtatatatatttttggagttcttcctaggacgtaagcatttctaaagtttgtcatggtacatgactaacgaggagagatgtgaagttaaattaagatcaatattgtagttagttaaaataggagatacagggagaaataaatgaaaaatgattgtgatcgattaaaatgagaaattaagttgatgaatatattacatagtactatatatttttttgataaaatttaaacgctagccgtagctatattttggaacgggcgagagtatttcactcactctgaatttgacctcctcatgttgcactaggtggcttttgtcaggactagctgtggcgcgcattcctcttttgaaaagataggcagggtcgacgcaggcaggcaggcgcatgtgtgcgtctctaccgaggtgacaacaaaatcacagggaaaattctcccctttcatagggatcaatgagcttaagcacacagctctcatgccgttgctgcgtccagtccttttcctctcctctgcatcatttcctttctctctgtctgcgtgagtgtgtgtgtgtgtgagagagagaggggaatctgcagagaggccacggttgggtttgcaaaacgcagacacggctgcttgctccctgatctctactgcatgcagtagctagcactgcactgcatgctggaggaacaggatgggagtaggaggagctagctagccgaggaggagggagagagaggagggcacagctttccctctactcccgtcgcttttgtggccagctgatcgatgagctgagctgagctgagcttaagccgggaagaagaacagctttatgtgcgtggtgaaatacggagcattcacacacacacacagtgtacatgtgcatgtcagtgtgagatactgagggcatgtttagatcagtttgttgtggaaaaattattttggtaaaagttttggtggtaaaagatttggtattgaagtttttctagttggtgtttagatgcatggtaaagttttatcattttactagtaaagagagatagcacggctcccaacatattttttggtaaaatttactactctagacacccaaataacaaatgttaaattgctaaattttctactagtgtttagatccattttaacaaaaagtactccaaaacagtaaaacttttgccattttagaggaactaaacaagacctaagggttgtgtgtattgtgttattgcgtggtggcagtagtacaacttctactcttacctcccctttccagtgcgtgagagagagtagagatggatactaccccacccattcatattataagttgttttgttttttctaattagaatttctaaagtttgattaagcttatagaaaaatatataatcatttttaacataaaacaaacatattatccaaatatattaaatattagttttaacaaaactaatttgatattataaatattgctaatttttatatatatatatagactaattaaaataacttataatgtaaaaaattataacggaggtggtactacactagtactcctatgttgcttgctcctgagctagctttcgacttgtcggccgctctgatcgatgctgccctttatccctctcctttctgcctcgatccgggccatcgcatgatttgcgtttgatgcaccggtgatgaccgtccaacagcaaattctggcgggcatgcatcacaccaatcgtccatggatcacttcccccctcttgcatgtcttgactgctgttcgccggtcacaagagctcccatgctggccctgttttagggaactttaaatagctacagttacttcgagaatctctaactccgtaaacaatctaagaacctgtttggtacagcttcaactcctgaatttagctccatgagttgagtctggagtgga

SEQ ID NO: 68759 - DNA, 5850 bp, Oryza sativa
gatttaggcagctctacaaccccactctagacccaactcctggagctaaatttaggaattggagctctaccaaatagaccattagcgtttaaattatgtgactccatagcggaatacgaaaaataaactagcagacagaagttgtcctcctaagggcactcacagtgcaagcaccagttgccgggtcctagctcaaaaggttggcccaaagacacacatccccacagtgcaagtaccctattttgtgtggcttaattggatgaaggtactctgggaggaaactgagtccacagtgagcgttatcccaaccgcttcgttctctccacaatgcaccaaatttatccccaacctaccctctcctcgagcgcttcttctccacgcacggatgcatcacacacccctcgccttcgctctctccacagcgcagcgcaccagcccgccggaggaggtcggtcaccagccacatcgggctcgccagcgtgcgggagggggggtagggcgtcggtgttcgtggtgacagcctggtgctcgcgcggactcggtgtccgtggcaacgacgcgatgcatccctccttctccccgaggagatgctggtgctcgacgcggtccgaagcagggcagactacgttggtggcggctggcgcgctggcgtagtggcgggaggcgtccccggcgtcggcggctggcacggtgtggcggcgagcaaccggagcgtggggctgcggttccggcgccgccacaaccggatccggcggctcagcgttggatctggccggggtcgacgggagtggacggcacaacgccgacgagcagcgggagcggacagcttctccacctcgccgatttccccttccttttctctaccaaattactcaagaattttgttggtttggtctgcatctgtggtgggttttttccttttctctaccaaattacttgagaaattttgttggtttggtctgcatctgtggtggttttgtggggggggggggattcgctgtgcgtttggagggatttcagttcgtcgatgattccgttggagggtgatttggggttttgtataggtgcagcgcgcttgcctcgcttttccccgtccgctcgcgccctcgccgcaacaaagttttgcgccgcttaggtaggggataagaaacctagctgaggtgcgggcatggtcgcctcgttgacccgaatctgagctggcgcaacaagatcacgtaccagctcagtgcactgtgaaaggcctaatttaagttttcaccagctggatacttacaggcaccaatgttttagaatcttcagcccctaaacatggcatgttcccttttgttcaaacttttcgtagtggtgatgatattattgaagcaattttcaataagaaaagaaaatctagcaaacatatgcagtttcagttctgcatgtttatcccatttcgccgtgcgtgcgcgtactctttttggccggtggagtacacgggtcgcagagaatcgttgctgggcgctcctgcgaaaaatacaaaataaagtgccatggattttagtgcgtttttggtcgcgtctaaaaggaatcaaagtcataatatatgctactgtgaccatcatgtatagtactactataatcaccatattgtatatgtatcgattgatttattcatagtctatagtgctattgttgctgctaccggtagtgtctagtgtgtggtgctaattaatattcctaggcactataattggattagaaggctctaatcgtttttaattagatttggatggtccatgccgttttgatgcttagcgctcaggatatggtcattgggacctaaattatctggagaaagtgaactatctgattaaaaattataggtgtgccatttgtgcttacgtacgcagtctcacccaaaaacagaaacttcattgtttaaagtaccatgcacagagggaatggtaatttggcacactaaattattactctctccgttttagagtcattttgactttagtcaaaatcaaatcactttatatatgatcaagtttgtagataatttataacaccaaactagtttcgttaaatctataattaaacatgttttcataatatattattcttgggataaaaacgtaactagttttcctacaaagttgattaaatttggagcaatttgactttgaccaaagtcaaaataactttaatccgtataagatgtgcacggtgagaagaatatgatataatagaagggaacaaagtcgaccatagtggtctacaagagcaccttcaatagtctcctaataatccatcttcaataaagtgatattgaactatcccaatatcactttttattattaggaagctacttttgcagctccccaatactttattttcactgtacatcatgacatataggctctatccattagatggccaacaccatcttctttatctctccttgacggtcaaattcattgtctccgcccttcctccgcatcccatgttggcaatggggcctcatttcccatttatgtgcgggaaattctctttaggacgggaaaggttagaattggttccgcataagaagtcgaacgagataaattatgtcacgtcaggtttcatgggggcaaagatgatcccccattcgatcattccccgtcccctgcggagacccacataggtttcaatctttgttaagggggtatttgaatctcctgaagatgaaaatgaagattaagtgtttcacgcaaaatgagatggtaataacgtgtgattaattgagttttaattattgcaaacttgaaaaaggattaatctgatattttagaacaattttcatataaaaagttttcgtatgaaatgcgccgtttaccagtttgaaaagcgtgccacgaatatccaaaacttaatccatttttgtaagtggaaacgaacgggggcaaatattaatattatttttttatcatgtgaattagtagatatatgttgatatattaatataaagtgtgaatatgcgttttacgttcgcatatataatttgatatgtacgtattgttttaagcaggaacagagagattaattcccatgcggaggtggggatgggaataaagtttcccccattatttttcgctgagacgaggacacataaaggtttgactcatgtggatcgataaaaatggggatgcattctccggcgaggaattccccgttgtcatatctactgcggtgtcttgcgagaaagccgaacaaggtagaggcaagcctaggttggagacgcattggatgagtcaacgacgagtgtgcgctcgaatttagcgagcaacgccctcttcggctagctagagctcggggcggtggagctccttcgggcagcgctagctaggcagtggtggcagagctccttgggcaccaaaatttggaaaactttgatggggtatttattgtcaaaattaaatgtgctaaccgcataaaaaatgccacttgttcgtgactgaaggagggatttgagtactatcattttgagatcccaccacggaagacacaattttacccatcacacccatgcacaccacatcctcaattacaaaatatagaaaattatattttaaaaaatatgtatctttattttctttttttttaaaaaaagaacaaaactccaagtacttacgaagggcagccaagcccacccgagaatacatgtgcatgcatccatccatactcctttcgtttaaaataaataaatttagtacgaaatgtgatatattttggattatttagtcccatatactatttggatccagggactaaaaattgctaaaggcacgtggaccaagggagatgctgccactttagtccctataagtacctccaagagggactaatagattttagtcccaatatgcacttttagtttcttttagtcacacctgtttgaatttctagggactaaaagagattaatgtggtgtttgaatctcctgaagatgaagatgaaaatgaggtatttcacgtaaaacgaagtggtaataacatgtgtttaattgagttttaattattacaaacttgaaaaataaattaatctgatattttagaacaactttcatattaaaagttttcgcacgaatcacaccgtttagcagtttgaagagcgtgccacgaaaatccaaaactttatccagtgttagcgatggaaacaaacagagcctagaatagagggactaatagattagtcctatgaaccaacagggtctaagattataaatctggacaagcttcctatagccctatatatacaatacaatatgttacatcccatatactttatccgtttcacaatgtaagtcattctagcatttcccacatttatattgatggtaatgaatctagacataatgttagaataacttacattgtggaacggaggaagtaaaattattttatttgaacggaagtagtacttaccaaaactgaaactgagcaaattaatcaaagttggtggttatgcctggtggttgacagaaaaatccaggagctagcttacctgtatatatcatcccaaccctatcagctggcgcatgtgtgtgtgtgtccttgcagcagaaacaaatgaagggataaagctctctagcctaagcgatatcgatcaagaggtggctgcggggaaaggggaggaaagcggcgttgggccgggcgacacggcggacggcgacgttggccatggctgtcgccccacgtaaacgaaggaacactgcccccgcgtctcgatcgacgtacacacgaacgaacgcacgcagcgcggccgcgtcgccgtcggctgatcgatcacgtcgagacgtcgccctccggtcgggtcggctgccggcatccgtcgtcaccaacaagtgcagcacggtgagaggaggagagcaagcgaatcactcctaattaagcagcagcagctgtctgatcgcctgatgtttgtgtaattgtgtcctgatgattaccagcagagtccgaaccacaaattgggctgaaaaccttagtgggccgaaatggggccagaggcggcagtttttatcttgaggggccgaggcctggtttgggaggggaataagttcattctaggtccctcaatttgtcgccgagtttgaaattcattccttaagtgcaaaaccaggtacaacacatcctttaacttacaaaaccgtgcaaaagaggtccctcggcagtattatgcccagttttggctgacgtggcgcttatatggcaatttaattttaaaaaataaaaaacatgggacccacatgtcagctacatacaaaataataataaatggtgggacccatttggccccacatgtcatccctcttctctccatcctctctctctctcacctgggcggagcaggtctgagcggagtggctggccggtggagctaagcggcggcggctggagcaagctggcacaagcgacgggcaaggggcggcggcaccgcggcgccgagaggtggcgggcacagcagaggggcggcgggcagagagggggcgagtggcaggcgagctcctggagatggcgacgggatgaggctaaaaggacgccgccgtcgtcgtcggtgtcctcgaaccagtacggcttatccacacccttgaggagggggaaaccgttgaacagcaccgggattgcgtcaatggtggtgtagatatgggtattggccgtcttcgggtgcttctcctcgcgccacggcaccgcctcacggccgtcgccattgtcgtcgtcatctcaatccccgccgccgtcgatgaagaggtgggggacgatgttagctaaactccggcaactgcagtgaaacctgcaacacacacacgcttggacgcgagaagaacaaaccaat

SEQ ID NO: 68760 - DNA, 9803 bp, Oryza sativa
  unsure (1)..(9803): unsure at all n locations
tccatacgcgattacagaacgtgggcacgatgacccaacttacgcggacacgatcctttctcagcagatgccatcccaaatgctaggatcgtggccacgcggcgtcgtcgacgcctaggccgagctccgccgagtcgccgacgctgatctggggagcgaggctatcgtctcctccctttggatccacggcgacgagaggagaggggaaaagggagaaggaggtgccgtcgtttgtgggctggccgccggttgctcgatgtcgtccgcggcgccggcgtgggttgtcgtcgtcctccaccgccttgcccctcgcctgtgccgcggcctccgcctgctggagctgcgcgtggagcaccggcgcagtggagagggcgaggagctcgctcgttctagccgctcccttctctcccgtatctcgtcgaccaccgcgagtcactccctcctctcccactggtgccgcgcgccgctgccaactcttccgtctcccgccggcgccgcgcgtcgctccctcctcacccgtcggccgccgcgcgccgcccctcctcactcgcgcctggagagaggacaaaggagaggggagagagatgaaggggagtcggggagagaggaagaagaagaggaggggcgaggatgacatgtgggtcccacgtgggcccccaccattttttattaatttgtgtgtgaaactgacatgtgggtcccatgggttttattattttttttctagatcgaattgccatgtaagcaccacgtcagatgaagaccgagtcaaattagccacgtaggcgccacgtcagccaaaaccaccctcaaacccatcgagggacttaatttacaccggttttgatagttgagggacccgttgtgtctggtttttcggttgagggacaaaagtcgaattcgttgacaagttaagggacctcagataaacttattcctttgggaggccattaccaagctcagagtgttaatgtacaggggattgctatttagcacacacattttttactactttttttgtgaaagcttttatatgtaaaaatttcatctggaaacttcatttgaaaatttttcttctcaaacttttcataagaaactttggcgcgggctttatggattgcttataagcaaatgttataaaataaacaatgattaaaaaataccacaaaaactaacttcaaaattagtttttaaaatagattttggctaaaaaaatcacaatgaagaaaaacacaaatcaacttaaaaataaattttaaaatttaaatttaggcttataaatatgagcctaagcgaaacaatggggctagtagtatttttatgatatggaagggaggaagaagaataacgtgtgttgaactattgatcaccagatggtttcatagaaaaactactcctacctgatactattaccatgtactctctccccccaatccagatttgtagtactgagtggtttgatatatattaggacggaggtaggtagtactacgtgtcatgttcactatagaatcagtagttaattgtctaagtttgttgtagctaaacaaacgatcaattatatgtagtattattgtgtatagatatggcatgacgagattatatcgacagtaaccgtctaaacagcttttccctcaaaaaaaaaaccgtctaaacagctattcgtatcatacgggagaaaatcctataaaatccgatcgagctttgaaacagacgcacatgtcaccagcttgtggctgtgtctgcttacagatggcgatttgttgatgcatatggaatggaagccgccgtctgtttcatggcagccaacagtatacggctaaatatagcttgcagattcctaagctgatttgtgcctttatcactcgattaattaagcagagataattgtaccatgagagagcagttgccagatgataagtagccttcaaatggtgctaaccttatcacttctacttggcactagcagtgtgatgtcatcatgattaaaatggtggtccatcagaagttcagaactccattggctgaccatattattcagagcgaggtcatcatgtgtggcaacttgcaagcaacggaagaacttgatgggtaattttaaattcttcccgagaaaacagcatgatctgcactgtgtaattaactaaaacggattnnnnnnnnnnnnnnnnnnnnnnnnnntgccatcctgaccaagcaatagaagggaaaaaaaaaaagcaagagcacacagatgcaagacagtctaagtcagaactcagaaataacaatacaggcccatttcaatatacaaatgccatccctcttcaaggtaaagtctttatactgaagattatatcattcagtgtgctgctagctctgactcagtttggagcacttgctttctgtgggcattgctgttttgagccacttcagtcaagctggcattgcacatccgacagcctggtccatgagcacagctcactgctccttttagaatacaatgacagccaaagcatcaccattagctagagtacgtgacagaaaaaataaagctttgagaatgtgatggccaactcactgctgcatgtaatgctgttttcagctcactttgtccatcagcatggagaagcaacaggcacaattcagaggaaactaaatctgactagatatttctttttaacacaatgctttatttgctataccttggtacaagatggcatcccccacaaaagggtttgtgtatatgaacatgaaaaagacttctactgactaccaacacaaatgtagttagaaaaatcaggcaatactacaacatgacatgagctttgtgcactggcaggaagaacactgcttaattggccttactctgctctgctagattgagcttaatcggtcttgctctgctctgccacattgagcttaatcgggcgcgcctcgaatccacctcccttgcggttctcaagagtgtaaggcatgtatgttccgaggatcttgtcccacatgacaaagaagggctgcgagaagttgtacttgttgccatagagctggtggtgaatgtcatggtaggcgctgttgttgctgaagaagacatggaggatgttgcccgggagccacaggccgcagtggtcatcgacggtcttgatggtcgcaaacgagaagaagaatatggccgtcttaggagtcatgccggcgatgaggaaggagagggcgccgccgatggtgtccaggatgaggccctcaaggggatggttgtagagagctccaaaggcatacgggactacaagagtgtggtgcttggagtggacatgcttgtacaagaacttgttgacatgcatatatctgtgcatgaagtattgccatgtgtccataacaaacatcgcaatgatgaattgcaatgctatcacaagggccggaggctgcttcctcacagtaccactttcatcaccaatgatctacattttggggaaattgcaagattgtaagtacaataatcacataagaagtttcatcaagtagaacgaaagtaggttcaaagagaaacttctattagtagtgggaaccgttgcatactatttcaaactttattgttttctagatcttcatatattagcttgcgcaaaatgtttgaaatccaatataataaatttccccatgttaaagaaaccaaccaaaccctgtttacttaacaggttagcttcagagttaactacagtttaaggcatgttcaacagtgagacaaaactcaagctcatatgctcccaaaatcaacatgcaaccccaccaattctgtttgctatcaccaggctaatttttccccacattacaaatgctacaaaaaactgtccaatttcgcattcacagttatcaagaaagctattgtttcagactagttcatgacatattctcaaatccatccccaaactgaattttcttttccctatgacaagaactaacagcagcgctaagacaaatgtgaggagagggattgttaccgtgaagaggaggagggagacggcgatctggaaggactgctggacgaggacgcccttgacgacggtccacttggagacgacgttcttggtggcctcctcccccttggggtggagcctgtagtcgtccatccccatggcgtccagcacgatgtacagccccgagtagagccagtacaccgcgatcgggacgaacgtgccgagcagctcgtcggacaccgcgaacgccatcctctcaagacactccaaatctccttcaaatcctctacacactgccatcgaaaaaaggcgcaaatctgaatgagcaatctgaatcgcaatacgcaggcattggcgggcaccgagcacaaaaccctcaaagaaaccaaaaaaagaaaaacaaaaagcagggaatcgattcggatcttaccaggaggaggaagcaaagaacgcaagaaggctctcctttgtttgattcttgtgctgctgctccgaggtgagtggatatggtgcagggcggccactccggcgagtacttatagcgaagcaatgcggagggggggcaatggccaaggcggtggcggtggcgggcgggcggggtctgagaagggcggcgagaccggcgactcgtacaaagatttgttctttttttggacggaggcgagacgcactcgaggaaggaaggaagaccggctcggagaggagaggagagaaggcgagccgtccactcctcctatctgttgctgtcttgacttcactggaatctgtgtggaaggagaggagggctcttctcaagctggacaaagggttggttgctgcttctccggtttaggttgtgttttggggttttttttttttttgaaatttttgaatatttagtattaaaagtaaactcttgtaaaagttgttttccaagatgtgaatcttttggccacgcaaaataatactgtcatgtcggtctggttggcgtggtagaataaaactgtcaagcctactacacgccagctcgttcggattttggaaataagttttagaagggtttatttttaaaattaaaaattaggaaggtatgaaaaaaaaatccactttactatcttctacgcactttttttcacatgcacgctttctgagttgctaaacggtatatatttctaaaaaaaagtctatagaaaagtttctttaaaaaatcatttaaatctatttttaaatttttttaagataatacttaattaattatatgttaataagctatctcattttttatgtgggaaggaaaagtccccaactcctacttccaaatacatctggcattctaggatttaaattatatagaaaagtttcctgtagaaaatatttagaacaaataactgattccctacaaagttctttgaaattttagtggactaggctactatagaggagttgtggagaaaaataatcatgtcttcatctttctataatttcaagctcatgtgtttttcccatgtataattgaaactgtagttttgaggcttttctaagtttttagttttcataggaatttaattagcacaatattctatttattattattattttttttagagaagggtatttttttactcggcctctatatccaactggatatatgcagcttttttttaataggaacttagcctatcgaacagggaactaactctcaaataacccaatctgaaattcgctcctatggagatttgaactcaggatattgggtgctactcaggttactgcaaacacgatattctattatatgtttctttttcatttttgtattttcacaattccacgttttaaaagaagacctataatctagataactaaccctagtggtaagtggcgaatgtgattactgttatacaattgtcaaacagaaaattatgccggctagcacacaggattacaggagattggaatggattctcagatgcattaactgttttgaaggagatagcacgtgctgggatgttttgaccaggccattattttttttactcgagttgttttatgccagcctgtaccgtccaaaagaaattatttgtacaatttaaaattttaaaacttagttttgtaactaaaattagatgtttttagttgtttttacttagttttggctttatgaaaactaaaaatagaagtgtacaagttttatcgtaaaattattttatattagtaatgtatttttagttaataagtcgcagctaaaaatatatcttcaagtggacaataacagtatcacttggcaggtttgtaggttgacacaaattagggtatttttatgttgaaaaggcacttaattatggtgagcacgtcacattttttgcttggtattttttggtcaaacttggagaaaccaggataacagaccacaggatcatcatatatactatcatgattctacatatcattccacgtgagattttgagattgacctctcgtcgcaggatgtcacattatcacatcccatcacaccaaagcactatactactcttaacgagtaattttgccccaaatcttctacggtgattcaaatcaatgatcattttgatggatgaattggacaacttggaattgacaaatggcatatgccttcctctacgcctttccattaaggcaggcgttacaaaattatttgcccggacagaataaagctgcaaatttaattactccctcagtttcacaatgttagtcattctagcatttttcacattcatattgatgttaatgaatttagatagatatcaatatgaacgtgaaaaatgttagaatgacttacattatgaaacggaggaagtagttttttaatgagttacttcgagccgcctagccatgttgtcagtgtgataaaaaatacgagccttttgttgtaaaaaagtgtacattttcgctttcaatagtgcgtgatagagcccacgtgtgcgcgtatggaatgcacatttataagcgtatggagtgggcatgtatgcatatacatctttgtgtaattagaataaaatcattttattaaaattaagtaagcgcaacttaactgattagattctttatagtggaatcaactcattcggataaattctaaaacacgggtgttcgtatttacggttaattattctttccgtgatagataacgtatatgtcaatagagagactcacatgtaaatatcaagatatgtgcgcgtgctatgagcgtatacgtctgtactgtgattctaagattaccttttatttaaaaaacaaggtagtgtttgagaaccatagtgttccacgctagggagaagtactaccgtaccgaacgaggctttcaactccaaaggccaaccagtttagaccagatcgtccggaacggaacgaaaaaacagaacggcgttgtattccgtggaacagtagcatcgcgtccatgttgctctaccggccattcatctattctgacatcttcggtgatggcttggtcagcaatggcgcagttaaaaatatttttaaaaaaatcagcaacagaagcccattcccttgactaatttcgctctgtcgttaccagggtttaaaagaaccggacttcctaactggttcgagttctaaaaaaaatcaaactggattttagatttgtgacaaaatttaaccgaattttaccaagagtcaacggttttcatagaataaaccgtcgacttgagaacggtttgataaacctggttgctagtgcatgtcaccattccataatagacttgttggccttttgcttcctaccatggcagatggcacaactgcttcacactgattacgttaagttttggacgactgatccaccactcatcaacgtgcctaatctattaattagatgctactgataaatgataatacacatatccgcacccacttttcttggctctagaaaggctagatagcatcatgccatgaatctacttctccggtctctgcacggtaggggccaaagttgaatcatagaatataagagcgtttttttggaacgcgggattctcaaaacgcagagagagattaaagtgtcatgacatctcaaatcccatggattgaaaaaacacatgaaaacatatgaatagccatttggatagaacacaggaaaaatatagaaataaggccctgtttagaggtcggctgcggctcccgatgaggaggagctctgcagcgagtgagcgaggtcggccgcagcggtggtgttaggacttgggcggcgaaacggtgaggacagccggcgatgtgagaggacgaggaggatggaaagagtgacggggtgaatgaaaagagtgacggagtggtatggttctaattttaaaaattttcagtgtcatccagtcgataacgcgaatagtagtgttatttttttgatttgccacatttgcagtggcatgggtctaattaacccaagtttttttccaaacttcacatcaaacctttcttacacacataacttttctatcacatcgtaccaattttaaccaaacttccaaacttcagtgtgacctaaacacagcctaagaagagagaccctaaggatttttctccaagaggttgaagtccatgttaaaattcctccagaattcctatgatttgagccaatccaaaggaatttcataggaatttttttaatagttattcctatgaaccaaatgaccattgaggaaaattttccataggattgaaaatttataatggtctagaatcagctactaagctctacttgaccaccatcaaaaactaggtcagaatgggactgctgtaactgctaaccgcacggcacggccatacgtccatacgtacgtcacctcggacaaaactgatgaagcacacaagggcacaagtaataaaaataattgaagaatacaatccccagcgaattagcaagggttataatatttataggaaggcaaaatgcatcaccttccacaacaatgcgattgagaactcgaaaaaaaattctcagctttcatgatgcaatcagcccaaggatatcacatatatagccttcttcttggatagggatgaaatcagattggaatcaggaggacaatatttgtaccagatcctgggtttgtattatatacactatccaatacactttcatccctagtcttggatcaagagtttataatcatccaaggttcaaagaacacaaacgaaaccacccagcctcatagccctacttgagccttgttgccttggcggaatgccaaggccaaaagaatgcggcaacacgcaaacaaaaagatgagcttaagattcatggatataactttgcagcacaattcaacagcatgggtgaacaaggttggaccaggacatcatttgtgcagggagcagatcaacgaggacagaaaatacaggtaaagcaaaccacagtgacaggaactgtgacaaccatccaggtttcctaaggtttggacaacttctaaatggcaccgatgcatctagcagtataaccggctcagggtaaaaacatggtaaattcagagtaccaatcatcgatacgctggcgcgccaggaaaggaatagagagacgaaaccgatgcaccaggtgcattaagccttgtagaggcatacctttgactgatatcagaatatgcgggattggggacctcataatgagctgttggatagggtgcgtggagagggaggtccacagcatgagtgatgcgttggtcagaacggtaaagatcctctacacgaacagcacgagcagaaatttctccaggacggtacagatcctccacacgagcaccacggataggaatttctcctggacgatacagatcctccatgcgagcactgtgagcagcaacctctcgtggacgatagagctcctccaca

SEQ ID NO: 68761 - DNA, 7240 bp, Oryza sativa
tcccatcctaggttgttttattttgggacggagggagtattgtagcacttttccggtggtatgttgggaaaaaaaaacatgaactacaacatgtttttagaacatatttttccgtcaggaataaactaacaagactaagtttccacaaggaattaggtcaaatttaaggatgggcgtgggtcactgactggtgcatttagttaattttgttgaactagacaaattcatgacgatcaagcaaccaatggaacttctcttgcaaagttgcaaacggaacttttctctttttcacaccttagagagctatatctccaagggaacagttaagatgaactataaatgggccatcatgtacataacacacgttaacctttcttttgctcagaactgctttgtgttacattggtctattgacaatctgacacgcttcttccatggattccttttctacatttcctaatatataaactatatggttgttaaggcgggtaaggcgacccacccacgccttactagttaccactatagtgtaaaaccgctaaggtatggcgacaccataacctaagtgattagcagcatcagaagagagagagaaagaaaactcaggccagcccaacaaagcccaataacgttcataccagcccaaagtcaaagaaataaccctaacacccacaccaggtacacactctctcctctcaaagcgctgcctccaatgtcacttcttcctcacgcctgtatcgcttcttccttgtgctagctctgctcctctatctgtgctccttactcccctgattcagaatgaatccagtgcttctctttgtatgtgctccttcccttggatggatctaatgctgctcccttgagtcaagatgaatctggtgcaggggagagaagaagagaggaaaccagagctaagggggagcaagatggcgatggcatggagcagagaaatgggaaaatggtgtagttgctgcttccttcacctcttctccctctccctctctgggttatggcattaagcccttaaggtggagggatgccttaacaccctcagggagccctagagctatagcgacgccttaacaaccatgatataaactagagatggcattattatcaagtatcagaattctgttgaacaattctaaagaaatgctaataaaaaatcgtaatatatttcttaaacctcaagattgtaccatagaaatatttgtggattagataagttatgagcacttcagtttaattgataacataaaattgcacttgcagagctgaatgataagagaggtgaaggcatttgggctcggttcaattatctaagaaagtgtttcacgggatatatactctattttaaaaccaggatactggccatgttccattcgtataaaagacaataaaaatgttctaggttgctaatgcatgcattgatagtaacaagtccaaacatttctcacacggtatctttacatttcggaaaaaacacagcttcaagcgttaatctacaaaaaataactagttaatcaattttatgtcagttttcaaatatttaactaaccaatggaaagatcaacttaatttgctgaattagtaagtattttcccgtctccaaacactatgcgtttccaaatgttttactacctttgtcccaaaaagagttcacttttagaaacgaatctgggcatgcctcttgtccagattcatgtataaaagtgcagtctttttgggacagaggtagtatttattaaccacaatgacagaccaacatgcaagagagagaagctctcgcaaaatttctacaagacatgttacgaataataaatatggaccacaacttaggaagctttgtgcattaacgtaccgatcaggcagtggatccacttgagaacgataatatggaacatcagatggagccaaatggcggtagtatgcatgtggaacatgctgaatctctgggatagaagggccatgacgaggctctagggcatgcggcacaagacgaggctctatgtcaagaggaacacgctgagactcgcgtgcaacaagtgtttgctgataatgtatgtggggaccatcatgagcattagacaaagaatgatcaatcctataatccactggatgtggatcaaagcgtgttgccctgtataagtctttagggggaggaacatgcatgacaggcaaagaagatcgtctttcttcatattgatgtggctgtgtttttccttcatagtggtgcatctcttcaagaggcttctgtggagctggttgaggtacactcacagactcaaatagagctattagcctatggacctgcacaatatcatgtaatacataagataaagtaaatactaacatctatgatttgttcttttaaaactttctgttttgaacaaaattcaaatgacactcacttgtctagagttgagctcgggattgaacttgctctttgcactatagttctctctgattgcatccttaaatctgctctcaggaagtggaaggcaatctttatctatcttaaatttcacctgtggcgagctcaagcacaaaaaatagttttgagtacaacgaaaatatcaaatcttcaacactaactactctagatgaagcccattttcaaacagaaggttgtgtggaatcttgtgcccatgaattcgtgcttgatcattgaaagtagataacagtccaaatatgcaattgtgaggtcttaaaagttgtgcacggaattggcaatggtggtcctaatatacatgctgtacagtcttatgtaagaaccacttgtacaaactttcgtgactttccatcatatggtttcccagatatggtaaattccaactaaccaatggaagtgcagtaaaaacaaatcgaccctcacagagttacagttatatctgaaatgacaacttgaatataaaccaagcatcaaagaactctatggacataaatggtcacaagcaaatcctgttattaagaaacaggggcaatgaatgttctcttagcagtctatcaaatcattcagtcacattacttacagcaccacctgttttcttaattaaagcaaagatgaatatagctagctagtatatctacatctgtttcaacagataaccaatgcaaatgcacaattcaagttacagctgatgatgatgtctaatgcatatgcatcaatcttccgaaaatggaaatgcaatatgtatcgacaacagggttattttgttctcagaaacagtgtgaaccagaaagataccatttctactatcgccaatcataggtttgtgtacaaaaatcattggtgcaccatagtatcaatcaatccccaaaatagtatgtacacccttaagtataaaaacataaaccccaaaaaaccatattcacttcctctttaaaaaaaacattcacagcatatgagtttgtctacagcgatggaataccagaattacctgtgcagggaattttccactgaatgcatctcgaacaagatcaagcccaccctttgatactgccttgtacaccccataaagtagcttcaagtcaaaatcatagaggaacaacctcatccctggtcggatcttctcaactattccgattttccctctgggatacccaaacaagcggctctgaaagcattctggtttagtctgcgcattacacatgaatataagccctcctcccttactgtcaagcctctcttccttcttgcttccctcctcctccttcctcctttccttcacattgctagtcctctccccagcaatctctctttttctcttcttgatggcatcaccatcgttgttatcagcacctacaccattcttggtggcaactacagcattagcattagcattagcctcagccagctttggttttagctttagccttcgctttggcgttgatgcttcagccgtagctgccgctggcgtcgatatcacccgagctgctgatccatcggccacagtagctgatcgcggagccggggctgcaggcgatgcatcagcattgccaccagcagcaccaacggatggggaccctgaagcggcagcagctgctgcagccttcgccttcgccttcaccttattcaacctagatgtcttcttgaccgatgcaggggtggaagggctccccttggatgccccgtccgcatcagccaccgcggccggtcgcaaagccggagccgcaggcgatgcatcagcattgccaccagcatcacccagggacgcggcctctttaccagccgcagcggctggcgcagcagccttctcccggctagccttcgccttcaccttcgccttccccttgaccaacttagtcaccctgagcgatgcaggggtggaagggctccccttggacgaccccccatccgccccaccggcggcggccgccttgaccttggcggcgacgttgggcttcttcatcgtggttgacctagcgtggaccaaatggggggcaaacaaacgaacgaaaacctatcatcaaaagctacaccacgcgcgcatcaaacgaaccaaatcgggaaggaagaacaaatcgaatcgatcccaactccggattggatctccgacgagggagggctacgagagagatagagatgaaaaataccttcgattcgattcgattcgcacctgctcgcgggcagcaggggagaaggcgcacgggcggggaggagaggagcaggccgaccgaccaccggtttgcccccggcccctcgtcgccggcgacgtgcgccggagcgaggcgaggcggcggaagttttccggccgtgcctccgccgggaacggcgtttctcttcgcaaacaagggttacgatagcgcaaacggagaatcgaagataaagcgagacggagagaggggtggaggtgtggaaggggaaatgctttatgggcctttatttccaaattagtaaatttagcacattttagaaaactttttttcttcaactgtcaatttccttgaacttttcgtttgccttgctagtaatgggtatatatatgccacaagtaggatgactcatctaaggccatgttttttcagcttgggattattataatccagattattaggagtaagttgaaagaaacggataacttattgaagtagcttattataatctagagcccagcttattataatctgataaactcatttaggtgagctttttctagattattgagtgaaaaattactcaccatgccaccccactccctttttagacttgcaaactcaataatctaggctctaataatctggaaagaaacaactaaccgcttattctactacagattataacaatctagcttatagtaatctaactcaataatctagattataataatcccaagctgaaagaaacagggcctaagactcttatatctacatatgtacttcctctgttccattctaaaattgcacggtgaatattaaaggtaaagtgtttttcaagcaatatagtttttctttaatatgtcaagctacaatttttgccaaatgctaatcttgataaaataggtatagcttcgtgacatttattccgattaatggatatcactattaggaacactcactaagaacctgcataaatagtaataagtggtttttaatggagtatccgccaataaatttcccgccaaagtctacctcctcactagctaaaacctcatgcctatgttatgcaaatccgatcaataatattttttttacctatctgaattacaacaccttaacatcataatgtcttgctcatattgatgttgttaaaagagaaaaatgtaattgatgtttgtagaatttgaagggtattcctgaagatcaatgtcaaacataataagagaggtgacttgtttggacccctaagaccgccaaagagagatgccattcattctatcctaagaactaaaatcctagtgtgcgatgacatagtgacgattatcatgttgcttaagagcataggaaattatacgaatgagtttgaatatatggttagatgttttctctttgctatcacttgttggtaaaccggaggaatgtgaggaatccaatggtataaaagccctacaatttaaagcttgcggcacacgccaaactaactgatgaataaagtacctatttggtgacattcaaaaaattttaacattcatgaggatattttcaccttcgcatgaattcacaatctgttaaccaccatcatcattatgtcaatgacatgagtgtgttgcacaacttattttgggcaaactaagatttaagcatcaatacatcgacaattatctcaactgaaattatgaaagaaatagcaatttcgtaacaaaggaatttgtcatgtacataaacatacataaggcaggagatggagcggagcttgaacaataaaatgaaggggccaatatgtaagtttctttgaagtataggctactatactaacataacatgtgacataacatgtgacagattatagtggacaaacttcccaagccccaagctaacaaaaaaaatttcttcatcagtatttctcagaatatcctttaaattaattaatttttcaactttcaaatatttaactactttatttgtgcgttcctataattgtcataacctcagttttattcctcaaccatcaatactctacaagcatggcctttaacttcaagcagtcatgggcatcaggttgacatcataaccaatcactttggtagaatccttttacagtcccatactcccatcctgattcagcactgcagaaaaaggggaaaattagaacaacattgcatcatctagctgaccagctctaatccatcaccgcacataggcaatccatgcgaacatgtgatgcagctttccatattttcttcgtattactcaaaatattgactagccacttcttggcaaaagaatcacagcatgatcaaatacatatttctcatggacagacggcagctggtgagtccactaagggtgagtttgaggaggaggagattgagaagattgggaagatacaaaaaacgaggtgagccattagcgcatgattaattgagtattaactattttaaatttgaaaaatagattaatatgaatttttaaagcaactttcctatagaaaatttttgcaaaaaatacaccgtttagtaatttggaaagcgtacgcgcggaaatagaaacaaactcactcactttcttcagctgccgaacgcagcctaaagattgagatggcagcagctgataagagctagcagaacagaaagctgcttca

SEQ ID NO: 68762 - DNA, 3930 bp, Oryza sativa
  unsure (1)..(3930): unsure at all n locations
cttggattatacccaaggcccattacatgccatgatttgtcaagcggctttgtattgccatagaatgtcatcagcccagcaggtagaacagatgtgggatcccaaagcacaccatcctcattctgccatgaaaataatgggtcatacattcatacacatatcagtgccttggtgagtgcaaacgcatgctagtaagatgcaaaaatagacaactatgagatcatttgcataactgcatatgtatatagtatattacacaggacaggacaaagtaggtcaagataacatgcaaacataaattgtatatcggggctgttattgttttaattactacacaatggccaatgaacacaaaaagcttagggctcagcaaaaaagtatcacatatgcatggcaatagaaacctagtgatgaattcatcttgtgttttgtggaacactagttgagaagtcaagatcatgaagcgctcaatcaggcgactattatacactaactgacatgattggttagatccttgtttacaagatttagccacactgtggttgaatcggctaaactagaaccagtaggtttgatgacttggttcacaattatagccatacgtttcaacatgaaaaaccagcagtgtataccttcatgtctatatctctatttttttacttctctcccttcatatctctacatctctcaatcttcaacatttagtggactaagcaacacaatacttaggggctcaagaaatatctataaccacatcgtgcaatcgcatgggaaattcgctagttgataaacttttacaaatgtgatacatttctgattatccatacacatcattgatagtagctaattggaatagtcacccaagagactacataattcttcgtatgtcacagaaggaatgtattgccctataatttcctataccaaatgcccactcaggttatttaaaaattgcaggaaacatcaagatacctgaatcgcatgatgatcaatcacaaaatatcttaagaacttccatcgagctagtgaaactgcaaactaaatgcatatgcacaaccaaatggcacgaatcgaggagattgggcattgagcataactataagcggcagtcgcgtatcaaaccaaacgcactccaatgctactcatatatgttatatataaccggataaaacagaagcttaccatttccatgtactgatggaacagctccgtgcagccatcccttcgccatgcctcaagatcatacacattgaccccatatgcccaagcacatgcgccaggatcgaaccgctcctgcacgatggcctgcgtgaagttgagatacttgctatatctcctgaatccaccgaagcacatctcgacggcaccattcaccttcccatccaagtcgagatgccagagcccagccaaatccttctgcaccaccacatcatcctccaggagcaccaccctctgcagtgccgggaacatgtctgggaggtagaacctcaggtaatcgagcaatgccacgtccctcttgccggcctcgatctgcctgagcaccggcgaggaggtctcgttgaggaacgggaagtcggagtaggcgaggagctggacgtgcacgccgagcggcggcgggcggcgggcgaaccagacgcggaatgccggcaggtacatgggcgcggtgaccacgtggaagacgtggcgcgaggggtcggccgcggcgcgcgcggcggaggccaccacgacggagacggcgagcacattgtcggagaacacggcgtagtggtacagcgaagggtcgtcgaactccggggacgggtcggggtcgtcggcgaaggcggagggcttggcgaggcgggcctcgaggaggcgcatggcgaggcagtggagggacttgggggtggagcccgcggcgatgcgggaggacatgcggcccgcgcggcgggcgcgggccagatgctcgccgacggcgaacaccgtgtcggagagcttctggatcttggactgcgtgtcgaacccttccttggcgtcngcggcgaggaggcgggcgagcttgatgcggtcgcgcgcctccttctccaggggcttcaccgcgtcctccgggagggacaggtgggaggcgaggcgcgacgagagcgccgacaggtcggacgacatcgtggcgaaggacagcgnntcnccgcccnacgcctccttgagcctccgcgcgtgcgcggcgtacgcggccagcaccgccgcgtggtccgccgcgtggcgtcggatggcggcgaggcgggacggcggcgatgcgccgaggtaggaggagcggtgcgaggcgtgcgtcggaggcggcgaggataggaggaacgagagcgtcgccagcaggagcagcgtcaggagcgccgcgaacgccgcgcggcgcggcgccgacggccggaacgcgcggccgccggccatcggagcagtggaggggagggggactggagtgggaagcgcgtcgcggatctgagactgatgaaggagacgggtgggcccgcggtgtcagtgggcgcggggtcgggtatcccggcgtaaacagtgggtgggcttgtcggtgaggttagatttactaggttatttgtttataggatgttattattggtggattaagtcgtgggtttaattaaggtggggacattattaatcatttgattaactgactgactggtgggggcaccgttggattcatgagaaggtgattcgtgtcaatgacatgtggggctcgttacattgggtccacttgtcagtgaggtattaagattgggagtagttggtttaggtgggagtatgcatgggagcaagatccggccaggctggatagatatcgggagtcaagacagacattctaatcgcaattttagaatagatcaaattcgatcataagattagttctaaactacgtaccgtgtcgacgacactcgacagtggatagtcaacgcggttcccctgctctactccactgaattttgctccattttgttctattgaaacataaataaacattaacaattctttgacaatggctagctgaacaattgatctaagggtgatcgaaggccgaaaacatagccaacctatacataaatgttgttacgatctgaccgttaattagttttgcttactctaatacaattgtaacgtattcggtactccctctatcccaaaatatagcaacttttggatggatatgacatatcatagtaatatgaatttggacaggcctcttatccatattcgtagtattagaatatgtcgcatccaaccaaaagttgctatattttaggacggagggagtatatacatagaaaacatccttctttgaccaagacatcgatacacttatctaatacgagagggtggaccagaatacgacatgtgtactcggtcccccagcgatgtaacttgcaatgtaggttggcgaggctgactgataggatagatccacgtgtagagatcgcaaatgtgccacccttgcagaggttttggccagttgcgatgcccctagggtgcagggataggctgagactagccgatgaagggatgtctttacattgacgatacagtggaagctccatgaaagcaatgaggctagggtgacaattttgagtgcaatgatccctctagacggcgttgtcaaggtggctcgctctcccttccaccggtcatttcagggtgaaaaccatatgttcagttttccttttacgggcgatggtggtgctatggtgttgtatctttattgaaggcgttgtcttggaggatctgtttttgccttccgttttcagacagttgagcctatgtttttggatgacgacggtccgttctttctcacactctccctctgcaacccctctcggttgtctggtagactttggtatttatcgtcttttggcgtgttgggttgttcagttttggatctgccatggctctagt

SEQ ID NO: 68763 - DNA, 772 bp, Oryza sativa
gctgctacttctcgtgtctcttctgtaccaatggttcagtctccagtctcctcaaaatctggggagatatcaagcagttcaatgagtgcccagtttggcgctgctgtgacatctgctgtaatgggatcacagaaagacaagttccctgcaaattccaatcctgcagtagtgggctatccccctgttgcttctagccctagtgattcaatgcaccggatgcagcagccttcagttgctccttcaaagagaaaatcaaattctgttcccaaaactcaaccgcctgtgagtggtgtagggtctccagccagtgtttcaaacatgcatgctgtactgaatgctagcagcccatcaattgggactgcacctatgggtgatcaagcaatccttgagagatttgtcaaaattgatgccatatctcaaaggtataaaataaagatttacagcatctgttaacacaagttattggttattgttgaccttttcttttgttttcggtgttttatgtagaagtgtgcagtctatttactattgcatagagcagttcatagctgaaacagaaactcgattaatgattatacaagatctaaaatccttttatgtccttgccgttgaattgttataatttcttttggttatagcatcattttacattgcagctaaagttcatgattgtcatgtttttctcaggtgcaagctgcacagcaagaagaacaaagttgacaatatacctcagagaaaaccgattatcaatgcaagccaagagaaagttgct

SEQ ID NO: 68764 - DNA, 58560 bp, Oryza sativa
  unsure (1)..(58560): unsure at all n locations
gattcagcagcagcaacagcagccgccgcagctgcagcaaaatgcacaagcacaactgcagcaaccagcatctcttcctctcaaccagatgcagagacctcaacttctaccaacgaacccattatctcagatgctggggaatactggctccaatcttccgatggcctcaagccacatgggtaacaaggtcgctctaattctgtgcagcttcagatgatgcagcagcagcaacagtcgaggaaaatgatgatgggcctcggctcgcctgccaacatgggtaatatggttaacaatgttgttggcctcaacaatattggaaatgttatgggaatgggcaatgtgcggccaatgtcgtccccaatgggaaacatgtcaggcttagggaacaaccccaatcagatgagccttggaatggtatccagtctctctgcacctgggattcgtccaggtatgacacatgctgctattgccaagatgcgaatggggttgatacagcagcaaagagcagcaggcatttacccccagactagcatggtcggaatgcctgggagcagttctccgattcttcctggttctgccaatttgtccatgatgaatcagctaaacagaagcaacattaaccctttgcagcgggccatgatgggtccaccaaagatgccaggcagtaattacccgttgactccgcaacagcaaatgcaactccagcaacagttccaacagaacccgctgcagcagcagcaactgcagcaactccaacaacagcagcagcaacaacaacaacagcaaatccagcagcagcagcagcagcaacagcaacagcagcagcagcagcagcaaattcagcagcagcaacaacaaatgggctctccgttacagcaggcggcacaggtgggctcacctgctggttcgcagcagtcattggtgatgtcgcagcatcagcaaataagcccacagcaaatggccgcgatgagtccacagctgagctcaggcaccatgcagcaagtgaataacaatgttatcaaccacgtagccacaccaggccctcctcctagcccgcagctcagctcacagacccatgggtcggtcaacagcatcgcaaactccccaatggagcagttgcaaggtgccaataaaggaggtccagggagcatgtagtgacggcaaataattgtttctgtgatggacatacaaaataatgcaaggtataaatatcggcagtgatcagcactttttcttatttgttgtggtaaatgatgttaaagttaggtgtcctgtaagttatagccaatagatgaagatattatggaggatcagccttacgcagggatttctgatgttgtagattttagataatgaaattagtacctttaggggattggtactgatgaaagttttgttcaatgggactactttcttgtttaaattaattatcaagtttgtgtaatagctatgtaaccgtggtgcttattaataagtatcttcatttgattgtggaaattttgccctgcttttcttgtaataatctggtataacactgcgattttgttgagctgtctacatattctgtattggtattaccacagtttttggtggaagaatagacggcttgttcatagcagttcatgtgatgccatagaagtatgtgtaatgtcatagaagtgtgctgtgctgttcatgcaacatagaatgcccaaaaatgacagtgtatcaattatttcccaggtgatgttggaagcctgaattatgacatttgagtgtgaacattaatgctatttcttctacatattacattcatgcttttacaattattgtgcatgtatgcattagacaagatgtaatccataaatccaaaagtattgggattcacaaagcagcttcatttggaacttggaagaagatattgcgttccggaatagtgaagccttggtcagcacacccggagaaaatttaatggagtcaaaataagtggattacatatgaagcaattcatagtgcataactcttctagctaaatttaccccttctttttcatgatttgatcgtataaataaaatacagtccaagacatactcacatggagtttttggagcagggcattatcacttatatactttcatgagatttcttattctactataagtgaatgaagcgattacttaaaattaaatactattggaggactgcaggagcttattctagataaaattcatgattgtttaattcatctataatggtaactgcagcttgtctttgctgataacgatctgtgatgccataagaaagcaggcagattggcaaatacgcacacatcaggttctagagctttatcacatttcagttctttatgaaataaaagttcatttttgcaaacgatttccattttcaaacgagcgtcccattcgatttccatggaatcaaaatcatatatacggaccagatgctcatagttgattaagaaaataactcctataaggagagaggaaacatattcccaagacctttgatgaattcaatcattgttgcgtctgaccactctgatttccaattcccaataatgggatgtatgacaactttgcatgaaagagccgagttaggatcaccatgttgagcaaaatgtatccattttaaaaacaaaatagcacaaatcaataagataggccatctcactaaggaaccaaacttgcatgttcaaagctcttacttgagggaagggacgaagggtatcccttcaacatatgtctaagatgattctaaataggtgatggactttcacttgaaagggcaatcttggctgtttaccctgtccttacttattgggttgtcaatcttacgacttggtccgaacaatcttcataagcactacaagtttcattttcaaaaagaaaagaatcagaggattctaacatataagagctcttcttttcatgtttagttagaacaagagaattgtcataaaaatcaggtaagttgcagcaagttttgctaggaaaattcatcaatctaatgcagttaaccaaagctctatcctctacgtagctattaaaatttagacaacataattagtaggacggttcaaagtgtcatgtcaatatatatatataactgttctatcacattggtttgtctgaattttagacaactccatgtcaaaatacagcttgcttgcaattgtatgcttagaataagggcaactctgcagcaaagggctgtgcctttcatgatatttggaatgttttcccttaagctagttgaagaggttcagttctcaactccatgtcaaaatacagcttgcttgcaattgtatgcttagaataagggcagctctgcttccgttctcattttcctggtaaacattttcaatcctctaccatcccatacaagggtcaaatactctaaagctcctgcttttggtaaaatagaactcacaataacacttcataatgaatatgccgagcaaatttatttttggagtacataaagacacaaggtagacagtagcaaatataaaaaaagtgctatatcctatagctttttatatcggcagatcaccacaggtacacggaaaactccattttattgtaagtccaggtctactacacatgtaaatgatgtttggaagctgtatgcaaacaaacctagtaattatcagacaaaatgtccaaaggccagcaaataccatcagaaggagcaccatgacagcatttggcaagccacctaggaaatgatgagtgtcagtactacgattggttctatatagaaggacaaactcaatcttggtcgaatgctcaaaatgacagatgacgtaccttcaaagttatatcattctgtaggccgacaccattattatgttacatctggaagaatggatgaacaacaagattttctttgagcctatgcaagcaattcattggcagctgaccatcaaactggaaagaagccaacacattgcccttcctatcacagtgtaaaatccgattcgagcatctgaccagcacatccccctccacagaaacaaccatcgcagaccagccaagatgctcaagattacactccgggaactgcctaatctgcgccatcggcaattcgatgcggtgcttgcatgcccaagtgctcctctcatagtcctgcagcacccaaagatcgatcctcgtcgtacattcaaccgcggagaagacaagggtgctatccatctccaacaaagacacccaaccaggtatcgccgggtggcgcatccactggaatgactcgctcgctgtatcgaacaccattatcttgcagcctccatctctgtgcctcagataccagtgcaggttgccgcgcaccagcacggaccgatcgccacgggcatgcatcagaaattcccttgccaatggctgctccacagtctctgatcccattgtcattgtgatgcaccttggttcatcggagcccaatgtgaggatgtggtagacacactcttcttctccatggaattcaccatacagcacccggtactcaccggaggggttgtgcgggtaaagccccaagaaatcggcatcgacgagctgcgggatttcggcccagtgattggtggccgggttgcagatgtagaagcggccggaggagaggagcaggaggccgtcgcaggaggcgatgacggtgtagccgagtggcggccaggtgtggtcgacgacggggcggagctgcgcggcatggaggtcgatggcgccgacgcggtcgctgccgccgcggcggaagtagatgagggggaggtcccgctggcggtggtggtgggcgcggaggaaggccgggtcggaggtgaggcggcgccaggcggtgcacacggcgcggcagcggaggacggacctcgccgggaggcgcacgaggatctcgcacaggaccatctcgtcgtcgaggccgccggtgaatccccgcggcgtcctcctcacgtcctcctccaccgactcagccggcgcggagtcgaccctctcctcgcccgcctccgccacccgcgacgcccgcgcgagcaatccgtcgaacaccttgaacctcctctccacctccatcactatctccgcctccttcctccgccgcagcaagccgatcgccggaagaacggcgttcgcccgcgcctccctcagcaagtcgaggagctccccggatacgccgccctccgccgccgcggcctccgcccgggcgaggcgcgcggcggcgccctcggcctccgcctctgaggccagcaccgccgccgccgccgcctccacctcctcggcgctcggcctccgcggcagctcccggtacagcctcgtcagctcctccaccgccgccgccgccggcgagctccccatcgccgcggaacggagggagtgaagtataataaataaataaataaatttataaaatagtcgatgcgaagtagaaatggtaaacgttggagactgataaagtgataattaataatcagatgagatcccgtctttttcagccgtccgatctgggatcaacggtcgagattggtgtttcacatgaaaacatcgaattcgcctcatcatcttatattttctatttgatcaagattgacaattcgtgatctaatagttgatatgaaatattttaagtttttttatgtgagcttttccttcacggctgcctaagtgcagattaacatgtacacatgggattatgagatggttaaaagcagtggcggatttaggatatttctgtggggttagctgatcccacagctttttaaaaaacaccctataaaccttaatttttatgtataaattcaaaaaaattagagaaatgaccccacttaaatataaaccactagtaattgatcccacaggtattaaatcctggctccgccactggttaaaaggttgatttctgaagaaacgaaccattctagaaaattgagacctaagtcgatgaagacagccaaaagtttcccttaacaaacacagcgtttattaaaaaggttgttctcgttccaaatactgcactgcataaaagtgttcgatctcagaatccattcataaaccatggccaagaaagcaagaaaccttgcctggtattcatgcttcggtatgcaaatttgcaaatcatcacatgattgtgcaaataaatcagctggatagcttatacaagagcgtgagaaaccaaaaaaacgtgtagctttctgaagctttacttgctacctcaggttgactcgcttgtccaaccagattactcacccaaaagacatagtttttcccctctcaattgtcaagcatcgcatcaaagtattgcacttaagtttactacctcaaatcatgcataaatttgcagttttccccatacgggcaccatccctgttgttgataaatgaagcatggcttccatggtcgaaacctctggggattctggttatgattctgcctgtcatggtactggtttccgttcattccctggcgaccatggtaattctgatgatggttctgttggtgatgatactgatcttgagacatttgcctgtgaccataataattctgatgatggttctgttggtgatgataactctggtcctcccaatggtaatcctggtttcttgacctgagaggttgatgcgtttcgcgatcgacacgagcctggtgatgaccagagccattggaaccatgttggtatgtctttgccttctgagtgaaaggctggaaggctggtttatcatggtctgtagagccccaattgttactctgacgatccatgaagcctgttcttgaagtacttgtcccgccctgctgccaaaacgcttcattcctgtattgatgattaggaggttgctgctgtgtgtaagagactgcttgctgtggagtaggagtaggagtaggtcttgaagatatctcctgccgcctcatgttctctgatcctccatgttgtctggatggaggagcctggtgattggtaaaatcttgtctggcagctgatgtttgggatactgcagccctttgctcttgcgaaggaggaacccgcggaagcgcttgattgtggtgttgatgtttgggatactgctgtgggtatgcagaactttgctgtataggagcaggcttgattgattttggcggctgctgctgctgctgctgctgtgttgtttccacttttacggcatgttggagggaaggagcctgatggttaatgagctgcgttgtgctagttcttgatgttcccttttggagaagcacttcgttgtgttgttgaggatgagggaactgtggcaggtaatggagcaattgctctgtgggagtttgctttgatgataaatgttgctgacttgagttcccagattcaccatgttggagtgaaggaattatcttctcagctctagtacatgaaagacacgcattagagaaatgacagcataattttagatgtaaaataacagagaattccctgcatgcattttctttcctatgtaaatctcatatttagatggcaatgcacaacagtaatcctgacaaaaaatatactacaatgaagcaaaatcacactttttctaacatgagaaagtgatagcattcagaagtaccttttctgaacagtattcgtagtcaccgtatgttgcggaaaaaccgcttgagatgattttttattcatgttgtcctgtcctttgctcttgttttccttgttcctattaatcataacaacattttgagaagtcaaaagttttcttttacaatgatatgaactctgatcacaaatttaagatgtagtagataattaaataatgctactgacgagaggaaaaaatcatagcatgtgctaccattctgatttagttaagtttcagagaaagtgctgtagaaaattaggacacatggctgggatctccaaaaaaaagcagttagatttcttgatcagtcatatgtttgatatatcctagcaccatgaccaacacattgtaactagaaatctagaatcagctcaaactttctaattagtctactgtctacttgcatcttcccaatcagaatctatttccaatgtttaaacaatggactggatgtaaacttcataagcaggatgagatgatctcaaagtagcaaattttcatgctggttctgaacagaatattttctctcttttggcccttaaatgatatgacctgttaccatagttttttgaacagaagaattcattgagatgcatacacaccatgacaaaggtttatattataatcatcactaacgcatgtcacagttaataggcttacctatttaatctcctcatccgttcattctctttgtccttaatcctgacttcccttgtcttacgtgccacataccctcttgcatgtttttcttggagggctctgtttctttcctcttcatcaagccatggctgtgagtgtaacagaaattagcttcaataattaagtcctgctttccctaagacaaaatgaacctttaagaacacacctgtctcatggtcttatccttgtagagatttctaccctttatgaggagtggatggaggggaggccatggtttgtaccccctactccataaaatctcaatctgcatttgcatatttctctgttggttttaagcggtctatgatgattattgtagcttaaggcaaaaacttatgctggtaaaaagaagtaagaatttacagtgaacgtgtgctgttgcttcttagtgccatagctttctttgattattcgacctgcatttgtcctttgaccacataaatgacccttgacaccacgaggagctccttttttcctgcagtgataatcaacagccaaagtaaaaaggacattatatataaatattgtgattggagaatcatgcccatcacttcagtaaattaacactctgcctaatatccattaccttttgtaaatattttgctcaaagaccacaacatcacctttgcatgaatcacctatgatatttaaggggtgcataagaaggcaaaaagttagagcttaaacagtccaaactgtagaaagaaaaaaaaggtattgcaaatgaaaatgccattaaattatgtattcgagaactacaactctaccagaagaccagaactatacttcaacgtgggcggtgttatttcagacaaccttaagtgcatgaactacggactatccattaactgaaacaagtttagaaagctttctaattttcttgtcattcatatcactgtgaaactatagcatgaatgttagactgatcaccttgacagttcaaaacaaaacttgacactggatacttcacctctcccatagttttcaccctggttttgaagcacaagaaagtggtcaaacaaaagcagttcatttgcattacaaaatatcaacaaagttgacaagtaacatataaagaagaaggacagattacataaaggatatagttcatactcaatttgtcctctgatgcgagttaggagcacttccttgttgcctgacaatcttagcttgtgcatcctcaaatatgctttgcattcataaacctttagtttctccaactggccatctgtgaattgcaatagcacatcactcatatgatcaacaataagaatatgtgatgaccagtaacaacatggaaatttactatttcgataatgtaccccatgaaactgtagcaatgctaagatacagtttctgcaaacaatttgtctgcttcggcttaaaattacattaagaaatgaaggtttacctgaaagagctaaaacatgacgattctaaaattgtactactgatcaaatttctttggaagtagtagaaagaatgaaaccagtcgtgcacaacatacattgtatcacattacccagttatctcaaattgcgttacaaaacaaaacattttttttttacttttgctaagtcgttttttttcctctcatgtcacactcttcacaagatcacactagcaggcaaaatttcaggccctcccggttaccagtttgcatcacattgttggagatatcacagtcacacaatggcaatcgaagaaagaactgaccatgcatcagcttgtccaccatggctagaagatccatctcctccttccccatcttcggcatccgcgatcctttcctgaaaattgcgaaactcgtacaaaaaccaaaacctaaatcaacccctttcgggaaaaaaaaaagcgagattcacggaggcgaagaaccaacccaaattcgcaaaccaaatcccgattcccaatttgtgatcgcagaaattggacaaagccccccaagatcattcatcagtgtggaaggggggggaagagaggggaggtgggcgcccgaaccgaacctgtccttgcgcgcggaggagagtgacatccgggccatcctggaccgcagcacggcgtccacctcgaggtcaccgtcggcggcggggtcgaaggtggggtcgtcgtaggagcccgcgtcggggtcgcagatgccggcgaggctcgcggcctcggggtcgtcctcctccgaccagtcatatccttccccctcctcctcctcctcgtcgtcgctctccacctcctcctccgatccctcctcctcctccccgtcgtcctcctcacggggcagggcggcgcggtggtcgtcgtcgtcggcggcgggggcggccatggatggcgtggcgggttcgggggttcctcctcgggtcgtcgaccgttggtcgcgggattcttgggattggtttgaagttttgaaaatttggtagatttttggcgtgttgcgtggttggggatttttataggcgtcagtctgctctttgctgggtcagctgagaagcgagccaagcagggctgcagtggcagctgcccagcactacaaacaattttttagaggtgatttcaccatggatggattacatatattttttagaggtgatttcaccagtcaaagattttcatttacaaccatatatctttaccaaccgtcccataaaaaataaatctagtattgaatatgacatatcctagtataacgaatctagacatatgtcatatacagtcctagatttattttttttagacggagggatagtatcatatgctagacaaatgacccgtcttcataggagagagaatatgccatggtcctttgttagagtaacagcaagatgattcgggtagatttaaggagaggagttgcagtggttattttactataagaagggcacgctataacacatccatcaattcacagcattgtgagcaacttttagcaaagtacattaacaaaacaagaaggatttgttcagttaatcatgagaagagatctgataggattggttgcaatttcacctctaaccccgcccctcaatctatttggtggagatacgaaccgaataagacctaagaggtaattaaccctcttctcctcctaaactagcatgcatgaccttgctagagccacaactcatgctatcattttggttgcacggaagcaggcgacgagagtgagctactccctccgcttctataataattgatggattaaggtcaaactttcataactttaactatcaataactttaaaaatatttagtttaaaggaactataacaacatatatatatatttgtctttcaaaacactataataaaattaaacatacatttatttattgtatatattataatagaaaaataaggtcaaagatatattttgtagaccgtgtcattatccaaaacgtcaattaaaataaaaccagagggagttgagaggagggctcagtctgcatgctgctacttgttttccctcattgtttagggagcgctgcaaggagatcaagactgagtaggcgatgttgtgctcgagaagatcaccgatgaggggaaggctgaccatccggttggccagtctattggagggcaaatttgagccaaaattgctataatttaacggaaaatgcaacacatacgattttttttgtatgatcttgttacgataaaacacaacggcatggacggcaggggaacctaacgtgagcgcacggcgcacgcggcagtctaagcgtaattatggaccctaaaggccagttcacctctaaatctgactttacgttcactactccaaactctaaacctgacttcatgttttgatctaatctgcaagtgtgaaactaatccaatagcatacgccatcgacaacgaaggtatgccatcttatttacttgatttcctttagcttcacaatcatctttttttacattattctccctctttttttttgttcctgggcaatgttcatagccatgaaatgctttctttattattatggatttaatctaaaattttcctttgcaaaacatatgccattatttttaatttaatatgaaactagggttgacactatcactgtccaaggtgcaaggaacatatttgtacgtgtaatttgcttaaccctgccacataataaattcaatattgagtgctacaattactatacaataagatattaggaagaatattgcttaagatatgattgaaaagaaaattgctttggttggctatccaagcaagccaatgagatagcaggccaagacgtcgggagcttgggcttggatataggatcaactgacggagaatttttttcatttttaaatttttatttttttaatattttgtaccggcgaaaatatttatagaagtagaccctgccgcttttggaaagggcggcagggtgacgtgagggacaggcaagataaaaaagaaactagaaaaatgcatttttggtggggcaataattgcatttgcccccttgcagcccttgtagagggcggcaagggatctcagtgcaaaatgcgcacaccttgtcgccctccacttgggcggcagaggccatttctataaatattttggatggcatcatatttctgtaaatattaaaaaattaaaatttaaaaatgaaaaaaattcaacagacggatccgtttgatcgtacaaccattgtaaaaaataattcgtatgtatagcagcgctgtaatttaacttggagagtggaataagtaggttgttggagatactcttagcctgtgttcttttctatgggttgggaacccatctccggcacacggaaaacagagcggtccattagcacgtgattaattaagtactccctccgtcccagaatataagcatttttagagttggacacgattattaagaaagtaggtagaagtgaatgatggagggttgtgattggttaagtagtggtggtaggtgtgaaaagtgaatggtggagagttgtgattggttgggaagagaatgttggtggagaaattgttatatttgggataaatcttgagggctaaaagttgttatattttaggacggagagagtattagctttttttaaaaaaaaaatggatcaatatgacttttttaaacaactttcgtataaaaactttttacaaaaaacatacagtttcgcagtttaaaaagcgtgcgcgcggaacacgagggagatgggttgggagcactgaagcaaagacacacagaagttcctactaaagagaattgaggctagtggtgtattgtcgtggggcgcaaattatacttttgattctcttctctgcttcaacggcgttatactagtaaaatctagagcccattagcgtgctaggagcgggagggatctccatacctgacgacggcgcatatatagacgcaattgccttatattagccaggtgaactagaattataaaattatattcactcaattttgcttaggattcactaggggaaaaaaattctctcattccaaacagaatctatatgcatgcgcgcgcgctctctctctctcttccttctttttgtttttggtagagagcatcaggcatagtaacgttcttccatgccttggacacattcttatttgacatgaatctcagtttctctgtctctcgcccaactcgcaacttctcttgcagtaaagctaatctgtacaaagatttaaaggctaacattgtagcgagctgtgtcgtgccaacccacgtgccgaatccacggcctagaaggtgtgatgtctcgtgctagcaatgaaaagggctatgaaaaaaatctaaatatagcaaaactgctagaggagtcgtgtccgtccaagcccacaaggccacaacaagctttggcgtcggccaaggcacagcccagaacatcacgttcccatgcagtgacggaataagttcactttagagggaagaggatagaaggaagaggggagtagtgaggatgacatgtggggccccactatttttttattatttgagtgtgtaactgacatgtgggttctacaagttttattatttttttcgaatcgaattaccgcgtaagcgccacgtcaatatcacatgggatgaaaacctagtcaaagaagtgccatgtaggcgccacgtcagccaaaaccatgggcaatactgccgaggaacctcgtttgcatggttttgtaagttggggatgcgttgtattctgttttgtggtgcagggacgaatttcgaactcagtgacaaattgaaggacctaaagtgaacttattccttatgttatcccacagcaaagccctgctgccgaaacctgtttgcatatgcccgacaccaacttgaaggggctaaggttagggccagcagagacaggacaggaggcccaaccacctacgttgccccagtgaacttgtgtgtgttcatggccagccgtaggctgagaagtgggggtatcaaagctaaaaaaaagctagtgaacgctcgcgtgcacaaacgtgccatttttttaaggtagtgtttttttttctaatgacgatgaagataagttttatagcacgcaaaagaaagaaagctagcgcatgattaattaagctctaattattaaaattttaaaaatagatttatttgatattctaaagcaagttcttgtatagaatgttttcgtatgaaacacatcgtttagcattttgaaaaacgtgctaataaaaattgaggtaaaatattaatcgtagtaaaacaccacctgctgggcgcccttgtccaccacggccaccggaccgccacccttattctgcccagccgatgccgacaacccgcatccgccaaattgatcgtcatcctatcgtgtcagtccaatcgccgtcctcccatgtctgtccaaccgttatccttccgtgttcgtccaaccgtcaatctcatagctaaaaatacttatattttggaacggaggtagtacttcatagtaattgtgaagtttatacagcgaaaacatcaaattaaagtttgtacaacaaaaatgtatgtatacaccgttccatttatacataaaggttatgcatagaaaattttgtttaaatgcgaacacgtgtttgacgcggctcgacggaaaacaaacgttcgcccaatagcctcacccgaactaaacacattgcactctatatagcactctgtatacggattcaaccagaacatacaattaaatgcattgggttttgactagtacctctccagtggttttgtcaaaaagttatgataaccaaagtgggtattgacgtggatccatagaatccatatgtacaacatttgaaaagtctaatttttgtaaagcttttaattttagcctatccgattaaggccgacaatcatatcaagccgttcccgtcatatatattttcaaaatcatactgatctatagaacgtacctccagcttgctagcatcccaatggcacgagagagagaaggtatgtgctagctagccgggccgacgcccgattaagggttcttttattttgtgttagtatctattagtttgtgttttttttacattattatatgccagtgtgtgctgagtttgtttacgtgtggattttataataattggttgtaactcgttgagcaaacgccaaaatattatttattatctaaaaaaaatctctactccaattcaaattgattcacaagaaaaaaacctgatctctccgggagataatattccataacaaaagaaacccgggacggagcaaagcaacgggcaacggcacgcatgtttccgctggggttgtttcgcttggacggacgaccgatcgacagtccaagcacgtcacgttgtgggagagcacacaaaaagcgaggctgctagctagctaaacccgcacacccacaggcagcggcagctcatgctgaacccaaatcaaacacacgccaaaattccttttcgccacgaaaacgttatcgcaaataatccaagtggaaggtatatatccatgcatgttgctggttttttccccgaagtttctttatttctagacaaaattacataaaccaccctaattatgtatcctttttcttttgagattttaatccataattaacttattttgttcaaaaaaacctatccacccaaatattgtcggtccgaaattaccccctctgcagaattcaaccaatttctttcggtatggatttgcaacggagcatatcagctaggtcggatgacagttttgtttgctgtgagctagaagcaatactccattattctttggctgagaacgaccatgagtccgactaatcatatagtcatactggacaagttttggctgatatggccaggcacagaatcaagtaaaaaaagaaaaccaaatcaactactcatgtgtacaaacaggggggaagaagtggagaacttcttggttgagtgggtttttacaataaaattgattatgaaagtgggatctcaaaacaaatatgataaatgaggtgattctgtaattctgtcttatttttctaactggtcatcatgacggtgcaatgtgaaccgctctttttatctttttccgcgttttttcttcatatgaacacagaacggcatgatgatagctactaccgtttttgtcgatacgtctgaggaaggaaagagatcaggcgcgatcgaccagagggaaaaaggagtgtggccacatatgagctgcaactgctagccggcaacgagccaggcagcgtacgatcgcttgggatatcgccgtgaacgcaaacccgatcgggggcacacggcgcgtgcagtgtatatcgctcgaaaagtcgaagcagggcgagcaggtcggcgtggcggccaaaagcggacgcgatatgctctcgtccttagctggaggccttcgttgcttaattcgccaaaattcccaaccgaaatgtcggtctcaataaggatctggggaatcaaagaggccggagagaggcgtgtcgtgttgtgcgaggagatcaggatggcagggtttacacattttcgaaacgaagctcggagagaaaagaattagtatattctattttgagcataacaaaagtttatgaattcgaatccagcttaaaacacttgacaatttaattttgtcctaaaccaaccaatcctgactttaaccatcaatgtttttttaaaatctatgtagtttaacatgccaattttatgttacgaaagtatctctcactatgcatctcacaacaaaagttttctaatgttaaactatataaaattttatggataaagaaagctgttcgatttgttttaaaaaaatctaaaacagatcgaatacaattaactgtcccaaatttcaaaacttgcatcaacattcggatggaaatcttatatttttttttcgattacatggtagacgcacatgcatacacaccactgcacacgcaacaccatattcatacctccataaatacgatccctagaaaatatgctctaaaacggaaatcaatggtacatcctagtcccctaaaacctctttgcattttaaaattacgaggccctggttgtaggtccacttcatcatggaccaacatctcgaggcagcttgattaataagctatcacagcctccttggaccacttctggctaattaattttgttattttccatgttttgtgtcacatgtaactatggggtctatggaaggaagagttgaaatggctctagccatagtctttttgttattgacttcttgtgctttaggagtactattatagtaacatggtactactactagtagaattcattcacgtgcttaaaagcggatacgaggttgcagttcattattggtcaaaactcaaaaagttcatggtaatatagatattttaattctttaagtactctgttccaacttggaagatggattggtcactgtcttctttcaaatctgaaagagaagttacccaacagccggtcggatgcacatgcgcatcgatacaattcaagaaacagattggactactccatgttctcctttacaggaatgtttgattattccaaattactactccctccgtccaaaaaaaaaaaaactcaatttctgggtttctgtgtctaacgtttgactgtttgtcttatttgaaaaaaatatgaaaaaatttaaaaaggtaagccatgcataaagtattattcatgttttatcatccaacaataatgaaaatactattcataaaaaaaatcatataagacggacggtcaaacattggatacgaaaaccgaataattcggtctttttgatagagggagtacatgccaagatgatcaccggtccttcgtaatatcatccacccaccatgaaaaagagaccaaatttaacatagagatgtttgaattccatcatcgttctttcagtatttttttttctgtacatttcaactctttccaatgaaattatatgatccctagcatatgtactactactaaaactactactactacttgtgacagataggaataatcgtgcactgtacaaatgctgcaagcataagcatcctcacggcctcgttaattatgggattaaagctgacgtgtactgatcagagcgcgagcgcgaggtggtcgccgcgcgccgccgccgcggcgtcgtggcgccggtacggctggccgcgggcggcgagcctgcccttcctcttctccatgaaccgctgcagcgacgccttcctcgccaccggcaggtccgccgactcgccggcggcggcggcagtgctggcgagatcgtcgcggggcacgcccctggacgaggcggcgagccgcagcagcgccgccgccctgtccgcggggcactcgtcgagcaccagcacccgcccgccgtagaagatggtcatctgcgccgccgccgacgatgccgcggcgccgcctccttcctcctcccgctcgtctccggcgacgtcggcccccggcatgagcgggagtggccgcaccgccgccgccgccgccgccgtccgcgccctgtggacgttatccgccgccctcacgtactggctcagcgcgccgcacgccgccgcgaacctgctcgtcgccgccgcctccgccgccatcaccggtgatcgatcgatcgatcgatcaaaatcaaccagccgctgcttgctctcgatggggtcgtcgaggtgttcggagaaaatctcgggttaatttcttcttggcgaggtggctcggggggcctcgcttttgtaggcgggaggtggggtcgcgtgggctgggctgggctgggctgcgcacgaagaacacgtgaaaggtgaggaggaagcatacgacgccgcatcgcatcgcatcgcgtcgggtggtggactcgtggggtgtgagggcgacggcgccgcagttcgacgtggcgttgggagggtgggtgggaggctgacggggtggggcccacgtcgcgcgccacgccgactgggtcggggtggtcaactcgtcgcgtgcgtgcagccttccgacacggtgggttgctcaccgtcacaaaattagccgatttatttatttggctcccctatttctttctttgtttggattgtttattttgtaatcatcattggcacatgtttagggtggattccactcctgtattatggataaaaaaagtgatagtataaataatgatttggcttgcaataaacaacaacccgaatgctcctgttattattgtagtatacagtaccactaattgctacaacttgaataaaaataatatgtacgttctcatgtgttcttttatttaggaattattatcatatgaaatatgattatgagtataacatcacataataaaaggaaaaagtacaccgaaggtccctcaacttgtcatcgagctacaaaatcgtccctcaaccgtaaaaccagatataggacatccctcattttacaaaaccgttcatttagaaccttcggtagttttgactccggttttgtccgacgtggcggctgagtcagcgtgggccccacatgtcagggtgtacgcgtcagcgccctctcttccccctcttctcttgcttcctcggtttctcctctcaatcttctctgtaggccggccggcgaggtgaggcgggtgttataggatgtgacactttatagcaatctagaattggatgtgacactttatagtacaatatatctggacaagaagcatgtttggattcgctgtactatgaagtgaccatccgtcactaggttgttatattatgggacggaggtcggagggagtactagattactttctctgttccatattaagtttatttttttatctcatttaatttgtttcaaaataactttttttttctaaaataataactgtatcggagtttgtaaaattatagaataattatattgggactagataaagtgatgaataattgtttcagggtgtacgtactggagtttctgtgcttttgggctctgggtagggcccattccctgacccgagcggagctattaaaaacaccggtccagctcgactgagtcgatagcctatcggcccagaaaaggatcctctgacgtaaagttatctctgacgtggtcactgatagatgggcccgcagtcaccacgttcgtctgattttccgtctgaggatctccttcccggtcggcccatgcacgcggtcacgcaccggctgaccgccgcatgcttccttcgcgtgtcgtgctggcacgtacggacgtacgtaccgcggtgtaggagtactctgtagtacaggagttctctggaagtactaacaacgagaagcttcttcgttgcggaggtcaggatcgagacgtgacaaattggaacgagaactgtgctgaatattggagtattactccatatttcacgttaacatttgaattcaacttcatataactatgattttttttcgatggttctgcaacttttatctcttttttttaccttattaaaatcctggatttattcccagagtttaagtatgccatgtgatccaatcatattgaggtcaaggcgtcggcttcagaagattagatacattttgcatagtaaaatattttggagttttgtgcttttgggctttgggtagggcccatttgctgacctgagccttgtaaagccggtccaactccgggtgctgggccagcctctacgtacgggcaggtaggtaccggccatgccggcttgtagctgtcagcctgtaacgcctctgcctcatatgcatgaactcccaagtcccaacgttacaaaatactacccccatcttagggcctttttagtttgcgaaatgaaattttttttgtcacatcggatgtttgaccggatgtcgaaaggggttttcggacacaaataaaaaaactaatttcataactcgcatggaaaccacgagacgaatcttgagcctaattaatccatcattagcacatgtgggttactgtaacccttatgactaatcatggactaattaggcttaagagattcgtctcgtgatttccctcttaactgtgtaattagtttttcttttaatctatatttaatgctccatgtatgcgtctaaagattcgatgtgatattgttgggaaaaactcttggggaactaaacggggccttaatataagttatttttcacacaacacacataaacatacaaaagaaaaatactagaatatttttattttatcaaatcataaatcaattatttatcactttatctattcccaatacaattattccctaatttcacaaactccaatgcaagattactttaaaaaattgaacttatttttaaacaaattaaatgagctaaaaatgaacttaatatagaacagagaaagtaatctagtactccctccgtcttataatataacaacctagaatcttcataatacaaaaatctagatatgaagcatgtccgtattcgtggtactatgaagtgtctcatgattcaaacctagcactaggttatgtcacatccatataccccattcttttcgattaaatttgtacatattttacctcggtgtgcattaacaaatttttcgaacggctacatagtatatttcgtgtgaaaactaaactttttataatttaaaacaattaaaactcaattaatcataaaataataacttttttgttttacgtattcatactagcttaatcttttatttcatctcggagctataaaaaatgcgggtcattactagcagtactctacatgcttttatttcatcccggagctataaaaaatacgggtcattactagcagtactctacatggacgagaagtttcttggttgcgcatgcagaaataattaactattttattactcttacgagtaatgataaagaatttgccactagaccccatgttatagacaaatgagggtctatgagtcatagatagcgagtgaaaattttttaattgacacattttaaagtgataaatagttaaattgtcccgcacatgcaggccgcacgagactgacaagttggaacaaggattgcgctgaacattacttcctcctttctttcacgttttccttaggtaaatactttctttcaccttaattgccactattgaccagaacaagtaataattgcacgtttgcttgtcacgtttagcctgcagcttaatagaataagccataatttcaattttaaaagtgattttaggactttcattgtagtttaatttcggcatttgcatgcttttaaatcttcaaaaacatgtgtatatataaattctatatgttaaatcgttaataagccatcgcttataataagtataataagcggtggtctaccaacgctaaccaagaacattctaaaagccaccaaatatatatatacgagggaataggctgaagaaaattattactattggtttaaaaaaagatagaaaacgtgtattgggtaatataatgtagcgtgacaaatatttgtggacctgtaaaatgaccaaattaaagagacaagtaaacgtgaacgtgaacaaaagccttacttttgtttggaatgagaattgtgctgataaagttgctagtctttctttggtctgcgctatgcatatccaaccatggataaacgctatagttatgaaaacgatgagccatcgatttatcgcattgtttgcaggcatgcacgctccatgctaaattagttaatttaatactagagtgagttcgcgcgctacgctgcgcggtattgtagcatgtaatgctataactcacagaaaaaggtttgtccaagaagattacataacaacaatactcaattcctcatgtacctacagcgtgataagaacattatttaacctaaatagttctttttataaccaaagtccccagaagcagttccggatagatgataatttatacaacaatttcacgacgcatagtagggatggcaagcatagtatgattcatccaacatctatgggcacaagatgcagtttgttatgtaaaactaactgaaaatagtacatggttaagtttctcataatcttgtttgcgaggactgcagtattaaaatagtatctgtaaactctagcattggccaaaaacccagtcagatgagacaatagtattgcattgatcaactatggtacgaaaaaccaactacatttcagattcattagttttaagtagggacttgactcttcactatgagaactttctactcaagaaacatatccccctcggcaattcagatcaccaaatgcaatacccagcatctgctaaaatcattcttaaagttaagagtttggagaattaactcagcatattagagatgttactaagtagaactcaaaagtttggagacttaagtcagcacatagagagatgttactaaatcagtagaaggaactcaaattaatgaacagatcctcacttcagtctatgttatgctactaatcaaatcagcggactcttaaaatagccatgtaaaggaacttaaatataaaggttcctgaaaagagacatctaaatgcaataactgagtatccactgtgaatcaatggactgatataaatgctagaaacaaatatacatcacctatgtgattaattagctaccaaactaccatgagagccttcaatatttgtatttttctcttagatgcccctcgtattctagtatagctaaggcgttgacaaatatcgatctacctaccgtacagtatttaaaaaaaaaagatcatcatggttaacgcatgtttagggatatttccacaggtatttcaaatggttttcctgctgagcaggctacagagaccatattgtttaatttgcacattgcagcactcaactgacttggtgttggtaagtttatttggtaggcaaaagaattggactggggtgcttcagcctaacacagtgcagccttgagatattaagaccagctcatagaaaagcattaaccgttgatgtgcatggagtatttttcctgtatggtttagaaaatgatcagatggagtgctcttttttttggtcaaaatggtaattacatataattaatgaataaaaataaataataggaaggattaactttttttttctctttctctctaaggagaacatcagagagcaaatcacagaaaggatctccaatgcatatttaccttgtatttgtttgtcaataagatgctggcagctccattcctgaagatccatgagctgagcatagtgggttgcctctcccaatattaacatgagacatgaattatcatgaagtaaacctattccttgaagattgagcggggatcttgggcctatcaagattgactaaggcgacatcaagcacacatcataagcatctcagttgaaagaacttttttttggtaaacttctcttaagggaaaactaaatatttaccatttaaacttaaaaagctacttgcacagaggctgtaaaactacaattctcttttattgtaccatatatgttattcatgtgtatgaagagaacacggggagactatagtagcagttcgtaatggtgtcgcatatataaactcatgtataatcagataaatttaatatatatcaaattatagataatatcacagaatatacacatctagaaatcctcatgattttgtattgacaaaaccgaaccaaactaacatgttgtacccatccaagaatacctcttgtaggtaaattgggagtgttaggattaattttgtagatcgactatccaacaaaccataggacaatacatcaataaagattaaagcatctcctggttccccaaagaaacttcaatgcaagcatatgtagttcctgtacaaaacttgccatgttaattctgcaaagcaataatagtgagaaagccaaattttataggggactttttcacatgataagataaaaacaaggaaatactactattatgcaattactggactgagtgattgatgtctacgcctgtcatttacaaagaatggcaatatatgggcatatggcgatctgtttgcaaagttacacaaaaatataattgaatttcagaaccatctgtggccatcagacatgtaaatggcatatcataaaaaggtacaaacaatgaaaggcaaatgtttaatggtgaggtaaaaagagaaattcctgcagcttacctttttctgttgcctttgcctggctgtcatggctatcgtgttctgaatggctacataagaacatgaatcagaggttggcaaggaagtagcacaagaagctcatgcgatggataaaagtatgaaatgattgctcttaatttgggtatataataatttcattaataagcaacactaatattttacaaagctagtaaatgttgaactctaaaaatggggcaagtctagccgtctgttcacccatatgctgaaaacccacaaataatttgtgtaaaaggattctttgtagtgcatcattgtagaactacttggcctagtgatcatgagaaccatcataaattacatggtaggatgatttgcaaaacaacatagagttcaatttaatggtatttgcttacaattttttttttaaaaaaatattccatgatagcacgtggttggccagtgagctatgcaattacaactttaaaattattagcagtcaacatcttaaactacaatcttataccaaataatttgaacttagatattgtaattttaaattcatacccaccttagtattagcctcgccttgagttgtactaagcaagccccttttaacacatccttatctaccaatgataagtttctgcaatgtaaatgaaagttaagcctgcaacaagtaaatcttttgatcccaaaagatcttatagtaactattcaaattgttgtcccatttacattgaagagcttagttttttactgaaactgaaaacaggtaacaatggaaaacttcagaagaattcattgccctctgaagcactgttaaaaagataggaaaaatttgtattaaatacagcagaatcagcaagaagcaattcacatcaccctggcttagttatccaacaatcaaagaaatgaatagtctttacctaaaagccagatataatgggaggagccatgtaagcgacgcaaaaggtccagcaagcaaactgcttcatgaccatgtaaatggaaccagtgggaacaaaaatagaaggaactctttagagatgattcaacataatatagttatcatttagaacattattcttttatttagaggtaacaacaaaaattcttttgaaatatatttttgaattctgtcacacatcttagcaaactcctcgggccatattaaacatctaggacactcatctagccaatacaacaagatagtacaatttgccaaaagctatttcactaagggaacaaaagctatcactgctacaacaagatagctgtttcactaagggaacaaatgctatcactgctgttgaacaaccaagaagatgcagtgtaaaaaggaaatataacctccagctgttgaatatcaactaattaggctcaattcataggacaacaacccaaaaggtaataaatgcaaccagagcagtgacgggtctggggaagaaccaccaccacctcatcctgccagtctatcttctgcatgtgctagctgcatgacagcatacataaatcatttcattaggcaccatgtttgctctgagatagaacaaattttcagtgcaaagcgatcctgtttggcacacacctatttgcaaaaaaatcaatcaaaaagaactcattatttgctccaaaaactcacctacagacaatatgatagtagtatgttgggctgtacaggagaggcaacagagaggacagcttcttctcgtcctaatcctcctctatgccattggcctacccagtagacagtagaaactcgaaatccacatttaaatcaatgtaatcgctcgaatcacacgcccattgatgaaaggggaaaacacagggagctgctaatcacgcacctaaccgccggcggcgacagggacccgtcgaactcgatgcgtcgtcaccacgtcgaagacctccaaaaaactgttgggggagccgcagcgacctcaaatcgctgggacctccagcagcagccgccgctgccaaacccctgtgctagaggctccgacgccgccgccaggtccccgacctcaaggctatgttgaaaccgccgttgagcccctccatcgagcgcagccaccaccgtacactttagggaagcactgttggaggacgggtaaaacgacggcgctggaaaggccatggaagaggaggaggaggcggcgccgcggcggaggagcatcggcgccgccggtcaaagaagcgagaagcgagaagggagatggggattgggatgcgacgtggagagacgagagatcgtggattccacgtctgggtaaggacggaaccatctagataggagacgaacgatcagattatgtccacgggtgagatcgaacggctctgattcgatggactcaatcgtaaataccaaaattataagggcttttctgcaaaaattaatggcgtcgatcaattaggtttgcagatacgtgtgtcacgagatgattagtcgaaggagtccaaatcgccctggttgcggcaaagctaggagctttaagatatctagtataagccactcaaaacatatactcctcctatcttcgtcttaaaatatagctacacgtgcataatcataactaactattttaaaacgtttaactattttaaaacagaggtaaaccactcgaaatatgtacctatattatcttcatcctaaaatatagctacacgtgcataatcatatctaactattttaaaacggaggcagtctttagaaaaccactactctactactctgaaacctagttcctacgtagtacatatgaacttcgaatttatctttctaaaccactcaaatcatcttaaaaaggcctttgtaaacctgtagcagcgcacgatggaccaaaggtcgaacggagaaggcccctcttcactcttcacccctgtggaaacaactatagtgcgcagagagatctttttagagtggccctgtatcaatttttgcgcaggaaattgcatggtttagttttttttttgttggtgtgtgcatgtatgttcatacatgtgaatgtgcgcacgtgtatacgtacacctacgttagtgtttcgaaaaaaaaggtaaattacatcgatgatatataaacttgcgatatgggtgcagtatgatacataaacttacaaaataattgttttggtgcacgaatttatataatgcgtgtaaacctgaggccaaatgagaaattgaacattactccctccgtttcacagtgtaagactttctagcattgcccatattcatatagatgctaatgaatctagacattaactttctagcattgcccatatttatatagatgctaatgaatctcattagcatctatataaatatgggcaatgctagaaagtcttacattgtgaaacggatgaaatacatagttaatcctacttagttggatatttattaggaacaagcacacatatttgaatgatgtcacctagatatgtatgagcgcaatcaaatgtataataaatgatggtgattatacacacaaataatataaaatatagatgaagtatgcaatgaatagaaaatagtgaatgaacaaaaatatatatccaaatagaggttattcgcacctgtagcatgcctcgttaccacttgctgtttgtgcggattacattctaaatatgctctaactcagtattattagtcacagtctgctgatttggccttctatcgttggtaatagacaaattcttggtgcaaacaactcgtgttttcactgagtgattgtgtctcctctccttctctctcctactattcttgtgaacattgtgcctacatattgttcttgtgaacatcgtgcctgcaggtggagttagcatggctaacgggcactagcgagcatgcatgatgtggtaatagccttcaaaaacggaggcctccatgtcggtctggtggacaaccataaatgactggtagaaagaaggagcacacaagctcgtgccaatcatatatagccatgcatggagagctcatgaccacactatattttaggacagagtaggacttgaaaaggtaatatatatgaaagctacttcaaatgaaacatatattgttctcagtatttttctttgggagtattttctattaaaaatcgttacgtcgtttctacactatataaattattattacctacatttacgtcgttttaatccctatatatggacaatggagatggcccctcttcaggcttcttcacccttgtgggaacaactagagtgctgtatcatctgatccgacgatttatttcaatggtctgtatcaaattttgcatagaaaattacatggtttagttttactctcgctgataatttgaaatgccaacaaaactattattccaagacaacaaaacaagacgatttcgccaacctctatcctaaattgttgcaatctaagccagctatacttctaaacaagccagtaaattggccttgaatcgtacgatcgattcaaatcaaaattcaaacgaatcttggtcacacgaaagaaaaggaagagctcgaattcagtagaacgcggcgtcgtcagtgcggcctgatcccggcgtccttgccggcagcattggcggcgaatggcgagtatgtacggcgccgtcgccccgagccgcctgcgacttctcttctccacggaccgctgcagcgacaccttcctcaccaccggcaggccggcgtcgcgcccgcgcgccgtcgtcgtcccgcccagcgcgcgccgcggcgcgcaccagctcgacgaccgcgccccccgcggggaagaagtcgtcgaacaccagcatccgcccgccgtacatgatcttcagctgcgccgccgcagccgcctcctccctcacgtccggctcgacgtcggctcccggcatgaggagcatcgtggtgtggtggtggtggtggtggcggcgaccgttcgccgccgccgccgccgcctcggccttgacgcaccggctgagcacgccgcacgccaccacgaaaccgccagctccggccaccgccgcaatgatgatccgacactgccatgatcgatatctacccggccccggtacatgatgactctgagcacgcgacgcagcgtgctcagagtacggatataagtacgtacgtacgcggtggatgggttgaagagagcgggtggtggggcgcgtggtttggtttgaatggatggatgcaacccaacaagtggccacacgagacaccatgcgcggcacggggggatgtaaactacactcgcgagaagcggacgatgtcgtgcgaattgagcttagctcaatggattatactaagattttttcttttttaaacctgtctacctgggtttaaattttaacactgattctcacatctatggtgaactattttttttctatgttagacatgtagaaacaaaatattatgtacattggatttcggtatttaggaatagaatgttatgtccattggatttctatagtatttagaaacaccgacaagtgtcgaaactttttttttgaatggcacataggaaatagtacagcattagagaagaagaaaacctgaggtctcacttcatgattatttttctcccaaattctcatagaaaagccctttcgataggaattttaagaaaactggtaggaatcaatcttttttttagaggacttaaacaattttttttactatagaatacaaatcctctagtatttctatatttttttctttcattcaaaggggtcctaagggtttgatttcctatacacacaacaacattgtgaattaatgtttttttttaaaaaaagtgaataaacagtaggttttggagaatacgcaacacagttaacacccaagttaatacaatttgcttcaagtagtcatatgttttacaatttgcttcaacttccatgaataagtaatttactcccatcgtgttacatgacactacacaagacaataaattaacaaaacaaataacataattaatcactagaccaggcttttctaaacaaaattattaaaccatgtttatgttatggacacaatttaaatgcatggttggaacgtttctgttggtgttcacagtcacaaaggagtagtgtattgatcaagtgatggaaagaagaataacgtgcaggccgtgcgtgggcgacttgcatgcaaaatgcaatgaaacggctaacaacacatgcaaatgcaatgaaacggctaacaacacaattggtgcaaacaactcgtgttttaactgagtgatggtctcctctcctactattcttgtgaacattgtgcctacatattgttcttgtgaacatcgtgcctggtggagttagcatggctggacaaccataaatgactggtagaagaagaagcacacacaagctcgtgccaatcgtagccatgcatggagagcacatgaccacactatattttaggacagtgtaggacttgaaaagctaatatgaaagctagttcaaatgaaatatatatgttctccgtatttttctttgggaatagttatatttatggcactatattttccattaaaaatcattaaatcgtttttacactatataaattatttacctacatttgcaatccatttacattgtaaatttagaaacttacactcttgtcagtgtacaaaatatggtataccctagcaacaacagaaaaatataattcatgtatagaatacctcatttccatagaatggaccccctcccacaccaaattatagatatagcatcccaaataaataaagaatactgtcagggttatggataccacatacccaatagtaatcgactaagctcggtaggacccatcatataccaagtcttatacggaacaaacctcgtatatagaagaagttccggataaggaagtactaatagagttctatatgaaaacgacaatgattactcggattgtatccatattggtctccctagttctacttggacaaggggacatctatgggtataaatacaagccccctagaaggagaggggacaagccacaagacacaacatacacacaaaccaatacgtggccaaatatcgacattagagattagtctagacataccccatctggtgtctacggagatcagtaagagagatctagcgccatctctgatctcgacaggtttatattcgaggaggaagactaccatgtcgtcgactacgagctggttatccatgccgccaagttgatgacagttagataggttatcccaaatattatacttgtgtgatccagatgaataaagagcaacaccggttttggccaacaggatgtaaggctattacctgtcagataaggggcacgaacctgtataaaaatccttgtctccatctcttttacctcaatctcgcatataccctagtaccaacgatccccataccatccaaataccgtagtcacgatctcaaacgtcgacaaatacaaaggccatagagttctattcagacttgccccagtactataccgaagatttctaagattatctccatgagtcccttatgaaaatggacctatgagtataaatatataaccccgtgaaaggggcgaaggacaagtaactctaaatcaatattttctgatgttccggttggatcgatattgtcatcgtttctaactcttgcgttccaatatcatttccgagaaaaaaaaatggtaacagaaatggtttaagcatttttcctaccgttttaatccctatggacgaaggtccaatggagatggcccctcttcaggctttttcacccttgtgggaagaactagagcgctgtatcaactccgacgatttaattctatggtctgtatcaaattttgcgtagaaaattgcatggtttagttttactcctcgttggtaatttgaaatgccaacaaaactattcttcccaaggtaaaaaaaaacaaaagtattattccaagacaacataacaagacgatttcaccaatctcaatcctaaattattgcaatctaagccatatatacttctagacaagccagtaaattggccttgaatcgtacgattcgaatcaaaagccaaacgaatcttggtcacacgaaagaaaaggaagggagctcgaattcagtggaacgcggcgtcgtcagtgcggcctgatcccggcgtccttgccggcagcattggcggcgaatggcgagtaggttcggcgccgtcgccccgaaccgcatgcgacgcctcttctccacgaatcgctgtagcgacaccttcctcaccaccggcaggccagcgtcgagcccacggctgtcgccgactcgccgccgtgccgcgcccgcgcgtcgtacgtcctgcccggcgcgcgccgcggcgcgcaccagctcgacgaccgcgccccccgcggggaagaagtcgtcgaacaccagcatccgcccgccgtacatgatcttcagctgcgccgccgccgccgcctcctccctcacgtccggctcgacgtcggctcccggcatgaggagcatcgtggggtggtggcggtggcgaccgttggccgccgccgccgcctcggccttgacgcaccggctgagcacgccgcacgccaccgcgaaccgccagctccggccgccgccgccgcaatgatgatccgacactgccattgatatatcgatctacccggcctcggtacgtgatgactctgagcacgcgacgcattaggccggggtgggtgggagtacggatataagtagcacgagtggtggtggcgcgagcgcgacgttgtgggggaaacatggggattcgcgaggggcgcgcgggcgcgagagaacaggggatcgcatgaccatgggtacgtatacgcgtggcgcggtggatggttgaagagagcgggtggttgggccggcgcctggtttggttggatggatggatgcaacccaacaagtggcccacgagacaccatgcacggcccggggggtgtaaactacactcgcaaaatgcagacgatttcgtgcgacctagctcgattccatcagcattaggaatcgtgctcccctgattttaacttgaaaaatactccctccgtattttaatctatgacgccattgactttttaacaaacgtttgatctttcgtcttattcaaaaaatttatgtaattatcatttattttattgtgacttgatttatcatcaaatgttctttaagcattacataagtatttttgtatttgcataaaaaatttgaataagacaaatggtcaaacgttgattaaaaagtcaacggcgtcatacattaaaatacggaggaagtagaaattaaggttaatatccttggcagttgaagaaagaaattaaggttaatatccttgacaagaatgatagttcaaacggctgcgaagtgaccttagctcaatggaatatactaagatttttcttttttaaacatgaagaaaacagtaggttttggagaatacgcaacacaaaacccaagttaatacaatttgcttcaagtagtcatatgttttacaatttgcttcaacttccatgaataagtaatttactcccatcgtgtggcatgacactacacaagacaataaattaacaaaacaaataacataattaatcactagaccaggcttttctaaacaaaattattaaaccatgtttatattatgcacacaatttaaatgcatggttggaacgtttatatatgtcggtgttcacagtcacaaaggagtgatggatggaaagaagaataacgtgcatgcaggccgccgtgcgtgggcgatctgcatgcattgtctgcgtttgccactgtgctggtggcgatggagaaggccttacgtggaagatttatactccatccgtttcatattataagactttctagcattgcccacatatatatatatatatatatatatatatatatgttaatatatacacatgtatgtatagattcattaacatctatatgaatataggcaatgctagaaattcttataatatgaaacggaagacgtacaagttattactattgcagatttatgtcgacgataactgtaactacactaaggtttaatatttacattgtattttttattaaattatacgagaatttttgtcattataatattgttacgaattattattcacattcgttacttctttgaaactttactagtacatctataaaattaattcattgtgcaaacattactatgatttggttacctctatgatacgttatttccaatgctctattccgttaatcccccttttcatatttttttgttgttccggttgtattgtatcgttatagtttccaactctaccgttgcaataccatctccgtgaaaaagaaatggtaacgggaatggtttaagcacttttcatgaccgtttccggttgttttattccctatggacgaaggttcaatggagaaggcccctcttcagtcatattcacccttgtggaaacaactcggtacactccaacgatttttttcaaaatggtaggtctgtataaaaaatttgcatagaaacttacatgatttagttttgctctctttggtgatttgaaatgcaaactgcacttcttccaaaacaacataacaagacgatttcccaattaatctctctggtaaaatattgagcggggcgccgcatgcggaaacggcctacgctacgatccgtttcgggcgcgcgcgcggcgcttgcaccatgcacttgttgaacaaatacactcgcaggaagtggatgatagcgtgcgatctcctgattttaacctgaaagaaaaaaaaatcaggtaatgtccttgacacggatgatagttcaaacagctgcgaaatgagagtagctctttatacggattctcacatttatggataattaatcattcgatagtagacgatgtagaaataggatgtcatgtttattagatttttataggatttgaaaacactgggaagtgtgaaaagttttaattgattggcacatatgaaaaagaaaacatgagaagaagaaaacaagaggtctcaccttatgcttatttttccttcaaaattcttctaggaaagccccttccataggaattttaagaaaatcaatcatttgtttcaaaagattgatagaataattttctcatatagaatacaaatcctctagtatttctatatttttcgtttgattcaaaggggacctaagggtatgattttctatacacacgcaactgcattgcaaatttatggtttttcaaagtgaataaacagtaggttttggagaatttgcaacacaaaacccaagttaatacaatttgattcaattcagtaatcctatgttttacagttttatgaaaaaaatgtttgttaatgagtaaattgtaccatagatacaagaactttcaaagtgggtgtgatttagcatatcaaattgtaaatcgcttatttcggtgcataaacttgtcaagtgtttgcaaacaaaagccaaaatagcatgtcgtaactaacttcactaagttggacgttgattaggatgttatgtaggtttacatgtcaaaatgatgttacctaagtaagtcatgttaattatacatattaaaaatgtatatgaagggactatgcaatgatacaaataatagaagaacaaaataactgttgggttacgcgcaggctacgatagcataaatcaaaattttctagcgcataacccaggtaccatgcaagtattagattacagatcgttaccactcgacgcgctgcgcagcggaagaaagcgctaagaaggcgaaggaaccctcgcgatgtagcgcgcgtcgatgtagaggaagtagtcgatcgcaccagcttgaccttctcctcctcgtgcgttctcctcgccatactcccacgccgatcagcaccacaaagtagcggcgcctctatcggtatccacacgtacagggacggaacgccacacgcagatgtgctagcacccgcgcgcggctagggttttgctcgtggaggggagtggcggctaggatttctcacgttatgcaatacaatccgccggtcacacccctcacgaatatataggaaccatgactcgagcctccaaggcccgtaggactcctattcggatctctatccgaattaagctcatattagatctcaatccaatccccttattccggcccattaagcatgtgaccctgtaggttcatgcacactcggctgtaacccgaaaactccttttcggtctacgtgtcaacagcggtccctagcagaacgtattgacccgccgggcatacataaagatcatatcggctgaacatctagcgtatacttgaatgaaccactttgcctcatgatatcgattaagctcaaggctagatgtgccatcctctaatagctcaatcattcactcaaacttgcgatagattatataacttgtgatagactcctcaatcatctttagcatggccatgcacttccataatcaataacatcgagggggcacagagatatctctccataggaggggcaaatcccatcttgattattcatatcccactacatgtttcatagcatacccgaaaactacttttgtaactacctaattacagagtagcgtttagcagtcactaagtaagctactacacatgttggaaaccatgataatgtcaggtctaaggattcaacaccaacactaaatgagattactgatgacacaacacatatggctattgcagtgtctcatgttgggtctatccaacaaattgttccccaacatgtgtccacattattaatttggtatttctataccataatccatgagacataatcatcaattaatacatgtgctgatcatttaaatatatttgtttcacatgtgatatttgatcggggatcctttagaaatagtaacaaacaacataaagagtctcataaaagaatcacatattcattaaccaataatgagttatctatttcaaggaataaaatcgaataaatatgtaaatatagtatgtgatacaacaatatgtataaaggtcagttgtttatatatataaaatatgccatgccctcatatgtgtgcgagacattccattccgactaactcaacataattaggctgtgttcgctatgggttgttcccaacttggaacagtagcacggaaaacggagcgatccattagcgcgtgattaattaagtattagctttttttttcaaaaatggattaatttgatttttttaagcaacttttgtatagaaactttttgcaaaaaaacacaccgtttagcagtttgaaaagcgtgcgcgcggaaaacgaggaagataggttgggaaaatggacgtccgaacacagccttagtcagtttctgactagtttgcatgcactagaccacttcgtatatcataatgtacttaaattgcacccacctaataaaagcatcatgtttttttaataaattatttatttattacgcatggaagttgatcgtaccattatttaccctcgtgaaaccacctcttcttatgttgccttttattttcaacttttcttccctatttatctaatggtccatcgaaagatcatttttcccatggttaataggatctgtcaccccagaaaagagttgttgccacctaaaattaagtttgatattttagtagacatgcatggtaactaaataggtaatgatgcatcatataattattatgttctcaagaattttaacacattttttattattgtgtttttttattcacatcgtgtttattataggacactacacaaaccaataaaaacatatgttgcattttactataaattaacaaaactaataacataactaatcactaaaccatgcttttctaaacaatttttttaggttacttttctaaaacaaaattattaaaccaggtttatgtttatggacacaatttaaatgattggaacgtttatattggacacagccacacaggagtgtactgattaaatgagggttaaatgggtatatttgaaaattaaggaaaagaaaaataacgtgtgggccgcgtgcgtgagcaaactgttagcatgcatgttttgtgtggggaataagttcatcggaggtcccttaacttgtcaacgaaagcgattttcgtccctcaaccggaaaaccagatacaacaagtccctcgactattaaaaccggtgcagataagatccctcggcggtttagatgacggttttggctaacgtggcacttacgtggctagcttgactcggtcttcatctgacgtggcattgacgtgccgcttacgtggcaattcgatctaagaaaaataatagatcccatgggacccacatgtcagtttcacacacaaaattaataaaaatggtggggcccaaatgtcattctcacccctatctcccgtctcttctgggcgccgtggggacggcagagatgacctcgacagcgtcctcgccatgggcggcgcgccgccctgctcctccgtcgccgccggctcgacgactccccccgtgccgccgcaccgagggccactgcgccgtcctccgcgtccccaccgcgtccgcgacctcctctgttggcctcgctggggattaccgggattggagggcacggtcgactcccggcggccccacctttggttacaatctctctagccttgactacctcctctgctactggaatcatgcgcttgattggatcataggccgaagctgcttccagtccaagaagagtacagcctctgattcataaccgagccacacagctccaagcaaatgtagctcccaactctccgcctcatcaacgccattgttgcacacacacatagagtacgcctgcaagtttcacatcatgcattagtgcaagaaacgagttcattgccgccctgctcctccacccttgccgtcgccttccctctccggcgggccatcgtcttcagcggcctccgtggtggtgaccgcgcatggctgctcacgcggctggccacaggaggagtcggagcgcccgactgcgggctccaacgacgaggacaacgactccggcgccatcgccacggcgcacgccaagaagccgttgtccaccattgccaccgcgctcgagaaggagatggagtttgagtggcgtcaaagtattgagggcggggatgcggccaccgcagctcgactgcttcttgcgcttcccgccgtcggccagcaggggccacatcggccggggcacgaaaggcggcggcgctgccgccgcgagctcgatggccttctcctttactgccatcgtcaccgacggcggcggaatcggtttctttggaggtagcagcggcggcgtgtcgaaggtgccgagccacacgcgtcgcccgcttcaccaacacccgcctcgccgccaccgccacctccccttcttccccttcctcctcaccgaccgccacgcacgccatccgcctcgccgtccatccaagcaatccaacctcagcagctcaagctgacagagagggtggatgaggcggtgtgggtgtcgccgaccgtgattccggctcaagcgaaggtccggcctcagctcctaagcaccgcccgccgctgctccgcccttctgtaggtgcaggggagagagaggatagagagaggagggaggatgacacgtggggccacgtgggtcccaccattttttattattttgtgtgtgaactgacacgtgggtcccatgggttttattattttttcgactcgaattgtcacgtaagcgccacgtcaatgccacatcagatgagaccgagtcaaattagccacgtaggcgtcacgtcagccaaaaccgcccttaaaatcaccgagggacctcatttgcacctgttttgatagttgagggacccgttgtgtctggttttggttgagggacgaaaatcggattcattgacaagttaagggacctcagatgaacttattcctttgtgtggatgtcactgtgctagcgtataaccatactctcggccttctgggcttttctttaatgttctttggagcctttgtgttgtatgtgcgggtcatggctgcgaagaatcaaggcagcagacagtctgcagtagaatttttttcttttaatatttacaaaaataatctaccggcgtaaaaaattacaaaaatagaccctgccgccctagtggagggcggcaagttgacgtggcagacggcggctcgacgacgccgtctgccgctgtctataaaaattgcatttagccccttgccgctctctggggctaaatgcatttttcgcagccctaaagagcatttggctcgtactttttttttttgcatctgagccccttgccaccctaggcggcaagggacccagatgcaaaaattaccagccaaaaagtactaggcccggactggcttttttgtatggggcgcggcaagggttttcgtgcaaaaaaaaccctccctctcccgtctgccgtcaccgcccgtccctcctccgtttgccacgtcagcttgccgccctagtggagggcggcagggtctatttttgtaattttttgcgccgatgtattatttctgtaaatattaaaagaaaaaaaatgaaaatgaaaaaaattcgtctgcagtacacccaaccacggtagtgcgcaaggacacgtggaacgaaaacggaaagacataagatacgacatactgctccctccgtcacataatacgagggattttgagtttttgtttgcactgtttgaccactcgtctcattcaaaaaatttgtgcaaatataaaaaaagaacaagttgtacttaaagtactttggataataaagtaagtaaaaaaataaataataattctaaaattttttgaataagatgagtagtcaaacagtgtaaaaaaaactcaaaatcctttatattggacggagggagtacttagcaacgaaaccactgcaagatgttaaatcccaattgtctccttctgttgttggcgtctttttcgatcctaacacgagacttacctaaaaatttacggtgttaacggggtcgctaaccacctcgatctagacaactctaaatcaagatgggttttgaagattaaattggctagcggagtcaatttaaagaacaaaacaggcaccgatgccgatttagattgatttgaagataatcacgcgtctcgtgggcgaacggaaggtttacgaggaaacctattaagggataatcgcactctcacgacgaagacgaatgatttatgatgcaaatcgacaacgatggacgaaactagggtaaagtataaggcatggctgaaaagtaaaggtaaaaaataattcgattgtgtagggattgaaatattgtgtggttttgaatcgaatcggccttagcccttataaaggggatggttttgccttctgtaacctctccttcatctccaactcgggacagaaacaaatggaaactcgaaaaataccttcacaagcaagaaaactcgaggcccaataaacataggcttggactctaccgatctgaccggccacatattgccggtcaaactggccccacacaccggtcatactggcctagtgaaggaaacccggcaccttccaaaattttgcaatatttccctatttcgactatagatgccaaattttggcgtaagaatatgtatccattttttttcttccctccgtcgacattcttaactgtttaatctgtttgaccctgcagattgctcgctaatataaaaagggacatacggattggcactaaaggtattggaaatattataattgacacctatagtgcttttcagtcctaaacacacgcccgcgtggataccaatggcaagaactagcacctttgtgtacaactaggtgtcgttttttaattggaactgaaaccaatattttctgttagaaaaaggtgccaattccagctaaaaactgacaccttttatttctatctcattagagttattgattgcgatacccacgttaaaacaagcaactatatgatggtcaatgataggtgttggttccagttaataaaccaacacttttatgcggattgagccggtcttatccaatcgagccgagcaaacctctttttttctctacccttacttttttttgtcgccctctcctctttttctccgcccgcacacctctttgttttcgccctctttttttttctcctcctctcccatctccctcctccaaggcgtggcgatagcggttgccgctccctgccctccctcctcagcatggcgatggctacggctgctcccatcctcgacgtggctgcggtggcggctgctgctccgtgcatgacctcctcctcggtgtggcaacggctgctgccgctcccatccccgacgtggtggcagcggctgctgctcacctccccggtgtggtggcagtagctgctcccctccccgaaatgcagccaacggtcgttctttggtgtggcggcagtttgatttgtgaatattttgtgggaagtttagaatttgggatgttgatctagtaaccaccatatgacgatggtttgatttagaatattgattttgtggggattcttgattttgatttatgattgcaaatgagtgcacaagattttcgttcataccaactaacaaatgtcacaaaaaatctagaaataattaaacttatactcctaatagcattacacgtatctataaagtctcatattcaaattcattatattttaaccatgaaaaaaacacaaaattcttacagatttttacatgaatttaaatatgagactttgcatatacgagcaatactattagaaatacatgtccaatttttctatagaatttttcatgacatttgctagttgtgtgccacgaaaaatttgtacacgttccctcgtctccctgcctaaaatctagcagtgcagagagtgaagcatgtgtaaacacgactagatcgaatgaagcgccccgcgcccaatcatgcggtgcgatccggccgccacaggtttttccggctgccgcggccgttcagattcagcggtgcggcggcacgcagcacaggcagcagcacgtgaaacacgcgagcacagtgcgtgcatgcaacccaactgtacgtacgcgctagctggaccaccatcgatgtgggtagatgagtacttgcatgcatcggtcggatgatggcagtgtacagtcgtacgcttggaccgcggcacgtttcgccaccacgcgcggctacagtcgtagcaggacagctgcagggcaaagctcctcgctgactggccgatcgaggcgcggccacttgtcgatcgctccgtacgcgtgacgagactgtagcggcaaaggccctgcagtggccgaagttggtgtgtgcgtatcatcaggcatcagctcgctagtcaaccgatcaaccaccactcggttccggccccgtcatttcacttatttggaaaataagccaaacaacctctttacaaacgaaaaatagtttgtgaataaaacttttatatttgtatttttagtgatttaaaagcaaaggctaaaaagtataatgcaatgaacccccctaaaatcaactccaaattttgaaaaatcaaatttaaactgataagcataagtatgatgatgcccgataaaaacaacctttatccgtctaataagaaaaataaacttttgttcgtctccgaggaaaaatcaattttgtctagaaagtttacttttttttttccattgaatttcttttatggaggaagcatgttttgcatttctgcagcctctggatatcacaaacgacatataaagagaaatacaaagatggatgaatctatcatagtgtgaactgttaaggagtccattgtgagcctatcaagagagtttttttttttgccgctagctaatttttacggatgtttacactgattgatcatgatagagacggatctggttaaaagataaggcctcgactaaactttaatgttagtttgatctattatggttaaaagataatactagctcatggattgttttagactatgaaattattgtgttgtgtataatgtctcatagattttttatagttactgtactgccgtaagaaaagtggaggaaaaccttttaaattttcagccgttggattatgagatgtttgtattgagcggaagctaccatcaaaatgactgatctttttccttcaggagtatcgaatggtaaacggtgggctttctcatataaaagagatggatggttttcttcctctaaaagacggttttgttaaaaacagctggtattctaagcaaagaaaattataaaaccagagtaagacaatgttttttaagcaattatttgttccacaatgttcatgtcttactacatgaaacgatatgatgtagaaccatgtaaacaataaaactacaaactataaatattgtggacaaatagcacaaagcaacttgccaattatttcttgatttgataatttgttgagaaggttaaaaaaagccagtttctattttgaactacaagaaaatctaagaaaaacagtctactttgaatctggacaacaattagttcctttaaaggcttggaatatttggacacaaaggaatggcttcatctttgatcataagccaccttctttatcctctcggaggcaactttttaaaggatgcctccttttattgtttaggttgaataagagagataaggatgaagtgaaacattggattatgttgtggcaattctagattgtaatctcttttctttcttttattaataaattgaaatcaatagcaggccggggcctcccttgatgtgtttctttaagaaagaatatgtataaaaatcgaccctagaacccaaactattcatgttctcgattgccttgatcttctcgggatttgcctctattcctctgccagagacgaggaaaccgagtagcttgcccgacggtactccaaacgtgcacttctctggattgagcatgaggcgatatcgtcggtggttgtcgaacgtttcccgcagatcgtcaatcaatgagtcgtttgtcttggtcttgacaacgatgtcgtcgacgtatgcctcgacattgttgccgagctggtcgctaagtgcgccctggaccgtgcgctggaaagtatattccctgcggttatcagtccgaatggcatcttaacatagcaaaataccccgaatggcgtgatgaatgctgtcttctcttcgtcttctttcgccatgctgatttggtggtagccagagtaagcgtcgaggaaactcaaaagctcacagccggctgttgagtccaccagttggtctattcgaggaagagggaagtgatccttgggacatgccttgttgaggtcggtgaaatcgacgcacattctccatttcccgttggccttccgcaccatgactgggttggctagccactctggatgaagtacctctctgataaagccagctttgagaagtttgttgagctcttctcgtatggcttattttcggtctggtgcaaatctccgcagtttttgctttactggcttggcatcgggtcgcaccatgagtttatgctcaatcacctccctggggacccccggcatgtcggacggctgccaagcgaacaagtcagcattgtcgcggaggaaggtgatgagcgcgagttcctatttctcgcttagtgatgccccgatcttgacggtcttgtcggggttggcactagagagtggaacgatcttgatcacgccgtccggttttggcgtcttgtttgtcttgctcactttcttgggtggctcagttgtggcgggtaggctgggcgtttgctcgaccatgtcgaggctccgcttgtcgcattgtaccaaaagttttgcattcccttgaatagtgattgttcccttcggtcccggcatcttgagcacttgatacgcgtagtgagatacggccatgaacttcgcaagtgcagttctcccgatgatggcgttaacgctgtatcgaattcagcgacatcaaaggtgatctgctccgttcagaagttgtttgcttggccgaaagtcacaggcaacgtaattttgcccaatggtttggacaaggactggggagtaattccatggaagggttgatcggtgggtgtcaactcgcttcgtggaattctcatcgcgtccaaagcgctagcgaagagaaggttgattgagctgccaccgtcgatgagaacccgcgcgaccttgatgttccgaatagtgggttcgaccacgatcggatagcgtcctgggatgacggcagtcttgggatggtcttcttccgaaaattctatcttctgttcacaccacttcatcttgggtgcagctccttgccatgttgaacagacttcacgttccactttcttgtattctcgctttgaggagtacgctgtggagcctccgaaaatgtgtgaaacgtggaggtcagagtctggatatgctgagtccaattcctgagcagccgcctctgcatccttctcgaccacgcgtactcgcttgcctttttcaaatgccatgtgcttctcgagcgactttttgaaaacaaggcagtcttccaaagaatgtctatccatcttgtgtatggggcaccatgctttcttcgcgtcgctaccttgtgggtctgggcgcttgggagggttcgcgtattctgctgcgagaacttccgcttgagctttacttttcccacttttgcgatttttcttcttgcttgactcaggtgcgtccttggctggtttcttgtctcctccagtcttcggtttgtcgttcttgcgtctcagtgcgtcatccgcatgagcgcatcgatcgacaatttcgaataacctccgagtagtcgtgatgcgcctcgttgccaactcctgagtagtgtagcgatctctgacaccggatttgaaagcgtgaattacagaagcatcggtgatctcggggattgtgtttctgcactcattgaagcgtcgaacataatccctcaaggattcgcccgggttctgtgtcaacgcatgtaggtcgtcttcgatcgcgtggcgcttgtaagttccttggaaattggctacgaattgctgccacagatctgcccacgaagagatcgagtaggggggagatgcatcagccatgaacgtgcagagcctttcaatgcggttggcaagtaatttgccaacgtcttgttgtccgctccggcggcgtagagtaccgtggagtaaacctgaaggaattcttccgggtcggtgctcccatcgtatttctctattgctccaggtcggaatctttcaggccatcagacatcccgaagtgaacgaacgaaagctctacacccagcgctgggggcggtgggttgtcggcgatcatacgtccttcgtggatgtctatctgatgaagatcacgaggatgatgacgatgacgatgggtcgcttggttccggcgcacaagtacgaggacgtcggccgggttctcgagaatcctgtcgccgtctcccgctgttgtctcggcgccgatctccaccatcgtcgtcattatggcgacgtcctcgaccagtatcgcccggcgcccgctgttcacgatcgtcgtgatcgtggttggatggcggctatcacggtgtcgatcttcactcgaatggcctcctcgttcttcattattgtgacgccgtgaagagacgcgatgtcgggaacggttctcgttatctcgtgtgcgtcgcgcctctcggcagccatttaggtgatcgcggagatcaccggtgccgcgaggtgggggggtggctcgatgaggcgattcccgctgttcagggttttcaccattagcatcaccagttggtggttgttccggacgcgctgcagcagcggcctcttcgaatgcgttaccgaggttggccactgattcccgtagtcgttctatccaacgtgcgagatcgtcgttcagaacgggatcgtagggggtttccctcagtattgcgttgacggctctgatgtgttgggccggagtggtcacttgattctccgcttccgcattggtgcgtgctgacgtgccgacatcgtcgatagccaatacctcccgcggcgcgctcgttgtcgatgatccatagtcttcgaggaggtgcaagaatgatggttcgtggggattaatgtcgattaccccaacaaatcgatctgaaattggcgtcgctccttgttccttgtctttatccctgatggggatgtgtgactgctggaccttaggagatggcgtcttcatagcgctgagaaagaccttgcagcttgagaggtcgtgattctttgtcttgtgaataggacaatagacatcacgagttggagaaatgcgctgaattccacgctctttgcaggcgcgaatttcggcgcggatgttgagaaaaacccagcaggcttgtaaagtgtgtttcctggttttgtgaataggacatcaggaccttgtcgcttcggaagtcatcctcgtcggctcgtggtccttgtcggaacgacaaggtttggccgcattagaatccttctcgagctcggatgtcgtcgatgttccattctccgcttcggcgggaggatccttcgacatggagtcgtcctgggttgtaaccactgcgttctcgtttccggtcattgatgaaccggctgagatcggcatcgtggtgtaaaccgggaagacgatttcgccgacttgagtccacaccagcattgtcgaagcaggaaatccctggttgaggttggtgttgacgttgttgtcgacgaagctggatgacatagtagtagaaccttgagcaccaagtccccctacctggcgcgccactgtcgacgtttgatgtcgcaattctggtatttgcatggtatggggatcatcggtgctagggtatacgcgagactgaggtaaaagagacggagacagggatttttatacaggttcgggcccctgaattgtcaggtaataaccctacatcctgttggccgaagccggtcgttgatcttattcatgataatcacaccagtacaatatttggggtagcctatctaactgttgtcgacatggcggtctgacgatctgactcgtagtcgacaacagggtagctttcctcctcgaatccgtgcccggcgagatcagagatagcgctttcgtctctcctgacagtatccggagacaccgtatggtactagccatgcttatccctgaagtcgatatccggcggcatgtcttggcgtatgtcggcttctatgtcaattgtgttgggtgttgatcctctcatggtgggtgtccccctgtcctcttaggggggcttgtatttatacccataggtgtccccttgtccaagcagaactagggaaaccaatatggatacaatccgagtagtccttgtcgtttccatgtagaactctggttgtctttccttatccggaactccctcgaggtcagtttccgtataagacatggtatgtggtgaatcctgccgagatttagtcaattactattaggtatgtagtatccataaccctgacaagtggttataagtaacatggtggcaaaaattagaagacaaaataaaactatatatgtgataaatgagaacacccacacgtgcatgcttacgctaaaaattaattggagaagaccgtagaagaggtcgatagataaatcttgggctatataacacaatactcatgcatatctgtataaacaaaccttgtatttatgtaaaatgcaaatagaatgtgatcagattaccaatcaagtaaaatgtaagcatactagaagaaccacactaccctaaaagagagagaaacaaaaatgtcagggagttttcacaaaatattgtcctagacaaacgtgggttactgggttgcaccaaattgaggaggcaaggaaacccgaagcagaaccgctgatatgtggactagccatagcatccatagcgtggagcggccagtacaaatcatctgaatataaaattttattatatattgctttgttcgttttataatatataacacattaattatatgtctgattcattctcaaaaatatatatgtaaatgtcattctttttgttggtactccctccgctccaaaatataagtatttttagctatgaatctggacaactgtgtgtccatattcaaagctaaaagttgttatattaaggttgacttatatacatttgtatatttgcactactagtatattttttaatgagacaatgctcaaacattctaattaaagtcaacacagtgttattcagttattgtacattaaaaaccgaggaagtacgtatttaagtttattcggctaaactaaaaatgctttaccgttcgtagtacgtacgtgtatcactgtacagccagctcgctatcctgataaccaagtggaacagaattaaggaaaacgtggagacaggaaataaagagagagagggcacgtcgctctcgagcggccgcgacggggatctggtctgatcctgatccttggatgatcgatcgatcgatcagctctatccgtgccctttggaattccttttcctccactacggcagcagctgcgatcgacgaccagcgcagtacgtacgacgtccgtaacgcgcgtgccttttggggttttgggtttgagtttgggtttggccgcctcgatcgctttctttagctcctaaacagcatatttataaacgaaaaataatttataaataaaacttttatacacgtatttttaatgatttaaaatcaagggctaaataaataaaattcgataagaaaacctcaaaatcaaacccaaattcaaagttaaaaatttaaattttgactgataagcataaagataaacgagaagatgggctatttctttatcactggcttacactgttacacatgtggctactggccggtcttcgtggcaaccgggcgataggcatccggcctctggcgtccccattccgaatgggaaaggaaaactacgtgaggggtagccatgggccatggctagctagctgccggcgtgaggtggaaacacagagtcaaaatgtgctgcatgccagctgactggaatgttactcgcgtgaaagttccatgatttctgggcgctggtgcggtgccttagtatgggtgtggccctgttttgtcccccttgaagctatctctaaaaagcaatccaaatggacaatatatatatatatatatatatatatatatattaaatttgtttggtgctccatggtgcccgggcaccattgttgaaattgagtatatacccaattcaaatgagtatgaaactttttcaaatatttaggtattaacattaactactttactaactagttcaaagcaagtttgaactgaatttgaacttgtttttgttaaattttgattctaggtatatagcatccaaatatataattagttaggtatgtaatcatggattgtgaaataaagttaaatttgagttgttttgttgataggtataggtatgaatcgaattcttataactagctatatactcataatttgaaaattttgaaaaatatgagtgattttgtgtgtttgatatcatggtgcccgggcaccatggtgccccatatgagtgtatatatatatatatatatatatatatatatatatatatatatatatatatatatatatatatatatatatatatatatggtgtttgaatctcctgaagatgaagataaaaatgaagatgaagataaagattaagtgtttcatgcaaaacgaggtggtaataacatgtgattaattgagttttaattattataaacttaaacaatgaattaatttaatattttagaacaactttcatatagaaagttttcacacgaaacacatcgtttagcagtttgaaaagcgtgccacaaatatccaaaactttatccactctttgtagtggaaatgaacgggtatgatatcttgatagtgtttaaaggggacagaattaaacacatatttagattacactcggctacatatcacttatagtctgttacaatgacattcagttacagtaaaaaaaaaaatcaggttttacaaattagcttgtctctagatttccgatttttaacatgtttatcccctttttattatttcattccaaacaggctagctatatccattaattggttgaaaattctataagattagcttcaaatttgggaaagatcaataggtaataggtagtcccaaaaaatatctttcacaatgcatgctccctccgttttatattatttttcactgatcaccaatccataagtcccgcggttattactattgacaattaattaaaagagaacttttatgttttcatagctctgaaattcgtaattaataaatatcgagttttctcggtttgaacccttggttgtagccttttcctgtaacgaggaactatagtcattccccttgtacttttggctggttcgaaccattttagatttgggctgtgttcggatgggcaagttcccaatctaaaatatctctttttcatgctcatgtttctaagctgttaaacgatgtgtctttttaaatttctatataaaagttactttaaaatcatattaatctattttttaagtttttattagataatatttaattaatcatatgctaatgagtcactccatttcctctgcgggagagtaatggtgtcgtctgagctagctagtttacacgtgactcatatcttcgctcttctcattataactcaagtgaacattagagcaggtacaatagtatactataagtcagctataaacacatattgagaagataaaagaggatagagaagagcagcgtcccaaaaaaaagacaaaccttaggtttccgtgtctaacatttgaccgtccgtcttatttgaaaaaattatgaaaaaaattaaaaatacaagtcatgcataaagtattaatcatgttttatcatctaacaacaataaaaatactaattataaaaaaatttcatataagacggacggtcaaatattggacatggaaacctagagtttgtctttttttagacggagggagtagccagctgcaacatggacttcaagacacagtgtatgtatgacaggtgggaccatatattaatagtgtagtatatgtttaaaaataactattgtataaattggctattaaatcgactatatatgatttagagctaatagttggttatattattaaacttgctcttagtattttttctatatggtatatcaataaattatatgggctctaccctaaggtgagtcaatgggtctaggatagctctaacttatcttcatgataacgtattgtcatacaaatatatattctcaaaaaccaacaatattgtattttgccgctatatttttactatgacatatgaatgtgtacaaaatataacactatattcttgacaaaatcaaacctatcattcgcatgaataaccaaaacaaaaaatacattattattttgatgaaaattgaaacgagcagcaaggttttcggggcatcaatcactcactattgtgaccagagaggtagtactctcttcttccatactacaactggcaactttttttttttgagatccttgttatcacaaaaacaacctaacaccttgtttaaaacatgggaaatcttttccgattaaatcatgcaattaattgatctctacgaaaatcctaccagtactttgtacttccctgtgcttaaatacacatgttttcttagaccactttgaatgagagtttcatttccattaaataaggtgtcatatcaatattttctatgatgtggaaatgaattaataacgtgggagataaaatgagtttcatctagataaaattatatctatactgtttccaatacaacttgtctcttgtatgtattgcctataatgcttgtaaaaacagcaaaactgaaacaacgtatttaaagagttattttaataatcaattaaggctatgttcgttgtgggcggttggaaacaaatattacagagccgtctattagcgtgtgattaattaagtattagtctattagctattttttaaaaaaaatagataaatatgattttttaaggaattttcatgtagaaactttttttaaaaaaaacacaccgtttaaccgtttaaaaagcgtgtgtgcggaatactagggagaggggttaggaacaccctgcatcgaacaggctgtgtgatacatttgagaacataagaataatatcgaaacgtatagtggagagggaagggaaacaaaacaatcgtacgtcgctcaaattcctcgcgttgacgaattctggaatcaaaacacacgcttgcatgatcgacgaaaattagattaaaactaatcgaaccatctcatcacgtttcttcccttttgttgactcggaaattagtgacagtggtccaaaacgtcaacgacgtaggagaacacctgtgcttcgaagaaaaaacgggagaagaagagacgccaatcgcgatcggtggttagctggcgtgtggcgtgtgctttgaagcggtaagcacaggggatcgatcggattaatggactctgttggccacccaagaaattggcctgcagacgtgtgcggtgtgccaaccaaccacccaagaaaaggtcataggctctcatagcgcacatgctcgctgggctgctgcttctgcacctgcctcttttatactagtttttttttctttactttttccaacatgtcgctgtactactactatgttaaccacgccaatttgttaaccaattataaccacaccgctcccgacgagaaaaaaaacatgacgttttggacacggatacggtattcacgtaattctgattaaataggtaaagtatttaaaatccaaaaataaattcataattattacaataatttttgagattgatctgcttatatgatctttaggtatccaatctaaaaatcttcaaatacattctttttttaaaaaaaagttaaatgatacgaacaacaagtcaataacgacatgttttctcttagattaagggtttgtttggtggagcttctagctctttcaaaaaagtacagctattttacatattctaagaagctatgtagttagaaaatgaaatagaagtgagaaggcaggaaacccagctttcccatattttcagaaaccggctaccgaccagcatttctcagaattttaagctctctaaataggctctagatatcagtacacccaatataagcacaatataaccattctaactcttcccatgcatcattcaattaagggtatgtagttttggtcaaaaaaaataatttaagagtacggtgtataaaatttgcaaaaaaaaagaggttgttttgacctctgcaatacatgaaaaatgttgaaacatgtgctctggaacatggactaaactagagggagagtatgcaaatttgaccaggaatgcgcagaaattcaaagatcgtttcctactactacatgtttaatcagaaagcagagaaaaggtgtactaacaacatataaaagccagtacacatgacaacagtctttccagtcttttgagtaataattattaattacatactatgcatagaaatggagacagttgtacttgtacatcaacaaaaatggataaatctaccattatttttcagaacactgtatatgctctagtggaggaaataatcacttaaatcagtgaaagaactctttgggtttgggccaaagaaatctcaaacagagacgaacttaaatcatggaaaacaacaatttagtcagtacttaattttttttctccctttgtgatattctcctcctctaaaccgggcagataaatcttcagagcccgagccatgtcgccggctcatctttcaccggcgcgacggcgaagcttttctccggcgccggcgacgccaccgccgccttcttgtatggttcgctcgttgtcgtgatcctgcaaattgatatgcacgcatgttaaaatccaatgatttaagaaattactaggggttaaattaacagacaagataataaaaattcagtcagaaaactgctctgctctacttgggagaaagatttagttatggattcgtcgaatttttgtttgaattctaaatattcggaacgaatttgatgtttgtagtgatgttctcacctgtgcttcctcttctggaggaaacgctgcagcgacgccttcctcgcgatcggcatctccgggagcgcggcggcgtgcgccggctgcggcggcgagcacgcggagccggccagcctcatgagctccgcggccttctcgaccgggacgtcgtcgaccacgaccatcctcccgtcgtagaagatggtcagcggggccgtccccgccgacggcgtcgcgacgccgtcggcggcggcggcgcgcggggggaagagctgcatagtccgcgcgtcctcctcctcctcctcctccgccaccgcctcaagaaccgtcaccggcggctgcggctgctggcgctcccgcatgtactggctgaggaggccgcacgtgacggcgaacctgctgctgctgccggcggcggccatggcgtccacctccaccacctcgcgttcgtctcgtttctttctttctcacgttgtctccgcgaagctgcgctgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 68765 - DNA, 7422 bp, Oryza sativa
  unsure (1)..(7422): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtgcagtaggttattttctgaaatgtttcagatcttgtagaaacaagttatgcttgtttgtgtgtatatagagtatgtagatcgatctccattgctgctgctttctctggaataaggattatgctgtgtttaggtaggattaggaggagacaaagaggggcgtgatgctgatctagctggtcagctcctggcttccaattgataaagagatcatgtaatatattctgcttggatgatcgttcagcttaatgttagttccaacttccaagttgatcagattcctggtgtcgtgtcgaaccaagctgctgggagttcgtttgcctgtcaatttgttgcttgataagaaattctctgaaagttaattaaagagttgcttcataggaattgaagtttctttttctaggtaagaaagatcagaagagttgataattaagaacttgagatggatggattccgtccgaatcagagctgcttgtcctggattgtgattggttgatttctggtgacaaggaatcctcgtggaattgggttcaaataccatggttgaattccaaaaatttccaaacagcatttgaacagctaccgccttatctcaattcatcgattttgagcgtaattcagagaacaagtggtgttactgaaaattagcttggactcaaaattcgattggttttgctgagctcaacaaggtttaagcaaatactaataacaatctacgccaactgtggcaaacgagtccttagctatgcttgtctcatcgacaagcattgggcgctttctagagaaaacttggaagattcgatcccggacaatgatgaactgaagctgtgatacggaagagtgagatgataattaaggcctcgaggtcatttgcatttcaagagtaaattacatctatggcacatgatcatggtacgccatagctgtataaatagatacaacaaaatttacaaattgtatgattcgatataagttagtccatgcaaatccgagccaaaacaattcatatacgatctgatgtggcgcgcactggtgaccctttcacctgtgagttggaacacacactattagctgttcgtagttttgcagaaaaccccaggacatgtaaatttttccatcaaagtccctgcgtctttgagtgctgtaggacccgaggtagtcagggtcaggagttgaggtggatggtgaccggtgagattgaactttggagctgaaagttcacttcaaagccaacaaagaaggaggcagcgaccacgataagcaaatttcacaaaaccctagatttctgggcttctgtgatgcgaggttttgttattcgtttcatgaaaccccaggttttggaacaaagtgtttcataaaacatcagctacaagcttatattgtctatccggctaatatatttatatctataataaatgtaaaaagatgcatgagatatttttaagtacatatacatgttagctgcttttgaataatcgtttatcatcatggtatgatcctttatgtgtatatttaaccaattatatgttattatcagttagaattatgttaagtttttgtgcattaaaaatttgagaaaaaaataaactatatgagatgaatgtgtactttgagttaactaatatgaatttacgaaaaaaataatcatatgcaataatgaaatgtgagtattttacacaatacgaggtttattgaaacattttaccccaaaactgcttgaaataaaacacaataactagggttttgtgttatggatgcgtcaaaacctgaggttttgtgaaatttactcttttttttatatagagatggattttcatctccagaaagaatatctcatcatttcttgcatgccacctaaacaattgtgaaaaaaaattgttaacatagattactacgaaatatatcatttcacaaacatgcaatgcaaattcaacttttacaagttgcaataaaaaaataagctgaaaatagtttaacttacgttcacagttatatttgttacgacttgtagaagttgaatttgaacttacatgtttgtgaaaagatatgtttcatattaatctatcttatcaacttttttcatattttttataaatatttaggtggcatgaaagaaacgaggagatatcccctcgagagataaaaacactattttgttttctttttgcatgtattatgttagctagggtttatatagactagtcaagttgttgtaccaaaacgaataatttgcaagttattcgagctatctgtatccactatgcaagttcctatgacaggcataatttactcatattttaattagtttgtgctgttgattaatcagtatgttatattttaatggtgtcgtctatctatacacatactacttccgtcttaaaaatataagaacctagtattagataagacacatcctaatactacaaatttagacataccatttgtcgagatttatggtattaggatatgtctcattcatcagtattaggttattatagtttgagatgaagagagtattaattaggcactttcaaaaattctcacgttagcaataaggatccatagatagatctagtcatgggtcacctaggccatgatcctggaccaaaaaaggattaaagcccactatgttcctcgatctttttttattaagatgtagattttatattggttttcgttagcattttttaaaatgtattttgtaaaaaagtttctacatataagttgcgctaaaatatcaaataaatttattttttaaatttatagtaattaaaacttaactaatcatgtgttaatagcttttttttttagtaataaggatccatgatggatctagtcatgggccacctaggccatgatcctggagcaaacaaggattgaagtccactatgttcctcgatcttttttaattaagatgcagattttatcttgattttttgttagtatgttttttaaaccgttaaacaatgtatttttacgaaaagtttctatatagaaattgctctaaaatatcaaataaatatatttttcaaatttataataattaaaacttaactaaccacgcattaataactctttttttttccgcgcccttacttaatatccatcttcattagtttcatacaccatcatttaaatgggatctcatgacttgggcctagcctggatttgtctctgaagtgacctagcttctttgtgtgatcccattatcatagctggaccatattatcaaataaaacatgaaattttaaatattgtggactctttagttttatccttttcaaaatattctaattttcaaattctaaattaataattaacaagttataactaagataaaagccactctagtttatttgaaaataaccaatacaacatatggttaagattttaatattcttaatatcggtagaaatagtccgtgcaagacatagattgacgactagtttatctattttttattgatctcacaagacagtagctccggccatcatcactgaggtggtgtttggatcgagagactaaactttagtccctgtcatatcggatgtttggacactaatttggagtattaaacatagactacaaaattaattgcataaataagagctaattcgcaagacaaattttttaagcctaattaatctataattagcacattttttactgtagcattacataggctaatcatgaatgaattaggctcaataaattcatgttgcgaattagtctagtgttatgaaataggttttatcattaatctacgtttagtacttctaattagtgtcccaacatccgatgtgatagggactcaaatttaatcctagatctaaagaggccctgatattcaatggatgcaatcatataaaaattctgcttctgctcattcaatttataatttaatagaagaagaagaagaaggagaagaagaagaagaagaagaagaaggagaagggacaaattcataggacaacatgcttaacagtacaatcgtttaattaactaattaacggtctaacgctaagccataagctatataattttgctttatgtggttcattggttttggtacgttttatggttaaccaacctagcttagctatctatgtacgtagctactccactagctaatttggccggccttatctgtaaactgtaatttaactctctctaataaccaaattaagccaccaacaatcaccaataccgcttgcttgataggagtatttgggcagcggccgtcgcggtttcgcctttcgctcgctcgcatagagttgcgtgtgcgtcgctgcatctctgcatgcttgactttgacttccgccgccacacccacaacacgacattacatacgtgcatgggagttaatattttttagtatgatcgaatgatatattcatatatatataaatctagcaaatgttattgttattttttctgtctactttgggtgagatcgaccactggcgtttagtgacagtaggggagtgaccgagtgagcatctagaggaaaagaaaaactactcaattcccccttctaaaatataaatatttctagttatgaatagttaaaagttgttatattttaggatgaaggtagtatgcacgatagctagctaggtggggattaattttagatggtttttggacaaactttcaagagccccatctagagtaggtataaaaaattgaataaagaaaatgattccctggtcgggttgatgtaacatggaacttgtcaattaatggtatacagtggtcaccaatatgttagtagatattactatctccgtttttaaatatataacgccattgattttttttaaaacgtttcatcattcttcttatttaaattttttgtgcaaatataaaaaatttatgtcatgtctaaggaacattcgacgataaatcaagtcgcaataaaataagtaataattatataatatttttgaataatatgaatagtcaacgtatttaaaaaggtcaacgtgtcatatattaaaaaacggagggagtacaaagttatctcgactgaaaatatgggttcttaaactctacgaacaacataagtactaaacatgcttttaaaagtcaaaatagaacttatagttatatatagtatgtgtgtttacggtagaaatagaatccaaattaatcttaatcctctgttaaatagatagagatgcaccacctgacataacaaggtagcaaacttttaatatttttgcactgcctttgcttgttggcgttcctactgctttcttgggttgcgtgctaattatattggctggagaggggtacacatttttaaaagagtagatgcaagtcagaatgtggattagctcaaatattctcccctaacaacatagtttaaataagaaataacccccactcatattgatgactcactactgatgcagacttgcttacgatgatcacgaagcagatggaacgaccaaacccttactcgaaaaataatgcattttcacttatggtttattcaagggataagtccattttacaccctccaactctttgttttgtctaaaatacacccaaaactctaaaaccggatatttcaaaccctccaactttcaataccattcactttacaccctcaagtggtttttcagctggttttcacctgatgtggaggtccattcagcaaaaaaataaaaaagtataaattagacccacatgtcagtgcatagccacctcttcttcttcccccatctcttcttccctttctctctctatccttcttcatcccagaccaggagagcagtgacggtggcattcttgagcgccgacggagctcaagcatatccccagccttcccttccgcgccgaccaccggcgagcacgagctcaaggttcgcctctcctgccacctccaagagctccgtcttcaccatgaaatcgagctcgccggcggagcttgagctacttggggacgtagagttcggtggaggcgacagagcttggggacgaggaacgcaagcttgactaggcggcaacggatgcggagcttgagctcgatctcgtccttgaccaagcggtggcggcgctcgatcttgttcttgagagaaggggaaggttggctgcggccacgaggccatgctcgggagaagagggaggttggtggcgacctcgatgcggagcccgccttcttggccgaggtcggagaagagggggttggctacaagctcagaaaagagaggtcgccggcaagctccggcgagggttgatggatgcggatccaccccctcccctcccccttgctgcggtcgaagaagacaggtgccagcagcgcggcctcgagtccacgacgagcttgatggaggagccgacgctgctaggcctccaccaccacgagtttgtcgtcgcccgcgctgtgtctgccatgagcttgcttggagccgcccgcgctgtctccgcctccaactcgagcttgttgggcggtgttaccgccggcggccacggaagggcgtggagctccgagcggcgaggagggggcgctccacagatggagctcactggccacttcggctgctccaggaatggaggggagagtgaggtagaggggaaggaagaagaagagtggaatggaactgacaagtgggaccctcctctttgctgatgtgtatttttttagatgtggcatctgacgtggcatctagttgtaccaaaaccagcctaaaaccgctaaagggtgtaaaatgtccggttttgatagtttgagggtgtcagatatccggttttatagttcgagggcatgatttagacaaagcaaagagttgagggggcgtaaaatggacttatccctttattcaatagctctcttgtgataaacctaattacaaactttttttttgcaaccgtttataataagtttatcctccaggaaagttcactgtacttgagatgtggacctctcgatccccataaatatatacttgagatccctatgaatgcatacttgagattgacgaggtcattatagacacctcgcagtcgatgagtatatcgcttgcactgaaaagaataattagttgtaaatacaagcaatcgtgtcatgtttaagatcactactacagatgtaattatcctggacagcggctcactttggttccaggctggccataagtggctccgcctgcaaccaggcgaatgccggggttgggcagtgggccgcac

SEQ ID NO: 68766 - DNA, 8350 bp, Oryza sativa
cggcccacagtaggcgaccgcttgcgatggtcggggggcatataagcccatagcccgaccggggccatgcatggccggcgttttttctctcctaaacatccacaaattaggggggaaggtttttgacctcaaatctttgattgggttccatataaaaggtgtagagctcgttctccttctttatttgcttctatttttgtcagttttcatcggtggaatacgaagaaacttgcagttttataaatgaaatagtgtaggcacctttttgttttttttatttttttagcaaatacatattgcaatcttttacatgtttttaaaagtaattagcacctacattgaaacgttgggtttgcctctattaagtttattttcatttggatgaaaggacgaatattttcattttttagaaatggatagacagtattctattaatgcttaaaattgctgtggggctgtttaaatagtccgaacaactcgtgtagatagattccactacaagcagtataaccagttgaggtacactcacttagcctctcgaagagttctgtttgcatacattttcaaattaggaacaaaattagctcttcaatttaggtcttccttttaacgtcagaattacatagaaattaacttcacaacgataaagctaatttccagtggaaaatgcgctcattcttgacagaagtgacatttatgcaataaaaaatgcaccgcaattcacctctacccacgtctcatctactcgttcaaatgatttttttttctcacgtggcaccatataatacatgtatgtaaaccaaaccttttaattaaaaaacccgagataaaaatatgtcaattttcaaaatagtgacctagctagctcctaggtagcaactaaacttgaacgaatttgtaccccaaaatataaataaaaaatgccatcttttaattttcattcaaagaaaattatatctccgtcccattataagtgtagttacgatttttcatatctaacatttgaccatccgttttatttgaaaaaaattatgattagtatttttatagttattagatgataaaatatgaataatattttatgtgtgattattttttgtagttttatcataaaatttttaaataaaactgaccatcaaacgttggacacggaaacttacaactgcacttataatgggttggagatagtatagtacagtagtacataaatttgtcaacttgtgatgatcaagtacgtacactcccgccaaagtttaacgtactacctttcttcctcctttataaatataaacccccatcgtcttctccgatgtctcaaacccaatcaaactccaaccaaactcacctacctacccccaacccatccagagctagagctatgtgcggcggcgcgatcctcgccgacctcataccgtcgccgcgctccggcggccacaccaaaaagaacaagcggcggcggatcagcgacgacgaggacttcgaggccgccttcgaggagttcgacgccggcgacgacgactccgactccgactccgagtccgaggaggtagacgagtacgacgtcgtcgtcgacgacgacgacagcgaggacggcgtggtggttcttccgccgccgccgccgccgccgccggtgattccacatggtgaggcgatcgatcgatcaagaattggtttgcatcagctgcagaatttagcgtggactgagaggagtttcttgttgtgtttgtcttgtcttgaatcttgcagagcgccatggcgcgaggcggttccgcggcgtgaggaagcggccgtgggggaagtgggcggcggagatccgcgaccccgtgcgcggcgtgcgcgtctggctcggtaccttccccaccgccgagtccgccgcgcgcgcctacgacgccgccgcccgccgcctccgcggcgccaaggccaagcccaacttcccctccgcgccgccgccctcggctgctgctcaccgccgcaagaagcgccgcgcccacgccgccacgcgctcgccgtcgtctccgcccgccaccagcgaggtcacggcggcgtccgcgtccgcgtccagcgatgtccccgcgccggcgttcgcttccttcgtcggcgagcccgggcacggcggcgccaagtcgatgccgacgacgagccacacctcgcagccagccccgccggcgacggtggcgtccgagaacgtcgacgacccggaggtgttcgacccgtacgacgtccacggcggcctcgcctcctacttcgccggcggcgcgtacgagtccctggagagcctgttcgcgcacggcggcgacagcgccgccgtcgaccaagcggcgagcgaccactggccggcggcgctatggagcttcgcagacgacggctcgttctgcttctgatgctgtcaaatcacatcgccattggcggccattgcaagccatggcatggcacctgatgatgctgatccagtgaactggtcactcgttcttgatgcgttttcagtttcttgtacagtgtttttccccagcaacagtgaagtagtattcagttattcactgttcagtcatgagttcatcgcaaaatatgatgtaagtatgtgtcttgagattgttttagcagtggcttttgtttgtataatgtatttctctgtaattaattaatagctgttttcagtgataaactaaattttctgaaatggaaaaaatgaacatgacctattcgatccaagatcgcaaatccgcaacaggcgaggatgatatatacagcagagtataggttcagttttcgaaatagctctgagaggaaaaatattcaagattactgaacaatccatcatccatggcaaatacaacccacttaattatctgcatgatgaaaaatagactattgtcatttctgctacagtacttaacttcccttttagcccaaaaatcgaccaaccaaatcatgttatggtctttctcatgcatggaaatttttaatttcttttcaatagttaagaagagcaagacagaggttacgccaaacattttaatagtgaaaaaataacctcactaatacctcaatggaacgtgctatcagcattgtcttagaaactacattaaaattagagggaaaaacaaattcgggcattgccacggctatatacattataacataggaaggattaactaattggaacatgcacaaatgggtgtttgagatcctatcctttcttctatgtgacgattggtgaggtgttgtttatcatttccttccaactcgtcgcatcaaaagctatgctcaattagctgattagtctaagtccaaggaaggatacttgcatgatgggttttcggtttagtttaggttaggcaacagcaataccagcttccatgatacaagggcacggcactggttttgattatattagacccaaggctaaaagccacaacaatatataatgcattaacttttcttgaagagaatgaactattgttagtttattatatattgatgtaggaattatttatcatgtttggatttggtctgtctaatcacaagattagaagtacaagattagaagtacaggatttctccaacattgacaaaaacagaaccttcaaaccaaccaaatgttttgccaccttcaggctataagcaaagagcttgcgagcctctcttgctatttttcatcaaaatggatatctaaatacaaatttgagaaagcagaatccagaactcgacatcgtgaacagaccttccatgatgggggcctgcaacctgttacataggcgtcccctttgaagggtcggaataaaccccaacacagaagcaccaatacaaacactcaccataggcctctagggtggggccgtcaccgatgacacccatcgataatggggataggttgatgcctggcaaaaattatggttaaagcccatctccgatgattacggttattgatggtctccatttattggccgttgccgatattacacactataaatatcccaatcccttcttgtagtggttatcccgaccaaatgtattgttcacatttgtgtggtgggagggctaggtgggcgaatttttccatttttaaaaaaaaaattagaaaatttagaaaaaggctatctaggtaggggtggattttgagctggcttggcccggctcagctcggtctggctgattgggataacgagctggctcggcttgttatcctaacgagctaaagtcctggcttagctcggcttgtttgaaagctcaagctagctcgtttggctcgtgagctagagcgcacaagcagaacaagcaacgaggtggacgacaagcgaaccgatgaagcgagcaggagaaccgcgtggctagtagcatggtagtgctcgctggacctggtcatagcagcaggctccgcgacaccagagcgggaactcatcggagcactggtaccgcgtcagcaccggagctccaagcttgtcgtcaatccgcacctcgcctctcgagctcctggataagatggagaaggatggcaggcagcaacggcacacgcggaacgccccacgaaaaggaggagaatgggggcggggcggatggcggcgcaggatgcaagctgtggcacgcgcacgtgcaataggttaaagcatgcatcggctggagatccgatattgttaaatccaaatgattagataatcagtaaaacatttgttgcaatcggctagaaccaacttatatgtaatccttataagccgatgcaacgtccagataactcataggctgaaaccctgatgaaacccttattggcaatcaaaggcaagttagcttttatgattctaaacacgacttagtaggtcaaaactaattgatgcaacactaaatgtgaaaagaagcataaagtctaaacaatcaagcctttgattgatttttagggtggtggacacattatattatctaagccaacaaagtaatctagccaatatcgacaaaaccctagatagagatcggtcgatgcaagtagaaaacactatcaatctagattatataatgtatatgataactcgatgtcatacatggacaagattagagtgtcgaagcgatggaagcactaatcccgacaatgcaagcagccataacaagccttacccctcgtcggagatcgaagctaattaatgcaaccccaacttaaaacaagaactagctcatcgagaaagacgaaaacaaaaagggtggtgatttatacccatggatagatactagttcttattggacaagacataaactttcctaaagataaagtaaaagatacaagtcctgattgaactctaaacacacttccctaaaaataaaaggaaactacccgactatgcctaattaatagataattcccaagttgtgtcttccttgaacttggtctcttctagataaacttcatttaattgattaatttccttaatcgaatccatcaagaatccaactattggcagctgacaatttccatcagcaaattccaagactctgaagtcgatactgactctaggccgatgatgacttcggggcttaccaaattttggcgttaacatatacatatatacagttgctacaatttaaataatttgatctattctttgatatgcaacaacaatttatatttctccgttgatttttggaaggcagttataaggggggttttatgattcgataaatattaatgaccatatttgtttcgcttcactgttgtcctttatctgtatttgataatatttctttttgttttcatgccatggatattcgtttttgtttctgaatccgaaatgaatatgaaaagaattgtggacaattagtttccttcggtatctaagccatttttcatctctactcgagtgcggtggagctcatcagtggatctaggttgcggacaggggtgggagcagaagtatttgcagtggttctaggcatgtcggctacccaagatggaggagaggtagagtgagaggagaaagataaagagcaccgggggggggggggacaaaaaaaaggtatttcgcatgctgttgtggaaaaagtgggttgcccccctcaactatgtggtaaactggcatttttacgaagtcctctactttgtgcaactagagaaactgcacggatgaagaaaaaaaagcctaaaccatttttatgtcctgcttgaatccaaccaattaacatgaaaaaacaccaaataacaatatagagaagaagcaatgatgagatattgagactttatagaacacgtgttcgagaaaagagactgtatagaacaaaaacaacgtttttttgggctgtaattacagaggagacaattacatcatgaacaaatactccttttaacattccatctttatctatgtggtcaactaagctaagagtttacacaaattgaatgtcacaaggatatgtttcttcatatatactgaatgcacatcaactgacccgagaagattggcatctttcactaaccccatcatcagatccacttataataccagaactgaattgaacttgaatggactgtgaatgtgctccttgttaagattctcctatagtaatcccaaatcatgtctattttacatagatgccaggataaatgtttttatgatattccttgcagagcatcctatgaactgttgcctagaccagtataatttcacactagccacacttcttttgcaggtatcactacaatgttgcagatggtacgttggcacagcatattacagaaggaaatgaagatggattgttcattagttcagtagcttcttgttcgaatctgtgggctttaataatggatgctggcactggctttacttctcaagtatatgaactttctcaacatttttttcacaagctgagtaattatagtagtcctttttgtttcctccatgctaccggtttcatatccttcacgcaacgtggttagatatgttgcagatttttgagattgttggatggttgtacagcagtggagtttcttctattacctgatagagataaacaattaaacttagaatagtggtagatatatattaaaatgcaaataaactataacatagtggggtttatatttaaaggtgtcaaccaagtaactattacatagcctgatcagttgttgtaacagacggtataactttgatattgtaagctcacccatgatctagtttggtcactattttactaattaacaaatattagtgtttatcatagtataaacaggtcaagacctaggattcaatgccacaactaacagttaggataatatcaaatctatcaatttcatgttggtcttcattaggactcacttgcctttggcgggtgctagccaagccaaaacctccaaattggaggctttcccagttggggttggaaatgtcccaagaatttgaaatagaatgcaaacatcaacaacttctctattcattcaaaaaaaattgtttcgttcaaaacgtcttattgcttttgtcagggatatgatattttagtaggtatataactaaaagccacttacatgtttggagaattctgcttttcactgtccatgtaagcattgctcacaaaatgttggatgttccgggtcagcttattcattgcactccactgccctttttgcttccaaaactcctaatgcatcaagaaacattagtcacttaggcgaattgcatggagttggaattctgaagaaaatgtgtgcactgtttattgtcttgcaagttgtataattctgaactgccatttgcagcaactaaatttcaagatctaagtactaatgcaggaggtgcccacaagtaagaagaaaataaattattgaactgcccaacgagctcttttcaatattcaaactggcttgacaatttaagtgtaacataaaccttgttttgagcagcagagccagtaaactgaagagccaatgcatcccccatttcctcatagaacagcatcaaggtgcttgacaagggctcttctatatgaatctccaaacccttagtctgcaccaatgccttcagctggcgccccaagccgactagtccatccacaatttgggctctgtttgtgcggtctcggctgtctatgcagttagtcttgagcactcccttttgcagcacaattggcagtatctctattatcccaaatttgggttcattcatgctagtactgctacttgcactggtaacatcgttttgttccctgtaatacatgtcgaaagtagaataagaaaaagaaaacaatactattcaaggtggtatcagtatgcaaaggtgcacaatctaaacatgtagtaatgataaatctagagttctgtatatgccatgttacactacagtacattgctagtgtgtatattgctctgaaatttacctta

SEQ ID NO: 68767 - DNA, 6695 bp, Oryza sativa
ccttctggggatattgtaacttcaacggggcttatcttatgatctctaacgtcgagaaggtatatgtcccaataccctcagaatatggtctgcgggtatcccctgtctaggcttatctttgatgccgaatttcgacaccgtcaaactttcgctccagcttcctgacatcggtgaggtatttggctaactcggggttggagcatttgtagtccttgtgcacttgattggcgaccaactctgagtcccctttcacaattaatcgctttactccgagtgctacggcggctcgtaacccggatggtagcccttcgtactttgcaatgttattggttgctcgaaaattgaggtgtattgcatgtctgaaccgatctccagttagagatgttagaataaatcctgcccctgctctttggctgttgagtgctctatcgaaggtcatttttccatgtctcgttatctgtttgatcagctatactgttatcaggaatagtccagtcggtaacaaaatctgcgagaacctggaacttgatagctgttctcagaacgaagtggacattaaattggctaagcttgatgacccacttggcaatgcgtcctacaacatctttgttcctgaccacctcgcatagggggaaagaagagatgaccgtgactttgtgggcctagaagtagtgaagcggtttccatgatgtcataatcacagcgtagagcagcttctgtatttggggatattgggttttggcgtcgtggaggacctcgctgacatagtatatggggtgttgtactttgtccctctcgacaactatgacggtactaacagaataaggtgtggcggcaatataaaggaatagctcttccactggttgacggacaaccagtacagggggttggacaagtaccgtttgagcgcgataaacgcgttctcgacatcctgcgtccactcaaatttgtcctactttttaaggaaagcgaagaaagacggttctcgttctcccatactggcaacgaatcaacttagtgttgctatgcattttgtcaacttctaaacttctttgagttttgtggatgacttcatgttctcgatggccttgaccttctcaaggtttgcttcaattcctcgtccggagacaagaaaaccaagtaacttccccgatggtactccgaaagtatacttccctgggttcagcttcagtaaccctgacagtattgcatagttgcatggcctatggggcagagcctagctatgggacacacaacctctcctatgactccatgttgttcttcaacatgtgtaccacatagaaagtttgctatgcacctcttgttcatcaatctcaaaacggttttttttatttgtgtcgccacaaaatctcgttgattacagtcgagttttcagccctttgattttgctttagattagtgctgaatattatgtttgtgtatgcgtggttcgcgatccgcgctggctacctgcaatctatcatcgatgtattagtgatcgagagtagattatcgctcaaacatcgaatgagtgagagaaagaaactcaccctaaaactaacactacagacctatatgtgcacatcttttctatcaggtaatgtgttaattaagtgtaattattagagatgactaacgaagttaattactaggggcgaatctaccgttggggctagttgggggcttggggcttaagccccagctccattcacattaatgcccaatgtatttctctactccagggttagttaattaggcaaatctcatcaaagaagggtatgaagtagaaagggcatggatgcagcgggaggattgagaagatcctgacgccgtcttgggcattgatatgtcctctagtcagctaacagtagtttgggtcaggtgagaaaacacacggccgatggcaacatactagagcctcgtagatttgttacattttcacagtgcagtttgttttctttcgttttaggtacaagtttgatgttttgattggtgatagactggtagatatgtttgtagtagtttttcataagccccaccttaattttcattagattcgccactgttaattacaccccacttacatctcatttacacatcacttacacatgtaattactatataatcttgggacttacaatgtaaatacatgttgactatgtttttagtgaaaaatataacgccataaatatagctacttccattccaaaatacggtactgcaaagaatatgtatcccctaacccttcactaagaggaacaaaaaaccataactcctgacccctcttcctccttttaagggactatttggtatggctctatcttctatatcccagtttcaaactccaattttagtgaaagctagcttatataggaggtgaagattgtttctaaagtgtttggctaacttggtcagcttccaaaagacctgaaagagaagatagagaggagatggataatcctaccttgtttttctgtttatttaatgtacgattaataattattatttttccttaataattggacgtgtcaatagttgtaaggaggaattaattcataccatccatcccaaatctaatgcccaactagccaaagtggaccccacaatccataggagaatgtatgcctcgtagcaaatactacgctagatatatttgtcccgcacattacatagttcacgaaaacaaaggaacattaggcatgcatactacaaaatactccctccttcctaaatgtttgacaccgttaacttttttaaacatatttgaccgttcgtcttattcaaaaacttttgtaatatgtgtaaaactatatgtatacataaaaatatatttaacaataaatcaaatgatagaaaaagaattaacaattacttaaatttttttgaataagacgaacagtcaaacatttttaaaaaagtcaacggcatcaaatattttgggatggaggtagtatgtgcgatggaatttaaagatgcattaagctcttctatatagctacatgaaaaaagtgggtgctttcttatgtcaatgaatttgaactggttagtactatccaccatatatgaatgtataaaacatgtcatggtgtaatgctaatgatatatattgtcaactagttggtttttgacaattatatttttctaaaaaaagcgattaatttacatttattaaagcaaatgtacacaaagcattttgagatggaatatactaataatcaaatgacatgtgtcgcataaacccttggaccatgtatcagtgagcgagtagtagcgtaggagtactgtgcatctgcgccgcagaaaatctcgatcggaggttgggttgggccgcctttggacacatcggatcgatcggttccaaaccaaagttccaccgtgaaccacgtccacgcacatcccttcccaattcccatggaccggccgcaccacaccacccccgtacaccgtacaccaatccgactcgtccgcccgcgtcggggccccacctgtcagtgacacgtcccccgcgcccaaaccgctcctctctctacataggtgacccgtacaccgagctcatcacctcttctctctctctctctctctctctctctctctaactcccccgacgagagctcgtcgtcggcggcggcggcggtggcggagagacgcgtagggggggaaccctcggtggcggcggcgggcggggtgggaggacgtgaggtgagccccctcggggcgcgcggagatggggatctcgttcaagctgtccaaggtgggcgtccgggtccaccccgccgcgcgggtggccgccccggcgccggcggcggtcgcggcggagaaggcggccgagaaggaggcgaagcgcgaggtgaggaggagggtttctggttgcttgctcgggtgggttttggtcgatacatggtcggtggaggcgttggggcgccggcgatctgggggctttttgtgggtggaagagttggggggtaaacaaaatttcgaaatttggttggtatctcgtggcgaatttgcgcccatttgggttgtgtgtgattgttgtcgtcgtcgtcgcggaaaggtcgggtttttccggcgatttttgactcgaaacctcgtgcttttggtcccgcgtagaggattttacactccaaattgtggttttttttctcctaccctgaatggattggtttgaaagtgaaattacgcgttagagattgtatctggagtgctctttggttgcgaattggtttaaatttttctcgagttcaaagcagtttgtgagaaaaaaatcgaaatattttcgtgtttcttcggaagcatttacacggaagcttgatctttagggttaatggatttagagggcaatagcatgtcagtgataaggactaaataatccttcttttttgtttactatttttctgtttcatcctagatcctaacattgttgaccatggatatttattggacttgtggtttattatgtagtttgggaggatttggtcttgaaaaaaatgcacaattaagcatgttaaaatcccttctcatttgaatacaaatatgatttcttcccagtttccacattggttagttgtcgtaggatcatataatccatctggtattctggtggatacatctagacctttgaggttaatcattttaagtaatgtgatgatgaaggctaagttctaggtgtgacaccaacacacttaccgttccattttcactgggcagtagacaattcaaaatttgatccctggtgtttccttagctcaacttggcttcctaaaaattaggaaggcctcagtttgtgatatatcttgtttgtttcgaattttgtccggctggagattatttttatggtttttgttttgttgcataattttagtatgcaactttcttgccttaagaatcatttttcctatctaccatgaaatgctgacatgtgctctttatgtaggatggtgttgttgaaagagctagtgatgccaatggcatcacgatttcaccagcatgctctaggataattttgccaggtattgtcaatcaaaaatgtttatccaaaatcattctgtttagctacatttgatactaaatggtcaacattgtgtgcagagcacgaggtttccttcactttcagtctgtatgatagaggctatctcattgcaaagtcagcagcggtgtgttccccaactataattttctgtagtgaattataaaattactatttcatcatatggaggttcaacagaaatatgttattttaatctaaattcctttttattcagatggatccttgccagccatcaatacaggatggaaaaacacttcatccctatgacaaggcgtctgaaaaattgttttctgtaagtatgttgtatttcttttgtagttctacatctggtagcctatgtcagatggtcttttctatttgatcaagattctttcaatggtgggttattggatggaacgctttgaggttgcatgtatgagatgtccatgaaatttaaccatgtgattttcaatgtatacgatacatcaatttgcctgcatatttactgattcaccagccttcgctgtcttattgttactgatgaaagaggagaatagattaatatcatgagtatttgtacataaatggcgtgggcagaaacaatttgaaagacaataacctttatttagttttcttgataatgcaacactttacttttctatctaatgcagacattaatctagtaattgttatcttatcgctttttccaacgatacacctatactgtatgtgatcatgcattttcattgaataatgcatgactgctttaagcatgattttgtgcataagctttgagtagcttcaacttgccaatccaagctctagcttagaagcttgcccaggcttggacaaatttcttgttgagtttataatcgatgtcattgagtaaacttgaaagctaagttttattcatccatttatactgcttcttggttcaataccatgtgtctttacagttatggatttcagtaaattaatctattcttctacctttcaaaccagaatgtattaatgtaagaacaaatcacatatcccaatataaacttgtgttagatgctgtgattatggatttttacgaacttttattttagctgattatcgtcatattaattggcaatttgtgtcagtgtttctcaacaatgggttcgtggacaaaataacagcaatgctacttgttttgttctaatggattgatcaattttctcctttttgcttgctaaaatcactggaaacagttatgccatgttgatcacgattaatgccaatacattttaataagccgttttgcttcatcacctgcaggcaattgaatctgggagactgcctgaagatatacttgatgagataccaagcaagtactacaatggatcagtcatctgtgaggttggttattttatcagacttgaggcatgatatgtaattaatgtatgtaaggcaaaggattgttgaaaaatcttatcacaagccttatactgatttattttgctttatgttctatattcccagttacagctagtatatattttcctatatgatagagataataaattttgtctagaagattgcatacccttttcacaggccaatttaccatagaagttatgtatctaatggcaattactaaaacaactattctgtaataattaagtggtccttatgctacataatg

SEQ ID NO: 68768 - DNA, 1449 bp, Oryza sativa
tattttgtgtcgaacataataccctatatgttttatcaaacttaaagaagtttgtctaaaaaaaattaaacacttataatatgaaacataatgagtatatctctatatgatgaaaaacattatatatatatatatatatatatatatatatatatatatatatatatatattgtcggtgacataggatcgagggtatcatgactagagaattgggcagccgcggtcacccacgtggcccgacccccccgagggtgacgtggccacccctccctctgtctccccgaggggtcgggccgctcccgttttggccccgagggctggggtgccccgaccccttgtgattttggcaccacgtgtatgggttaggtgagcacaagcggggctcacctaaccgcatttatcgcgggttggacgagcgcgccacgccacatttaatgcagcatagcgcatgcttatccggtccgtgatcggtcgcagtgtgtgaccggtcacagaccggtcagatcgcgggttagggggcaacaggcggactgacacacgcctcgccccgtcccgtcggaatgatgagagcctgcacgcactcatgactagccggagccggcgtgggaactcctaaagttggcacgtcagccccggccagatacattccaggcttcatcgtaaccattgcaaggaagtcattgtatgaataagggcagacgtgtagcatgctaaactgacacgtggtggacaagaatgaccggtctgtgactggtctgacgccggtcgcgtcatcggcagacaaccgtgctcccacgatgcatctgcctccggtggagtggaggtaggtatgacccatctcgtcggatggtcatttggatagcagccatggcaaatctccgcccattaatgagggagtaacagggagatccccggtgtcaggcgagtgatgacgctgggcctcactcaaagataagctgtgatttagcttccaggcgaaggcgcaagccagttttttcttttttgggaagatagggtgagtccccacccaaaagaagagtaagtagaagtggtgcatgtgggatccccttgagatataaaaggaggaccttgcccaccgaagggagcgggggaaaaagggaagagaaaggactctagaggggttctggagcctgaactctcttgctctccggctttctgtaactccttcacacacagatccaccagaacacaggagtagggtattacgcttctcagcggcccgaacctgtctacatcgcccgtgtctcgtgcacttgctctctcgcgaacattccccagatcgatcgaggacgaagaacctcacttagcgcccccggccgaaccggcaaaggggggcctacgcggtctcccggtgaggagtcccacgctccttcatatatatatatatatatatatatatatatatagagagagagagagtactttta

SEQ ID NO: 68769 - DNA, 876 bp, Oryza sativa
tatgtagtcagctcagcacaaggtaaaaataattaacaagacgagatcccctggtcgatcctggtcaggttgcattgaggaatcaagctagcatgcaggcatgtgcggttggtgttttgtgatggtgtaggtgctgtgcgataatcatctatataaatcagagcgaaattactctctgctaccgatagaaagtacgtacgtactgtagcggagcttatataattaagctcacatattgtacaagaagcttgactaaagatgtaattaatgaagcgtgttcagttcatatatagatgcatggtcatgtcgttggtttgcacaaggttaattaagctgtatcccgtataccttacatagatgaaatgagccattaagagagaaagaaaactagttgatgctaataatatgaaggaacacgcaactagcagtatgatttcatcaagctagggctgcataagcattgttaagctcgcaagtgggaagaagaagaagaagaagaagaagaagaagaagaagaagaagccatgaattaagtaggtgaggtaggtaggtgaagctagctagcttttgtttggagtggaagatatattgtggaagtgcagcagcacgggggtgttgcacctggggcatctgggctgctttgtgttggacacggccagcatcacgtacatgaggcaccgtgggcacccagccaccaccatcgccgccgccgccgcctgctgatcttccgcctccgacgacacgcacgaccttgccggcgactccatggcttaattcccacctgcactgcaccacaagcttactcgatcgatcgatcgatctgtgtcttaattctagctagtgtggtggcctcgctgatctcataagctagcacta

SEQ ID NO: 68770 - DNA, 4101 bp, Oryza sativa
attacgcgttctattcatagtcaaatttgttatttttgtttctacttgtataagttgaatttgaatttacaagtttgtgaagtgacatatcacatattgatctatcttactaaatttttttgtgactttttaagtgacatgcaaaaataagtggatatccccttaaggaatgaattgagttttcccatatactataagagtattttcttagtaacatgcgcattaatttgttcaccatacgtattagcgattccgtttcttttctcggttactttcaggttttatacaaaatgtacatctcattaaccatacataggtggtgtttgaatctcctaaaaataaagatgaagataaaaattaagtgtttcacgtgaaacgaggtggtaataacgtgtgattaattgagttttaattattacaaacttaaaaaatagattaatctaacattttagagcaactttcatataaaaagtttttgcacgaaacgcaccgtttagcagtttaaaaagcgtgccacgagtatttaaaatttcatcttcgtcttgttggagaaacggacaagacctatgatataagtactcttgagaaatctaggttgcaactaacattaatgttgtattgcgcaaggacattatatatagtaatccaacgtgggtgctggggggactcgtccccttacaccgtgagatcaccattgatagagataaaaggggaagaagagtgagaaaatgaagagtaggggactaaagaaggaagaaataaatgtctcaacttcaatctggttctggatccgcctaatagtagtggattcgtctagcaagaaaagcttcagcttggacatatatacgtacgtacagaggcgcccggcgtacaatttaaagcaaatcagtctgtattacgtatatattaatatttggttgaggctgttgtactgctatatatatatatattccaaacgcttaaatgaggaaacatacggttatcacccatttttccaataatagtttatcacctaattcctgattgaactagatcttaaatatatagtttagtgagcaaccgccaagtgatagctagtaggtcaggtttaatttgcaggtttttttgcacatcaggcggctaggaagaaacgggccgccggattatattatattgttgcacttaatttgtatgttctcaatgcaaggctttattattttggtaggaacgaagtatcaatgttcggcattgataagcaacaatatatatattatatagcatatagcttagtggttacaatgacctgagtagtacctcaaggttctgagtgcaaatctcatatagagcgaatttcagattgtgttgtttgcggagctaagttccctatttcaatggccgtatatatccggttggatgtagaggccgggtaaaaaaatatccttctctaaaaaaaagcaacaaggctagaaccaactaactaggtttatgtaatcagaagcaaccttcaatgagctacagattttcttgaaaagtaataaacattacattaataaaagtatttttcttcttcatcataaaagatgcataagaaaacgaagttaggaatagatctctccatttcgttgaacaaaaataaaggaaggaaaattaagtcagtaagatatctgaaggtgtgtgtaccctgtttgagtagaaaactccaataatgcgatgtgccaccagaccagagtgaacaagtccaaaaacactttgagcatattattcagaatccatccatcttctttagtatatatattctccaaagaattgaatttgtggtgcactgcaaagacttcaatccagcgtgtgaagatgataacttaaagaagcaattcatttcgaccaagaaagggaaggcacagatatacagaaccctgaaacataggaatcgatattcatatattgtcactgaatcagcagcagcagttgattttggttgagccagaaacactagggtaatattctgagtactcgtcaaggagtagaaatccagatatccagtagtgggatacttaactcataactctgagaagatgttgatcgatttcagcagtgtattcaggcgatcgatcgaactaatcaattaatcgaggggaggccgggagcgactgtcgatctgtctctgtgtttaggcatttaattaggactaaggctgcgttgtcttcttgaaacggctaattagtcacacgtaaaacgataacgtgattcacatataattaattaattaattaagtagtaatatataaagttttgatgaataaatttattagattttttaaaacaacttatgtataaaaagttttcatgtaaaatgtaccgtttaatagttactgctagagagctgatctttgtttggatggcaaaaatcatatttgtcccaattcgaatgggaaccgagactaaaaatcacggttcaaaatagctgtcaggccatgtcaaacccccaactatctttagtcccacattccacatatttttttagtcccatcaacccagactaaagatgtctccagggttagtttaaaaaagaaaacatctctatttaagtcatatgtgtgtagtaggtgggatgataacatgcgtgagagctgaggtgagagattgagttcgaatcccacatcccacacattttttttttgacttggtatgcatctttagtccggttatttcaaccgggaccggattgtgcatcctggttacacaaccgggactataaacggttgcgaaccagggctaaagtccctttctccagcagcgagtttgaaaagcgtactaatgaaaatcgagaagtagctaagctgaaatagctgaaaagtatgaaacctagggcatgcactagggtaactctattcactgcttacatgttttgcaaacgtagtaccattgtgttgccttgtagctactctctgacactctatctctccatatcgtcactagattatcgtggtgacccaatgtttgttgtttatagaaaaataattaggaaaaagtatatataaccattattggggttggtatacttaaccccatgagtatggaaaccggatcaaataacctcctagagtggttttataggtagttttagtatgtaggtggtgacgtggtatttattttgctttcatggcacaaatattagtcaattaaatttaagttggcccaccaacttcttctcattgattgacatggataaaagtttcatagtagtaccaataatgtatattattatcaagccactttcacttgtgaaaaataattacttaagcgattctctatggttatatccattaccctccgtttcacgtggccaaaaccatcgccacatcatcgcgtacatagggaaaaccacattatgggttatttaaaccggtttttatattttaagggtaaaacatatggtttcatttaaataaaagaaagtattggttccataattagcgaggttaagtaaaccaatctgaatacttaaggagactttttttttcaaaatgattaacatataaaaaacaaactgttttaatttaatattatagacgttaattatattattgtaagagcaattccaaagaaaaacatgttttgaaatgagaggaggaaagaagaagaagaagaagaaagactagtgcaatctagaagccttccaacggggaggagagagagggtaatccggggagtaggactagactactactagtacatgagatcgatcgatcgatcggcatctgcatctccgcccccgcccccgtggatctgaagcggcggaagagggatgtcgtcgtcgtctccctccggccacctgctcgcctctgtctcctccgccctcgccgtcctcctcctcctcctcgcctgcgtcgagctcggcgacgctgctgccgccgtcggagtctaccgcctcatccagtacgacctcgccggcgcccctctcggctcccgcgccgccgccctcaaccaccacgccgccgccctccctctccccgccgccgccgacctctcccgctccgccctcgtcgcgccgctcctcgatctcccgctcgccttcctccgcggtacatccctctcctctcctctctcttcttcaattaataa

SEQ ID NO: 68771 - DNA, 13453 bp, Oryza sativa
  unsure (1)..(13453): unsure at all n locations
accatttcaaatatccaggtaccctcctcgtaccattagtttacagtttggttcagtgtttattgtttgatttttgtctacgttatactttaatgtattgatccttttctctttcggagatgactggataaaccatggccctgtggctatttgttggaagtgattgttccagctgatattttactaaagtaatactgtttatctgtgagaacgaacatacctgagatgaatactttgatctgaagggatggttacctggattgaaaggagagggtgaaactgaacaacttccaactattgccattgtttcaaattatgatactttcggtgctgcaccagtacgtcttcgtgaaaaatgtttctagtgccttctttaatattcttctagatattttgcataaatgcatattttctcaggcactttctgtgggaagcgacagcaacgggagtggagctgtggctcttctagagattgcaagactgttttcacgcctctattcaaatcctaagaccagaggcaagtacaaccttctgtttggcttaacatctggtggaccctacaattacaatggaactaacaaggttagttattctcttcagttttttttttaaaaaaatctgctttgtggcatctgtttttatcaactcatggctgtatcttttttgaattttggtacagtggcttagaagtttcgatcagcgtgtgcgtgagagcattgactatgcaatttgcttgaacagcgttggttcctgggacaatgaactctggatgcatgtgtcaaagccaccagaaaacccctacattaaacaaatctttgaagtatgttgaccatttcaagcatgttggtgcataacagttattagttgtcaagggcagtcacttttacacctctgaattcttttgctttcaggatttctctgatgtctctaaagagatgggtgtttcagttggaatcaagcacaagaagattaatgtctcaaatcctagggtatgcacttgtcacctttttaaagagtatatattaccattagttctgattaggaatggacatggtgatggtacccacataatatatttatgatccttatagattttactacattcaatgcaatgtgttacatgtctatctgttggactctgttgtcaacacggcactgtaatatgtaccagaagtattatcaattgttgatgatgttaaatactgtacatattgcttttaattgtcatgtaggctagtattggactgttcatcatagtttttcttactcaaatggaactgaatgatggatgaaaaccttgtggaggtgcatacaaaagaaacagaatttttccacgagaacttttgtgaaagctcatcgtcttaaatcaaatttgactcagaaaagattgccacaagagagacctcattaaaagaaaaatgtattctaagggcccctgtgaattttttatttcttcctgcagtgccattacatggttttatttgtttggccctcatattagcttcccttgttcgactgtctgaatggttcttagttcatatgtcctaagtatgcgtaattaaatatttattctgcccattgttttctcaacccactgatttgtaacagcagaactttactaacttgcctgtttcatgaccatcacaatcctcacaaccactattgcatttatgcatcatactgtgcaatcttcagcacatagtatgtaccaacatactaatttagtttgcaactttgcatatcttctgctggatgatttgctccttttagcatagtagtagcatggcatggaataaaaaaaatgcatgatcaagaattaactggtaattggcataagggccagtttataaattagttccaaacaagataatatcactggatgttatccttgtttactacctaccaattttgaagatgtaattttggaactgtattatttggactgttcaggggtcctattatatttagtcttatgtttgtagcttgccaagtaacatgctttcaaaacttccaggttgcgtgggaacatgagcagttctcaagatttagggtgactgcactaacactttcggaattgtcctctcctcctgactttttagaaagcaccggtggcctttatgacactaggtaaagcacttataatgttttccttttacatcattaatttatgtgtccattttttctaaccttttgtttgtatttgacttttcactgcagagaatcagcagatgctgagtcagtaattagaactgtcagattagtttctgaaagtcttgcggtaagctaaatcattgcttgtagaagttcttcattttgctttatacactagttcattgatgatgtttgttttattatttgttctaacatgccccccttgggtcagtctattatatacagctgaaataattttagagaatgtaggttatttcagtattgtatatttacatttattattgttttctggatgatctgtactgtttgcgggtttctgctgtgtaagaatttgcaaagctgatcagtggttacttgttttagattctagttgttgcttgaacctggtaagtgcttttattctgattaaagaataatttgactgtccctgtggtatgtagggtagagtgttcaactgatttcccactttgcataaaacttactgtgtagctttgtaaaatgtcaatggagaacctcacgtggttatgatggtgcatcagttttacatgcatattacaatgcttttctgttcacgctatttaggttgcattcttaaatgtgataaacacagggcatcgtggcttcaaaatagctactatgattaatgagtgatattaaagctgactagttgcctctttgcctttctgaactgaagttgaccagttcttatatactaattccatttacagagacacatctatggactaaaaggaaagaatattgatgtttttgcggagaacagcagtttagccatcaaccctcactacatccagtcctggttggatcttttatcacgaacaccacgggttgcaccgtttcttcagaagaacgatccctttatagcagccctaaagaaggttcgtttgccttctatcaaatagagtattcatctagttcacctagttcgtagttttcttgcaaaccatgacatttcatgccctgttgcaggaactatctgagcacactgctgatgtccacgttcaaagcgatgttcttgatggcatgttcactttctatgatgcaacaaaggcaactctaaatgtatatcaggtaagtgtttaggctttgtgtcatttgttcacgtttgagtagaacaattaaaccttgcagcagaatggtctaatatgcttattgtgaagagcatatgccctgctttgtgattccttatttttatgctcgtccgtctcaaaatatagctacttatgcctcttttttggagggattaaggctgagattggaaatggttgtgattggttaagatgagaaagtaggtgaagaattaaatcagggatagttgtgattggttgagatggggaattaggtcgagaagtacattatgagaaatttgaatgctagatgtagctatatattgagacagagggagtattataatattctgctcatgtattctgttatgaattgcttaacagcaacaaagaattcattttaaatggacttatgcaagatatgaacacattgaaatattctcatacattcttcgaattattaattcacaggttgcaagtgttacttttgatttactgttccttctggtgattggctcctacctaattattctcttcagtttcctagtaatcactacacgggtatgtatcatttcaagccttcaaatataagacaggaagctttgtttttcctgcagttgagaacttattttttttaatcagggtcttgatgatctcatcaacatattccggcgaccaccatcacgcaaggtcaagggggcataatagaatagattgtgctttgtgtattagtatccaggaacgcgctgctagttagaagagctagacaccaggacgacaggcgagacgacccagctctccacagcaaacagacttgtaatttcaaaattttcatgttcgatagccaatgtgagtggcttcagatactgcaaggcagaaacatcacgaattttgactgatgaagctgcattttgttttatgttatttttgctggtgctcgccattttggctaccatggaatcaaagggcctcttttgcagaattatcgatcctgtcagcaggggcgggctcaagatttagaggttgggtattcgaaataggtaaggggtaaaacaaatttacacccaaaagtctaataattggtttgtgtaatatcatatacaagtaatatattatatgcatgtagcccaaaattatatacttaaagttaattaaaaatttttaagtgttagcaagaccatgtgtgatagtgtatgactgctgcactgctacctgcttgttttgggctgtttacctgccggttctggattgtttaggggaataagttcatccaaggtcccttaacttgtcaacgaattcgattttcatccttcaatcacaaagccagatacaacgggtctctcaactatcaaaaccggtgcaatataagtcccatggtggtttgggtggcggttttggcttacgtggcgtctacgtggctaaattgatccggtcttcatctgatgtggcattgacgtggcaatttgatttggaaattaataaaaagagtgaccccacatgtcagctacaccaaaagaattaattaaaaatggtggggcccacgtgggctccacttgtcattcgctcccctaatcttcttcctcctctctctccccatctcccctctcctctctccaggagctggcggttcggcgacgcggccggccagcgaaagcggagccagggatgacctcggagacgaggacgccggggagctgcgcctggacggggacgccgacggtgattgttgttactggactcagagttggtgttgttgttgttgagctcaccgtggtaggagctgagagggggagagggagagatggggcggccgctgtgctgcgagaaggcaaacgtgaagaaggggccatggacggcggaggaggacgcgcgccaagctgctagcgtacacctccacccatggcaccagcaactggacctccattcctcagcgagcaggtcgtgaaaatcaatgatatcgccgttgctgctgatgggatcgagcttgaggtgcatttgatcatatcagatcagatcaaaatatggtgtttttgtttatctcttcttttgccctttcggcgatgcggcgtcaagggaggttcggtcgcctccgccacttcccgcggcatccacatctccaagttctccgtcggctttccccgacgacgaaccggactccggcttctcgcccgacgacccggacctcttgcgcaaccgccccgtccccgaccggctcctcgtcgtctccgccggcgtcgccgccaacctcctcttcgccttcctcatcgtctacacccaggcgctcaccgtcggcatccctgtccaggcgcagctccccggcgtcctcgtctccgaggtcatccctggctccgtcgccgccagccggccggccgcgtcgccgaaccgccagctcctggagagaggagaggggagatggggagagaggaggaagaagatgaggagagtgaatgacaagtggggcccatgtggaccacaccatttttaattaattcttttggtgtagcttgaacgcgtagagatgtagcctagaggggggtgaataggctttcctgaaattttctcaacaatcgcagcggttaaattaatagggcccggaacctcctggtgaagaacaccggaacttcctggcagtgatgagcagcccggaacttccggagttcttgggccaggaacttccgggcaacagagaaaattgaaatcggggacataaaacaggtcctagctagagacaatcaggcacaaggtagcacaagatgtaaatcacaagataccagcagattcaaacacagatcatgcacaagtgagacaaaggcgattttttcccgaagttcggatcacacggatcctactctcagttgaggtgctcaaagagccgggtctcgattaaccccttgcctcacttatgcaaagatcccagaagaagtccacagccttcaacttaacacttctaggtcattttctagaattgagtgaccaccaagatccaactcacaattccttctagaaaagaccacaagtgcaagttgctctacctaggacaacctctgaaaactcagcacaagaatctttactcacttacctcgtttccttgcggaggtgaggaaaaccttcacaaactttcccgggacatctacaagatctttggaaactcacgggcgacacctaaccgtctaggagaagatctccaagagtaataagcccaagtgacagcccacaaggtatccaaagtgctcaaacgaacctaatcttcaatctatctccaaaacactcctacactctaatctaatctctcaatctcacaagataggctctagatttgagtggaggaagcaaaggaagcttgggagtggctagaaaaccctagaacatgaaagagctgaagtggaatggccaaagggtgacctggggacgaaatccatatatataacggctaggtgacgtcatctagccgttactcacaagtttgaactggaaacctgccaggaggttccgggcaaaagtgccaggaacttccgggcagcacttaggaaaaatctagctaaacttcggtgcccggaagttccggccagaacctccgggtagccctctctgtcccggggagaaagtaaactttggtgttcggaggttccggccagaacctccgggtaggcctctctgtcccggggaaaaacatttccaaaaaaatgattccaaaaacctttagactcatggatatgactcagagcactttgaataccctagaaccacacttgaaacccctctttatagtacggtttttcctaaactcaatttcgaaagtgaaagacctagtctaatcaccttcagtgtttttcgcacttaggaacattcaaattggggggcctccttgcattcttagccatcacaacttgctttgagactaaactcatgttaataaacttgataaacacgttagtcctctttaaccaccttgtcattaatcaccaaaacccactagggggtttaagtgcaccttcatagctgacatgtggggtcactctttttattaatttccaaatcaaattgccacgtcaatgccacatctatgccacgtcagatgaaaataggtcaatttagacacgtaggtgccacgtaagccaaaaccgccttccaaaccgccatgggacctatattgcaccggttttgatagttgagggacccgttgtatctggttttgtggttaagggatgaaaattggattcgttgacaagttaagggaccttggatgaacttattccttgtttaggctagtgaattgggccaggaaagcagggaggaggcaggcaggcccaagcagtgaagaagatgaactgaatatggcatttttttcattttcttcatacacatatacatagtacatactatatatacatattcttttgtcaaaaatcttgggtattcatctgaatacccttgaattgaagtgggcccgcccctgcctgtcagtgtgtgtgagacgggtaaagaagcacgatgtaattctcgcatcacgactttactttcccagtggaaaacaatgtctttataaataaatatgcggaaggcaaaagtgcatgttttcatatgcttacacacaataataacttgctgctgttggtcgtcaaaccccccatgccttcagttgcatatatattaccgtacgtacttgtgtaatatatatgtgcaagatgtttgatctgtagcaattttaccattgtattgctgggtgtttgtttcccttggtaaggtgtgagatggtaaaatatgacgtgcagtgaagtaagctattgttggcaaggtttgctcaatacggtatttgcagttgaggcatcaacaatcttcctaccgatcccgtttccgattaatatttccttccaattaataccgatgatcttcgattgtttccaattaatactcgtccaaaatattaggcccaaaatcttcttatatactatccaacaagaggatattatattactccaccattttgaaacccaattgagaataaatttgcagtagggactacacttactatgaaaacggatggggtgtcttttggtccaaattggagcnnnnnnnnnnnnnnnnnnnnnnnnnnnnnnnnnnncaatttttcacagcgctccgcactatcctcctcagttttggttgaatcgatctgagctgtttggttgggtttcagtttatccaagacactgggtcagttttgttctagccacactttgtcaccatttgccaataaatgttgttacacttgccaaagttgaggcgcctaagagaatcttgctacatttttatgagccaatgatgcgtgggacctaatttgttataaaagacccttgccacaatgtggttacaaatcaaacagctattaacgtgatcaaacatgcctaatcttggaggtggcaaattatggtaaaatgtggctagcaaccaaataccttgtaaatgttgagttgttctgtggtgaaaatattttttattaccgatgatgtatataatatagagtatgctcaaggaaaatgtcattcagtttaaaaaaagaagcaaagcattggaaggttgaaaatacaaattcattgatcattggtaaacaatatgtaggccagtaaaagagcactagagattagattaggattagagagggatgagcatgccatccatccatacatacatgcataaaaagaagaaagagtgtttgtttgtttgttgaaaaacaagaggataagcaagccatccatggccacccaaaatagttgtaacgcacacccagcccaatgggtccggtgatctgaattaaggaggtgtgttgtgtgcaccacagaacattgtcatgcagatgcagaggtagaggcagatgcagatgcaggcggcgcggccccgcgttggtgtccgtcctcgcggtggcattcggccgtttccactgcccaccttgagcttcaacaacaactccaacaggagtgcgtgtgcgtgtgcgtgtgcggtgtcggtgtcggactctgagcttgcggcgcgcgggttcgcggtgcggcgcagctcgacggggctggacgtgggggcgctgaacgaggtgttcgcgcgggtggggttcccgcggcggcaggaggagcggctgcggcgagcgctggagcacagcgaggtggtgtggctggaggactcggcgtcgtcgtcggcggggcggccggtggcgttcgcgcgcgcggcgggggacggcgtgttcaacgcggtggtctgggacgtggtggtggagccgtcgtgccagggcctcggcctcggccgcgccgtcatggagcgcctcgtcgccgacctgcgaggcaagggcgtctccaacatcgcgctctacgccgagccccgcgtcgtgggattctaccgcctcctcggcttcgccatggaccccgacgccatcaggggcatggccttctaccgctcaaggcaacaaatacaaaacacctcctcctagctccttttctatcttcttcttctccgatcaatatatccaaaacacatattggattgcatattaatttgcatgtgtatgtatgtatattcaagctgattattattgtctagacacacacacacacatgcagagtgaaatcaactcatcaaatacatatgtagttgcagctgattgcaaccagtaatccattccattcatcacacttgctaattacacttcattcttgttttacctctctctctctctctctcttgaagaaaagaaaaaaaaacaagaattttctgcttgcttagcttgttgcacattgcagaagaatacatacacatatatagtataatgcacacaaggaaggaactaaaacaggacacatgcagcacataccggagggaacagagaaatgcaatcaaaccaccaaatcaaatcaaacttgacgcttttgctctgcttgctggagctcgtcattggatcgcgcggatgaagaagctagaatatgatgtattatgaggcggtgtggtgggtgcggcggggcatggtgaaggcggccatgacgatgaggaccatgaggacgaagacggcgaggaaggaggcgatgacggcgccgctggtgcgctggcagaagccgtggaattgcaagcatatgggcacccagttggcgcgcaggttgccctcgtgcgccacgtacaccatcgccgccgccgcagacgctgccgccgtcagtaaacccaccatgatggtgtcgcagatgagcagcagaagcttgacaccggtggccttggagctcatgatggtggcggcggagaagggcagcgacagtaccatgtaccccgccgcgatcgcattcgccacaatgaagaacctgcatatatattttttcatttcattgattgatttattacagaataatagtaataagcttagtagctcaaatatatatgatgattactcgaaagccgggaagtcgtcgaatctggcgcggaactggaagtagttggtgaagacggagagcctctcgtcggaggtgccgatggagatggcggcggccagcgtggggccgaaggcagccaccctcagcacaaagtctatcagacccaagcaccgccggaggccgtcgccaccgctgccgccgctgcgcagcaggaacggcacgtcgctgctaccactgccagccttgcgatgcccctggaaaggcgccggcgccggcgccggggcaccagcaccgtcgtatgacgatgaagccttgccgtgcccgtgcccgtgctcgtcgacgtggacgctgcccgaggtgtcgctcccgctcatgctgcctgcttaatcaataatctcttctgctttcttaatttactactgctactatttgatcgatctatattatcttggtgttggcaatctatccccctatgtatgaaggtatatatagagtgccctctgctatatatacatattactctatttgcagaggagttgtagtagttgtttgggtcatcaaatcatactactaactgcttaataatcaaatattatcattgacctgagatctttgctggttgtatatatatgtaaggactcagcctaaatgatgagtttcaattcatatatgtgagtgaagaaaagaagttgagagttgctgttgcggatgaagtttgctagctccattacattcaatccactatacattggagcagttgtttcattgcattagctgcctgtttgtgcctcctttctttctaactgctcactcactcactcactctgccatttgcaatccatcatgcatgctgcaccattttgctttctacctgatcgatcaatgtaatgtactaccaactccctgcactaattatagacttctccgacgttacccaaaaatgtcctcccaagtcccaagtttcagttctgtattgtatttcttcagcattctcaaactatcagagattcagagacggcactccaacccattacctgaacatcaataaaatccgtcacgccagctgatccccgggagctacaaattaatcatttcatcacactccatgtagtaattcaacacttcactttgggcagatttaatttccctttcttccaaaaattgatttatcgggataacgacattactcataaaccatatttgtatattctcttcggaatattacatgacattcgctttatttaaggaaacggcacccaacagcactcataccagtggcacaagacaaacccccagctcatcatcaggcaaaaccatccaattcatgtgcaagcacaacggtacagaaaagtcttagccaacaccgggaaaatgatttcatctctcgagaagatatacactcgttttgtatatgccatctaaataatcaattaaaaatatgaaaaaaaattagtaatatagattaatatgaaatatatcacttcacaaatatacaagtttaaatttaatttgtacaagctgtaagaaaaataaaaaatatagttgcgaatgtgcaaaggagctagccagatctcgtactctgctttattggcaaactagctagctattgtactccgctttaatttgttctcctctgtttaattaagtgtgcgcgcctacatgatacaataactgagaatggatattcaatttgtcatgctaaatcaacactagtacagtaacagcacgtggtaatatatcatatttatttatgaaatgaaggaaacaattacagcagcaagcacataattaagaaatatgttattattggttaattgtgcttgtcctccgttatgatcatcttgtcgatgttgctgagcacctcggcatccctgtgggccatgttggtggcgtcatcggcggtgagcggcggcggtggaatggtgcagggctggtagtcggccacgtactgctccctggactgcatcatgaagtcgcggtcgcggcctcggcgggggcacgccatggactccgggcacagctccacggcgcggtccggcacggtgggcttgtagcggagcagcgaggcgtagcgcgtgagcacgtgcagcatgtagtcgtagacgtagtccatggccatgtcgtccgtggcgaaggcgctgccggcgaggcccatgcgctgcgcctgcgccgggtgggcgttgccccatcgcacggcgaagcggatgtcgcggcacagcttggagcgggaggggtcgatgggccagtagtgcttgccggcggcgaggcctcgggagaagaagtcctggtagggcgtggcgacggcgaggacgggcgagtcgcaggcgaggatgtacttgcggctgacggaccaggagcggccctgcacgtacagcttgtagcggtggcgacactggcgggccaggttggagtcgcggaaggcgttgcggttggcgaagccccagtcctggcggtacaacctgaccgtgtcgtcgggggggagggagtggttgcagcggaggagctcctgccgcagcggcgacacgtccgggttgcccttccagtaggcgtagggctcccttcggctccacggcagccgcgccttctcctccgccatctccgcgagcagcggcgcccatggccggatgttcacctccggccatccccagaaggaccagtccgggaagagcacgtccagggtggaggggtccttgcagtagcggaagaggggcggcgcggcggcccggtcggggtaggcggcggcgcgcacctcgggcatgtcgtcgcagttgaacatgaggtccaggtcggggacgcgccccgggtagcggcgga

SEQ ID NO: 68772 - DNA, 6060 bp, Oryza sativa
  unsure (1)..(6060): unsure at all n locations
cgctccaccgcctcccgactgatgcctgacgccaaccacgccgccaggtccagctctatgtgccggaagtaggacggacagtaatccaccgtcgacgtctgtggtggcggcggcgacatcgatgcaggcgccggcgccggagctgacgccgcatagcgggggcatgtgcccgtgtcattgccgctgccgcaggtgaatggaattggaatggaaacgagactagtgcggtgaggcctgtggcgccgtgcaccgtcaccattgccaaactgcaggaacgacgactgctccatccatccatcatgcatgtacagtacagaaaatgattaaatttattaattaactaatatataatcggtcagatactagctaagtatagatgattaggtaaaataaccagtactactatttattacttaattagtgaggaattaattaatagtagtaaagtctagttgtaattccattgatgcaaattaagcatgacgggcgaccaagactagctagttgtaaggaagagtggttgtaattccattgatgcatgcacgaccaagacgacgaatcgacgagcaacaggtacagctatacatctccatcaaatttattaagttgccgtatggaagccgttgtttgtcgatctccatcggaagcgcacagcttcaaatattgttaaattaaaatcactttaggtcaagatgataatggcctaatgtatgtttattcaaccatcatcgattgtgatggattggacacgtactcactagctcgcttagctatctagttcttcgatcgctcaaagtctgcgagccaaattaaaagtcgaacaagtttttccacatgttgtggcgcttaatttcaacgcgcggttttgttagtaaatgaattattccaacctgagatcgtacagcggtgagtagtaacgtcatgcatccttatatattctatgtacttacaacgtacgcagttgactcaactcaacagctagcctcgaagaacttatatcattcatacacgtatatatatacttaggctaaaaacaaccaaccatatacgcgcattacgtaattattatactacccttaatcttaatttcactataaattctaactaatgaggggttaatttgtcataagtaatgaagtgtctccttttaattttgtatctctaatggaaacatatactcctagctccgtcttaaattataatgcctatatttttttacacgctctttaataacatactttgaccattaatttatttcaatctatgttttcaacaaacatgcaactagcatcacaagaaagtactttaaaatatgaatctagtgatataacgtgcataataattagtatatgtagtacatagttagattattagttaaaagttaccgagtttaatttttcttaaaaataggacgtcctacaattggagtactatttttaatcaataaatatgtgtgttcaaaattaagtaaactacatgcatgcatttatgtactactactgtttttggcgatttatagtgcgttgtgatgcatgatcatctggtttactttccttgtgaaaaaccaaggcgcgcgccgcagaaccatagaaccactagtaatagtaacataattatatgtactagtagtgttttttcactcgttataaatatatctgatgcagtagtcttttgataggattaatatatactccctccgtattttaatatataatacaattaatcttttatcagcgtttaaccattcaatttatttaaaaaaattatgtaattatcattaattttattgtgacttgatttattctttaagcatggtatttttatatttgtaaaaaaaattgaataagataaatgtcaaacattgtttaaaaaatcaacggtgttggacatggagcgagtactactaagcttaatatccccaggagttaatcaactactccagcttagcttaacaaactagctacagtgccgtgtatctcgtgatcaagcactttcgtcgtgaacacggaccatactgcttgcatggctttgcttgctttctattggatctatatatccatctagctatctatattatattaattgatctgtcagtcgtctacaagtacagttataagcccaactatatatgcatgcatatatatatgcatacaaaatacaatttgggtgaaattaattaatttaagatgcatatccattgatcgaagcgtgttgattcaggtgtatacatgtgtaaattaatatagagggtggaaaatggaaatgcgcactaacaagcagcgctagctagtttccgtggatctgtagctagctatatatgatgtggtcatttgttggtggaaagaagaattaagctagtcaacattcaatgcgtgacagcatgagcatgctgtaagttagttaccactagtaattagctagtaatccaggtgctaaaccaaataaaactagctagattgtattgggtacggtgtttgacgtcaaacttggaaattatggccggccggtcggcatgtgttcacaactttaccaaatttcatcgttactaaattttggtagagtaaaaaaactaaatataatcttgatcacaattaattattacataccttatataatataatttggaaagttctttctctcagaagaaaaaactccaccaaaataaatttgttaaccccaatatatgttgaaattttaattgaggctgatttgagcgacaaattaaagtttcgtatatactaatttcaattcatcaactaataaataaatataactcctgggcctgtggtcgtgcgtcgtacgtgcatcgtcgctagctgctagcggtaaaaaaaaacaagtggatcgatcgcatcggagttgaatgaatgaattatataaggtatatgcatgcacgatcgaattgatatattgaagaaagaaatgataattgagcgagggacttgacttacaacggcgccggtgaaatcgacgagttgcggccaggtggtggtggtggtggcggcgacggcggcgagcaaggccagcaggacgaatccgccgacgacgacgacgatacccacgcgacccggcgcccgcactcgcttcttcaccgccgacgacacccacgttgaccaccaattgctgtagccgtagccggcctcctcctcctcctcctccgccgccgccttatttgagtccggctgctgctgctgcttcgtcgtcgtctcgccctcttccgctacctgcaccaaggccacgccttcctcctccgacttcgacttgtgattattgctacttcccctcatgatcgatcgatatattgtatttgatcgatcttaatttggtttaactaactatatattagtaatagtatcccgatcgatacatgcatatctaactatannnnnnnnnnnnnnnnnnnnnnnnnnagatacgtatatatgagatgaccggagaggagaggagatccaagtatatatgcatacatgagtgagctctacatagatagatagatagatagatgatagatagatagatagatcagctgcttctagctgctgctcatctctcgccctctcctagctagctaactccttcgtcttccctctagctagcatatatatatatatatatgacttgagcggctagctagctaattaagctacatctagctatctatctcgtctcttctcttgccatccatcaatatatataatcaggagggagctagcttaattagctctgtttatttatatgtttatatgtggagtagctaggagcgagtcagctatagcttgcgcggtatatatagacaagtctccagtctcagtaataaagtcagtcgtacgtcgtcgtcgcctgcgcagatcgtcgatgtaccaattaggagtactagacaaattaccttctgatgatcgatttccttttttctttcttcaattaattattccattccccttttatcgatggattgaccggctggccataaggaggatgtttcctaacccttagacaaaaccaaatcctattttttccccaatctttttcaacaatactatatatgtacatgtactatatatgtgaagcagtaatccaatattagtattacaatacaagagaagggaaattttaattttgacacagtggccgcccggtttatccattatctttagaaaaatatataaataaggggaaattaaattggcgaattgtttacttatatataacactcaactaattaagcttgcgcaactattagttattgatatctcagtcaaaatccaagtccatcatggtagcatatagttgcaccaatatgcagtgaatattttttttaataacaaatctcaaatataatttgtttgatacttaatttagttcacaggttccgatacaaaaccattgacttacacaatccatacataattctacgctaaacttacacacgtacgatcgaaatataaatggaattgctaaaaagcgtttgacagtttctgtcgtaaaacttttaaatacatatatgtcatcgtcagattgccttgagatttgtgtggcatgcaaggaaaaataataccctcaaaactttagaatttgttaacatcggaggattgccacgacaatcaatttgtgcggcctgcaaggaaaagtgggttgcaagcttagcttgtggcgctaggcacaatgtccacacgtgagtttcgataagttatatacaagttatctataagttacatcctaattacaataaattataatataattatattataattatatcaattataatataactacattctacgaggatgagctgctggtgttcatgatatacagtacgtggttttattttattcttttttttctaaaccaaagccgccatgcagtactgtatatatgtaggaaggttgatttggctcgacggcctggcaatcaatttgactgcagggtcaaattagctcatgtgcttaataatataattatccactcgaccgatcggcaaggttacgcatatgtcacggctgtgttcagcacccttttcccaaccatttccttcgttttccgtgcacacgcttttttaagctgttaaaatatatgttttctaaaaagtttctatataaaagttgcttaaaaaatcaaattaatttatttttaaaaaatagataatacttaattaatcacgcgtaaatagaccgttccgtttttcatgcgtactgttttggttggtaacaagaaattgcgaacacacccaaatacattgtccatattttaatgtatgacgccattaactttttaaccaacgtttaaccatttatcttatttaaaaaatttatataattatcatttattttattgtgacttgatttatcatcaaatattctttaagcataacataaatattttatatttacaaaaaaattgaataacatgaatggtcaaacgttgtttaaaaagtcaacggcgtcatgcattaaaatatggagggagtaatatataaataaccaacgggcttatttaagtttgtccatctatatgatctggcttgctagcttatttatgtgggtttattaactgtattatcttaattatgtattggtttcgcgcaaacggcaaaaggtacggatgttacgttcgaaacacgttgcgtacgtactgtgctatctagctagccaagtactcccacgtactactacatgtgccgatcccgttcatgcatccagctccctcaaattttgacaacttgatcttttaaaaaaaactatttttacaaatgaactaccgccaaaacttattttaaaaccgacccatttgttcaacgccaaatcatgtggcgctgaatttagacacctcaacactaaatagtatggcgctaaatgttcattggcacgctgacttagcctttcatccgtggtagcacggcattcagcgtcaattgacgtggcgttgaagtgtctatgttcagcgctacatgatttgaggctgaaaaaaaggtcattttttaaataagtttttgcgacggttcatttgtaaaattagctttttcaaagggataaattgttaaaatttgtgcatccagctacc

SEQ ID NO: 68773 - DNA, 7565 bp, Oryza sativa
taacagagcaatatattccagcagatctcttgctagctgacggtttcaaaaggaaaaaagaaacatctaagctactccctctgtcctaaaatttaagtaattttgattagatgagacgtattctaatactacgaagggattcgtaatattaggatgcgtccctttcatccaaatctattatatcttgggacggactgagcagtgaacttatttcgcgacgaaagcttagagaatggacacgtcttgtgcacttaaccctcccgtcatgcctacatatatacgatgaagcaaacaaagaaaagcaaagcaaaagctagtccaatcgatccaattgattgatcgagcgagggactatatatgtcgctataccacgaattaattgaaaggtacgtgttgaaaatcaacattgacagtataattgttgctttgtgtgcaatagcttaattggccaagtattaattaagagtagtattttttttagacagtgtacactatagctagctagtcaattaacacagtctctataaagtgcaactaatttgataagtaactaattactactccacatgatatatgtagactattacaataaattattatcaagcatcttgattatacatataaaatacaattttatttcgtttttatttctaggcaaataaatcgaaattttaatttgctgcatatatactccctccgttttttaatagataacaccgttgactttttcttatatgtttgacaattcgtcttattcaaaaaattttatgcaaatgtataagatataatcacacttaaagtactatgagtgataaaacaactcataacaaaataaattataattatgtaaattttttgaataagacaaatggtcatacggcgtcatctattaaaaaacggagggagtagcatgcaatctatgtttagttataagtagagctagcgtggcgaggatgcggtgcatgcagatagccacagccacaccaacgtatggttgccttcctattcagggaatctagatagatacctcatatagatgtatcacaattcgattagcgttcatttggttcaaaggatataatagggtgtggattggtttgggtcaaacttatttttcagtctgttttgtttgagaaacggtgagatgagtaatccctaacaaggaatattcctaagttagagtttaatatataggctctgtttttttctccaacaaaagttggattaaattttggatacttgtggcacgcttttcaaactgctaaatggtgtgtttcgtgtgaaaactttatatatgaaagttgttctaaaatatcagattaatctatttttcaagtttggaataattaaaactcaattaatcacacgttattacaacctcgttttgcgtgaaatatttaatatttatcttcatcttcatcttcagaatattcaaacaccacctatatattcttttttttcttatagtttatacagatagaaattggaagtagtaaaaaaattgtaacttaaaaaagaatgaacatatcgtattgttgtgtcaattttattaaatatatagtgagagaaaaaacaatatttacatactccctccgtttcaaaatatttgacaccgttgactttttagcacatatttgaccgttcgtcttattcaaaaaattttgtgaaatatgtaaaactatatgtgtacatgaaagtatatttaacaatggatcaaatgatatgaaaagaataaataattacttaaattttttgaataagacgaatggttaaacacgtacttaaaaagttaataatgttaaatattttgaaacggagatagtagtaactttagtaagaaatgactggagatgatcgatcgaggacatatatccgctcgagggctctagggggggaaaaatcattgtcaagagatggccgggggggagcgggtgatatgatatatcgagttgatgtggatggcttggctggctagctgtggctgcggctgcggcatctgcgcgcgcggcggcagggcgtccacgtaattgtaaccgccacccaactaactaaactaaactagtgctttcttttcttttctttctttcttgcagttgagttggggtgctacgcactagctactcaagtgcatgagctagctcaaacaatcgatcgatggcgatgaaggcggtgatcaagggcggcgatggcggaggcgggtgcatggtggtggtggcgcacgtgctagcggtggcggcgacggcgatggtgttggtgtggtgcgttcacttccgcggcggactcgccctgcgctcccacaacaagcagctcatcttcaacacccacccggtgctcatggtgcttggcctcgtcgtcctcgccgccgaggccatcctctcctaccgctccctctccatcatcgtcagcagcagggacgccagaaagaaggtgcacctggggctgcacgccgtggggctcgccctcggcggcgtcggcatctacgcggtgttcaagtaccacgccgaggccgacatccccaacctctactccctccactcctggatcggcatcgccaccatctccctctacgcgctccactggctcctcgccttcctcaccttcttcttccccggcgcctcccacgacaccaggcgctccgccgtcccgtggcacgcgctcctcggcctcctcgtcttcgcgctcgccgtgggcaacgcccagctcggcttcctcgagaagctcaccttcctgcaggccccgccgctgcgcctgtccaggtacggggcggaggcgctactcgtcaacttcacggcgctggtggtcctcctcctcggcgtcgccgtcgtcctcgccaccgccaacgtcgactccactaaatacaccgccatgtaattccattttattatacatatatttcatcatcttttctttattattactctacatataatcgatcgatctagctacacacccgtagtacgcagtgtcgtaccatatatacatgcatcgcgctgagtgtgtgcgcgcgcgcacgtgtcatgtggctttgtgtaattaattaattattattattcctcaattccatcgtgcatctttaattaccatgcatgtatatatatatctggccgagtgtaaatactatgtatgtatgtatgtatgtatgtatgtatgtatgtatgtatgtatgtatggatacacacttacgtactcatctgtaaaatacataatatattgcgtctcatctgtgtacgtatatatagcaaattgtttttgccgtctgctgtatagcttgttatatatcgcgattatactatcataattttaccgtgaaatataggagtatatatatgggcgggccttggctttaatttccttgcttttttatacaaagcaacatatataatataatgttcttttttgttgcacggaaaggatttactggttgggctactataccagcatcagtacgagatgcaaaaataaataaagcaaaaagaaaacgacagcctaatcgagagagatgtatccccaaaagttaaagctaggaaaaaaacagcactttaaatagtcatcaacaaaatattttgttttctacttgaaaacccaaacaattaacctgcataacatgactatgagacacatatgcatgttaatataactaattagtgttatgtccgtgcgttgcaatgggatttttttctacaatgttaatataggttttttttctatatgtttctttttgttgattttcacatgaatacgtactagttattttggtgcggttgtttttagagacagttttttaagtgggaaactatgatgatagagaaagagtttaaaatactgaaaatttgacattctgactattttctaaaacttattttacaaatagccgtagcaaaaactttaactaaaacaacaaacgccctttgtctcagcgccaaacaccttgcgccgagatccaacatcaacattacaactatattgattatttccccaataaacgaagactttttttttaaatattacgtatttaattccatccataaatcgacctcagcgccaggggtattggagttgtgcatccaccgtctatgatatatatttcattatatttatttagtattactctacatataatcgatcgatctatagctacacacccgtagtagtgtcgtaccatatatgcttcgcgctgggtgtgcgcgcgcgtgtgtggctttgtaattaattaattattactcctcaattccatcgtgcatcttataccatgcatgtatatatatatggccgagtgtacatactatatatatatgtacgtacgtacacatctgaaaatacataatatatattgcgtctcatttgtgtatgtttatatacggattaagtatagcaaattgtttttgtcgtctactgtatatctggttatatatcccgattatactatcataattttaccgtgaaatatgggagtatatatatgggccagccttggctttaatttccttgcttttttatacaaaccaacatatatagtccctctgttttatattgtaagtaattctaccatttcctacattcatattattcatatttatattaatgaatcatcaatatgaatgtggaaaacactggaatgacttacattgtgaaacagaagaagtagcgttcttttttgttgcacgtatggaaaaggattctactcgttgggctaccagcatcagcatgaggtgcaaaaataaataaagcaaaaagaaaacgacagcctaatcgagagagatgtatccccaaaagttaaagctgggaaaaaaacagcactttaaatagtcatcaacaaaatattttgttttctatttgaaaacccaaacaattaattaacatgtataacatggctacgagacacatatgcatgttaatataaatagctagtgtcatgtctgtgtccgtgcgttgcaatgtgattggaattatatataggttttttttctatatgtttatttttgttgattttcacatgaatacgtactagttatttttgtggggttgtttttagaggcggtttcttaagtggggaactatgatgatggagaaagagtttaaaatagtgaaaatttgacattctgaccattttctaaaacttattttgcaaatagccgtaccaagaactttaactaaaacgctaagcaccctctttctcagcgccaaacgccttgcaccgagatccaacgtctcagcgctagaggtcttggggcgtagagcatccgccgtctgtttacagacaaaccaatgaccaatcatttcgagtagctcagttgtggtacaatgatttctgtgcttttgatggtccaaaccatccaacatttcccttattttttccacaaactagtacctaaccagaaaaaaaaatataaaaaagccaaaaatgtgtcgctgctgttaagatgcaaactagggttgctagcgctaccgaaggcaagagctaccatcacaccacgttcacttccatgctatataaggcatgttaattctttttaatccgtggatgcatgttagtgccagcgagctcaaaaggtccctgtgttgagaagtttgcccttagcaccaagaagtttagcgctaaaatttggttcattttctaatatagtttttgccatgatctaattataaaataagttttgtaaaatgggtaaaatactaaatgtatggtttaaagtagttgagaaatactgggttttgggtagggtggttttattatgaggcggttttttagtggggacttcgatggcggggaaggatgacgatgactctacttttaaattagtatactagtgttgtgaccatgctatttcactgtaatcaaaacaatgtagaatacataaagcattgatacatgaatagcagatagtggggtcatagcagattctcctgcgaatattgtatagcaagcgatatggcgaacgttatatattccgatagcgaaataagaaaaccactcaattctgcatatttgtgaggtagagtagtgcttaatttacagaaacaatatcatattatagacgacatatgagttatggagataagtaaaaaaatgcggtactcttccttcatgttgaaaataattatctatttagacaaaactaatatcaaactttaaaaacattgactaccaataacttctaaaatatttgtctttataatcatggagaccatataatacacagattaatcttaaaatatacttaagtaaaagcatatatttattgatatttctacatacattacatacattgtagaagatcgcaaaccaaagtcatctgccacattgtcgggagcatacctctcatcaagttatcacatttcatattgtagcctttaacagaaattaggagttaatgcatttttttcaccgtgtacctatccaaaacaacaattatttttaacaattatttttaacctaaaaggattgtattttctataatatgtaccaaataacacctactatttttcacatagcagacgtaatattcctccaccattttagtagcacagcatcaccatggtaatataaaaaccacgatactgctatttagtaccatcatgcatggttataacataggggtgtatggggatagtcatgctatacatataaaaaacttgcttaatactagttaattttctagtattagtataattttttattttagaaaaatagaattgtgataaagggctggtttggtttgtggcctaacttgaccttaccaatttttgtcaataccaaattttagcaagttttagcatatgcaaagttttgtttggattgaagccaaaatagcctaagttaactattaaaatggcctatttttctaggtttggcagaaattgacttcaaaccaaataaacacttaacactattgaaattaccaaatattggtaaggccaatttaggacacaagccaacagctcaaaactcggctggagtgttgggccggcgtgggcttgttatacgtaaccattgttagaaagcgtattttatgggttaaggaggcgcactcgaagaaaggcccctccccccgttttccccttgtctcaaagcgcattttggagattggagtttggagtttggagagagagaaatgcaaatcggaatttgaagtttggagtcaccgccgccgttgaggtccgtcgtctcgtccgagtccggtccgcgcggaagtaggggcggaagtgcgggcgggagatgggggtgaagaacctgtgggacatcctggagtcgtgcaagaagaagctcccgctccaccacctccagtgagtccccgatcgatcgatcgatccgccattaaaattaaaattaatttccggggagggtttgctaatggattgggaaatgaaatggtggaggaaggaacaagaaggtgtgcgtggacctgtcgtgctggctggtccagatgtacagcgccaaccgctcgccggccttcgccaaggacaaggtctacctcaagaacctcttccaccgcatccgcgccctcctcgccctcaactgcaccctcctcttcgtcaccggtaatcccattctccttttctacttt

SEQ ID NO: 68774 - DNA, 6343 bp, Oryza sativa
ttatttatttatttcttttcttctttcaggatggctgtttcacttcagactcggatgcttttctttttggcgctaggactgtttatagagatgttttcataggtgaagctgattgcttattggcttgcatcacaactcatcaacaattttgttgctgcctgctgccttgttctattatcaactagtctttgcttatatatttatctggaaatcctactcatgttctcaatcaaattaggggagggtggctatgtcatttgctatgaaatggaagacatagagaaaactcttggctttggcaggaactcgctggtaagttgcaatgaatttgttctgcccgagtttcaacttatgggatctcttctgaacaaatgttttgactgcttgtgacatatcacaaagatgtaaaataaacttacttaaatatgccccttatgctcctagaaagatcacttagacttttgtcagttaatggcttaacacggtcaaagcaactaatagataaagacctttaagagtagactgcactgcaggcacaacagcttagtaagtgaatgcaatgtgctgatttaaaacaagaacttgcaagttgtatgcatagagcaacaccattttctcaactctgatatcacaagaaaatgtctcagcgcactcttaaaaatcctttgggtaattatcatgtattagtcagagattacgggatgttgcatgtaattgctgatgacttgtatgacaatatgatgcaataacaatattacatctcccaccaatgacttttttttgggcttctgattctcaggattttttttttgtgtgataatgcgtaaattcttattgtcctgacttgacaacctttccagatatcacttgcagtgctccttggtagtgattattctaatggagttaatgggtttggcccagtaagtacaaaaaaaactgtcattttcattgtcttagtataacatgcatctgttcttatatgtttctatatgaaatctgacactcgacgacaagatgggaatcatggagcttatcattatatttgtaatggtgctcttttaatgttccaggaaacagcatgccggcttgttaagtctgtaggcgacaatttaattcttgatcagattttgtctaatggagttaaagctactagaaaatgtaaagggaaaaatagtggaaacaaggtggacgacatgtgccccaaagcaagttcctgcggtaagcagactctgtggtgcttttctctaaaatttaagtaattagctatgccataaacatgttgtggacagggaatacgcaacatcatttatgtaatatccttgttttacagaggttggcatgactcaagactctgatggtcaatttcgtgacgtcataaatgcatatctggagccaaaatgtcactcacctgattcggaagctgtgcagaggtaaaagagttagtggaaaactacttcgctgtatagtttatttgtctcggattttgaggttcagccccaattgctgatatgatactttgctttcagtatgtgttcacctttttatatttttcttgtcatttttgggtgattctgtggaaaattgatcagggtgttaaagataggggttgcttaaattgcttttctgaaggttcgtttgttctatctccatagggtatgcggacagcacccatttcttcggccacagcttcaaaaaatatgcgaggaatattttgattggagtccagagaaaactggtactctctgaagtcctcgactgttatgatgattagcattattagtatgtgcaagaggaaggcagtaacatgttttaataggtatggatcctgacttgttttcttctgtatgtctgcagatcaatatatacttccgaagattgctgagagagaacttcggaggttttcagaccttcgctctgcgtcttcagcactaggaataaaacctttgttgagtgaggtaaaaactttggtctgtctgaagcaaacgttttacatgtacctttctcaagtctaagtatctaatttacagataccagtaccatgccctgtactggcgattgtgaagcagaggaaagttcatgggaatgaatgttatgaggtttcatggagaaatatagaagggctccaagtttcagtagtccctggggatcttgttaaaaggtagtaacactgtaacagtcctctcttatccggcaatagcaacagtgattgtgtgctgctggcacatttttctgaatattgcgaggtgcgattatgcacagaaagcatgcataagacacatattaggagttcaagtagaagtctattgaatccagaagttagttgcttgatgcaacaaaccattgccgctcatgcacttttcattttactcttaaggaggaggattcttgcccttcctaaatgcttttgcctgtgcaattgcagtgcgtgcccggagaaaataacagaatttttggagaagaagggtgaagagaagaagcagaagaggagagcaaggccaaagaaatcagggcaggctgcagtgaaagatgttgatgaacagctccaagagttgctgcttggtattgaagctgatagtggtggcatattgggtgctacagccagtgtgtgtcagactctgacagcagcctacactgtggctgtggaagatgtagttgatctgtcgtctccttctcctcctcttcggaagctctccaagtcccaaaagaagatgatggccgaggatgtcaatgtggctggtatgaacatgaacaagatggagtcagaaagtagttttagcacgcaatcaagtactagtgatgttgacaaccagctgattgatctgtcttcacccctggctggtggtgataatggtatgaaaggtggaagaagagccctggcagacataagcaatgttggttcacacagcactgagacagacggaggaggaggaggtggtggtggtgtggcatcggtcggccatggaaccaccatcgacctatcttctccgtcgccggccataggcgacagatcaagggttcatcacgatgatgatgatgtaatacacgagaggaaagcaagggacctgagaatgttcctggacagcatacggaacgagctgtattgagtgattatttatgaatgtttggctggcgttttttgagatgatagtgaaatggaattggaattacaaatccgtttgagatgagacgatgcgttccctgagcgcgcaggccctgaggtagagaagggcgtgggcgagcatcccgcagaggaagccgagcgcggcgctggagcccaccagcgacaccgccgtgcacagcagcatcacgaacgcctccgccctcgtggacatgtccctcgccgccgccgcgagctccactccggcgaacagcagcagcgcgccgagaagaccgacggggaactggacgaggacacgcagcatggagccgcccagcagcaggcccagcgccagcttcagcacgcccagcgccgccacgcacccgccgctcctccccccgaacttgtactgccccgccagccctcccgcgccgtggcagcacggcatggcgccgaaccagcaccccaccaggttcatggctcccatcgtcaccgacaccgacgtcggcgactccttccgctccgggaacaggtcgcgcgtcagcttgcacaccgccaccaccgagttgagcaccgacagcgggatctgcggcagcgcgcccttgatgaacccttgcttccacgcctcccgagagatgtgcaccacccgcatccgcgacggcccagcgcgcagctccctcaccgccgctgggtgacgcgccaccgcgaacgcaacgcccaccacgaacaccaccacagccgaaggaacggaacccaaccgacgacgccaccactgttgctgctgctgctgctgctgacgctgctcctgctcttctccggccccgttgacgagcacgatgaagcagaccgccgcgatggcgagcacgaggccgtcgaggcccacccaggggcgccgcccgagggacttgcccttgcccaagtcctgctcgtagcgtatgtacttgacggcggccatggcgaagttgaggccctgggcgagctggatgccacgcacgacggagagcgggacgaagcggtagacgaggtccatgaggcgggtgaggccgaggaagaggacgaaggcggcggtgaggatgccggcggccatgatctccgggatggcgaaggaggggtcggcgagggcggcggcggcgatggacttcatgggctggacgggcatggggacgccgtagaggaggccggtgatggcgttgtagatgccggtgaagacgagggtggtgccgaggtccagctgccgggacagcgccagcgacagcacgatggggatgtacgtcccgaggtcgcccatggcgccgttcacctcgccccacaccgaccggaacctcaggttttccaccgcccgccgcgccaacccttccttcatccgcccatctccacctccatctccaccgccgcccaccgcctccggatctactaccacgcccacgccggccatcaccgctgctcgtctcttctcttctctgctcgccgcgcaggatttataggatcctacctgtctctagtatttgtcactgatgatgtatttctgccatggtcaactaatacagtataacttctcgtcaactacaccctccaaacacaagtatgtcctcctaaattccgtgaaaatgccgttaacaaatttattattagaaaaactctcataactgttacatttatggaactactatttccaatttatgggaaatgatttaaacggtgaaaaagagtttatatatgtatcataaagaatatttttttccttaaactcgttcgtccatccatcccatgccctcgtactctcaaaatgtagatagaagatcttagaacttgtttagggcatgtttgagtagcttctggcagctacagtttaatttctagctactagaaccttctttaaacagtatagatttttatttagattctgagaatatgtagatgtgaaatttagcaaatgaattagaggttttccggcttctccaaattaaactcttccaaacagctcctaagcgtgttatttcgatctcagtttaccatgattccagcgagatcctatgtggcagcgcggcgctgatgtgtcatgtcaagtcgtggttggagatggagggcacgaggatgtgcatgccgaggagctgatcgtggccggagtccaaggagggattggccccagcggcaacagtggaaactggaaaggaggataatctagattatcctgtccagccggataaaatgtcaaacgtactcctgtgtagtagtgtctacgtaatttagagtagcagtattgtagtgtcccattcatgcaaccaagggacgaatgaacagaccggcctcattctctcaggtaaaatcttaagtactctacataaaatattgtctttagtacttcctccgtttataaatatttgacaccattgacttttaagcacatatttgatcgttcgacttattcaaaaaattttgtgaaatatgtaaaactatatgtataaatataattatatttaataatgaatcaaatgataggaaaaaaactaataattacttaagttttttaataagacaaacggtcaaacatatttaaaaaagttaacagcgtcaaatatttacatatataaatatggaacagcattgtccctttcctttcagtttggctgcaacggcatgcaccgagatttatccaggtcattgtcaatatattcctctcttcacatctcgaaatcctaacatatacagacgacatgatggtaagcaagcagctgtttgctcgctgacttttgatgccaaattcccctatcaattcatagctgagaattgcttctttctataacatattaatgttatcttccgatacaactagatcaacgtgatagagattatctgataccgacggacagcaccttcaaagtaagaagatagggcctgtttggcacagctccagctccagctctacccctcctggagctggagctcagccaaccagtgtcatctgcactaaaactgggagtggagttgggtggagctctctcacaaaatgaactaagttgtggagctgggtttaagcagctccactactccactccaaacctaactcttggagctaaatttacgaatatatgctgaaacagactagcacattgtgacctgatgaaagcattaacataccagctgacccaaggtgaaaacgtcacatattccttgattattaatttaaaataaccaacagaactaatgcaaagattaggagggggacacattcgatgccaaaagaca

SEQ ID NO: 68775 - DNA, 798 bp, Oryza sativa
ccaacctagcgagcttatagtaacttactagtacacagttgtcactctcatcaaagagacggatcatcgatgtgcggcacattctacggttcatgttatgggaattaattagatttcacccacagctgtcacacaagatagataattgttgaacaccgcacaagaaataccagatttttagcgatctagacgtccactattttcttcatcatactccaggagttaattctttctggacaaaacagaaaatatgccatatcggtcgatttgacatgatcaggtcttcaaggtggcagacaatgtgaatatgcatccaaccaacacggcaatcagtagaactacaaacgccattagaatgctgaaactgctgccatgcgtcttcctcgagccattctgtccagagttcatctctttcagaccaggctctgaaggcgcttttgacaaagctccagggaccacatcccaaaacgatcctagcgtcgcagccgatgcactttctggttctacgatcgaatagtttcccatatctgcttcaagcgacatcacttccttgcagcgctccatggcatcctgcacatgtcacacataagggtgtcaagcagccaaaccaaaccttatcatttattctagccgatcatggatatgttagacaaactaacataccacaaaccaaccagcgaacaacatatagaatactacttcctccatcccataatataagggattatgtaatttttggtaaaaattaaggaagtagtgaaatgacgtgatagtacaaaaggtgagggctgcaggaat

SEQ ID NO: 68776 - DNA, 17374 bp, Oryza sativa
gggacaatatttgcaacagcaggcaaaaattgctacaattcaccaccattcatttatttcatgaatatatcaactaataaattttgtcctactcttggtgtctggtaacttcaataatagtataatttagaagtcactgcaataataatacaatcaatttgttagttaatataatatattattcctgtctcaaaatatagtaacttttagctatatatgtttctaatcatgctttttttgtctagatacattgataaaacttgttatattttgggatggagggagtagtacattcattttgtcagtttatttctctacctgttcatgtctaattgatattgaaggggaaattccatccgcatttactgcttgggttgaaattttctgctgcatatatattggattggcaagtcattcagataattatatgcactccattcaattgctcccggtattcattcaaatccgcatgtggtttagtcaaatgtactgtggatttgaatgccatgtttagtagtagtaccgattaccgaagatgcacagatgtgctggaaaacagtaccaaaaaaaactgtaatgatctgaggaattatccttcgtgagctgtacgtgtacgttataatgttttttttttaaatttctgtaagattcaggatgttgtccccttgctaatttgttttatttttgtagtactagtgtggaagtgctctgaaaaccataaagaagacaaaaaagaatactccagcctgcctgaaactgctttgtacatcagaggcgaagggttggattatttattaatcgtacgtgacataaagtttgtgattatattatactaattgggagtgcagcatggcattggcaggttcagccaggtgagaaaggaaaggaatctgcatgcattgcactagcagcagcatacaagtgcagtactggaagcagagcacccagctgatatatatcatgcatgtaattaagcaagttcatgtgaaaattgaagtttgcttaattttgcagggcaggttgagggacatgacagatggatatattttatataggcagattaatgtgtgtgcatcaatcttagtatattcttgttacagaggagttagttgtggagtcgattaattgagctggactggatcggagcctcttttgtgttgtctttgtctccaagtgattaattagttgtagcaagtatgtgcacacttgcacatactccatatgtgtactggactggagtcagtcacctatcctttattattccattttggacttaagcggcagactaacacttccacacaaattaaacacaagcatgtgaagatcgatcgatataattaatccatcgagtcattgcatgcatatatattgattggatttaatatgcacacaggggtagggcacaaatctcattcaattcatctatgaaaatttaaccatatttgagaaggcataagaaggtaacatattttttatataaatttaaaatctctaggcactagatatatcaagatatcaatagtgtaaatttaggtatcttgagatatatttttttaagaaccataaaattttaccatttacctatctttaatctgatcaaattactttgtagtactagcaggatcgaggatgggcggcctgtcctaagagtaggtacaatagcagactattaaccagctacaaatatattttaatgagataaaagatgagagagaagagcagtgggctacaggtctgtagccagttgtagcacggactctaagacgcaacatgtgtatgacaggtgggaccatatactaatagtatagtaagcaactattgtataaattggctattagattggctatagatgaattgaagctagtagttggctatactattaaccttgctctaagtgcactactctagtgcttaattagttgtacacaatcccttcaaaaaaaataaaagttgtacatagatataccagggaacaaatcctatgcacataaatttctcgtgtacatcaactaacaaatgttacgaaaagttcttaaaataatagatatttatttctaatagtattacacatatatgcaaagtcttatattaaaattcattatattttaggctaaaaaaagagaaaaatctgacagttttaagggtaaatatctgtcagaattttgttacggctaaaatataatgaatttgaaaataagatttcacacatagatataatactattggaagcatgcgtctaattttttaagaattttctatgacatttgctagttggtgtgtataggatatgtccccgacacatcatatgtctatagtgtgcttagttaaatatatatgcatatatatggtagtgcactcctactacctgcacatatatgtgcctaaaatcctctttctctctctagctacatcgatcggtctcacacgagctaacttattagcttctcatgaactccggacggtccatctgaattctatcttgtctgatcccatccatatcaatacattagctagccatggtgaataggaagaagaagaagaccaagcttggtatcacctctcttctcttcagcagcagcagcagcagcggcagggacacatccactactactagtggcttgccgtattcgtattcgtcgtgctccaatatgtcgtcgtcgtcgtcggcggcggcggcggcgtggcaatggccatcctgcaagcagccgaggacactctccttcaggcagcagcagcagacgatgatgaagaccatgaactccgcttacttatccgcgggcttctccttcgcctctcgagacagccacagctccacctgcagctgctgcaggagcaggacggcgtccgacgcctcggcctccgccgacgccgtcacccgcgcgctgcgctccgaccgcctcttttttgaccctgacgcgtccccggccgccgccgccgacctcaagctcaacaaggccaaggccaataagacgaagaagaaggtggaggcgttcggcggggcgacggcgatgaccatcgagtcgtcgaacccgtaccgcgacttccgggagtcgatggaggcgatggtgactagcggcggcggcggcggcggcgctgatgactggcggtggctggaggaaatgctggggtggtacctccgggccaacgtcaagagcacacacggcctcatcgttggcgccttcctcgatttgctcgtctctgctgccgcctcgccagctgcttcttcttcttcctcctctccggcggccaaaggcaaatattcctcttgctgcagcgcctgttcctcttcctccatcaagctggaagaagaacatcagctacgacattactaatatataattgatccacacatctacggtaattaatgttcgtttaattaatcaattcaatggattaattatatattggagcgtgcattttattaactactccagtggtagtacatcatatactagtatattcgaatttcatacatccacagtttcccctctcaatttgtgaataggcggagtcgatcgccatcaccatatgtacgtgtgatattttaatttgtcagtcaccgatctctccctatgacatgctcacttcgtactaaaataaataaattataagatgaaatgtgatacatcttaattattactacgatatgtccagattggtaaatcagaatatcacatttcatactaagtttatttattctataatgaagggagtatatacatgtgcgcatcaatcgatggcatatgcatatctctctatctactatgtgacgcactacatagtttttcatagagaaaatatataatgcaaaactctatagatactacaaatctttttttttgcggggatagatactacaaatctgaaactactgtaggataaaatatgaatgtctgatatttatccatatctcaatgagtggtatagtagtgtttaggccctgtttagatagatgggactaaaacttttaattccctatcacatcggatgtttggatactaattataaatattaaacatagactattaataaaacccatccataatcttagactaatttgcgagacgaatctattgagcctaattaatccatgattagcctatgtgatgttacagtaaacattctctaattatggattaattatgcttaaaaattttgtctcgaattagcttttatttatataattagttttgtaagtagtctatatttaatactctaaattagtgtctaaagacagggactaaagttaagttcctgatccaaacaccaccttagtgagcgcccagcacagctagcctagataggccaggcgtgctgccttgctatgttgatttatatatcgattgagatctactggaacaatgatgcatgagatgagatcgataattgtatatactggggcgagcagctagcttgtgatcattggacataagacggtcgatcagacatcattaattacagtatatcaatgttgtatatttcagcagtgccgttggacgactgatctcatccagaaatatggcatcgatagccactcggcctgtcctttttgcgctcagaagcttgagacggcgaagcacatcctactcgactgcgtgttcgctcgtcaggtctggttacgggtgctgtcgcctcctggctggattgccctctctcccctcagtggcagctggcttcaagactggtggccatcttctaggtcatgtttacctaatcacctccgtgccagtttcgactccctggtccttctggtctcttggcaggaacacaactccagagtttttgactctgcgctttcttcggtctcagtgattctagagtccatcctttcagagggccgttgtggtcgttagtgggcgttgcttactttggatacttgttaggagtgttgcgtggctttgccccctcccgctgtttgaagtagcgttatccgttgtacgagtttttctttttcttccttggtttttgtctttattttcttccttccttggcataagccggtctggctgattgtgttgtgtaacaaaaactctattcttttaatttattgacgtacaatctttttactcgttcgtgaaaaaaaaacagtatatcaatgatcgatataccggggaaggtcattttgtcccataaatggttgtacaatagggtgtatttgacaggagtaaagtagaagacggagaaaatatatgattaattaagtattaattattttaaacttaaaaatattaatataaaattttgaaagcaacttttcttttattaagaaaatatcatttagcggctcaaaaaacatgtgagcgacagagggtattttctcttagtccactactaacgcgaaggcaaccttgttctttctagctatgtgatgtaattaaatggctatacaaaattctaaaaaatattaataacatagatatgtaattgtgtgagatatcattacacaacatacaggtttaaatataacatatacaagtctattatatatactattataaaaattgaagatgtttccacggtccgtcatccgtgtttgagtcggttttaattttatgttttggttttaatctatatctcttctctatctctattattataaaaattaaagatgaagatgtttttgccggtattttggttcatcatccgtgtatgagttggtttttaagttcgtttgcttttggaaatacatatccgtctttgagttggtttgtaagatcgttcacttttggtaatacagaaggaatcatataagaaatctgtttaaaaaaactcgcatgctaacttgagacgttggactcctaactgcagctcatgattttctaaaaatatatatatgtaagcgaactccgacaaagaatttcatcttaactaatgtaacgctccgcttttcgtgagtcgttaaaaactaactcggtaaaatcctaattgcgaaaattttcgttctttgtgtgagagtctaagttgtgccaaggatcccaatttaatcccgttgttccctctcatcgaaatcaaaatcctccacctcgaaaattcctcttccgattcaagtctctggaatcaaattccgaaagtcaatcccttcccttgaatcctccccaaataattgttcccattcccgaaagtatcaaactcccactttgtttccttactcgtctccttgaacccttgtgtacaagtatcaaaatttagatccaaatcccaattccggaagtcactctctcccttccttgaactcgttgccaaatctttctcccgatttcgagagaatcgtttctcatccaaatcatttccttgactccaccttatattcccgagaacaaatacccaagtattccttttgtatcttttccatgacttctccttgagtttcccttgatacatccctaaaccctcgagttcgaatatcaaatttgaattcgaatccaaaccctaaatctctccaattctatccaaatcagttttctctgtgaaagtctagtttgcctcccccaagttctatgggccgaacgcccctccccagcccatttcctccctctgccgtcctcctccctcctctcgcacgtgcgatgcatccgcgtgagccgagcagagagagagttctctcgctctctcgtcctcttcctctctctcgctgtttctctctctctcgttcgatctccctctcctcggcgccgatttcccgccgccgccgttcgaaatccggccgcacccccgcgtcgcgcgcgcgctcgctcgcgaggtggccgaccggccgaacgccgccgccatcagtcctcgcgccgccgacgccacgtgcgaccgccttgcccccgctccatgacaaaccgaccgccgccatcatcgccgacgtcatccatggcccccccgccaccccacgccgcacccgtccaagagtgggagaagcagctgctctccctctcctcctcctcctcactctccctctcctcattatggcaagggaccaagccccttttttacccttcttttccctttcccgaccactgccggtgtcactgcctctacgccgcttgaccgaccgcgccaactcgctctccttgaccgcgccagcccgcgctcccgcggtttgatttccgccgcttgatccaccgccttcgccgtccaacgcatccacgccgtcgccgttttcgcactgcccacgaaaccgccgctgccacccgtgaacaccagccgagctcccttgaccatcgaactcctttccaaacaattgtcccaactccgaaaatatgtggtttccttcggatccctctcaaataatcccttgaaccgccaaatacaaatctatcccgaaaatatcaatttctcaccttgatctcccttccctggttccttcatatttagctgagttcaaacatgcaatttgaattcgaatttcaattcaaatccaagccccaaacctcccaactcaaattctctgtataagtctatttagcctccccatgttttggatgggccggatttcctcccctcggcccaccttccccgctgctcctcccctcgcgtgctcgcgcgtgcgccatggccgagagagagagagagctctctctgttccttctattctctctctctctctcttattctctctctctctcgtcgagctcccccaccggtgccgatttccggccgccgctgttcgaaattcggccgtgccagctgctccgcgcgcgcgcgccgtggtggccgaccgcctggtcgccgctgccgtcagcgcccgcgccgcccgtgccctgtcaccgcccgaccccgctgctctgtgcgctcgcgtccaaagacgcggaggcagcgcctctctctcccacgcgctccatcctccctctcctcgtccaaaatcgacaaggagctgagctcctttcccctccccctttttctgcttttccccctctcagctagcgtcacatcctctgcctcccgtgaccgtctgtcgccacttgaccgcgaggccgccagccgagctccccttgaccgccctcattggttccttcccctcgaagccccatctccacctataaaacccgcactcccctccctcgttcggctcctagcctctccaccatcgcaccgtttctcaggccaagaacgctcgcccaacgccgcggcctcctccgtcgctggtgttcccttcctcgccgccttgcgtcgccgctcggccaacgcggtgctgcctgccgtgaacaccatcctccagacccagcgccgccctccccgaagcccggccgttttccttcgccggcttcccgtttgctcgccatcgacgccgttcatcgccatcggtgagctcttcacctaatcctcctcgttgtcaccctcctggatcactgtagaacactcccgaaccgccgctttgatcgccggacccctctccctccccggcggcgttccgcccttccccacaccgcgcctcgccgtcgccggcctctctcagagtctctccgccccatccgaccccgagaacaatttcccagagtcctagagatgctcccgccaccacgaattgaccccattctctcccggcgtgttttcccccttttgctcgccgccggtggccgccgtcgaaatccgccgcctccgtccagttccggccacatccgagccgaggaatggagtctgcgtctccttttccctccctccggtggtctcccttcctcccgcctcgcctcgcggccgctccgccgacgcgcgccgccgcctgccgtccatctcccggtcggtctcgtctttctcctctcgccggcccgcgtggctgccacgtaggcgccacgtcggtgccaactcggctagaccgagtcaaaccggccagcctggctagccccctccgtgcgcacggaccacggtgcgccatgcggctgcacgtgggcccgtcgcgcctcggtccacccggcgcaccaatcgtgagccgcatccacccgaaaccctaaacgccgcccgcgtgctcccatccctccgtgaaccgtgtcgccgacatgcgggccccacccgggacctcgcatggtgggttcggtccacccggaccgccccctctcccttccgcgcgcccctaatgggccgcctccttgcgcccgcgccggcccaatggcttggccgagcctccttcaacccattgggccgcgcctcacgctcggcctaaaagtccatatttcctccctccgtccaagtcagtgtccatctctcatgagctaaaagtccatatctgctccctcccaatttactcctctctcaccttttgtaggccccacatgtcaatgagtaattaaagaatattccaagaatattcttttccacgaattcaataaaccatctctcgtattccagaaaaattcgacaaatcatttccttgtccagaaaattcagataaacttccaatattcatatctctcgatccgtagctccgatcgactccgttccacttccagtatttctataaaattgagatctatttaatggcactattaattagtctaaataggatccttcttttggtcttttgtttaggttttctattgtttgcgtatagttacggttgcggattttcgtcgatcgtggttatctcgaagattcgtgaagctccgtgaaggccttgagcaaggcaagtcaccctttgatcaattgcccctataattgaaaagtcattattattttgtttgcaacttgcatgattagaatcacacacttaacttgcttggcctcggtttgcgtgccaaaccgacggacctacccagtagtcgcactaatttccgtaggtcgtactaccctgattccttgtcgctccacccttgtggtacctcggtattcgtgctctctgagcgcgtataccaaatatcccacatacaccgttgtttgtcgaaaacttgggaaatgggtttgtgaagccttcaaaacccgacatgtggtgtcggtgtgtttgaaaataaaatgaattgtgaaaactcgcgatgcgggggttgtgcctatgtggcactgtcccgtattcgcatataaggaccgattcctgtgggaaactcatcgaacataatcaaagtgcaaccacaaggtggaatgggacaccctggctaagtaactagtcggttcagggaaacctcgcatgccaatagttgggaacgccggggcggggtcggacaaaccgggttcctggtaaggcaatgacgagaagcttgctcacttaccgatcaaggtggttggagttgatttgtgaatgcctaaaatggcctatacttacgtgaggatttgatccttctatgtggcatgaggtaaccctgggtcggcttgggaaaggctttgtcgcgaacctctgacaccgaccagtgtctggagtaagttcgtgtcttgtgggtaaagtgtacccctctgcagaggttaactaactgttcgaacagccgtgcccacggtcatgggcagatgtgaggtggttcccgttgcgtagatttgtttgcctgtgctttgtgaaaagttgttgtggtgtgggaatcgtaaccagaatcagcctatgtggcagatggatgacctgagtggtcagaaacgaatctgtgtgattcgggatgtctgcgggcatcatagactaggcttcccgagtggaagcggattgttatgctgctgggcagctggactctgggagtctgagaaaatgaaagaagctctgggagccgattaatcaagtggaatggctctgggagccgagaagtaatgatctgacccgggaggtcggtacattaccaaatgagctgttgaaaaacatctcttaaagtcgaatcgagacgcaagtctcttttcggcccaaacttagaaagaaataaatcacttagtgatttcaaaatgtcttcaaataaaagatttgcaaaacaaccttgcctctcttccaagcttgcattaaacacctaaattcccgtgacttgctgagtacgaaagtactcacccttgctctatataaatatatatatatatatatatatatatatatatatatatatatatatatatatatatatatatatagttcctccgccctgaagagaagataaagtgaagtgaagattagggtttcgtcctggttcccagccgtcgcctgtggtgttgggtattagaccgttggttccgctgctgctgttgttggtgttcgcctcgtccgtgtcatcggttgtattctcgggctgtctgagctgcaacctaagttaaggtaaataagtcctctatttattttaaagattgctatgattcatatttgtcaccgtgggtaccagcactatgtcctaggactggtaccgagatcgcggttttgtaggaagcggttcgcgccgttttccctacgacacgctcctatcaggtgccgttgtacggcggtatcagattggggtgtgacaactaaaccataaaacaataataaaattaaaatagacttcacccgttgcaacgcacgggcattttttctagttgagacaaaaataacaaatctgactatgaataatagtgcttgtactactaattagggtgtaatctagtagtattttattactcatgttgtggatcaaatttgaaaatgacttttttggtggatgtagacgagtatcagttaatgttgtcattcagatttttcttataactatttgagtagtatttaagatttacagagaaacgagtactggacatacagttaggggagaaaaggaaaaagcagttccaatcgatgtcaaagtaactaggtgtcagccaaagtaactaattaacaatgaacaagtaagtatgtagggttaactatactgaactgaaaataaatgccatatatatatagttgcatggaatggaagatgaatatatatatatatatatatatatatatatatatatatatatatatatatatatatagagagagagagagagagagagagagagagagagagatctctaaagagagatgagtaataattggatcagtaggagatgtggcaggtggtggggtggaagtggtggggattatgattattagtggtggtggtggcgttggaaggagaagggtggaggcggagcctgagggggcagtcgagcttgatgttggggccgggcagcctgataatggcggacggcgtgagcttgatctcggtcttggcggccatggtgacgtggatggagtagatgccctcggtgtcctcgcggcggaaggcggcggcggcgaggccgcccaagagctggtggcggccttggaaggagggggtgatgcgggtggtgttggtggaggcgggctgggagaagtcagggaggagggcgtgggcgaagcgctggtcgtggtagtaggcgtcggcggcgatggagtggtagcggagggcgaggcgggcgttgtgcctcgtcaggtccacccccaccgacaggttgtagctcagcgtccactccttgagcgccagcgagaaggtggacagctccgcccccgccgccgtcgcgtgcaggaggtttggccggaacatgaggtacaccaccatcgccaccacaagcacgcaccccatccccgccaccacgcagctcgccacgccgcacaccgccgaccgccggcaggggtagcaaacctcgccgcccgctcccattctacctcgatcgcatcgaccagatgactggaattggatgcgagacgaggggagtaaggcgctgcatgcttatgcccctctttgcatgcgttgaactggcaacgtacccactgcaacctgcaagataaggcctaaccagcctagcctgcccagccacatcatggcccacttacttccagccacggcccaactggaaatgggccgcatcaaacagtttaacaaacaagagaaagttctccttgatcacatccctcaactaggggtcgagttttatctatatattatattgacggtgatttttgactgacatggtgccctcgtggcacattgatattatcatcatcctacgtggcgtctaggtggtgcatacatagccccaacttatgaaagtccctgatatggacccacacataagtctacgagaaaaatatagtgaggtccgcatatcatctccccctctctctacacttttatattcctcttgatgtcttggttgtccaccgccaccgggcaccaagggcagtacaaggaggtgctcccttcaagcctcacctatcccctcccccctccctctgagctggcagccacaacgccaatgccgagggatgttaccagggcaagattctccgacaacacagcctattcggttgcaaagaaccctgccaccacacgaatcccctaaccttgtgagggccacaaggaaggagcaacaagggccacaaactggcactccaccagctcccattggaacacctaatgtctctaccatcgggatgagatcggtggcgggtttaggtggcattgctacctactcccaacatggtgggatgggactgggctcgcaagtggcagccgggggagggggcatctctgcatgatgatagcgggctagaggacgtcagtctcgcatcgtcgctgaccggctcagccctcctcgtgcttcccctctcattcccttggctctgtcgagatccttcgtagcctcacacggtcgatgcgagtgcaatgcgcgaggaacaccgatagtagctagggagagagagggggtggaaggggaaggagataagagtgaggatgacacctggtccaactgcacttttttattttttaactagatacccactgacatgtgggtcccacatatatgttttatttttaacaggattcccacttacatgtgtgtcccattgttttttcctctagtgacacataagcatcatgtaggcacctcgtgggacgaaaacccaattgaataagcatcccacgtcagccaaaaagctcttggtaccgcagaggaatttgattttcatttattttggatatagggaatgcttaatacccgattttatggttgatatatagatgtacattactactctacctctatttgagtgacttaaagtgaacattttttagcaaacaactagtagggcctagctaccgctcctttctctcctttctctctcacgaaaccatggcatggcaagttggcaactcctcctatttctaggctgcggtggcgccgcagctaccaccgtcgtccatggaatgccggccactctcaccctaaagcctgcgacctcgactatcgcctgcgatggaatgggaccctcccttttaatttgagcagccaaaggtaattaatacttcttctatttgttctttaatatatgacattgttgatttttagatatatttgatcattcattttattaaaaagttattgaattattattttttttattatgatttgatttatcattaaatatttttttaaggatgacttatattttttatatttatataaaatttttaaataagataaatgactaaaagtttatcaaaaagtcaacggcgacatatattaaaaacagatttagtaataatcagccctggtttctgtttctcccctaaaatccatctccatctactatttgaagaaattaacagggtagctgatggtatgtgtacggtgctaaacctccaaatcggatattactactccagttggtagtgcaatgtcatgtcgaattgatgatattttccttttaagtttgcttctctatcactctatctgcacccagcccaactactttgcttggatcttaattacacagtccgtcaaacccaaaatttactagtcaaaactcaaaacagatatgatctttcaaaaatcaaattacgagtaacaagctagggccaaaacaaagtacacccagtaaaccttcaaagaaaaaagaaaacccaccagtattgtgccttaaacaaaatccaaggaattgaattctgtgaaacacaggggtattaattattaatcttgacatatccatgaatttgtattccggcagttacatattctcgtatgttcatcctggtggcaattgtattattgcgtatcacatattcacattagtttataaattggtgtcaaaattttaaaacttattttaaggttgattttaaagtttattttgatcgtagtttatttttcggcatcgacttttaaatcgtgagtaacacacaactataaaaaaaatttacctacaatattttttacttctgttccattttcatctaagcagctgtaggctaaacgatcggaccaagccaactttgctaaggtctccttcgaaacatatgaatttttcataagaaacatttcaatttttctaaattttttatgaaattcctccaatccaaaataggcctaggaccggccggctgtgaggatcaaatagtgcaggcaaagaagataagattgatgcaacaagccacatatatacatgtagagatatgtatatgggtgtaggtgtttgccccacttagtttggacaaatgcacgcaagagtccagaaatgtcatcatgcaactataaggacatctcaactcccaaccatctccttttcttttcttgttcttttttcctgacaatcaatttatttgctacttctccactcaactggacatatagatcgatctttctagctagtgatgagtactgatactagcatgtcaacaaattaaaggagctaggtaaggtacctggtgaccaatcctttgacaactcgttaattagtgagtattaattaacaatggcaggtaattttcatctgtaatacctttttgtcaataaattaatgttccgggctggcgttggacaactgctgtagtttcctaaaataaataaataaataaataaataaataaataaataaataaataaatatatatatatatatatatatatatatatatatatatatatatatatatatataagctagacggacgtttcatgtatcaattgtaatatgcctagcattatttctgctactagcttgtttaatttattgattaatagctagaaataaattgaaggtgaagacgaacactctttgttgaaaaatgaacagaacattaattgattacaatgttgcaactatgtagtatgcatgtgaagataagtacaattattatatattctagtagtaattacaagattgtagcaattgcttaattatcccctctctatatgcgaattattactacaagtagctgtacacctgaaccatgcagctagccacaagcatggcactgtacgtagtaccaaaaaaaacacaggcatgaaaattaagtaagaaaaaggtcaaattaattcgtactgtaaatacataaaaccactggtggcaggcatatatgcaagattactccgatcctcactcgatcagttgagctgagcttttaattatatagcttcttcatcagggctgtgcttgtagaatgtagatcgatcaattaagcaagcaattatatatggaaggaggagaattaattaaggatgatatgatttgttggatgcatgagaggaggatgaggagatggatggatggatcagacgtcgacgacgcaggcggcggctcgctggaacctgaagtagccgttgccgccgccggagttggagccgtagcttccccggccgtcgttgacgatgagcagggcggggcacctgacgcggaggtggtagtgtccggtgatgaaggcgccggccttgtagcggatccagccgtcgacgcggatggtgacgagcaggtagccggcggtctcgtcctgggtgatggagacggcgaggtagggcgggagctggacgttgttgccggagaggaaaggggaccagacggtgaggtccgggtggccctggtacaccggcggcagcgacgtcggcacggtgatgcggaggcccttgtactcggcgtacacgtcggcgcggtcgtagtagatgcccacgcgctcgttgccgttgcgggcggcgagggtggtctgcatggtgacggtgaggaaggagaagtagccggaggaggcggtggcgccggcgtaggaaccaccggtggtgacgttgaggcagacgacggtgaggtcgttgaggtagaagcgaggcttggtggggcggaggatgagccagacgatgaggacgatgaggaggaggaggagaaggatgccgaagatggccgcgcagcaacgccggtacaggcgctgccgctcgcaatccttgtgttgctcgcagtgcttgatcgacattatatatctatattcttgctagctagctagtactatttctctaaatttcttgtgtaattcttcccaactctctctcaatctgctacaacttgttgcttcaattccttgtagctagcaactaactgggactaataatcgatcttactaataattgaggggtatggtaggaaaggaataattgagaggtatggtaggaaaggaagggctgcaggaat

SEQ ID NO: 68777 - DNA, 7197 bp, Oryza sativa
atctatcgttcgatcgctacatgtcatgcatccccatgtggggtgcctagctctctcggtgttctttctttctttctttctgttttgcacgctcgtacgtactccatgctttcttcctgtaataagcagacacattattcagcattcagctgcgtgattaatttgactgcatcatgcagggctctctctcttttgttacctacctatgtgagatctactagcactagtagttcacaattgccgaaatttcccaatcgatctttctgcactttagatgtgcctaattaattaaacagatacttcagaggctggttattatttgtttttcaggtgaaagtaattagtaccagcacgagtagctagctagatagaggtgggagaaacactattttttttaaaaaaaaacatttttcgtggagaacaaccctttttattactagcggattaaacatatatacgcttgtaaaaatgctaccgctgtgggcggaaagactgtgccatgctgataggactgttatcgagtcctataaacatattctatcctctcatctccgttcaaatacaacttaaagtccctatactccaacttccttttaattgaaattcaggtgggaagctctccccaggatgaccagtctaaaaaaacagagttgctagaaatatggcgccatatgctatagtcgattttttttcaaccacttacacagtagttatacctcatttacaccccacttacatatataattagtatgtaattttcgaatttacatatgcaattttagtacttacatatgtaattttgagacttacattgtaaatacactaaaattacatatgtaatttatggacttacaatataaatacatgccgactattttttaatgaaaaatatggcgccacaaatatagctacacaaaaaaaaaattgtattgaagggatttccggtcacggatcaccggcgagaatcaatttttacaccaaactgcctaggaaaaaacgtttcttgctgatgggcttcctagggcatagtttgcgaaaacatatatccgttggcggcataaaaaccgtcagcgatcatcatcgatggttgcaggcaatctgtttccgtcaacgaaactaaaagtgaaatcataagtaatttcccattttgtagtagtgaaatcataaaggtggaattaaaagtgtgagtgattgagggagtgtggcattagctcgcaaaagtggatatatatacatagagagagagatggcggcaggtaagctgtcaaattcagacaagtccatttcatcaacatcaactttttgtttctctgttttaaattctttttggagaaaaaagaaaaaggaacaggacgatcgagaaaaagataggaggcaatcgaagccagggataagtggatcacaattaacttaggcacgcagaggccgatagatcacctggcttcttgtcagtctcaatttcgatctgaatattgttttgctccagtaactgcacgtatacatgtttagttacaaatatgtagcatatcacgtcatttctcatttcctcacatgcatgtgccggcctgcctgccggttagctctagtagcaggggctggctaacgggcgatcgatctccatccacccctatacacttctctccccccttcttcctcccttcttctcttcctactacactataattttttttacaaaaataaaaaacaaagtatatgtatatatatatatatatatacacacacacacacacacacacacacacacacacacatgaatcgggtatgtaaacttttgacttataaactttgggtctataaactttagatgtataaactttagatgtatagaaatactatatataaaaaatatttgaattcaaattcaaatttgaatcggatatataaacttttgatttataaactttgggtctttaaactttagatgtgtaaacttgagatgtacaaactttaagtgcataaatttactaaaatagaaaagtaatatggtgccaaaaaagaaaccaggtaaagggaggggatccgaatttgatcgctccttagcaatctcgctagtagcgtgccatccaccgatggatgcatgttcactaatccagcactcaattagatcaattagcttgattagttaacaaaacaattaagggttgaatcaaagtaagaggcaaaataattatgtttcctgcgtcgatacgatccacgtccaccactacttagaaaaagagttttttctggcggtcaaaattgatttttttgcttgcgggtagccagcaaaggctagtgaaaaatgcattttcactggtacgcagccggctgccagcgaaaatcaagtttcgtaggcagcatgttaatacaaccgctcacaaaactaccatcttcactggcaacaatttaagaggaccaccagtgaaaatattttttgggggtaaaaacaattgaaaatcagtgcgcgctggctaccatggccgcatgcaccgcccaccgcctagccccaccatggaggctcccttgccaccactgagccctattcacagttggtcaccgccgccaccggtcgccaccgcggagcctgtagaggagaggctcccttgcaccacctcactctactgagcccagctatcgccaccagatcaagcgcctgcaggagtcctcgccgctggtccgcctcctgcgcgagtcgccgccgccacctagggatgcaagcggggcgggcaagcgggtttttttaacccgcttatcccacttctggttcattttttcttctaaattttgtactaccatatgaaaaataaactagcaagcgggtttttatgcgggtagcgggactacccacttgcatccctaccgccaccccctcccctttgcctccgccgagcccgaagagaagagactcccctatgccaccccactctgccgagcccggccacctccctaatgccttactgccacggccgccgccctctaggtccgcgctcgcgagggagagctcggccggccggcggtggttccgccgctccgtggcccgctgacgctggatttggagcccttcgtcgcctccgtaacgccctaccggagccatcaccgtcatggccgccaccctccggatctgagcccgcgagggagagctcgggcagccgacggtggatgtacctctccgtggcccgctgacgccagatccgcggaggtcgatcacgtgccgtcaccatcgccgccgagcggtgtcaccgccaagccccgccatgcaccgccgattcttccccacgcgttacctccgagtcccctccttgtcgccgccgccgccagtggggatggaggaggagattggtgcgacgacttacggtgggtaaggaaggcgccactggtgagggaggaagagagggaggcggtgggttgggggatctggagaagaggaggcgatgggtgggtggatgtggagatccggtgggtggtggtggtttttaatgtcgtaaatttgttttagtgtgccgatgtttttcactagcggacctatttagccgcctctggtaaaagtaattatcatttattttacggtgacttaatttatcgtcaaatgatttttaagcatgatttatttttatatttacataacatattgaatcagaagaatggttaagcgtttgtaaaaaaattaatggcaccatatattaaaaaagggagatagtagctcgtgaagcatgctggttggtggcagatcatgctcgatcgcccccatcgtcgcccagcttatattcctcgtccaaactaaagaaacaattaagctccatcggagacggtcattatctatagagtaaagtgcacgggcggtctctaaacttgtgtgggtgtgtcaactaggtcctttaattctcaaaataaatttttgggtccctcaacttgtctcgggtgtcatataggtccaaaagggtttcaacccgctccgtgtgctgacatggcatgccatgttggcgcctacgtgttagtagaacccatatgtcagccacatatagaaaaaaaaggacatattttttctcctatcttttttcatttatttttcaaaaattaaaacatcattttcttctctctttttaaattttatttttttctacatgattgacatgtggatcccactgacacataagagttactgtggcttgccacattatctcatagagtgggttagagcccgtttagacctatatgacacatgacgagtttggggacccaaaaatacattttgagagtttagagatctagatgacaacatatatatatataaacttaggctaataaaatcttgctactaaaaatatcatgcactctttagttttaaatatctaaagagtaattcctttttaggatattgctggcctcggccgcccgatgcagagaaaaaaatcggtagacctcacactactatacgtatgcaatattgtatctagccactagtttattctctttccctctttcacactttaaatattttatctcctaaactacttatccaatctacaatccgatcacaccgttgtattcattgtaattaaatttttactacaaaatattatatgattatattccgataaaagagaaacatgtgtttgaaaccgttaaattaaactcaatattttatatgtgatagcggcacgtttcaacccgtgtttccgatgtgtttcacaaaattgatgcaactacatgcctctattatgtcttctctcttcattccatccatccatgcattcatgtatttaatgatcttaaaaaaattctcctaaattacttattcgatctacgatccgatcccaccgttgtatttattgtaattaaatctttacaataagaatcacatgattatatcctgatgaagaaaaatgtttcaatctgttgaccctcgatatttcatacgcgcgtgatagagacatgttttaatgtgtgtgctttccttgtgtatcacaaaaaatttgaatgtttgaatggttgatttttttcaccatatatgacctaacatttttagaacggtcaaatgaaatgtttgaccggtaagaaaaatcaaacacccaatttggaacattggtctggtaagaaaaaccgaacactcgatttggagtttgctcttttttttcaagctattattaattgttccatcaagaataggaaagctccatggaagtcatttaggccctgtttagtttctaaaaagtttttcccaaaaacatcacatcgaatctttggacacatgcatgaatcattaaatatagataaaaacaaaaactaattacacagttagggggagacgaatttttttagcctaattagtccataattagccataagtgctatagtaacccacatgtcctaatgacggattaattaggctcaaaagattcgtctcgcggtttccaggcgagttatgaaattagttttttcattcgtgtccgaaaaatccttccgatatccggtcaaacgtccgatgtgacacccaaaatttttcatttctcgcgaactaaacggggccttaggtccgtgcattgcagccacagacgtgcatatcacctcgtccgacccggctttaacatagctagcgagtactacctttatttatttacaactagttaattattaattattactgtgtgatcctctagctgtagctaacccgcgcgccgctccgagagataagataaacccgcgagtagtgagagtcgacgatagatggcgccaacgctgccgtcgtggtggttgctcttcctcctgctcctcggagttggcgccaccgcggcggccagaggcagcaagaagctgactcccccggtgtcgacggcgtacgagtggccggagcggttccacgcggtggtggtgtcgatcaacctgaccaaccacgaccgcggcggcgggcggctgcagctaatcgagatctactacgactggccgcatggccgcgaccttaacatcgtcagggaccagctctccggcgatccaccgctgtacaacgtggagtgggtgaatggcacctcctacctcttcgacaccgccgcctccagctgccgcaccttccagttccccgtcggcatcctgcctcgatcgggcgtgacaccgtggacgccgacgtcgccactggccgccccgtccgctggatattcaacggcaatacgcggcatgtgctcgtgttcgaagccggtgtaatcctccaagtggcaggcgccgccgtactgcttcctcaacctcaataatctcgtcgctcgatcgatctcgctgcctcatgattatattaactgtgatcaggttcgcatgcatatatattggaccagctgatgattatatccacccatcgatcaattcatgccaaagtcgatcaatatatcctgtgcacgcgcgtacaacttactgagtatatatgttgtatatatagtttcctctctgctaccaattaattcatccgtattttaatgtatgacgccgtttaaccattcgttttatttaatttttttttaaaatatgaaaatatttatgtcatgcttaaagaacatttgatgatgaattaagtcacaataaaataaatgataatacaataaaatttttgaataagacgaatgttcaaacgttggacgaaaagttaacggcatcatacattacaatatggaggtagtaattaattaactgtgacataccatagtcaatacatatatattctgtgctaaacaacactaatataccaacctgtacttacttgcacagttatattttttttctcctgctatatttaatgaaattaacattctctactctggtcgtaaaaaaaaatataatacaacaccttattaactactcctttcctaaaaaaatattaactactccctccgtcatattatataacaatctagtatcagatacgacatgtcagtactacaaacctgaacactatgttgctatattttagaatggatgtaagttgctggctatttaatttgtttaagccagcctccatgggaagggaaagggaagggatgatggggacatgatgcaatttcaggcacaacacaacaacactcatatcaatcgataggatatagtaccttatttttataatattggataaaacacaacataacactataaatctgaatagtgtgtgttccattaaattttagtttgttgtattttaggaagatgatgagggagaatata

SEQ ID NO: 68778 - DNA, 2358 bp, Oryza sativa
aatctacgtttaatactcctaaatagcaagattccggagggctatttaatagcccgaaggatccaaacaagaccaatgagatagtactaagttactttctccgtcttaaaatattaaaagaaaatatgatcggatgggatatttcttaatattatggatctggataggaaatgacgcattcaattctaggtttatatattttgagatggagaaattaaagtattgtatggcagaaacagaaagcgaaaagagcaggacgaggcgtgagcttatggagaggggactgaaaaaacgagaagcaggatgtctatatatcaagtagtaaagcactggttttttagtgttatcgtaaattagtatactttgagaaatgaacttcacaacagatagctttcgaacaaatgctttaagcaatacggtacaatttttatttcgaatcatattttatacaacccgtgataaagttttggggggaaaagaaggctggaaagaaccctctattatctccatgtgcttatatttgtggctgtctctgtctgaaaaagagaaaagaaagaaaagaagaaagggagcggtacatgaacatgtacttgtcaggtgaagtgaggtaattaagcggcaaagagaaaaaaaggtaattaagcggcaaagataaaaaaagaaaaaagaaaaggcagcagtgagcagaggatgagagccagaggaacaggcagatacacacactgcagagtgcagagtcgcctctagcattcttcttcttgttgtattactttgtttttcatgtgactgatactttcttttaatttttttcaaaccagattggtaacgacatgtggatcttatttgtgtttttatttttaattttgagtaattttttaaaaatagagatatttagatgaaactatcacaaaattacaaatttaatgacatgtatcacagaactacaaatttagcatcaaatttttcatgaaactgcatattcaagacatcatatcgtatcataaaactatagaattagtgataaagttattaaagaactaattttagagtttagatccatgcatggtactattatctctactattataaaaattgaagatgtttttgccggtattttgatacgtgatccgtgtatgagtcagattttaagttcgtttgcttttggaaatatatatccgtatttgagtcagtttttaagataattgtttttggtaatacagaagaaatcatataagaaatctgtttttaaaaaaaactcacatgcaacttgagacgatcggactcctaagtgtagctcatgatatatatatatatatatatatatatatatatatatatatatatatatatatatatatatatattcaagtagactccacagtgaattttatctaactaaaccacgtaacaataataaaattaaaatagacttcaccagttgcaacgcactggcattttttcttgtttatttaaatttgtaaaagctgtaggtttatgataatattgatgttaaatatgatatcttaaatctgataatattttctgtgaatgacaaatgggtctcacacatattttttaattctaataccacctaagcgtcacgtcaacaccacgtggaacgaagactatcctccaaaataatctagagagtcaaattacaccggttttaatagttgagggttgatatatccggtactatggttcaggatacgaatcaaattcgtttattagttaagggagtaaaagtgaacgtattccacttcatatatatgaatgcatggtctctgctagctaagctgctaattattaattgggccatgattttatacgtgtgctaggcccaacgcacgcacgtttgcttcattgagcgagctggacatactgttggagttatgaagctgcactgtgacctaattaacctacgtcgccttcccagctcgtacctgtatgtacgttctaattaagctactgtactactactagtcattactactgtcaacaaattaactaaagtcattcgtatatttactttattttgccttagctaatgtaactgcaaacgatttactactgtgttaattttccttgagaaaaatactaccgtgttcgtcataattaagtagctgtaattaatactgcatacagctacttaattacgtaggatagatatgtatggattgatccataggagactgcctctatacgtatatatgttcatacatgtcgatcgatgatgtagatggttgatactattaatttggatggattcaacgtacgtaattgaccagacgaagacgactagatcaatctacccttgactttgtctcctacgctctcttttgaccgtctccctaattc

SEQ ID NO: 68779 - DNA, 6730 bp, Oryza sativa
  unsure (1)..(6730): unsure at all n locations
agcgggggaaaaagggaagagaaaggactctagaggggttctggagcctgaactctcttgctctccggctttctgtaactccttcacacacagatccaccagaacacaggagtagggtattacgcttctcagcggcccgaacctgtctacatcgcccgtgtctcgtgcacttgctctctcgcgaacattccccagatcgatcgaggacgaagaacctcacttagcgcccccggccgaaccggcaaaggggggcctacgcggtctcccggtgaggagtcccacgctccttcatatatatatatatatatatatatatatatatagagagagagagagtacttttacggtataatatactatactagtgctatatattgatagtataaagaagattatgttggaaatttctcacaaaatagaaaatgttctttagtacgtaatttcgtgttagatgttaactcagataataatcctaatggatcatgcgtcagatcggattactgactggatacgtttgaattaataaatggcacaagatctctatagattgctcaaacacataaaaacattagggcttgtttggtttaatactaacttaaattttggtaacttcaatagtaacaattgcatgtttagtttggtaccaaattttattcacaataattcaaattcaatactatccatttggcactatcaagattttggtaggataaaaattggttccaaaccaaataggcccttaatttgtgttatagctagagtgggagagattatctagcatagagaaagatcattttacccccattaaaattttatattgcagtcgatttaaatggatatataggcaaatcaacctacacccttgaattgtttctactagcggtatacattgtaccataaaagttctctctatatataatatatatatagagagatacaaagatagatatatatagccccaggggcggagctagtgtatattagggggtgcctaggaacccggttaagaaaattttttagttataccttatctatttttaccatgtatgcactcccctcaatacaaacttagacatccacatcagcttaaactcggtctaaagtatagtaaattaagcaagtggtaccaccctctatttcgctctagctgcgcccctgtatagcccataaatccatcatccacatgtacatatacgtgtgcacatcgatcgattgatctctgcctcctcctatactacactactactacgtcaacgcctgcgttttgagtaattacgaaaaaaaaaactgcggggtttgacaccatcaaaacatgacaaagtagtagtacaagatatggtagttgctttccaattcagttccagcaacagcagcttgaaatcagtctaagcgcattaatctagcttagctgctcactccaatctcgatcagcaatcgggctaacttagctcctcacagtacacatatatatagtcacacgacacgctcttcttatgtacatgtatccttcaaacaagccctttaatatatatgttattttgtttaaataaaaggcccttgaaatgttacttgtacgtattatatatgaagatactacacgatagatgttatattgcacacacataaaaattctcatacatagttagctaactatgttgataagaaagcatcgcatttttttcaagtctttgtagaaaagacaaattatgcaaaaactggagtagatcaggtggttatgtaccttatgataggacctactaatttatactttttataaagttatagcctactaaatctaaaactcaacatgcaacattgccacattatcacccattaacaataattgcatatttaacctcatgcaaacatacaacggcatctataatttatttaattctacaaatcaatatgtaagcatatccaatcatatcccctcacatcatttgcacaatattttaacaaatctatctattattttttataatatttaaaatatacttatcaatatgtttcacattaaaacacgggtatcatatgtttcatgataagcactgataaaacctaatgtttcatttcattatttaccctgattgtcgaaaaaaacatattgagaattgcttagcaattcccgtagcaaaatgcggggaaccatctagttttataatagtagacatcgtacccgtcgacgtcaaagtgcttgtactagtttttcttccatttcaaggtacgctgattcatagagataggagagagaggttatgcgcgagtggacatttgtattgagtttcgtaaaaagaataggaaaagaaaaagaaaaactgtaggaaaaataaattgggtttatcacggcacgtaagtggtaataagaaaagaaaagaaaataggtaatgggtagagaagattgctaacttgatcgttgagctgctgtcggatgaaatgaaatgaatgaaatgaaaggtaggaagcttcttaacagaaaaaaaagagcggttatgtagagtatataattatatccgcagtaaagcgaaagagatatgtatgtgtgacgacttggcccactcaaatctatcaaccaaaagctgatgagaagaaactgactgactaagtgcaccatataaaccaatgaaagcaatccacgtctatacgtaaatagttagggacagattcagcacaaaaaatgtatcgtattcaagcagcagaacatcgattgagatcgatcgatcgatggatgatcggtccagctagcttaatgaaattattagtaatttgacgttgtcaaaaggcaagcgcattttccattttttgaggacaaaaggcaaggcattggtgaatggtgatagctactgcaattcactttttcttggcgatcgctagctttatactaatattttgcaatcgatcgatggagtgcgtccatgcgaccttttgttgactcgatcgaacatcgatgtatcctcctacctcagcttacatatatgcataccaaatcaacgggaaaaattcaagcaacaattaataatttcagtttgcacctctctctctatatatttaccaacggggccggctagacagtttactttcaggcaggcaggcagcagcagctattactatcgagctgaaaacgagttcagtacagctgcgggcatcgccggccggccggccggctgctccccttcaaccaaccaaaaaaacttaggcttaggtcgtcatggagcagcagttgtcctcgccgtcggcgtcgcagcgtggcggcgggagggagctgcagggtccacggccggcgccgctcaaggtccgcaaggagtctcacaagatcaggaagcaggagccggtgcagcagctccggcagccggtcatcatctacaccatgtcgcccaaggtcgtccacgccaacgccgccgacttcatgtccgtcgtgcagcgcctcaccggcgccccgcccaccgcaccgccgcagccgcagccgcaccaccccacgctcttggcgcagatgccgccgcagccgtcgttccctttccacctccaacagcaagatgcttggccccagcagcagcactcgcccgccgccatcgagcaagcggcagcacggagctccggcgccgatctgccaccgttgccgagcatcctgtcgccggtgccggggacagtactgccagctatcccggcgagcttcttctccccgccgtcgttgatcagccccgtgccatttcttggtgcaacgactacttcttctgctgcgccgtcgacgtcgccgtctccaatgggcggcagcgcctactattgggatctcttcaacatgcagcagcagcagcactaccaccaccaaaattaattaatttcatccatcaattcagatatataatttgcacggatatggcgcggtcatcatcacaatattggcatccatttaattagttcctaagctagttagggtttaccatattttttttagatatatgacgtcatagtcatacaggagaaaatccactgtcagatgatagagtacattgggattaattattgatagatagtcgatgctaattacctcgttagctagctagcttaattagttagagtgcacaactgtaactaactctagctagctgcaaggaagcttcatcgtatcgatcgccagcacctactaattgattttctccgatgtacttgctgtaatttttcactcttgtaggcaccccacttaatttggaggtgataatatacctagatgccacagtgtataatgtaatattcacttcattcattttttatataaactacaggtatgttaaccagttgtgccctcttgtattatatatgctcttgattctaccgtacgtaccacaccatgcacgcattgcggtcagttcagagagaaaaaaaaaatcagaattgctaacctactgccgacataaattgcacccctaaatcttgcagattttgagccactggatgagcttcgagattcatgctccaggccttctactccaactccagtgacctcctcttcttttccagcgccgacgacacctagactccggcagaggactctacgggttaaggtctcgaggtgaggttggggtgggaggggcaaggggaaggggaggagttcttcggctctagagggttggctaggagaggcggcagcccagcggtgggcggcgagacgccggcagcggcgccggagcgcagggctggaggagggcggtggaccagcgttggtgtcgggggcatctcgccgccgacggcttgaggaggaaggaggggggaggaggaggaggctggctggccgagggatctcaccggcgccgttgacgccctccggccagccggcgaggcagcaggcggcacagtggggcggtggcggtggaggaacacgcgatgggaggggaacgggaggaggagcgctagggttaatgcctctgtacgaatcttaaagcatatttgatggtccaaaatttgaaggataggaggtgggattttatgtcagcagatatataggccgtctcaacaaaaaatttgcgaatgtatacgatcgatcaatgaattaatcatgcattcatatatatacaagagtgtatgcaaccatgtcccgcgactggcaaaagaactagtcgttctcgctctcctccctcgtcctagttttgcgtaacatagccgcatcgccatactcgggcgctgttgtctcccttcctcgacgcggcgaggctacaccaactggctccttggacgagcagtcgccagaccgtgcatggttaagttcatccgtcgtcaatggatgccgatcgagtttaattggcgcctcctccgacgccgtcgacttaatcttggtgagggcggcctgccttaggagcctatggtttgcatagctctgtccatccccattgccgttgacctgatctcgtcgagctgaggcctatgacgatcgagcagatcaacataacgagcatcaacctctccacgctcctccgccaagagcatcaacatccgttgctaacaagtctagttggaggctgcccagtgaaacgtcccatcctccactgtcagattggagaaattgattggggaggataaatatctataggagtgagaacgaaaaaaacaaagagaggctgataagtaaaacccattatcagattggagcgcaagccacatatggctctaaattgtttgcctagctaaccaaataagggcacctttgaatcaaaggattttatgtagtaatttcatacgattcaaattctataggaaatttttctatgtggccatttgattcaaagaattgaagctttaatttctaaagaattgaagctttaatttctaaatcctatgaaattcctatggaatggcttatttcatataggtttttgaaggaaacatagcaagagctctaacctcgtggaaaatttcctttggatctatctctctcatccgatttctgcgtttttcatgtaatccaatcaaacgatcattcatgtgttttacctatattttgcaataatctattttaaacttacattcatgtcttgtgtttttttctattcctccgtttttttcaatcatgcgattcaaagggaccctaaatgtttggagaactaaaaatatccactctattagagatgctccggtgaagtgtccaatgcatggagatacaaatgatggcaaggaaaaatggcatggaatttctgtttttagcctactcactcattaaacaatctgaaaatagagtattttcatttggatcaccttttcattgttgtagtaattaattatcatcaatcgcacaaatttgatggtttggattaaactatctattaaaatcaagacaaaatttgttctcacctgtcaaaatttgttcattagcaattattgcttttaaatatgaattaaccactcgttataaagatagattaaaaaaatggagggagtactcgtgtaattttattcttttttgtgctggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 68780 - DNA, 1480 bp, Oryza sativa
aattacaaatgtctacaactgaaaagagactagacatcagctaattaactttagcgtgtagttttaaaataatggactaggcttgtctcttatgtgaagtacagacatcctacatgtgttagttgctgtgctatggcttgttcaattcttgaggcgcataagttattagcacaaggcgcataagttctctgtgcataagttctctgttttgtgacagaaaggtcatccagtaaatttgatgtctttaatactaacctttcacttgtgtattatgtaggatcgaaacacaagaactaggccaaccagaggggggtgaatggttggtatacccaaaaaccgaaaacttttagcggaagtaaaagttaccctcaatttcgatgagatcggtctgaccgaagtagattagccggtctgaccgaagcgtagcagccggtgtgaccggtgttgatctaccggtctaaccaccgagatggcttgccactcgttgtcgccgccgctggtctgaccgccgtgctcccgccaatctgaccgccgcaatgccgccggtctgaccgctggtgagttgccgattagaccgccgaaacccggtgaaacacaaatcgaagaactcttaaagtagatgacaactttattgattctctctgtgtttacaaagtacaccaacagcactccttataaaatttcaactaaactcgaaaccctaactcaaaactcaactctattgctctgaaaagcgataccgggaagcctcacgctccccttctatttatacatgaggtaggcagtctaaagccacgaaccaaactcatactaggagtcctaaacaccttaggaaaccctctagtacaagaaagaagctttacataaccaatcgtaccaaatttggattccttccaaattcaactctgcatcccatacgcacacaatacctccatcatatgccatatggaatctccatcaaccacgtgcatcaactctagcctaagtatcccgcatgatctctgaccaccacggacatcgtcttatccccaagccgactcccggtccatcaccgcaaatactctcccgagacatcgagtcacctacacatggaacaaacaaagaaaccatattccaagtccaagctatctccaacttgactcattagtagcaaacaatagtattacatacgtatagtatccatctagaagtcataatcatgaaataaactcggatattcaaataaacaacccgaaaccgaaaccgacacagtgtcggccggtcagaccgcgggctggccggtccgaccgctcgaacaccaccggtctgaccggcaacacctgcccggtctgaccggtcacatgaaataatgaacctacgattcacctgtgaaatccagtcatctccaaaaccacttcgtaaataaattccaaataacaaaaccaataatctctaatgcccaattgttcatcacataataataaccaagggctgcaggaat

SEQ ID NO: 68781 - DNA, 1570 bp, Oryza sativa
attcatgatttcatacaatttataatgcaacatcttaacaagcacataggttgaagaataaacactaaacacatatacctattgcatttatcactctttctcaaataacctttagcacagaataaccaagagaatttgttttaactttttcttttcttgagcctttttgctcatatttttctcttttattccgggtacgtccctgtcgtcaagactgtttccagggattcggtacccattattttgctcacatcgaatatgtccttgtcgtcaagactgtttccaaagattcggtattcatttttttatatttttattctctttttcacaatgagcaattaaagctatttgagaaataacaagtcaataaagcatataaagcatatatatatatagagcatttatagatcaaaccatatgctagcatcaacattgcatattttcttaattcaagtattgaggcaaaagatttgccgaatatattagaaaagggccgagaagcttacattacaaattcaatagaccttacagaacagaattaagacaactaaatacatcttacaaggacacattgtcctacaaaacccattaaaaaggtcttctcgagaggcttatttggtttatattttcctgagtcaaagaagccacctgattttcagtcttctaaatctgttgaaaaatccttcgattacgctcaatccatatattccaccatataataatcaagtctccaagaatcttctttcttctagatgatggtgagatttggcataacatattccaccactccgcatgggaattcgttgtctattgttgtggaatgttactatgtccctgccattggtagattttgccccacactgctattgagaaggggcattccttagctaaacggcaattatcttcaaaagtgcttgtgcaataaaggcaacatatccaatcacaaggccatcgtcttttaagaagattctctgcagttagagccttttgatgaagtaaaatccatccaaaaaatctctgcttcggtttagcttgtattgtccatattggatcgaaagaagcatgggtgatagaaccctgaaattgcgctaagtatgcactctttgctgaatattgtccattttccgttcatttccacaagatatcattggggcagtcttataagagtgctacctcttgtagtcgagattacaagtgctacctcttgtagtcgagagcctaactgaatcaattcctcaatctcttccagcgaagtaatttgattcagcaaacttaaccaatggttattctccaagtccatctttaattaggcaatttgactttccctttgccagtcaaaaaatagagcactccttaggcgatcttccttccagccagttatccatccaaaacttgatcttcttgccatttccaattgaaatagaagtgcctgctctaaagagcgttgtatcagtttcatcacacggcgtttgcatgttaatccaaggttttgagtcttctttccattcaaaccatagccatcgagttgactaccaattaactgcttcttagaatcttaagctcccacaag

SEQ ID NO: 68782 - DNA, 12864 bp, Oryza sativa
attggcacgcctgcatctcatcaaactttggacctacactggagctaaacagatctcccagaccgttgtattcgtcgacttagttcgcgcaacacaattccggcaccatcgactaagcgcggatttttcgtcaacacaaccctacctaacacgacgatcaaatggaaattttcttttttttaaatatgatgattaaacggaacagagggagtataagttattcacaagaaaaaaactaataagaaaaaataaatacaaaattgcgatataacatatcgcacaactttccttattctccgacaacatagtaattcctctctaaactctaacatgaaaaacaaacatgatgactttgtcacagaacactattcatgtataaattttgatcactcatcttttttgcaaaaaaaataacaaaaacaaaaaaacaaaaagataccatattatcaaaacgtgttgtatcctaaacataagcgttaagttttcactcatcctagtctaaccattttataaatattagtggccaaaatttaaaaagtgccaatcaatttgtgacaagtgtttggtaacaaagagagtagataatttagataaaattttcattttaaccgctcaactgcatgacatcgaagcaaatttcctttcagttactatccctctacaggtattgattttgcaggctattctttatgtacaaaaaaaacacagtttttggtagccaaagttgtaacccctaactgattgcggctaaagttaaaaaagggagagtatgatttaatttgacaaactgaagtgtgaagaagcgacatgagagcagttctgaatatccacaaacaacataaccatagtatatcagcatttgttgtttcaattaagttgatgaaatcagatacaagtcatgagtcaattcaccaaggaagcaacatatagagacagagagcagcaaaggaaggaagcccttgagaatggaatggggaagaagttgcactccaatcgaatccaaaaaaagagggataattaagtcgtctaatcattcattcattcattcacttgatgtgcaggtcacactgcaagcactagtagttctagtactagaagatcaccaccaccagaatcaatcgatactgctgctcccactagcatactagcaatgtgatggatccgccatttacaaaaagagaaggaattatccatccatccatccattggaccggtggcctagatgtcgtcgtctagctcgttcttctcttcctctgcaccatcttcatcttcttggtcgtcttcatcagtgcctttcttgggtggctgatctacctcctgctcgcctgcgttgccaccaacattgttctcctgccatcacaatattgatcaattgtttgtccagtaaaaaacggagggaggaccggagggaaggcaaagagaaaggaaaaaagagcatacgtcgctgcgctcgccattgtggtactcggccttgagctctgcagccttgtccaagtaaggcttcttgtcctcgtcagacatggatttccacctctcccctccttccttggcgacagcggagacgctcttgttgtcagggtgctccgccttgtactccttcctgaagtcactcctgcatattaagcatatcatacatcttcttcttcttcttccatgggaatggaagccaagggaagggaaggaatgtttgttacttacatgaagaggaaaaaggcagtgggtgggcgcttgccctttttggccccctcgccattgttgttgttgttcttgccgctcttcttcttgctcgctgccacctccacggcctgctccaccacctgagcctctgtaagcacagatcataggaagaagatgacgatgagaatcgcagattcgtaggcagacaaagagagagagaaatgagcagcaacctaggctgatgcggatcttgtcgtcgaggctgcagttgtgcatgtcgatgaggaccacggagacgctcttgccgcaagcctcgctgcaaaccaaacccaactcactcccatgtttggattgtattggaaatgcaaatgaaagggggaaatcaaagaaaaaggaaacggactgaccagcgggtgaaggcgctgccgtcgcgcgcgcgcttcaggacggcggaatccgtcgcctccacgcgcttcctcgtgcgtgcgccggatttccccgccattacagaggagaggaggagggctatggatttggaggagatggaggtttggcggcgagtcggcgaccgccacgcgcttatataatcgaatcgaattgggggacccaaatccaattttatttgcccgctccccgctcgcgcgcaatctcttctcttggatgccgcgaaacaacattcattacttggcgccactccagccactcatctcgtccgttgagccttccatctcgctggatccgacggtccacagtgctcgctgggaatcaggagctccgcgcccacccaaattcccaaatccatccaaatttccaaatccccgcttcgttttggtttggagccaaactgaaagcattttcattttcaggtcggctttccctccatccctcctcttcagtttagtttggttccctttcaaggcttgctaatattatattctcaagtgcacatcttaagctataccaatttcatttctcgacaccacacagccacaaaacatcaattcaacggattgggatcacctgcagtaggaatagcgaccgcaagttaaactactgcatgcgattacagccgttcattttggtgatgaatggaccagatcttccgctacagtactgacgcaagaatattgaatatttcttgttacagtgttctacagtatccggatgcatttgaaccgttagattcggatctaacatgtggcagtggactgcataagggcatccacaatgtaggggagaagtgggtattaggaattaaaatattcttactactaggtaagatacatcgtggaagtagtaaataactactaccaagccataagcttgctacaggttatagcactttgtggtgggtcctacctaatttttaattgtgacatggctcatgtttggggttctttttcagataggtcccaccttattacccactctacacatatatacattgtggtgcatcttcaatctactattaccatcttacatgggcccaccttactacctacttttgcaacatacattgaggatgccctaagttgcagtgatagtactaactgcacatgatacaaatcccaattcaacaccagctgctgtcaatttcatttcttcatccaacgatccaaactcaagcaactattccctccgtctcattttaattatagccataattttccgtgcacaactttaattgcctgtcttatttgaaaaaaattaaaaacataagttacgtataaagtattattcatgttttatcaactcataattataaaaataaataaataagatagacgatcaaagttaggcgcggaaacttatggttgcagttaaaataggacaaagggagtagtactactaccactacagcaattcaccacaaatgccacccttttcaccaaaccacaaaaggtatcttcacacatatgtacacagctcatcttttttcactggaatgtatagtagcaaagccatttgggttagtttcctgagtacttctcatccacaacttaatactcagctaaactgtcttatattcaatgcagtgcatcatgaaccctaattcaatcttattaactttaattgaacatgaatatgagctaatcttcactaagcaataaagataagaagctaaacagattatattaggcttatttgactcgaaattgttcatgtcgaaccaagatggcaccgatggcttctaatcacatggatgatgtgaataaggaattgagtaggctaaagttaagctctaataccacaatgttggagttctaattcaagatcttattcttttagcatataaataatcacctttcaattacgaaaattaattctctgacttgagatgaagccattaaagccgatatctggttttgaaataatttcatttagaggctaaaataatttttcatcaactttatttggctaagaaggcttataaacaaatttcttaacattataagcattaaaattgacaggatttagttaaatttgctttcggcccagggcttccgaagctggcccaaacttgggccggcccgtctttgctcgagccgagtcagttcgacggctcgcaagccgagcaaccgagcgcggcccacatacgcggcaatggcccgatgcacttctgtggcccattgggctgcgtaatcagcggcggcagcggcccgacacagggcaaatctgaaccgtccgatctaatggacggctccgatcgtccctgcgccggatgaagcgccgaccgggagagaggagcaaaaccctagctcctaaatccttctctcccgatcccctttctctccggtgacgagagagcggaacgatggcgaaggcagcgatggtggtctagcgagctggtgcgtgtgggtagtgacgaccgccgagcagctcctgcttcaccggctggggggcaccaagccatgccacggcatcggcggtccagcgaggcgggcgcgcaaacggtgatgagcgccgagcggcccagatctcgtcggtagggcaacgccaatgccaatgcttctcgtctccggcaagggacggtggaagagtgctccaggacagcgcacgcacggggaactcgacgcgactgcgaggaggagaaggtgcggcggtgccgcttcccggaaagctctggtgagattataggcttcaagtccggtaagtaacctgaacccttagcttaattgatttcaattttgactcttagggttcttacccgaaattagggttttttgaatttggagaattttgtcgggaaatttcaatctattttattccctctttttaagtctggggagttttgatgaaacaattattattattattattattattattattattattattattattattattattattattattattatatgggtattatctattatattattaaaacaactttgaaaggaggcaccacattccctgtggaggctgaaaattcccacattactcggagaaaaagaaaaaaaagaaaagaagagtccaagtagaagtataatttaaaaatagatgaaattcggaattaaaaataagcaatattgaaagaagtttccatataagaatcaaatacaagattaatcaaaattcgaaataaaaataaaataaaatctaaaattagaaaaggaaaggagagttcaagtagaaatacaatttaaaaatagctgaaaatcggaattaaaaataagcaatattgaaagaagtttccatataagaacccactacgagattaattaaaattcgaaataaaaataaaataaaatcttaaattataaaaggaaaggagagtcaaagtaggaatacaatttaaaaatagctgaaattcgaaattaaaaataaggaatattaaatgaagagttcatataagaaccaaatacgaaattaattaaaattctaaataaaggtaaaaataaatccgaaattagcaaaagaaaataaaataagagttcaagtaggaatacaatttaaaatttgctaaaattcagaattaaaaataagcaatattgaaagaagaacccatataagaacccaatacgagattaattaaaatttagactaaaaaaataaaataatatccaaaattagaaaaattaaaagagattttaagtaggaatacaattttgaaacaattgaaattgaaaataaaaaataaaaacattaaaacaacacaatacaatatcaactaaatttttttaaaaataaattctgaaattaggaaaagaaaaataagatttcaattaggaatacaatttataaataactaaaatttgtgataaaaataaagactattgaaagaaaagactatctaaaacacatgatgagataaattaagtaacatggctataaatgagtagagtggtggcggttgatatgacatataaaaattgttaataaaacaccaaatagaatcctaatgacgattaaaaggagggatgtcaggcatgccgtgaagcaaacaagtaaggcggttgccgggacttctaaaagtaaaaaaaaacccattgataatcatttcaatttttaaaatctcaatgacaataaaaagaagaagcagcgtgcggggtgtataagagtatagttgcagagccgccgacggttgatgggacttctagaaaataataaatgaattccaatgatagttatgttcaatttttagaatcataatgacaataaagagtaagcggcggacgggctgtagaggggcatagtggcatcgtttgatgggacttttaaaaattataaaaaaaaactacaagtccaaattttaaaggtttgtaacttttaaaaagtaaaaaaaccaatgataatcatgtttgattttaaaatgtcaatgataataaagaagggaggcaacgggcgagccgtagaggagtataatggcaaagccgttgacggtttggattttggcggggcttatagaaagtaaaaatgaacccatacgataattatgttcgatttttaaaatctcaatgacaataaagagaagagacagagtggacgggtcgtagaggagtataatggcaacatttgacgggacatctagaaattataaaaacgaaacccaacgtgacaataaactctaaaaactataaaatacattttttaaaggttccgagaagaatggattgaaatagtggtagaatatagattgtcccaaagatgcaaaattgttttcttttttctttttattctaactcgaataagaagaagaggaaaaaattgcaatggatttaaaactagaacttattcttacgtaaatccattgggagatgcttctctagagtgtcccatatatgttttccatcttgcatacgaaaactgtcaatttgtcaattctcatcagatcttcttccgtcttactcaaaaggtcaaatagtgtatgaatattagcccttttgagacaattatacgttctagaaggcagttctaattgatcgataaaaatacaatcaatggaattctttttttgtttttctttagattagttaatcttttttaaaagcttaaaaggggaagtaaacctgtttttattttcttggaaacgaaaaaaaataaagaaggagatgacataagaggtagcaactggtgtgacttttaaaactactccctctgtttcgaaatgtttgacatcgttgactttttagcacatgtttgaccgttcgtcttattcaaaaaacttttgtgagatatgtaaaattatatgcctacacaaaaatatatttaaaaatgaatcaaatgataggaaaagaattaataagtacttaaattttttgaataagacgaacggtcaaacatatgataaaaagtcaacggcgtcaaacatttcgaaacggagggagtatataattagaaacacgaggatgataaggtttggtctttcaaagtcttaagacaatgagacagctatttaataaattttaagtgaaatcatactttaaaaaatatatgatctagtttgatatatatatatatatatatatatatatatatatatatatatatatatatgggtttattttaaaaatttttttattattatgagtagttaattacagtaaaaggggaaaaaagagagaagggaaaaggcgacggcagaagagaagagaagaggcgggatctggattgtggagatcgaggatggtgaagacggtggtcggcgacgaggcgcaggtcaaggcatcggaggaaaccctctcagcttccacctctccagctcaggtttaccctactctctcatcgccggcagccgcagccatggccagattcatcttgatcttgatcgcaggtggggctcgtcgtcggcaagctcagcgcctcttccgaccgtgccctcgcctactccctcatccccacgccgcccaccgattccggcgctcccgcttgctccctcctccgcgccaagcccgccgccaaagctgcctcttccggcgcgtcctcgtcgctcgacttcgatgtcgactggctcgccgagcacgcgcgccaggtactaactaacgttccttcccaacctagctaagctacctcatcacaatgccaaatccttttattgtcttcctcctatatcagatgcacaaacccaatattttcatatatcaaaatctgatgtaacaatcacaacccccataatagtattgcaaatcggaacccccttagtctctctcactcatgaactttacgtgggtaagatgcgagcccccttttccctattttgtcttggaaacatctgaatacataccttctatcaatcacaggtctcgaggatgcttcttggaggaatgaccgtcataggtatttacatatgggcgtcagaagcttcattcaaagcgacttcccctgctgttttatcacaggtaccaaccttctccttccattgataatatgggttttgggagtcaggtttcatctttatatcatgccattttcttttgttttcgcatccacgccttttttttcccaatgatgcctcgtaatgtggcatggacctgtaatgtaaaggatagtttgcttctcctattttccaggttcttagagctgtttctcaggtagctcctttgtatggcactggtgttgatgagaggctgctcattcatatttcttacagcccaagaaggtgctccactatttattttttgcggctattgcattcttacccctactttgaagttcaattgtgattttaccctcgttttttagggtttgtatttttacccttgtttttttattgaaatgaagaatagatttgcccctactttggatggctgtgttaacggtgttaagtcgagtaccaaaagacatttatatccttgcttctattgcagattttctcttacttctgaacaaacaattgtgtttttaccctttatacatgaaacttggaactaactgtcgaaacaagatttcggcaatataaaggggtagcgcacgagacctaaaagtggatggatgcggagacaaggatttagacaggttcaggccctctcaatgagaggtaatactctactcctgtttgaggatttgaatccgccggatgtagtattgatctgacaatctggttgtgaatcatgccccctagagggcctcctgcccaccttatatagaatggggggcaggattacaagatagaaaccttaaccaatacggtatcggtttcctaaatctactttacaatattatcaaaccaggattttaggccgttccataatatacaaggaaacataatacccaagtcatgatccgttacatatttcatagatataagttatcccctataaccagtcagataaccgggtatggggtacccataatctccacactaacttgtacacaacgttttcttgactaatctctcgtcatctcgcgatgctgctacatcctgctcatgtgctccactccaggccgtatttgccggtccaaatgcttctctaactgcaaaaccatgttgatacatacatcaatattatagtttgtttgttcttaagattaatcaagatgtgcacacaagaaagtatgtttggaagaaaaagagaacaaatagcatctggaagactgaagaagtaggaggcttactctgcacgcgtcgacgaccggccaccgtggcctgcttctcgcgccgctgcgagtcaccactgcaaattgctgctagcgtcggggagatgtcactgctgccttctgctcgtgaagccgccgccgcgccctgctgcttgcatcgaggtgcgcttacctgcttctcgtgacaccgcgccgaggagcggccgctggggcttgctgctcgcgtcgaggcacgctgagaagccgccgctgctgcctgctgcttgtgttgtcgagccggctcgccggagccgcctccgccacctgctctttctcccctagagtttggggattccttggtgtgggataacaaatctgaccaaacatatttactcaagggtagattgggaatcccatatttcctaaatattttttcccttttcatttatatttctttcacttgatattgtgggaccaccaaactaccgtttaaagtaggggcaaacagtgacttcgtttagaaaaaaacaggggtaaatatgcaaaccctaaaaagtaagggcaaaatcacaattgagattgaaagtgggggtataaatacaattctcccttattttttcctacattactttggttccttctttaactgtccatgttctagaaccatgagctagaaaatcacttttttctttaactagtaccatttctactttcttagttcttttttccttttgcttcatgtggttcagcttgcgttctgtctatagcctaccccaacttggttgggcctaaagcctgatgattttattgtactttgtattcttctccaagtaagttatatggggtcagttgtccgcttagcacttgaatcaagctttatcacttggtgagcctggtcgtcaccaaatcagttgacataaatgaaaatttagtgtagttcagtgttatggtggttctggtattacaattctccttcttttgtatgccaactgatgatgctgctcttcaaattctgccctgctcaactgcattttgagttaagctattatattttaggataaattctcagtacatgctgacatgcacacctcataatacaaaatgaaaattttgatgtgttacaggtgggcctgtcgtatatgtgatatgagctcaggacgtttaaggccatgtgacttcaagtatagtaaactattagcttctcttcaaactttcagatgcacatataattttgagataaggtactgctttttgaattctgacgcatccttagatccaacaattcttgtctactttatgtcacaaagctagaaaaacaccattcgatgaagtgttctggactatcaaacattaaagatacataaaaaatcaactatgcatatcagttttaatgtgtcacatgcactttagttaatccatgcatttggcaatagtacatttccctgtattgcaatgagatcccttctgtcacattctgactgatgacatacaatttgcattgcatactgccatagactgccagttgttcaagctgagccttttaagaaggttatttcgaaggcaatcagtcatctcacgaagcaagtgcagaatgccaaagctttgattgatggagtcctggtatttacacaacttcttagcccttattcagctggagaagtgaaaaaaaagatactatgagtcagaataatttgcattgtcttagaattttggagtcctctagttttgtttgtgcttgacatcctctcatagttataatgtattttcaactagtttttggatggcatggacaacactttggagggaccacataacgttgaatttcttgtgcctttcaagaacaatttgcctgccgaaggtgccctagctaatgctatttcctattatatgtgatgatcagtttctctttatgtcattatgggagccttatggtaaatgcttgcactaaagaatgcagtttagaaggtgttgctgggctacttctctttgctggatctgtcagcgccttggcatacctgggcccaaaagagtccattgcagaagttatatctgatctaaaggtagttataatatactaatttccattatttatcactgcaccttgtcactttttcccatgatggactagccagaactttataaccaccttcacatgctaagcttctatgattgaatctgattgattatcaaggaagtggcaatgcatttagtggtgaaaatgtgagcaagctcttcagttaggatttcagcactggattgggaatttcaagaatctgatcctggaaaaaaaatactgaaacttgagttgtgactgtaatgtagctatatgtcttgagttaaggagctttatggctactggaattttgattctgaggtataatttttttaaagatgggattcccttatatggtactgaatagtgaataatgtccaaagggttcatatcatgaatctcccttgcattggttgatttctagtcccaaccatcgttttatagaactactcgaacacttgtcgctgttcagcaaactaattagtgctttgtgctgtctgtcgacctgtgcgtattcagctggacatcatcacaagcctgagaagcagattggacatcatactagatgaggcagatgatgactctactactaacaatttggagaattcactgtctcagaaggccactcaagttgtttttcatgagttgaggtacttcatattttccatgggacatttatattttggagtgaatcaaagtacacaaaccatgtcttacattttcaagaagtcaggcctgtttggtgttatggtccaaaggaacatatcttgatgatattaaattaaagcattaagatttcctgtatttacaatagatagaacaacaaatatgttgccacttagtctgttgttttcttcatgatctttgcaatgttttatgcagctgattacatccttcttttcgcatacagagcaccttacagttttccattccctagaagaattctgataccttggttggctggctcctatatttgtgactacttgcaacaatcagaaacaatggaggtatttgttttttcgtgtagctaatctgaatgcacaaggggccttttaattgtcttaattgtcaaagcctactagtaatattccaattcttctagaaca

SEQ ID NO: 68783 - DNA, 1105 bp, Oryza sativa
tctgggtatgcgtccttggattgctgttgcatattcagctcctgttgcagctgctactgctgttttcttgatttaccctattggtcaaggaagtttctctgatggtatgcctttaggaatatctggtactttcaactttatgattgtattccaggcagagcataacatccttatgcatccatttcacatgttaggtgtagctggtgtattcggcggttccctattcagtgctatgcatggttccttggtaacctctagtttgatcagggaaaccactgaaaacgaatctgctaatgagggttacagatttggtcaagaggaagaaacttataatattgtggccgctcatggttattttggccgattaatcttccaatatgctagttttaacaactctcgttctttacacttcttcttggctgcttggcctgtagtagggatttggttcactgctttaggtattagtactatggctttcaatctaaacggattcaatttcaaccaatctgtagttgatagccaaggtcgcgttattaatacttgggctgatatcatcaaccgtgctaatcttggtatggaagtaatgcacgaacgtaatgctcacaacttccctctagacctagctgctcttgaagttccatctcttaatggataaggcttttctgctaacatatagcaatttttgaagaaaggaaagctagaaatacccaatatcttgctgaagcaagatattgggtatttcttttttttttattttgaatctttctattctgaattcagttaacgacgagatttagtatcctttcttgcactttcataactcgtgaaatgccgagttggtacgaattcccccaatttgcgacctaccataggatttgttatgtaaataggtatatgttcctttccattatgaatcgcgattgtatggccaaccattgcgggtagaatgctagatgcccgggaccacgttactattgtttctttctcctccttcatattgaccttttctatttttgccaataaatgatgagctacaaaaggattcgttttttttcgtgtcacagctgattactcctttttttccattttaaagagtggcattcga

SEQ ID NO: 68784 - DNA, 774 bp, Oryza sativa
aatagagaaatagaaaaaagtcctttcggatgaaaatggaagaatattacgccatatatcccacttggacaaattagaagcaattttctcttatcctcatttgttccttcctttagataaatactcaaaatccccttacaataatgcaatttcgaagggaccttttccctcgtgttgagaaaacttttcttcttccaattcttcttcattcaattcatttcaaaaaattcaattggtactcaaaatacttccattggtatgcgcaagaaataagccaattcggcagctttttgttcaatttctcgtggagtaaaaaacttctcatcagtacgagtcaagggaatggccccctggccccggatttccatataaaggatacgacgaggaaaaagaccttctttaacctgaattctaattgattggatatcccgcataaggaatcgaaggaagacgcgacgttttattccagggaatccccaacgaaaaatgcacactactccctcttttctatcgaatcggtcataaccactgcctacattccacaaaatagtgcaccacaagtaagcgctaatgaataggcctgcgattccgtagaaagacatcacgaccccctgtggaaaaaaaagaatttgttgagatggaagtacagatataatattcttaccaagataactggaagccccaaccgctaagaatcctagtgaacctagaaaaagaatacaggcccagaaaaaattacctctttttcgagaaccttttagaagttctatccat

SEQ ID NO: 68785 - DNA, 766 bp, Oryza sativa
acctttatatcttctaaatatatagaatagaggaatcccgatttgtcaagtctcatgatcgtatcaaaatctatttaaactcggctcaatcttttttcagattgagccgagtttaattgcaatcaattagaagaaaaaagaagaattactgcattttcgtaactgatttttgatctttctatttctcttcttttttatttagaccttttttctatctaattttatccacttagtctagctatctagtttatctaccggctcgaactcgaatttgatcgctttccatatttcacaagctgcggctagttcaggactccatttgcaagctgatcggataatttcattaccttcacgagcaagatcgcgcccttcgttacgagcttgtacacaggcttctaaagccacccgattagctgctgcaccaggtgcattaccccaaggatgtcctaaagttcctccaccaaattgcaatacagaatcatctccaaagatttcggtcagagctggcatatgccaaacatgaataccccctgaagccaccggtataacacctggcatggatacccagtcctgagtgaaaaagataccgcgagcacgatctttttcaataaaatcatcgcgcaataaatcaacaaaacctaaagtcatttcgcgttccccttctaacttacctactactgtaccagcgtggatatgatctcccccagacatacgcaatgctttagctaatacacggaaatgcataccatgatttttctgtctatca

SEQ ID NO: 68786 - DNA, 4536 bp, Oryza sativa
  unsure (1)..(4536): unsure at all n locations
tagtaagccccccccaagatgagtgctctctcctccgacttccctagagcctccggtagcacagccgagacagcgacgggttctccacccatacggggatggagcgacagaagcatggaaataggataaggtagcggcgagacgagccgtttaaataggtgtcaagtggaagtgcagtgatgtatgcagctgaggcatcctaacgaacgaacgatttgaaccttgttcctacacgacctgatcaaatcgatcaggcacttgccatctatcttcattgttcaactctttgatgaaaagatgaaaaaaccaaaaaaaagctctgcccttccatctcttggatagatagagagggagggcagaggcctttggtgtcccttccagtcaagaattggggcttcacaattactagccaatatttctctcatgcctttcctcgttcatggttcgatattctggtgtcctaggcgtagaggaaccacaccaatccatcccgaatttggtggttaaactctactgcggtgacgatactgtaggggaggtcctgcggcaaaatagctcgatgccagaatgataaaaagcttaacacctcttatttgactttttcactattttgaaatacgaaaaagatccaaatccaaaatgcaaaggtcgtcttattcaaaacctcaatcatcacatcccctctctcccacttcacacctcggaacgcactgttcttatagagagaaaggggctttcccatcttcttaacccgaaatgaaatggctgaggagagggaggttccttttggggggtacccccgggaagagatccagtggagacggggtgggcctgtagctcagaggattagagcacgtggctacgaaccacggtgtcgggggttcgaatccctcctcgcccacagccttccaaaggggaagggcctttactttccccctgagggtaggaaaaccatgatcgggatagcggacgtaaagctattgaacttgggtatgctctttccttttgtcgaagtggaatcgtagaacagaatgtgatacgatgagataaaatgcaatagaaacaaggatagcgaacgggttacctactcctaagggtcaaagcaagccctttaattcaattctttattcttacattaaagaatgaatcaaatctccccaagtnnnnnnnnnnnnnnnnnnnnnnnnnnnnnnnnnnnnnnnnnnnnnnnnnnnnnnnctgaggaacaagggggattcgacctcctagagttcaactcccgctctcaacccatgaacaatatgagtccgaagcttctttcgtaactcccggaatttcttcgtagtggctccgttccatgcctcatttcataggtaagcccagagtggctctatttcattctatttcacttcctagcacttcctatcatttaatatccatccctttggtcttattgacataagagatgtcatttatagtctatctctttctatatatggaaagtcaagaaattctcatcgaaacatcgagaaattgtgcatatagaaaactctaaagaaagaaaaaaaggagacccatgccatgattttcaaatcttttctacttagtagtctaagtttctcgatgaggataattaattcggtcgttgcggtcggactctattatgggtttctgaccacattctccatgggtccctcttagatcttctttctccaatcttggattagggaagaaggagatattcgcgactcctggtggtttcattatggggcagctcatgatcttcatatcgatctattatccacctctgcatctattctttcttagctaaacgggtggaagatccatccaatttggttatatcatggactcaaaaaacggatctgaatgtgactgaaatgcacgatcttcacaggtatcacttttcacgatacctaaaaggtggaatagcgattttcgaaccatttcctataagagaaaggtttccattactttgagaaatggattctatatcaaactatagctattgcattaaagaagaaaagaaactaatagaagtcgaagacgcggaatggtagtgaatagagagaaagattcttctggttttcttgttcctgaaaatattctatctatctcctagacgccgtagagaattgagaattttcatgtctttcaattctcgtactcgtaattggaaagttacggaaggagatccatcattttgcaatgaaaactacataaaaaactctggacaatttcgaaatcaggccaagcgtcttaatacatatgcaaaaaaattcattattggcccaccattgattagaagatttaacttgtatgaatcgctattggtttgatacgaataatggcagttgtttcagtatgttaaggatacagatgtatccacaattcatttagagttacttaatagcctatttcttataccatatctctatcccgtgaaattctcgagccgaaagatggatgcatatgctatgtttcattttgctaaatgatatcaattaaacggtgtatcaattccataaattggatatagcaataaataaatcagcaaaattcttttattttagatagaagaaacttttcttctatctaaaataaaagaatgtacccttctatccaaatccaatttgcatcgataaaataaatccaaattccagtagtagatgaataattgcaaatttttgtgtgtacgagattagaataacttcaaaataactgacataattttttatttttcctgatcagaaaaatacatgaaaaagaaaggaggtagaaaaatttttggatttatggttaaagaagaaaaagaagaaaactggggttctgttgaatttcaagtattcagtttcaccaataagatacggagacttgcttcacatttggaattacacaaaaaagatttttcatcggaaagaggtctccgaagacttttgggaaaacgtcaacgtttgctggcttatttggcaaagaaaaatagagtacgttataagaaattaatcagtcagttggatattagggagcggtaatttcatcgttcgaattttttttcttattttattagtagtcttatagtagtcttagattttgcattttgatgagcctcgttttgaggaattcatggaataatccattttcatggaataatgaattaaggaagaaaggatatgagtctaccgcttacaagaaaagatctcatgatagtcaatatgggccctcagcacccatcaatgcatggtgttcttcgactgatcgttactctcgatggtgaagatgttattgattgtgaacccatattaggctatttacacagaggaatggaaaaaatcggcaaataggaaagctacttaggcaggagataggggaattccttaagaaagaaaaaagaataagaacacagatacataacataaaaaaaagaataaataagacgaaattcgacctccccctacatatttaatttcttctcctatacaaaaactagcaagacctactccattggtaattccatcaatgacacccttgtcgaaaaactgcgttagttcggttaatcctcttatacccaaggtaaaggtcctagtatagaaaatatctatataaccgcgattatatgaccaactatatatctttttttttagttgatggaaaaaatactttttcggacccccttttacaaaggaatttattaaatccaaattctgaaaaaaagagtaagcagatccataaaacatatatgctatgaatagaccaaaaatagctagacttacagaagaaattgcattagtgataaattcatatgaatttatggaagaattagaactttcttggaaaaagttgattgagggagttagccactttgataatatggttaattcccctatttcattatcaaaatggattcctatagatccaataaacaaagtacaaagcagtaatataagaagaggaaatagcatagtatttcccggttcatgaggatagacaaaagtgtttttagtccccaatgaagtactaaaggaccctatcctatttcctgtattaacatgaattttggatagattttgtgaaaaaaaagaaactccactcttcgctgttgataaaacgaaatctctattgactcctttagatatcctttttccccataacgatattgaatacaacgaatcctctttagtactactgtaattttgaaaatgaacacgcaaatacccatcaaaagtaagtaaatatatccgaaacatataaaacgcagttaatcctgcagtaaaagaagctattattccaaaaaagggtgaatataaccaactattactaaggatttcatctttggaccagaagcaagcaagaggtggaataccacaaagagaaagggtaccccataaaaaacaagttcttgtaattggaatgtattttcttaaaccacccataagaaccatattctgacttttatctggtgaatatccaacaagaggttccattgaatgaataacagatccggatcccaagaataataaagctttcgaataagcatgagtg

SEQ ID NO: 68787 - DNA, 1486 bp, Oryza sativa
  unsure (1)..(1486): unsure at all n locations
ccaactatcaaggaattcctaaggttttgggcggaatgggaattgctattctttctacttctcgaggtataatgacagatcgagaagctcgactaaacagaattgggggagaagtcttatgttatatatggtaatcgccccgcctatagcggtaatcgccccacctatagttatagtacccaaattctatcttgaagcttcctatttttcaaacaaaaatacaacgtttttttatttgaaaataatcnaagaaaaataggagaaaaaaaaatatgacagaaaagaaaaataggagagaaaaaaaaaacccgagagaagcaaaaattactttcgagggtttagttatggaagccctacccaacggaatgttccgcgttcgcctagagaatgacaccatcatcctgggctatatttcaggaaagatccggtctagttctatacgaatactgatgggggatagggtcaaaattgaagtaagtcgttatgattcaagcaaggggcgtatatttatagacttccccataaggattcgaagcgtaccgaagactcgaaggataccgaagatttgaaggataccaaagattcaaagggttaggtttttcttttttttttctagggtaaaaaattcaaagttctaaaattcaaacaaagagacttattttttccaaaagagtaaattcatagtttaagaaaggaatacggaaatatgaaaataagagcttctgttcgtaaaatttgtacaaaatgtcgactgattcgtaggcgtggacgaattagagtcatttgttccaatccgaagcataaacaaagacaggggtaatctttcgaaaaaagaacttgactttctaaaaagtaaaaaaaaaagtacccgcgaaaatgtccaaattccaaataaaaaaattcaagtaaaggatatattttaccctgaaacggatatctttgtatctttttttctttttgttatttctaactcatatttatgagataataaaatatgacaaaagctataccaaaaattggttcacgtaggaaagtacgtattggtttgcgtaggaatgcgcgttttagtttacggaagagtgcacgtagaataacaaaaggagttattcatgttcaagctagtttcaacaatactattataactgttacagatccgcaaggtcgggtggttttctggtcctccgcgggtacttgtggattcaaaagctcaagaaaagcatcaccctatgctggtcaaagaacagctgtagatgctattcgtacagtgggtttgcaacgagcagaagttatggtaaagggtgctggtagtggaagagatgccgcatacgagccattgctaaaagtggtgtacgattaagttgtatacgcgatgtaacacctatgccgcataatgggtgtcgacctcctaaaaaaagacgtctgtaaaagaattaaacccctttcaagagaaataaacgattcaatgatcaaataataatactagtct

SEQ ID NO: 68788 - DNA, 1284 bp, Oryza sativa
gtatgcatgaaagagtcagatgcttcttctattcttttccctggcgcagctgggccatcctggacttgaaccagagacctcgcccgtgaagtaaatcatcgcccctacgatccaaccaattgggagagaatcaatagactccttttcgggagcgattcatccttcccgaacgcagcatacaactctccgttgtactgcgctcttcaagtgtgcttcttccccttctcccccttaccatggcaagtccttgggaaataactccgatgggcagaaaaaggaaggcgttaagagaccctcctggcccaaccctagacactctaagatcctttttcaaacctgctctgctcccatttcgagtcaagagatagataaatagccacatcccattgcactgatcgagggcgctcgtagtgacttagggagtcgaagaccaagaagtggcttatttataccaagcattcctcttatggctagatccaacctcctggtccctgcggaaaggaaaaagaatttcacgttcttcctttcaggaagggaggattagggaagtcctattgattgctgctttctccagaccgccgggaaaagcatgaaaaaaaggctcgaatggtacgatccctccgtcaccccagaatgaaagggtgatctcgtagttcttggtctgtgaagatgcgttgttaggtgctccattttcccattgaggacgaacctcaacctgtgctcgagagatagctctccatacactgataagggatgtatggattctcgagaagagaggagccgtagtgccccccccggaccgcccggatcccacgagtgaatagaaagttagatctacatgggatctcacctgaatcgccccatctatcctcctgaggagaagtttgtttggtttcaaactccgattcaaacaggaggagtacgccatgctaatgtgccttggatgatccacatcttcgggtcaggcgctgatgagcacattgaactatccatgtggctgagagccctcacagcccaggcacaacgacgcaattatcaggggcgcgctctaccactgagctaatagcccgtcgcgcgggcctccctttgggaggcctgctacgccaaaagcgagaaaaactccatccctttccttttgacatccccatgccgccacaccacacgggggggggcatggggacgtcaaaaaggggatcctatcactatcaactaatctgttccgacctaggataataagctcatgagcttggtcttacttcaccctaaacgaaagaagacttccat

SEQ ID NO: 68789 - DNA, 2091 bp, Oryza sativa
ccatgagattcatagttgcattacttatagcttccttattcgtagacaaagcggattcggaattgtctttccttccaaggataacttgtatccatgcgcttcagattattagcctggagttcgccaccagcagtatagccaaccctaccctatcacgtcaatcccacaagcctcttatccattcccgttcgatcgtggcggggggagtaagtcaaaatagaaaaaactcacattgggtttagggataatcaggctcgaactgatgacttccaccacgtcaaggtgacactctaccgctgagttatatcccttccccgtcccctcgagaaagagaattaacgaatcctaaggcaaaggggcgagaaactcaaggccacccttcctccgggctttctttccacactattatggatagtcaaataatgggaaaaattggattcaattgtcaaccggtcctatcgaaaataggattgactatggattcgagccatagcacatggtttcataaaatctgtacgattttcccgatctaaatcgagcaggtttccatgaagaagatcttgttcagcatgttctattcgatactggtaggagaagaacccgactcggtattcttaaaaaaagaggggaagcagaaccaagtcaagatgatatgggtcgccccttcttcttgcgccaaagatcttaccatttccgaaggaactggggctacatttcttttcaatttccattcaagagtttctatctgtttccacgcccttttttgagacctcgaaacatgaaatggacaaattccttctcttaggaacacatacaagaaaaaggataatggtagccctcccattaactacttcattttcatttatgaatttcatagtaatagaaatccatgtcctaccgagacagaatttcgaacttgctatcctcttgcctaataggcaaagattgacctctgtagaaagactgattcattcggatcgatatgaggacccaactacgttgcattgccagaatccatgttccatatttgaagagggttgacctctgtgcttctctcatggtacaatcctcttcctgctgagccccctttctcctcggtccacagagaaaaaatggaggactggtgccgacagttcatcacggaagaaagaactcacagagccgggatcgctaactaatagaatagtactactaactaatactaatatatagaaatagatatctagaaatagaaacgaactaatatatagataatcgaaattgaaaagaactgtcttttctgtatactttccccgttctattgctaccgcgggtcttatgcaatcgatcggatcatatagatatcccttcaacacaacataggtcatcgaaaggatctcggacgactcaccaaagcacgaaagccagttagaaaatggattcctatttgaagagtgcctaaccgcatggataagctcacattaacccgtcaattttggatccaattcgggatttttcttgggaagtttcgggaagaaattggaatggaataatatagattcatacagaggaaaaggttctctattgatgcaaacgctgtacctagaggatagggatagaggaagagggaaaaatcgaaatgaaataaataaagaataaagcaaaaaaaaaataagtcgaagatagaagagcccagattccaaatgaagaaatggaaactcgaaaaggatccttctgattctcaaagaatgaggggcaaggggattgataccgagaaagatttcttcttattataagacgtgatttgatccgcatatgtttggtaaaagaacaatcttctcctttaatcataaatggaaagtgttcaattagaacatgaaaacgtgactcaattggtcttagttagtcttcgggacggagtggaagaagggcggagactctcgacgaggaaaaggatcccttcgaaagaattgaacgaggagccgtatgaggtgaaaatctcatgtacggttctgtagagggacaggaagggtgacttatctgtcgacttttccactatcaaccccaaaaaacccaactctgccttacgtaaagttgccagagtacgattaa

SEQ ID NO: 68790 - DNA, 911 bp, Oryza sativa
ctgtgatatgagttaccaccccttgatcacttatagtaccccaaacatccgactgcattttccaactgaaatggaaaatgactaccgaaatggaattgtacatccagaatagacctaagaaaacatgatcccaggcggatacttgacatgttccccctcgcccaggcccatcgcaagggaagcgaaaaccaagatttgctttatcgggtatcaaacgggaactgcgagcaaataaaacacctttcaaaagtattaatacagtcacatggattgtaaatgcgtgaatgtgatggactaaaaaatctgcggttcctaatggaataggtaacaaagcaactttgccgcctactgctactaactcgccacctccccacgttaagctggtacttgttgttgcaccaggagctgttacgctaggcgcgccagcatggagattttgtacccattgagcaaagatcggttgtaattgtatggcggtatccgaaaacatatcttggggacgacctaaagcactcatggtatcattatgaatgtataaaccaaaactgtgaaaacctagaaatatacatacccagttaaggtgggatatgattgcatcacggtgtctaaggacacgatctaatagatcgttgtatcgagtcgttggatcatagtctcttaccataaaaatggctgcatgtgcagcagcaccaactattagaaatccgccaatccacatgtggtgtgtgaacaaggaaagttgtgtaccatagtcagtagctaggtatggataggggggcatagagtacatatgatgagctacaacaatggttgtagagcctagcatagctaggttaagagataattgagcatgccatgacgttgttaggatttcatagagacctttatggccctgtcctgtaaatgggcct

SEQ ID NO: 68791 - DNA, 1050 bp, Oryza sativa
ttccggcgaacgaatcatcattaagtcctcctctttccggacaagacatacaaagagacccgccaactttttagtgaacctttgaaagatagatattatgattagtccttttctttactatctaccgtccttctatttttttttagttattcactggagcaattatatattgaagtcaatctgaggcaagtgttcggatctattatgacataaggattgggtgcctaacggactttttttatcttggatttctccacgtaacaaaaaaacctttttttaatttaaaaagctagtctattttttttaagagtataagtccctatctatatctactttccttgagcataatatagatttttttattcgattccaaattccaagataactcattagaattattaataagatggtcctgatatattagcaatatttatattgcccctttttattcgctttattacttctattctagaccctatcgtttatccttatgaaatataatataaaatagaaggcagaggaaagagatataatgaaattcttgattcgatcttccgacctaatttatttgattaatggatcaacaaccaaacccccattttctgaaaaaggagagtggtcttattcaaattcaaagcgcttcgtaatcttcaaccagttctgtgcttcaatataatttcccggagtaagcgctatagcttgtttccaatactcagcagcttgatcaaaccaagcttctgcaatttctgaatcaccctgtagaatggcctgttctccccggtcggaataggtagttccttcccctagaaccgtacttgagagtttcctacctcatacggctcagaaattgctatcttaatttcccttgtcttaactgaattcgatttctcaaaaatcgatccaatttcttcttgggttacgcagaagaagttaattacctaagtttcaaaccctaaattttgatcaataatcagtttgatcttttctcccacctgcagaaaaatgaagcatagatagacctatatccttcgtccgaattttctgaaaggt

SEQ ID NO: 68792 - DNA, 838 bp, Oryza sativa
taaatccattttttttcttccataaaaaagaatatttgatccatagaaataaaagaaataaaggataaaaagaaaaggggaaatatctttctaatctatatctctttcattcctctcttacaaacaaaagaccttttcttattggttattgaaaggtggattattatctatttttagcgataataaatcgcgacatactagttatgtcattctcactatacccccatacgatacgggggtatgtagtatatgattcgtctatttcttagagtaggacaggcgaatattcttattcttatggttccatttaagaataagtatgccatacgccccgcggggattgtagttcaattggtcagagcaccgccctgtcaaggcggaagctgcgggttcgagccccgtcagtcccgaactagggttcaatgaatggagaaattcatctttcctttttccatgaaaaaaggggggcaggaagcaagatcaaatacctatggggtacccctatttcactttttttagttcgcgtttctcagtaaagagaggagagtataggaatttttttatcactacttctggttgatagcgaaagacatacatatcatacgtggaagggatcctcctatgttatactattccactctcaaccatgaattgatttgatagatccgatattcataatattgaattgattcagtattatcagaatgcaagtcctccccttgaatttacaggatacccttttccctctccatgggattacatcccgagttattgcgaaaaaaaagaggttatggaagtcaatattctcgcatttattgctactgcattgttcattcta

SEQ ID NO: 68793 - DNA, 1115 bp, Oryza sativa
cggtaatggtagtatcttgtacctgaaccggtggctcactttttctaagtaatggggaagaggactgaaacatgccactgaaagactctactgagacaaaaagatgggctgtcaaaaaggtagaggaggtaggatgggcagttggtcagatctagtatggatcgtacatggacgatagttggagtcggcggctctcctaggcttccctcatctgggatccctggggaagaggatcaagttggcccttgcgaatagcttgatgcactatctcccttcaaccctttgagcgaaatgtggcaaaaggaaggaaaatccatggaccgaccccattatctccaccccgtaggaactacgagatcaccccaaggacgccttcggcgtccaggggtcacggaccgaccatagaccctgttcaataagtggaacacattagccgtccgctctccggttgggcagtaagggtcggagaagggcaatcactcgttcttaaaaccagcattcttaagtttaagatcaaagagtcgggcggaaaaaggggagagctccccgttcctggttctcctgtagctggattccccggaaccacaagaatccttagaatgggattccaactcagcaccttttgttttgagattttgagaagagttgctctttggagagcacagtacgatgaaagttgtaagctgtgttcgggggggagttattgtctatcgttggcctctatggtagaacccgtcggggaggcctgagaggcggtggtttaccctgtggcggatgtcagcggttcgagtccgcttatctccagcccgtgaacttagcggatactatgatagcaccgaattttgccaattcggcagttcgatctatgatttcgcattcatggacgttgataagatccttccatttagtagcaccttaggatggcatagccttaacgttaatggcgaggttcaaaagaggaaaggcttgcggtggatacctaggtacccagagacgaggaagggcgtagcaagcgacgaaatgcttcggggagttgaaaataagcatagatccggagattcccaaataggtcaaccttttgaactgcctgctgaatccatgagcaggcaagagac

SEQ ID NO: 68794 - DNA, 1117 bp, Oryza sativa
ttctttagtaactctaccaagggctatagtcatagtgatcctcctattcaattacttcaaccatttccgagcaccttatatcacttccaaggcatacgatagattatctgtggacgattttttctcgttcaatgccttttttcaatggtctcgaagatagaaattttgcatttttatctatggggtcacagccgaggtcgtggtaaatccatgaatttgattcaattagtttttcttatactatagaaataaacattggaattcaggattattccatgattcctatttccaagaaagcctattttttaagggaaaaatgaaaaaaagtaacctcccttttcccactcgctctctattgcatgggtataagaacaaaaataggattctgaaaaaaagtaaagatattgaaaagaaaaattgactttcgaaatccatttttatgtgtagcggaaaggggttgcgatttcttcttattcctatagaacatctagtaacaagaatatgaaatagtaaatagcgagaaattcttgccttgcgtggtctaagtctaaggaaatacaaaaaaatccacttatacaatttcatctacatcgaatttatatatcagaatagcggatagaggcctcattcaaggagtcaggtccacttactttatctttctttccaattttatggggtgggttggtttgataagacccctttttgctttgttgataaataataaaaaaaagagtttttttctataacctgcttgttttattataacaagtcctatatggaaatgcctgctgaagagaaaatctatctgattgtcttatagccaatatccaattttagaattagaaagaaaaaagaagaattttcttcttttttttattaacattaagaaaaaagaatataactaaaatggaattggcaatataatttttttgaacttttgaaagaaaaaggaaggattttttgcaatcgttatttcttgcctctgtcatatcacggaaacctttcgatttggaacggggagagatggctgagtggactaaagcggcggattgctaatccgttgtacaatttttttgtaccgagggttcgaatccctctctttccgccccctcggatc

SEQ ID NO: 68795 - DNA, 1117 bp, Oryza sativa
aagataagaactgctcgttagatagaatggattcaattttgatttggagttgcttctattaggtaaaagaaaaaataagtaaaagcaaagaccttaattttactttacaggaaatgcgttttttttacttcatttttttctttcttttggtattcgagtcgaagaaatacgagaattctataactaccaaaaaactttcttttcattgcaatagtttaactagttaatagttaattagttttgttacggaaaaatggtatggaaaaatagattgctaatctaatatattaattaaattaattaaacgggaggttgatagtttatttgttggagaagagtcaattcttctcttatcatttcaggattggattgatcatctcgagtcctctgttgaggatggaaattccataataaataagtcttaagcaaacttgtttattcccttttttcgaactatatttcattcatatgatagaatatgggtttaaataaattggctctttgcggagtctttcccgataaatacttaatttcttttattcatatttctccatagatagcaaagcaagtttgaattagtatacaaaaaacgaaactaatgactattcatgattccatccatattggatcaattccctataacactttgcaatgaaattagaggaatgttatgttaaaacttcgtttaaaacgatgtggtagaaagcaacgtgcgacttgaaggacacgatcgattgtggattttgctatccaccattttccatagtaatgaaaatgctcttggctcgacatagtctgttctattcgtcccgaaccgaattttcgctgggttgtttgtaagtaagctaagtaaatagtacacgatggagctcgagaggacagaatttattttttatcaagggaaagaatctagggttagtgaaaactaataaattaggccaactttgtcattctacccttaatatagaaatcgaaataatatagaaatcaaaaggttaaaataagaagaaagtccaattttggaagatatgggaaaactcttttgattaaaagtctatcagaatcaatcgctcatattcgatttctatagaagagggaaatgctttatcgaaggaaa

SEQ ID NO: 68796 - DNA, 1199 bp, Oryza sativa
taatacaatcccaacatttttggattccaaattcagagcaatacccctagtcccttctgcaaattcgactaattcgcctgacattatttcaccaagacctataatacgagcaatcccatcccccacttgaactacgcgaccgatattctcaatccctacttttctattatattgttcaatacgttcgcggagaattttatgaatttcgtcgactcgaagggttgccattagtgtttctttactatttttttttcggaagcaaggggaaaaataatgcctaaattctaaaggaaagtagaagttcaaggcctaattaatttaactcttccattccatggccccgagaatgctaatattagcacgaatcgtacggaaatgtaactcggtattcaaacaactattcagagttcctagagctccttgtacggcttgttggaaaacccgttgtcggacctgattcatcgccctttgtttttcaaaataaagggtttcgttttagacttttctaattgttccaaactaatagaagtggcattaatcaaatttgctttttctcgttctatctcagagtatccattcattcgatactcatccgcttctagttcgactttctgtaatcgaattcgagctttttcgagctgctcaatggttcctctacgcaattcttccgaatttcgaatagtactcaagatcctctgttttcgattatctaataaatcttttaatgaaagtagattaccttgctattaagtttacaacttttatgatctcttcccgaaccaaacatgaatctttcgattcatttggctctcacgctcccttttttctttttttgctatggctacttccatattttttttaatgtaatgagcctatcctctaccctctcttttctgtttatatttcaatataccgaaacccatataagactagataaatattaagaggactcttccgcctagataaaaatctatcgtgggcagcaaagttgtttttttatttgtatttgccctttagttaaaattttcaatttcattaagaaaaactaaatagaaaaatggaaaatgaaaatggatagaattcctacttttttcttcaaatccaaaaactttctccttttttatacataggtcgtcgattcggcattggataaaaaagggcagggtgccccttctagtaaatagttcaaaccattttat

SEQ ID NO: 68797 - DNA, 1326 bp, Oryza sativa
tttaattccagggtttctctgaatttggaagttgccacttagcaggtttccataccaaggctcaatacaatcaagtccgtagcgtctaccgatttcgccatatccccattttctttttctttgagaccaggattccttgtgcaatttcctccatctgttagttttttttgaatcgttgaattcattactctatgtagtctagcggttcgtctctagttgagagactccgcttattgcaattcagcattgaattgattctatcgttgatgtatttgcaattcaatgcgaatcaatatatcccaaggtttttctctcccccacctaccgcgttccttttttagagtattcaaaatcatactataacgcttgatattcattctttttttttgctaatcagaattagcaatttcatttgctatgattctatgttctccttagtgaaatattaatcattaaattattagcaaataacaaaaaaaaacaaaatatctcaaaaaatgtctataatgatggactgaaaatacaagaaattcgcatgttctctttattatgttttcgtatataatatatattatttattcttttccatgtattagattattcgtccgagccatatcaaattaaaaatatctaaaatcaaattcaatatagaaattggaatagattctattagaaaaatagatttgcgaattagagaaaaaagaaagttcaaaaaaatctatctaactttattttatgaagttctagtatttttttctaagtagaacttccaatttcgaactagttaatagctaagattaataattaagatctgacattttacggatttcctatactatacatatttctatttgttacactatttctgttatgtaagcccacttagctcagaggttagagcatcgcatttgtaatgcgagggtcatcggttcaaatccgatagtcggcttttttctctatcaatgttccatgaacaaaaatacctctttttctccgaattaaatggagaagccaggatctattatgtcgttctaccctacaattttgctagatacaaaacaataaaataaataatatatatacaaaaattcagatgttgatgaaattccatttttttgtggtacttttagtagattttactctgtttatcctttactttaattcagttttaatttcgatgtattctgtaatgtaaatacaatgaaattaattgtgtaaaatgaaatttcaataaaaaaaggagtcttcatgtcccgttatcgaggacctcgttttaaaaaaatacgccgtctgggagctttaccaggactcactagaaaaacacct

SEQ ID NO: 68798 - DNA, 1585 bp, Oryza sativa
ttcctcggcgatcgcgccaaaaacgcgagttccttttggatttcctttttgatcaatgataaccgctgcattgtcgtcatagcgtattattataccgtcttcgcatttgaactctttacatgtacgtacaattacagctcgaattacttcggatctttctagaggcatttggggcactgcgtctttgattacagcaacaataacatcaccaatacgagcatatcgctgattactagcagctcctatgactcgaatacacatcaattttcgagctccactgttatctgctacatttaaaagggtctgaggttgaatcatattattttgatttcaatttgttatttcaatgcaaaaggatgaaagaaatattgtctttccagaaagaagaacctggttttttattttcaatactactttttttggggggttatatttctaaccgaagaaattgacttcgtatgggcattttgctggcagctatggaaatagctgctctagctacagtttcggatactccgcccatttcataaagtattcgacctggtttaacaacggctacccaatattcgggggatccctttcccgaacccatacgtgtttcggtcggtcttattgtaaccggtttgtcgggaaatatacgtacccagatttttccaccacgacgtgcatatcgtgtcattgctcttcgtcctgcttctatctgcctcgccgtaatccaagtgggttcaagtgcttgaagagcatatctaccaaaacaaatacaattgcctcggtaggattttcccttcattcttcctctatgttgtttacgaaatctggttcttttggggttatagtcgatggttctctcttagttccatctctactgcaaaactggacatgagagtttcttctcatccagctcctcgcgaatcaaatgagaaagtgtgcaaatttctctaattccacaatattctaaaatattacggatagatacacattaataggaaaggttagggtttttaatattgaatttattaaaatactaaaatatatagtcaagaaagaggatctagaatatatctagatgtgtatgtttatttatctatattctatatttaatgtaattctttttttttttttttttaatctcctttttttattttactcttattgaatcgcggtaaagtattctaattcaataaaaatttcgcgggcgaatatttactctttcctgtcttatttgttaattcataaccttatcaaataagacaatttttttggtttgttccgccatcccacccaatgaagtattgggattcttttcaagaaaatcctatccagtcataggttctgtcgttcccactgcttctcctttaatggttaggtttgaatctcgcaatggagcttccaaaaaatttctttccgagtcaatttctcagttttattaactcgggacgctctttgttattccttgaaatttgtatttcttgtttcaatcaaattacgatttcgaattctctgttatttttattatattgatgctttatcacattgctttttatgatgtaattcatagaccatacatattggaatcctatatctt

SEQ ID NO: 68799 - DNA, 3069 bp, Oryza sativa
ttagttaggatctcgacaatacgaagcaataggttggttattagttcattttctataattacatagtagggttcattctatttttttttaatcccctttttgaaccctaaaaaaaaactaacgagtcacacactaagcatagcaattttattaaaagatttctcaattttcattaaatcttatagaaagaggtagaatttcttctttttttcagggattttagggaaaataaggctcttgtcattttttattctattactgaacagaatgggaagacagggttggttattcttcgtctacgaatatccaaattttaactcctaatactccatagatagttcgaattggatagcagcaataatcaattttagcgcgaattgtttggaggggaagtctaccttttttgatgcactcggcacgcgcaatttcttttcccgcgagacggcctgcaatttttacttttactccctttatatctgtttttttagttaattcaatggcttttttcattgcctttcggaatgaaactctattttttaattggaaagctatatattctgcaagaatgttaggttgtctataaggttctttcactttttcgatcccaatattaagtctctggtttacagaattaacttctttttgtagatctttctctaattcttcgattgctccttttttctttaataaattggggaatccaatatggattatgacgtggattgtatcgatttctttttgaatttctatatgtgtaattacttcggaacttgagcctgagtccatttttttattatgtgtaattacttcgaaacttgagtctgcttctatttttctattcgagccctttttcctattcttttgtatatagttcttgatacaattccgtatttttttatcttcctgtagaccttcagaataattttttggttgtgcgaaccaaaaggaatggtgattttgggttgtaccaagtctgaaaccaagtggatttattttttgtcccatatttttctattctattttttttaccgggaatcaaatcttagatggatctaaagattatttcgatttctttactatatttagtacaattgttatatgacacatggttttttttatgggagaactacgtcctcgagcccgaggtctgaatttattcataatagtactcctactgacttcggctttagtgatgaataaatttgctttgtcgaaatccctataatgagtagcatttgctgctgccgaataaaccaactttaagatgggataagatgctcgataaggcatgaggttcaatatcataacagtttcttcgtagtaacgccaacgaatctcatccagaactctttgtactttgaaaacggactgtggatgcgtttttgtgctttgaaaacccgttcgaacttaagtagacgatcggttggtacttttcttgcgagtttccttagcccactcttcttcttctttatcctaggggtatactttaccagtttgaaacttgtcataaataaggttattccccgcttacctatttcttttttttttattttgaatctttctattctgaattcagttaacgacgagatttagtatcctttcttgcactttcataactcgtgaaatgccgagttggtacgaattcccccaatttgcgacctaccataggatttgttatgtaaataggtatatgttcctttccattatgaatcgcgattgtatggccaaccattgcgggtagaatgctagatgcccgggaccacgttactattgtttctttctcctccttcatattgaccttttctatttttgccaataaatgatgagctacaaaaggattcgttttttttcgtgtcacagctgattactcctttttttccattttaaagagtggcattcgatgtccaatatctcgatcgaagtatggaggtcagaataaatagaataatgatgaatggaaaaaagagaaaatcctttagctggataaggggcggatgtagccaagtggatcaaggcagtggattgtgaatccaccatgcgcgggttcaattcccgtcgttcgcccatcccattattgcaaattccaaaaatgcaattttccatattcctagttacgtatttacttacggcgacgaagaataaaactatcactatattttttccttttcctagttcttcttccaagcgcaggataaccccaaggggttgtgggtttttttctaccaatgggggctttcccttcaccgcccccatgggggtggtccacagggttcataactacccctcttactacggggcgtttacctagccaacacttagacccggctctacccaaacttttttggttcaccccaacattacccacttgtccgactgttgctaagcagttttgggataccaaacggacctccccagatggtaatcttaaagtggccgatttaccttcttttgcaatcagtttcgctacagcacctgctgctctagctaattgcccaccccttccacgtgtgatttctatgttatgtatggccgtgcctaagggcatatcggttgaagtagattcttcttttctctcaaaaaaccccttcccaaactgtacaagcttcttccaaagcatacggctttctagatgtatatgacgatctctagacagatggatcttatatgaatcgtatgatgaagtaccacatgagtggatatataggaaaggaatccaaatctgccgaatcgctcatgttatgatcttctacatcctaggtctccgcgttccgtcatctggcttatgttcttcatgtagcattcagatcgaatgactctatgaaattacgtcgatacttctacatattatgggtaacgtaggagacatccctattttcccccgggggtcttaattaccactgcttagctttcaattcgcctctgaccatcaaattaaatgtgaataacccgtcctcctctctttgaaacaaggggcgcttccggttctgtgcgtgcttcaaacaattttgtcttctccatattaccatatctctagagtcaataattttctatgaggaactactgaactca

SEQ ID NO: 68800 - DNA, 933 bp, Oryza sativa
acctccccctctatgccttgcggtaatgattcctctggaattacgacctttaccacaacggtgccgtccatggatcaaattatttcgtggattggatttcacttgcctatctatggttcccttgcgtgtgctcgggataggtgttttgtataaatgtttcgccgtattattaagtattctcctttagtttttttctctatctagaagtggaatagaataacccggttgaagggtaatgatcatacgtctgtaatgcattgtatgtcctagaatagggcccattcttctaccctttccgggtagtcgatggctattcacagctactaccttaacaccaaagaagagttcgacccaatgctttatttctgtcttagtgaatcccgattcgacattaaaagtatattgattctttcccaataaacgaagacttttttctgtaaatactgcgtatttgattccatccataaatcgactttccctcctatgctctgagttccagtatcgataagaattcgagttcttattgttcttatgttatggtatgaatataccataccaattcgttatgtatggatgatggatgagattccatggatagagagccagttccaatagacttatggaacgttccggttcgcgtgcatccagcaggaattgaacccgcaaatttaccaattatgagttgggcgctttaaccattcagccatggatgcttaacagggatcatcgtacatcgtaaataaccaattttcatatagaaagacatatcatagaaaaatgaaatcgaaaatattcggagatggcaaatattcggagatgactatgaaaacacctctctggatcctcgaattgaaagagagattgagagggatccagaatcctaattctcgctatttggaatggatccaattctattgagtctgactcatagtg

SEQ ID NO: 68801 - DNA, 1306 bp, Oryza sativa
tgatcgctacttatgggcgtgcgctcaaaggatacaaacagggattcgcaaacaaaaaggggaattcgtagtcactttttcctgtcgcgtaaaaaaaaggctttacgcgagagcaatagaggttgggatacatctatctcttctgagcaacctcttttggattcttaagaccacccttgcagtaggataccgtctgctttgggttctttattatattatctccttcgagggatttttaggatcgttcaggctatatttagtctattttggcttttactgtctccttttctcagggaagtggttaaggacctcagaagatagaggagagcgccaggcgcagatttccggaatacttctacggggaatgctcattgaatgcgcattctccgtattatgccttgaagaggactcgaacctccacgctctttagcacgagattttgagtctcgcgtgtctaccatttcaccatcaaggcatcttgaaagtgaatcatattccatgaatatgatatctatctaatgtgatatcttgaaagtgaatcgtattccatgaatatgatatctatctaatgtgatatatggaatatatgacaaaggtggagtcttggagtatttcgatcgatcggtcatataggcctgagtcagacatcaaatagcttcgatttgcattatccgtaggacaccttatatgtatcaaaatcaaaaagatgtacaatccaatttctcgattcaatagaagcccaaagaggtgcatatggtacccaaataaggataggatagatatgtcaaaagcaggtctgattacacctattcctaatcctaaatagaatgtaaggacgtggggatttctatgtaaacagagtatcctatttccataggctcgaatgaccccttctcataataagaatgtgcacggtctggtccggtatggaatgaacttataatctgatgatcgagtcgattccatgattataagttcattaccctagcgcccattcccattttgggcggaacagatctactaattcttttattccagttagtaagagggatcttgaactaagaaatagacctagcagctaaaagagggtatcctgagcaattgcaagaatggggttcattgatattcctggtatagtagatgctatcacacatacagtcatactcaattcgatggaattgtttgatcttaaaggggatcttctataatttcgcacataaggggttatttcttggtttcgtccagtcattaataacttgactatttttagataatagtagatagaaagaacgctcgtaaggagtcc

SEQ ID NO: 68802 - DNA, 1018 bp, Oryza sativa
tggacgttgaacccatttcatatgatgggagttgccggagtattaggcgcggctctgctatgcgctattcatggggcaaccgtggaaaacactctatttgaggacggtgatggtgcaaataccttccgcgcttttaacccaactcaagctgaagaaacttattcaatggtcaccgctaatcgcttttggtcccaaatctttggtgttgctttttccaataaacgttggttacatttctttatgctatttgtaccggtcaccggtttatggatgagtgctattggcgtagtcggcctggctctgaacctacgtgcctatgacttcgtttcccaggaaatccgtgcagcggaagatcctgaatttgagactttctacaccaaaaatattcttttaaacgagggtattcgtgcgtggatggcagctcaggatcagcctcatgaaaatcttatattccctgaggaggttctaccacgtggaaacgctctttaatggaacttttgttttagctggtcgtgaccaagaaaccaccggttttgcttggtgggccgggaatgccagacttatcaatttgtcgggtaaactacttggagctcacgtagcccatgcaggattaatcgtattctgggccggagcaatgaacctatttgaagtggcccatttcgtaccagaaaaacccatgtatgaacaagggttgattttacttccgcacttagctactctaggttggggagtagggcccgggggagaagttctagatacttttccgtactttgtatctggagtacttcatctaatttcctccgcagtcttaggcttcggtggcatttatcacgcgcttctgggaccggagactcttgaagaatcttttccattctttggttatgtgtggaaagatagaaataaaatgactacaattttgggtattcacctaattttgttaggtataggtgcttttcttctagtactcaaagctctttattttggcggtatatatgatacctgggctcctgggggagga

SEQ ID NO: 68803 - DNA, 2890 bp, Oryza sativa
  unsure (1)..(2890): unsure at all n locations
acatagccatacgaaatgactcactaacctctagaaacatctcaaatacaaatcccttttcgatatatttctgtatactgtatccatgtatacaggatccgctatatccgcttgtgaaataaagcataaaaccccctcaaccccatatccaaataaaaaaagtggtgagtaataagttttaaagagaagaatcaatggattcatgattaaacccctcctacttcttgtattttattacaattttgattaagtgagggatcaaatataatatgtagtcaactttatttgatggtaacttggaggattagaaatatgactattgctttccaattagctgtttttgcattaattgtgacttcctcagtcttagtcattagtgtaccccttgtatttgcttctcctgatggttggtcaaacaataaaaacgttgtattttccggtacatcattatggattggactggtctttctggtagctattctaaattctctcatttcttaaatgtgtttagtatttagtagcccgatacaaaataaaaaagggccgtttattcggattgtgagacgcattaaaatgcaatttgcgccccgaattgattgacagacaattaaattaataaaaagaaaactcaaatagaaaatgaaacggtcgacccagacatagacggtcgacccaggcggatataccctataaaatataggacgtagcgagcgtagttcaatggtaaaacatctccttgccaaggagaagatacgggttcgattcccgccgctcgccagcttaatttagtaaggtactatgataaaaaatttagtctacttttattaaagtaataggtgttagtctagtaccgtacccctttactatcttaaccccctttgcaccccactcaaaaaaagagcactacagcggcgggaatcgaactcggcaacagggttccctaaaccggggattcaccgaaacaaacaaccagcaaacagcttttaaagggaagggagatagactgtgcctttctttcatttattttttcttttctgcaaggtagggagggggccttgagagttcctcttgtggtagcaagttacttcgcaacctgctcaatttggccttatagggtcgggaactaatgaataaaaagggttggataccgcccaaccacccagccctctaccatgtctagacaaatagaatagttattttatacagactgctaagtgcggagacgggaatcgaacccgtgacctcaaggttatgagcctcgtgagctaccaaactgctctactccgctctggagcgctggaaaccggtggacgaaaaaggttgaatacaggcctctaccatgtctagacaaatagaatagttattttatacagaannnnnnnnnnnnnnnnnnnnnnnnnnnnnnnnnnnnnnnnnnnnnnnaggggttatagtcgacgttggttgattattattaacgtctctaattcaaaaccgaacatgaaattttgatttcattcggctcctttatgggtattctcaccacttaacatctaagtcagcttttttgtctgaatggaaccaaggctctctgctttctagatgatccctaaagagtaggagatagaaatttgcctaaatctatctatctaattacttcgttccctaatttcatttaagagatcctgaggaaaagaattgggtttccaccgagctgaaacaatatgctgatggttctagtaaaccaaaactaccgttttttagctatttggctggcatggccttttttaacaaaagaagatttagttacgattggaaataaatttttttgtatcttcatccatagatcctttactcatatttaaaaaattggaatccttaatccaatgcaaaattatgcttcgcgactctgtactcataatccaaatcctatttgttttttggatgcaatttcaattagtctttgggtacaaatcgcgaaaatgcatattcttcctcaatatgctattgagagaaaaaggagtaaatcctttctaagaactaaagttttcatcggaatataaaaaaccttaaggacgccttaagtatatcatttcaaattcagttattaatagaacgaatcacacttttaccactaaactatacccgctacatgtaaattctgataccaacgctaccctttgtcaagggtagccattcgagaaagatgctaattccctcttagttaatgaaacagagaaggttcctcacagttagcggttggtacttcgatcgcgggcctttcctttactttcttttttgttcagaattgaacaaagaatttggggaagaaaacatcttcccccacttatcatgaaatctgggccatagagaaagagtgagatgtttttttttatttatcatagacactttccctatggcttgagagaaacaataaataacttaaagaaaaaggcacataggagccgaaggatttacttgatgtaaagaagattctgaatgtctctgcttagtcgattctctccgtttaactttttcttctcttcttttccactcaattctagtttattagattcttgtttaaaagaatcaaagaagatgaatagaactaagaacacacaaaaaagaacatataggcccgagaccattaccaaaagttcttcccaataatcatattgggtatctgttcccttccttttcctattaggatggggcatgttggattttccatatccatataccatcgaaccttaagggttccagaaccctccttttttgctagttttcggaaacggaaaaccctgaaccaggagcagtataaattctactgcccgccttttacaagaaaattggtgataaaactccactacagtttgttcaaaatgcaccaatcagaatcccttgagaatat

SEQ ID NO: 68804 - DNA, 6375 bp, Oryza sativa
atcaagtcaaaatgaaaaaatccatggagggagagaaaaataatatgagaatagactatagtaaaagaaaaaaagtaaaaggaaaaaaccagcgaatctttcatgcttaaacatgtcgcgaaatgtttcaaaagagcataaaatttattttaagaactaagaataagaaaagaatataaaacaaatggaaaatgtgcgatatgttgggaatagctccgcggaagaaaatctaaagttcttatgtatagaacttttttaaccatgggtcgcttctagtagcgattatgaattgctctcaccgctctttctatttctattttctattctttctatttctattctactatatagaaatagaaatagaaagaatagaaagactctttcttacaagagtttcttacaggagtgaaacaaaattaaagaaagagagaaagaataaagttcggcaaaatgattaatgcaaaacggtcaattaaagaaaagagttgatacaacaattcgactactcaatcaattagtagtatccctagagtccactcctcccccatactactagtgaaagagaaaatgtaaagactaccattaaagcagcccaagcgagacttactatatccatgtaaattatgtctcctatttctatgaaggaattattctactattgatgaataatcatagtagaatcaagggtacagagtcaaaaaggggttctgacctaaggctatggatgaatcagttcaaagaatttactcttaacaaattcttagagtatttctggtagaattggggagcattaagtataaatatgatacatagccctttcttattaataaaagaataaggaaacgctatctcatccctattggtatcggtttgggccactactgctaaaacaaaccccagtttgaggaaagaacggtgggttctcaaaatccagtatcgccgagccttgttattctcttgccccaacttatgcgggtgcaaatttgtcgatttggatcagtactataagcctaagtattttattgatcaggcggcacccagatttgaactggggataaaggatttgcagtcccctgccttaccgcttggccatgccgccaaaaaatacgatctaaaatcgagaaaagagcaagtattcatccacgtccttactaaaactaactttcttttatcttaaatctaattctgcttacttatttccaatctttgtcaaagaatctattaatgctttttttggatccagtttcgatgagtctccttaggggatctattttaagacacagatggtaacattagaatactttccttttttgctcacgaaacgttcaatgatatatgctggtttttggcacaagctacaaaattaagaacaaattggaaccattaactagaattctctttttattttgaatttcggtattctctcccgcctgccatttaatgtcataataaaagacaatggatttatgcctaatccgtatataggtaaactccaggtccgaacagcattattatctatggatcccccttatgtacatatctctgtggagaatcgttctttaatttttcattgcattaaatatcttgaataaaaaaaagaaaattgactttgctatgtggaggtccagaactagattggcatgtacttaaaaaagtacttactttattttaggattctacaacgaaatcttatatcttatattttatagaaattctactactacgaaacaaaaaagaaccttcaaattcttttttgaaattaaactaagcgtgctattctcaatcgaactaaagtcaaactttctagtgcttataaattattatattttggttttatcccattcatagaaaggagaaaaaatgagaaatctttgccgtccaatctaagaatatcataaactgtaagtggcagaatttttttcgaggttctaggaatgttttatcacttcattttcattccatttggacccctgggaaattcgaactttcgttgaaattgtctctattcatatgtatgaaatacatatatgaaatacgtatgtggagttcccgagaatttcatgtgatttagtaaacagaatatagattccataattgctagatcgatctgtagggattgatgaagagtgagctgataatggaatttttcttcgataaacaggaaacttaagattaagatgctccggaatggaaatgagggaatgtccacaatacccggatttagtcagatccaattcgagggattttgtaggttcattaatcaaggcttggcagaagaacttgagaagtttccaacaattaaagatccagatcacgaaatttcatttcaattatttgcgaaaggatatcaattgctagaaccttcgataaaagaaagggatgctgtgtatgaatcactcacctattcttccgaattatacgtatccgcgcgattaatttttggtttcgatgtgcaaaagcaaaccatttctattggaaacattcctataatgaattccttaggaacctttataataaatggaatataccgaattgtgatcaatcaaatattgctaagtcctggtatttactaccgctcggaattagaccataaaggaatttctatctacaccgggactataatatcagattggggaggaagatcggaattagcaattgataaaaaagaaaggatatgggctcgcgtgagtagaaaacaaaagatatctattctagttctatcatcagctatgggttcaaatctaaaagaaattctagataatgtttcctaccctgaaattttcttgtctttccctaatgctaaggagaagaagaggattgagtcaaaagaaaaagctattttggagttttatcaacaatttgcttgtgtaggtggggacctggtattttcggaatccttatgtgaggaattacaaaagaaattttttcaacaaaaatgtgaattaggaaggattggtcgacgaaatatgaatcgaagactgaatcttgatatacctcagaacagcaccttcttgttaccgcgagatgtattggccgctacggatcatttgattggaatgaaatttgaaacgggtatacttgacgatgacgatatgaatcacttgaaaaataaacgtattcgttcggttgcggatctgttacaagatcaattcggactggctcttggtcgtttacaacatgcggttcaaaaaactatccgtagagtattcatacgtcaatcaaaaccgactccacaaactttggtaactccaacttcaacctcgattttattaataactacttacgagaccttctttggtacatatcccttatctcaagtttttgatcaaaccaatccattgacacaaacggttcatgggcgaaaagtgagttgtttgggtcctggaggattgacggggagaactgcaagttttcggagccgagatatccatccgagtcactatgggcgtatttgtccaattgacacgtccgaaggaatcaacgttggacttactggatctttagctattcatgcgagaattgatcattggtggggatccgtagagagtcctttttatgaaatatctgagaaagcaaagaaaaaaaaaagagagacaggtggtttatttatcaccaaatagagatgagtattatatgatagcagcaggaaattctttgtccttgaatcggggtattcaggaagaacaggttgttccagctagataccgtcaagaattcctgactattgcatgggaacagattcatgttagaagtatttttcctttccaatatttttctattgggggttctctcattccttttattgagcataatgatgcgaatcgagctttaatgagttctaatatgcagcgccaagcagttccgctttctcggtccgagaagtgcattgttggaactggattggaacgccaaacagctctagattcgagggtttctgttatagccgaacgcgagggaaagatcatttctactaatagtcacaagatccttttatcaagtagtgggaagactataagtattcctttagttacccatcggcgctctaacaaaaatacttgtatgcaccaaaaacctcgggttccgcggggtaaatccattaaaaaaggacaaattttagcggagggggctgctacggttggtggggaacttgctttaggaaaaaacgtattagtagcttatatgccatgggaaggttacaattttgaagacgcagtattaattagcgaacgtttggtatatgaggatatttatacttcttttcacatccgaaaatatgaaattcagacggatacaacaagccaaggctccgctgaaaaaatcactaaagaaataccacatctagaagaacatttactccgcaatttggacagaaatggagttgtgaagttggggtcctgggtagaaacaggcgatattttagtaggtaaattaacgcctcagatagcgagcgaatcgtcctatatcgcggaagctggattattacgggccatatttggtcttgaggtatccacttcaaaagaaacttctctcaaactaccgataggtggaagaggacgcgttatcgatgtgaaatggatccagagggatcccctcgacataatggttcgtgtatatattttacaaaaacgcgaaatcaaagttggggataaagtagccggaagacacgggaataaggggatcatttccaaaattttgcctaggcaagatatgccctatttgcaagatggaacgcctgttgatatggttttcaatcccttaggagtaccctcccgaatgaatgtgggacaaatatttgaaagctcgctcggattagcaggggatctgctaaagaaacattatagaatagcaccctttgatgagagatatgagcaagaggcttcaagaaaacttgtgttttcagaattatatgaagccagtaaacaaacaaaaaatccgtgggtatttgaacccgagtacccgggaaaaagcagaatatttgatggaagaacaggagaccccttcgaacagcctgttctaatagggaagtcctatatcttaaaattaattcatcaagttgatgagaaaatccacggacgctctactgggccctattcacttgttacacaacaacccgttagaggaagagccaagcaagggggacaacgaataggagaaatggaagtttgggctttagaaggatttggtgttgctcatattttacaagagatacttacttataaatctgatcatcttatagctcgccaagaaatacttaacgctacgatctggggaaaacgagtacctaatcacgaggatcctccagaatcttttcgagtgcttgttcgagaactacgatctttggctctagaactgaaccatttccttgtatctcagaagaacttccaggttaatagggaagaagtttgatcggaataaatataaattcttttcttatttctattttatgattgaccaatataaacatcaacaacttcaattggactcgtttcccctcaacaaataaaggcttgggctaacaaaacactacctaatggggaagtcgttggcgaagtcacaaggccctccacttttcattataaaaccgataaaccagaaaaagatggattgttttgcgaaagaatctttggacccataaaaagcagaatttgtgcttgtggaaattctcgagcgagcggagctgaaaacgaagacgaaagattttgccaaaaatgcggagtagaatttgttgattctcggatacgaagatatcaaatgggatacatcaaactcgcatgtcccgtgactcatgtgtggtatttaaaaggtcttcctagttatatcgcgaatcttttagataaaccccttaagaaattggagggcctagtatatggcgatttctcttttgctaggcccagtgctaaaaaaccaactttcttacgattacgaggtttattcgaggatgaaatttcatcctgtaaccatagcatttccccctttttttctaccccaggctttacaacatttcgaaatcgggaaattgcgacaggagcaggtgctattagagaacaattagcagatttggatttgcgaattattttagagaattcctcggtcgaatggaaggaattagaagacgaggggtatagtggagatgaatgggaagatagaaaaagacgaataagaaaagtttttttgattagacgcatgcaattggcgaaacattttattcaaacaaatgtagaaccagaatggatggttttgtgcttattaccagttcttcctcccgaattaagacccattgtttataggtctggggataaagtagtgacttcggatattaatgaactttataagagagttatccgtcggaacaacaatcttgcctatctattaaaa

SEQ ID NO: 68805 - DNA, 1411 bp, Oryza sativa
gtcattgttgtgggtccttcactttcattacatcaatgtgggttacctctagagatagcaataaagctttttcagctatttgtaattcgcgatttaatcacgaaacgtgctacttctaatgttaggattgctaaaaggaaaatttgggaaaaggaacccattgtatgggaaatacttcaagaagttatgaggggacatcctgtactgttgaatagagcacctaccctgcatagattaggcatacaggctttccaacccactttagtagaggggcgtactatttgtttacacccattagtgtgtaaaggtttcaatgcagactttgatggggatcaaatggctgttcatctacctttatccttggaagctcaggcggaagctcgtttacttatgttttctcatatgaatctcctatctcccgctattggggatcctatttgcgtaccaacccaagacatgcttatcggactttatgtattaacgattggaaaccgtcgaggtatttgtgcaaatagatataatagttgcggaaactatccaaaccaaaaagtaaattacaataataataatcctaagtatacgaaagataaagaatctcttttttctagttcctatgatgcactgggagcttatagacagaaacaaatctgtttagacagtcccttgtggctccgatggaaactagatcaacgcgtcattgggttaagagaagttccgattgaagttcaatatgaatctttggggacttatcgtgagatttatgcccactatctagtagtgggaaatagaaaaaaggaaatccgttctatatacattcgcaccactcttggtcatatttctttttatagagaaatagaggaagccatacaaggatttagtcaggcctattcatacactatctaaacaaggaagttagattcggggatgcccctttcgaggggcattccgatttcgctagtatcatcatttttgccgcacgaatccagattgagattgaggaaaggaagttaactaagttttcgaatcactgactcaggcccattgtcgaatcctactcagcaattgtcgaattatactcagccgaaaaagggggtacttatttatggcggaacgggccaatctggtctttcagaataaagagatagatggaactgctatgaaacgacttattagcagattaatagatcatttcggaatgggatatacatcccatatactggatcaaataaaaacgctgggcttccatcaagccactactacatcgatttcattaggaatcgaggatcttttaacaataccctctaagggatggttagtccaagatgcggaacaacagagttttcttttggaaaaacactattattatggggctgtacacgcggtagaaaaattacgccaatccgttgaaatc

SEQ ID NO: 68806 - DNA, 2685 bp, Oryza sativa
cctattcaaagcaatttacgcgagggactttctttgacagaatatataatttcctgctacggagcccgcaaaggggttgtagatactgctgtacgaacggcggatgctggatatcttacacgtagacttgttgaagtagttcaacatattattgtgcgtagaagagattgtggtactatccaagctatttctgtgagtcctcaaaatgggatgacggaaaaactttttgtacaaacattaattggtcgtgtattagcaaacgatatatatatcggttcacggtgcattgccactcgaaatcaagatattggaattgggttagtcaatcgattcataaccacctttcgagcacagccatttcgagcacaaccaatatatattagaaccccctttacttgccggagcacatcttggatctgtcaattatgttatggtcggagttccactcatggcgatctggtcgaattgggggaagctgtaggtgttattgcgggtcaatctattggggagccagggactcaactaacattaagaacttttcatactggtggggtattcacagggggtactgccgaccttgtacgatccccttcagatggaaaaatccaattcaatggggatttggttcaccccacacgtaccggtcatgggcagcttgcttttctatgttatatagacttgcatataactattcagagtcaggatattctacatagtgtgactattccttcaaaaagcttgattctagtgcaaaatgatcaatatgtagaatccgaacaagtaattgcggagattcgtgccggaacgtccgctttgcattttaaagaaaaggtacaaaaacatatttattccgaatcagatggggaaatgcactggagtaccgatgtttatcatgcgcccgaatatcaatatggtaatcttcgtcgattaccaaaaacaagccatttatggatattgtcagtaagtatgtgcagatctagtatagcttctttttcgctccacaaggatcaagatcaaatgaatacttattccttttctgttgacggaaggtatatctttggcctctcgatggctgatgatgaggtaagacatagactgttggatacttttggtaaaaaaaatagggaaattcttgattattcaacgccggatcgaatcatgtccaatggtcattggaattttgtctatccttctattcttcaaaataattttgatttgttagcgaaaaagcgaagaaataggttcgccattccattacagtatcatcaagaacaagagaaagaaccaatatcctgttttgggatttcgattgaaataccctttatgggtgttttacgtagaaatactatagttgcttattttgacgacccacgatacaaaaaagataaaaagggttcaggaattgttaaatttagatataggaccctagaggacgaatataggactcgagagaaagactcagagaacgaatacgggagcccagaaaacgaatataggacccgagaggaagaatgtaaaaccctagaagacgaatataggactcgagaggaggagtatgaaaccctagaagatgaatatgggatcccagagaacgaatatgaaaccctagaagatgaatatggaatcctagaggacgaatataggactcgagaggaggaatccgaggacgaatatgggagtccagagaacaaatataggccccgagaggataaatatggcactttagaggaagactcagaggacgaacatgggactttagaggaagactcagaggaagactcagaggacgaatatgggaacccggaggaagattccgtcttaaaaaagggggttttgattgagcatcgaggaacaaaagaatttagtctaaaataccaaaaagaagtagatcggttttttttcattctccaagaactgcatatcttgccgagatcctcatccctaaaggtacttgacaatagtattattggagtggatacacaactcacaaaaaatacaagaagtcggctgggtggattggttcgagtgaagagaaaaaaaagccatacggaactaaaaatcttttctggagatattcattttcctgaagaggcggataagatattaggtggcagtttgataccactagaaagagaaaaaaaagattcgaaggaatcaaaaaaaagggaaaattgggtctatgttcagtggaaaaaaattctcaagagcaaggaaaagtattttgttttggttcgacctgcagtcgcgtatgaaatgaacgaagggagaaatttagcaacacttttcccacaggatctcttgcaggaagagggtaatctccaacttcgacttgtcaattttatttctcatgaaaatagcaagttaactcaaagaatttatcatacgaatagtcaattcgttcgaacttgcttagtattgaattgggaacaagaagaaaaagaggaggctcgtgcttcccttgttgagataagagcaaatggtctgattcgcgatttcctaagaattgggttaatcaaatccactatttcgtatacacgaaaaaggtatgatagcagaagtgcaggactgattctccataataggttagatcgcaccaataccaattccttttattccaaggcgaagattcaatcacttagccaacatcaagaagctattggtaccttgttgaatcgaaataaagaa

SEQ ID NO: 68807 - DNA, 3017 bp, Oryza sativa
cagaagaaaagatggaaaaattccaccatctcccaaaaagagatgtggcaatcttgaagagaaaattatctaccttgcaaagatatctcggcgggatcaaatatatgacgaggttgcctgacattgtgatcgtcctcgatcagcaaaaagagtatatagctcttcgggaatgtgccattttggggattcctactatttctttagccgatacaaattgtgacccagatctcgcgaatatatcgattccagccaacgatgacactatgacttcaattcgattgattcttaacaaattagtatttgcaatttgtgagggccgttctctctatataagaaatcattgattaagaagaatagttaattcttgggcaactgcgtagatttatggaatcacttactattcttttttgttttgcatagaaaaaagacggggaatattgatatatattagagggtattgatatatattatcatctgatgtgatttcttgatatcctaaatataagattaatacttcacgttgctgagttgagaaaaagatggttgaatcaaaagaattctttttttgaagttcattttttatcaggggacaatatgaatattataccgtgttccattaaaacactcaaggggttatacgatatatcgggcgtagaagtaggccaacacttctattggcaaataggaggtttccaaattcatgcccaagtacttatcacttcttgggtcgtaattactatcttgctaggttcagttatcatagctgttcgcaatccacaaaccatcccaaccgatggtcagaatttcttcgaatatgtccttgagtttattcgagacttaagcaaaactcagattggagaagaatacggtccctgggttccctttattggaactatgttcctttttatttttgtttcgaactggtcgggtgctcttttaccttggaaaattatacagttaccccatggagaattagcagcgcccacgaatgatataaatactactgttgctttagctttactcacgtcagcggcatatttttatgcgggtcttagcaaaaaaggattgagttatttcgagaaatatattaaaccaactccaatccttttaccaattaacatattagaagatttcacaaaaccattatcgcttagttttcgacttttcgggaatatattggcggatgaattagtcgttgttgttcttgtttctttagtccccttagtagttcctataccggtcatgtttcttggattatttacaagcggtattcaagctcttatttttgcaacgttagccgcagcctatataggtgaatccatggagggtcatcattgaattgactagttttcaaaatagtcttttttttagcttaactcaattcatgcatggttgcggaaaattcgcttggttggaaaacaaaatagttagaattgcgtatgaatatacaatctagagttgtagaagagagaataggctatattacggaattgccaaacaaagtatataggcattagggaggggcggagtcaggctagatctatatcctttatgtctataagttcagtcatcttttgtatgggtttccactttaaggaattttttttgaatccgattcaatagaaaatgagaaaatacacaaacaaaatagaagaaacaaattgatatgggatattatatattcccaagttagattcattatctaatccgatatatggaatcggattccatatccaattcgatgcagcatattgttatcaattggatatcttgatttaattcctattggatctggattaggtcgatttccataggggttcttcctctatttcaccttttattatgaattagatgataggggaaaaaatagaaactcaaggatatcgaagaggaaagaaagaaggatggaatgaaagatcagttggttggaaagaaagagaaatagaataatgagtacacaaacctctaatgattagaaactaaaaaggagatctcgaagcagttcggagaattcagattatcgtttcaatttgtactttttagttacttctgtccaatagagcttagaaatatgaatttcttggttgattgtatccttaaccatttcttttttttgacacgaggaactcatcatgaatccactaattgctgctgcttccgttattgctgctggattggccgtaggtcttgcttctattgggcctggagttggtcaaggtactgctgcaggacaagctgtagaaggtattgcgagacagccagaagcagaaggtaaaatacgcggtactttattgcttagtctagcttttatggaagctttaacaatttatggactagttgtggcactggcgcttttatttgcgaacccttttgtttaatcctaaaaaagaaaacgagtcctttagattagatactttcttctttttttagtaaattggtatttgcttctgcaattccaattatatcaatactttactcctaatttattactcctagagttttctatttatggggacagacaataccccaccccaggaatagctgatttgaggatgatcaatttagaggatatgttcgccgtcttgcttcccgccctttgtttagggcagtggaaagtatttttccttttattttaggaattttgggaacatttcaacaaaggaggtctttcacaggtcaaacgagatctaagacttaatctaaaagaaattactaaattgaatctatttctattaaaaaaaattgcattaaaaaaaccgatcaaaaagggcgagcgaagtaagtgatcgaaaaactttgttctttgttcgtcctatctataagaggagagcatatgaaaaatgtaacccattctttcgtttttttagctcactggccatccgctgggagtttcgggcttaataccgatattttagcaacaaatctaataaatctaactgtagtggttggtgtattgatttattttggaaagggagtgtgtgcgagttgtctatttcaagaatagattggatctatcc

SEQ ID NO: 68808 - DNA, 1059 bp, Oryza sativa
gtactaatactggaacttatgagcaagaattgctctatcaatcaccatctactttagacatatcttctgaaacttttttcaaatccaaaagtccagtatcttcctacaaattagtgaattaggaggagctctttgtgccgaaaaagaaagagcagggcaatatttcaaacttgcattcgaactgcgaaatatttatacaaaggaggagagatcaagataatgcagcagggttggttatctaattggctagtcaaacatgaggtggttcatagatctttgggcttcgatcatcgaggaatagagactttgcaaataaaagcagaggattgggattccattgctgtcattttatatgtatatggttacaattatttacgttcccaatgtgcttatgacgttgcacccggtggatctttagctagcgtgtatcatcttacgagaatacagtatggtatagataacccagaagaagtatgcataaaagtctttgcccaaaaggataatcctagaatcccatctgtcttctggatttggagaagttccgattttcaagaacgcgaatcttttgatatggtgggaatctcttatgataatcatccacgccttaaacgtatcctaatgcctgaaagttggataggctggcccttacgtaaggactatataacccccaatttctatgaaatacaagatgctcattgaatgataagaaattcatgctcacttatacaacacaactccagattttatgcaagtcaaggaatatttttacgctctgttcctagatgaaacagaatacctattacattctaattaattccaattatacaaaaggttcagatagactaagcaaaaaagggcttcatttcgttggaaaatcacatattcatttccttcgtatgaacagaaaaatatgatgactcaaagaagttccctaccacgaactttgtaccgcgtgcattacttagaacaactagtaaagtaagataagataaccaagaataaaaaaatatttgtcggaatagcggaatagaaaattaagaaatgcaaaaatgcagaaaa

SEQ ID NO: 68809 - DNA, 774 bp, Oryza sativa
cagagtaggatccgcggctcaaattaaagccatgaaacaagtagctggcaaatcaaaattggaattagctcaattcgcggagttacaagcctttgcacaattcgcctctgctctcgataaaacaagtcagaatcaattggcaaggggccgacgattacgagaattgcttaaacaatcccaagcaaatcctcttccagtggaagagcagatagctactatttatatcggaacaagaggatatcttgattccttagaaattggacaggtaaagaaatttctggatgagttacgtaaacacctaaaagatactaaacctcaattccaagaaattatatcttctagcaagacattcaccgaggaagcggaaatccttttgaaggaagctattcaggaacaactcgaacggttttcccttcaggaacaaacataaattttgcacgtctactcttgttagtagaagtagtagaggagaaatcgttgagaaagatttttcatttgaatcatgcaaaaaagttttcttagtttttagtatagttatttaaagaatagatagaaataagattgcgtccaataggatttgaacctataccaaaggtttagaagacctctgtcctatccattagacaatggacgcttttttcatattttcttctttcttttcattttttatcggaccaagagaaaaaactgttagaccaaaactcttttaggaaagaaaaacaaatgcatatacaaatgtatgatgcatatatcataaagaaggaatatggagcg

SEQ ID NO: 68810 - DNA, 1083 bp, Oryza sativa
caatgtattggtgatgagtatataaagctgcttgagtagtaaagtcttgtgctatgaatgcataagaaggtaaagagtacatatgttgagctactaaggaagtaataacccctaaagaagctagagcaagacctaattgaaaatgaatcgaattattgattgtgtcgtaaaggcccttatgcccacgccctaatcgaccccccggaggagtatgtgcttctaaaagatctttgatactgtgcccaattccgaagttagttcgatacatatgaccggcaatgagaaaaataaatgcaatagctaaatgatgatgagcaatatcggtcagccacaaactttgtgtttgtggatggaatcccccaagaagagttagaatagcagttcccgctccttgagtggtaccaaataaatgattactcgaatcggggttttgggcataaagattccactgacccgtcagaaggggtcccaacccctgtggatagggtaatacatctaagaaattattccatcgaacgtactctcccctggatgctggaatagcgacatgaactaaatgtcctgtccaagccaaagaacttaccccgaaaagtcctgacaaatgatgattgagacgagattccgcgtttttgaaccacgaaaggcttggtttccatttgggttgtagatgtaaccaaccccctattaaggatagggtagaaagaaataatagaaaaagagctcctgtataaagatcttcattggtccgtaatccaattgtataccaccactgataaaccccagaataggcgatattcactggaccggcggcgcctcctcgagtaaaggcttccacagcgggttgaccaaaatgaggatcccaaatcgcatgagcaataggtcttacgtgtaaaggatcctgtatccatgattcaaaatttccttgccaagcgacatgaaacagatttccggacgtccatagaaagattattgctaattgcccaaagtgagaagcaaaaatgttctgataaagacgttcctcagtaatatcatcatgactttcgaaatcatgtgcggtagcaataccaaaccaaatacgacgag

SEQ ID NO: 68811 - DNA, 2737 bp, Oryza sativa
ttgttgtacaatgtcattgtacacaattcctatcttgttttccacatcctaattttcttgtctttttctatctatagagaatcctcgtgtcatttcttctttttggtctcatataatcaaggaatggtatatatctaaatccaatctaatttcacctataaaagaaagattactattccttggtaatctataggaagggattgtctttttcgtttttagttcggaatttcgcctaaacaaaagaaatacaaatgatcttgggcaataatatctgatcatatacgtattccaataaggaaggaggattttcaatgcgggatataaaaacatatctctctgtagcacccgtgctaagtactctatggtttggggctttagcaggtttattgatagaaattaatcgtttatttccagatgctttgtcattcccctttttttcattctagttgttgctatgtgaggaatagagttcttcgtgacatgataaaaaattcccacttttcaatccctttttagtataggaaagaaaaagaaagaaaagatagattgggttggaccttagagtcatgaaaaatttggtaaatctcatttttgaaaaaagaaattcaattaaaagcagtatccaagctaagtcaggcctcagaaatcagagcatagaaagaggctgggttggctactaaaatgaaaggattttgcttcaaaatccttgctaatttgacaaggattgtattccttaattatttctctattttttattacttaattgaaaaatttccaaaaatttttattctaatggattttcttcttcctcttcggtttcaaaatagaggaataaaagaataagtagaagaattaagttaagtcaatccaaaaaggaaaggaggttcatggccaaggggaaagatgttagaatcagagttattttgcaatgtgtgagttgtgttcgaaaaggggccaatgaggagtcggcagggatttctagatatagtactcaaaagaatcgccacaatacacccggacaattagaattaagaaaattttgtcgttattgtcgtaagcatacgattcatgccgaaataaagaaataggagcatcttgtgttcgatctttccaaagatcaaaaagaataagaacttcctatttaatatatagagcatagatagaatacaaaatacaaatcaacttgtctgatttccattagatattatttcatatgtatcgagggtattcatctaatatatggaccaaagagagactatttcttctggatccaaaattaataaaataaacaaatcaatttttttttcaattttaaaataaggaataaatcatgtatacatctaaacaaccctttcataaatccaaacaaacttttcataaatccaagcaaacttttcgtaaatccaagcaaacttttcgtaaattcaaacaaccttttcgcaaacccaaacaaccttttcgtaggcgtcctcggattggcccgggggatcgaattgattatagaaacatgagtttaattaatcgatttattagtgaacaaggaaaaatattatcgagacgaataaatagattaaccttgaaacaacaacgattaattactcttgctataaaacaggctcgtattttatctttcttaccatttcgtaactatgagaatgagaaacaatttcaagcccagtcaatttcaataattacaggtcctagacccagaaaaaatagacatattcctccattaacacaaaagttcaattccaatcgaaacttaagaaactccaaccagactttaagaaacaacaatcggaacttaagttccgatcgttgatgtggatgcgcatgggccagactatatatcatgaaaggagtccaattgatattgtagggtcggttatatgagagaacagtggggaggataaaataccgatcgtatgtattgctacatgctcgctgattcctaccacttaatctttttttatgtatcttcccggagttacctctccgggaattcttttttaattattcctgtatattacttttttatccctttaattgataatctttattttattggaaatcgtgtaaagattatttgaatttaatacagctacttgtgcaaggattttacgattaagaatcaattctttcttgtaaagattgtgtattaatttactataattatcgaatactttatgtatccgcgttgctgcgtttatccgactgatccacaaacgccgaaaatccctcttttgcctgactctatctcgatgagaggaaacaaacgctcttcttacctgttgagtaatcattcgattaagtcttaaatgagcccctctaaagtttgaggcaaatgaacgcatttttgcccgtcgtctccgagctatatatcctcgcggaactctggtcattgaatcaaattaaccttaatgaataactaatgatttctcttcttttagccatcctttttcccattaataacaaaacgaattattcccatatataaaatattagttccaatggcttttgctactataaccttcccaaccacaattttctcttctactcccttcagttatttcgcacgatactaaaaaatagtgggttccatcgtttctatggttcccttttaaacggcgaggccctctctatacaccggagccctttctttcatttcatcaaagggtattgtgaacttgtatagttcacattctttggctctacctatccattatagagtaaatag

SEQ ID NO: 68812 - DNA, 1750 bp, Oryza sativa
tctctttcttcttacgaacagaattggcttcttatttttaatggaatgaaataaatattcacgctttctgacacagaatcccctagaagggttaggtacataggatatggatagtctttgccaatgcgataaaataaagtgacatcgtgtctatttttctttgctaaaggggtatttccatgggtttgccttggtatcgtgttcatactgtcgtattgaatgatccgggtcgattgctttcggtgcatataatgcacacagctctagtttctggttgggctggctcgatggctttatacgaattagcggtttttgatccctctgatcctgttctggatccaatgtggagacaaggtatgttcgtcattcctttcatgactcgtttaggaataaccaattcgtggggtggttggagtatttcaggaggaactgtaacgaatccgggtatttggagttatgaaggcgtggcaggggcgcatattgtgttttctggcttgtgtttcttggcagctatctggcattgggtatattgggacctcgaaatattctgtgatgagcggacgggaaaaccttctttggatttgcccaagatctttggaattcatttatttcttgcaggggtggcttgctttggctttggcgcatttcatgtaacgggtttgtatggtcctgggatatgggtgtctgatccttatggactaactggaaaagtacaagctgtaaatccggcgtggggtgcagaaggttttgatccttttgttccggggggaatagcttctcatcatattgctgcgggtacattgggcatattagcgggcctattccatcttagtgtccgtccacctcaacgtctatacaaaggattacgtatgggcaatattgaaactgtactttccagtagtatcgctgctgttttttttgcagctttcgtagttgccggaactatgtggtatgggtcagcaactaccccaattgaattgtttgggcctactcgttatcagtgggatcagggatactttcagcaagaaatatatcgaagagttagtgatgggttagccgaaaatctcagtttatcagaagcttggtctaaaattcccgaaaaattagccttttatgattatattggtaataatccggcaaaggggggattattcagagcaggctcaatggacaatggggatggaatagctgttggatggttaggacatcctatctttagagataaagaagggcgcgaactttttgtacgccgtatgcctactttttttgaaacatttccggttgttttggtagatgaagagggaattgtgagagcggacgttccttttagaagagcagaatccaaatatagtgttgaacaagtaggcgtaacggtggagttctatggtggcgaacttaatggagtaagttattctgatcctgctactgtaaaaaaatatgcgaggcgttcccaattaggggaaatttttgaattagatcgggctactttgaaatcagatggtgtttttcgcagcagtccaaggggttggttcacttttggtcatgctacctttgctttgctcttctttttcggacacatttggcatgggctagaaccttgttccgagatgtttttgctggtattgatccagacttggatgctcaagtggaatttggaacattccaaaaagtcggagatccaactacgaggagacagccagtctgaggccgcactgctttggtatctttcacctctcttttttgatttgac

SEQ ID NO: 68813 - DNA, 2114 bp, Oryza sativa
ctttattcgcggtattcctatctattattttagaaatttataattcttccgttttactggacggaattttaatgaattaggtttctactaacgaaaactacgaagtcatagtttttccatccaaaagagcctttctactttaagctctacatttctagacattctggtagttcgaccgtggaattttttggtttcggtatctctggaatatgagtgtgtgacttgttagaatttgctcctattgataatacatagaaagcacctgttatctctatcaagatgattctaattcgtcggatattatttattctagtatctggaacacgaaatagatagagtggatcaagaaaaaaaaatgaaactatgattcatattaactattcagacctcgcaaccagactgaaaaaaattcaagtagttcttaataaaaataaaaaaagaaaatttcttccttccaattttgtttgcccaaaaaacaactttttttctctcgattttgtcgagtcattacaccgattcaataaatgatcatcaagcggttcttattcgaagaacccttgccttttgtttagcttgagactcaatcatcgtggctctagtatgaatctaaggttttaattgaactgattcataggatcgcaacaagataatttctaccagaaaactactccaatttttgctttatttatttatctagtaaaacaagagtaaatctgcattacgcacaaaaaaaagaaatccaaaatagggaagagaaaaatcaagaggcctctaatgatcaacatttgggaaagaaagatagacgagccaacttgagattttttggcattatcatcacaaagaagaaattctggatttttcttatttcatatcttcaaggcaaatcgacccaacccagtggctgatgaagttttgaaccttttttctaatatccgttgaaaatttgtgtgtttctgtttgagccgtacgagatgaaattctcatatacggttctcggaggggggttcgggttagttacctatctcaataaagtatatgattggtttgaggaacgtcttgagattcaggcaattgcagatgatataactagtaaatatgttcctcctcatgtcaacatattttattgtttagggggaattacacttacttgttttctagtacaagttgctaccggttttgctatgactttttactatcgcccaaccgttacagaggctttttcctcggttcaatacataatgaccgaggccaactttggttggttaatccgatcagttcatcgatggtcagcaagtatgatggttctaatgatgatcctgcacgtatttcgtgtgtatctcacaggtgggtttaaaaaaccccgcgaattaacttgggtcactggtgtggttttagctgtattaactgcatcgtttggtgtaactggttattctttaccttgggatcaaattggttattgggcagtcaaaattgtgacaggtgtgcctgacgcgattccggtaataggatcacctttagtggagttattacgtggaagtgctagtgtgggtcaatccactttgactcgtttttatagtttacatacctttgtacttcctctgcttactgccgtatttatgttaatgcactttctaatgatacgtaagcaaggtatttcgggccctttataaggaaggcatctcatagagagttctaattctcatatatcatatcgggtaggttgtggtatttcattgctacaaacatgggttattctaaaataagacatgtcatttagatacttctcttcaactccgaactattgtgatacaaataatacaaatagttgaagttaattttacgaaagaaaagaaggcggattatgggagtgtgcgacttgaattattgatttggccatgcagatagagagttggatctgccacattagaattcacgaccaaaggtgtctccatatccaatcaacacgtaagtcccctgtctagtaaggataggctggttcacttgaggagaatattttctatgatcatacctcaaccatgtcatccatgaagaggctccgtaagatcccatagagtagaaatggaataagtcatgtgacatgatccaattctcta

SEQ ID NO: 68814 - DNA, 968 bp, Oryza sativa
actccgtacagtacctaataagttattgggcgttctcttaatggtttctgtgccgacgggcttattgacagtaccttttctagagaattccaataaattccaaaatccatttcgtcgcccagtagctacaaccgtttttttaatcggtactgcagtagctctttggttaggtattggagcaacattacccattgaaaaatccttaactttaggtcttttttagggatttttcagtttgattcattcaatcgtgaagtaccgtgcataggtatctaggaaatagttacttccaagtgaatcttccctagatacctataatctattttattatgatccatttcgcgaaaatatagattgtcccaaagatgcaaaattgttttattttttctttttattctaactcgaaaaagaagaagaggaaaaaattgcaatggatttaaaactagaacttattcttaggtaaatccattgggagatgcttctctagagtgtcccatatctgttttccatcttgcatacgaaaactgtcaattctcatcagatcttcttccgtcttactcaaaaggtccaatagtgtatggatattggcccttttgagacaattatacgttctagaaggcagttctaattgatcaataaaaatacaattcaatggaattctttttttgtttttctttagattagttaatcttttttgaaagcttaaaaggggggaagtaaacctgtttttattttcttggaaacgagtaccctcttcctccgtgtgaagaaaaggaagaaataaatcaatcaaattacgagaagcctcataaagcgcttccttaggggttaaacttccattggtccatatttctagaaaaagtatctcatattttgcatttccattcccacaagcaaaaatactataattcacatttcgaacaggcatggatacagcatctataggataacttccatcttgagtgttc

SEQ ID NO: 68815 - DNA, 810 bp, Oryza sativa
gatttttttgttggatttcactccacccgcggttgggaactactaattcgttgggtctataacgatcttggatgggttcctaacgagctaattttcactatttttgtttgtagttttcctgtgattctagatacatgtttgaaattttgggtctttttttgtttaaaccgcctatctccttcgcttgtagtcatttatcattcaattagtgaagcataaactcatttgatctcctgatattaatcaaaattagcatcctttttcctttagaaagaaagcctttttccattttagcaaaattctttttttctatttctacctgctcaaggtattcatcattccagtacaactgttgcagtagaatgacaacagattcgtgtatagggaactagattagcttagctacctatctaatttattgtagaaattccgggatctgtgattggacatggaaaatagaaatactttttcttgggtaaaggaacagatgactcgatcgatttctgtatcgatcatgatatacgtaataactcggacatctatttcaaatgcatatcccatttttgcgcagcaaggttatgaaaacccacgagaagcaactggacgaattgtatgtgccaattgccatttagcgaataagcctgtggatattgaagttccccaagcagtgcttcccgatactgtatttgaagcagttcttcgaattccttatgatatgcaactgaaacaagttcttgctaatgggaaaaagggagggttgaatgtgggtgctgatcttattttgcccgagggattcgaattaacgccgcc

SEQ ID NO: 68816 - DNA, 889 bp, Oryza sativa
acatccctgaagcgcggccgattttctagcatttcgtattggctgtcttgcgtttctaataagttgtttaaccgttggcatgtcgtatgtatatagaaaaaatggattggtttagatcgatcttaacctgaatgattgatcattatgaagtatttccattaaattgcataaaacccgaatttagggttgaaataaatttacaagaaatctggccactaccaatccttaaacatttctggaaaccacactggatcagtatcgcagtgctcgtcaagcatttcatcccctacaatatcgacaagtccataagctttggcttcgtctgctgacataaaaacatccctttccatgtcttcggatacaacccaaaaaggcttgcctgttcttagtgcataaacccttgtgatcatttcgcgaactttgtgtaactcttccacttctagtaaaaattctggtgttcttgcccgataataagcactagcaggttggtgaagcataatcctcgcgtgggggaatgctatacgcttggtgggttctcctccaagcagaatgaaggacgccatggacgcggctattccgaggcatattgtatatatatctggtgtcaccgtttgcatcgtatcaaaaatcgccattcctgagattaaccacccgccgggggagtttataaacaaaaaaatatcgctaattccatcttctatactgagatataccatgagacctgtaatatgattcgtgacctcgcaacgaatctcttgacctaaaaaaagtgtcctttctcgatacataacattgtataagtcaacccaagtcgcttcttcatctccgggaatccggtaaggtacttttggaacaccaatgggcatattagattaatattattaaattt

SEQ ID NO: 68817 - DNA, 960 bp, Oryza sativa
ctgtggtcacaaaatagatgctgcgagaatcagaccttaaccccataatcagttctttccctttttgtttctctctttttggatccgtaacttgagctgttatgcaaacactctattttatacaaagacacacaaatcttatatatattgctgaaaaaataaaactccaacgcccaccgagtgaatggccaaacacctccattccactctacctcccactccctcaccttccaatctaggctctatctacttagtccatccgttgcaaaatataacaatattttctctactcccttatctcaaccaaatcgcaatcacctcgatatcattctttttttcctactttcccatctcaatcagtcataattatttttattcaaagtcacatatttttttaatatgcatgagtatttttttctcttagaaaaatgtttatgttttgtgattaagaaagtagccttgtgtattagcaatgtgatgcctctgtcgtactatccctttccgatcttgaagtcgtcggttttctatgcgctgtgtgcagttgagaacagtagtgcagttgaactaaagtgaggatgatctggattcatattattttgacttgctaagaataatgaggtgattaaacaacaatggatgctgacaagaggatgctcgtcggcatttgctgcatttatctttccttatttcttttccccttcttgcttcttggcagcacgtgcattatacattcatatctgtcactagatgccaatcagaagcatcttggtttgggtttccatgttcactgctactactagcagtacaaaattgttattgtgcaaaagggcaaatagtggtcgaaccggaaacaaagcatatgttcgcgtttctaagttctgatcacgaagtattatatccatcatcaaatataagacttagctattccctttgttttaaaatattattataaatcagata

SEQ ID NO: 68818 - DNA, 10831 bp, Oryza sativa
  unsure (1)..(10831): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaacctgaaaaccttggcctccattccaacaagagaagaggtatatccaacagagaaaagcttgtttcctagtcaccttaacagaaagaaaaattgaaggttaatcagaaaagtgagcacgccaccagtatttagaattcaatgtactatatacaggagtttaggtggatcaaatctttacataacactgggatatattgaatagcatacgagtaagaacaccaaaaagtcatgtcccagtatctcaaatatgatgaaaggtgccactctggtggtctttgcaaaataaagagaagaggaacctgaaagaggccacactcaattcctgaacaatgaagacggtgacaagtagcactctccaaagcatcagtgtcttgtatcaaacagataatagaaaaaacatatattccagattagataacaacatgtcctaaatcttcaaaacacctaaaaccctcttatgatcgaaggtgtgaaacaaatcacaatagctgtatactccctccgtcccataaaaactcaaccgatgaggggatgtgactcctcctagtacaacgaatctggccaaccctctgtccagattctctagcaggggtcgcatcccctcctaggctgagtttttcttgggacaaagggagtatgttgtgaattaaggataggggtcgccacggtgactcaattactaatttggacatggacaaagtcacactgatggcttggtgagtagtagtgaggcacagatacacgatatagtgtttttggtccaaactagaatcattatagcagctgcagaaattttactttgatgactggaaagctaagcaaaattcctattaaggcgccatacagcgatttttgtttggtactacaaactgaatcattctaaccttgcaaaaaggaaaaaaaaatcaaaaccattgtaaaatgggaatcatacacctgtctgactcacgattcaataatctatgatgtcatttcccatatcatcttagactacaaacacccctcctaagcaatgtacttagtatcatactagcggcagaatgttaatgcatcactcccctagttggatcttttaggccttgttcggttgcttgagaattaatccccaaggggaacctatccaggaaggggttgggtgaatcccttccatatcacccaatccctgtggggtttgaatccctttcctgtttttaatccctatcataaaaccatgtgcttgttttggcagggatttcacacaaagtagcatgttgggattccaaatcccgctactttgccatactgaatctagacccaaaaaactcctactccttccttcctgcactgcaataataagaaatgagtattcagtctgctgaatcaaagcacaaacggtagctttgattcagacagcaaaaggcacattctgatagcatcaaattgatattagtatttggtttatgttgatatctccgaatcaagctcgaaaaatccatttgtgaaccgagctagctagcttagcttgcatttccgtactccgatccagccaaagaaacaatactagtgaatccgaattcgaattcgtgcattcatggtgatacaagtttgggatctactatctatctgatgcgatgacaagaagatagaggtgctaggctataagaatccgaacaaggttgagacaaaactcgtcagtcgtcgaaggcagcggcggcggcggatgaggggtcggcgaggtgggcaaagcgggcggcggaggcggatgaagctagctacatcaaaaatgcacaccatgttgacggtggatgaggaggagcccttgcagtcggagacggagacagaccaagaaccgaggatcaaagacccaaaaaccctaggtaggacagggagaagagaggggaaggaagagatactcaccggtgagaaggtggccagcggagggggcggtcgccggaggagagagcaccgccgccggggagagctccgcgtcgctgtcgcgccgtcgactcccagtcgcgtctgcgtcgccaccgccgccgccgctttcccctacgcgctcctcgtctcctccgcgcgagggtttttttagcggtttcttacccggcccaggacggggtcggcctggattggaataagttcacctaacgtccctcaacttttacgtcgagtctgccgaggtccccaatacgcaaaaccataaacctctgcccctcaactatcaaaaaaatcccgaggcagtattgacccaaatttttaccctttttgctgacgtggcatacggcgggatccacatgtcccttgcctcctcgcgcgcaccaacgatccaccgctcgccgtggccatgctctcctagcatggcgccgaccttcgcccgtcctgcatcctcctcaccctcctcccggcgctcttcccaaccttccctgcgcacagccgccacacgctctccgccgtcgcctccatgcccacgagacggcggggagatgtgcaagatggcgcgtgcggtgcggcgggccaacaagttgtggtgacacaccatggaagccgcggtgaaggaggtgctgacgccaacgcaagacaaagagttcctaaagaaaaaagaaaaagaaaaggagaagatgagaagagattatgctgacatgtggaacccaccgtatgccacgtcaatgaaacagggaaaaaatgggtcaatattgcatcgggatcttttttgtacgatttgtaatagttgagggatagagatttctggtattgcgaattggggacctcagacagacagactagatgtaaagttgagggacgttaggtgaacttattccgtcttgattcaatccgcgatgggcttaaccgaatgcacatttttatgtgggccgggtttcactccgcgtctgtccaatccacaggaattgcagcccaatccagctcgttctcaggacaaccaaataaggacctagaggggcagtttctgaagcaaaacctgcaagatgtgtagacgaagttcccagtttgaatgcttttgtagactaccggtactacggaacttgttgtaaacatgaagaatgttgtctgtgccgtggtgtttcagtcacgacgaataggtcaaattgtaggtttgttttggttactacctggatagaagaagcctaacatgatgcctccttgtgacttgcctaaaaggtgtttgattggaggcctgataaattgagtagctccaacgcatcattagcatgagtccggcgtgcgaattcggacgcctgagatccaggcgaaactgctcaactttttaatcacaagagagttctgccgacatcttctcgaaaagcaaggtagaaggggataagaatttcacagctagcaaacccccattccacaaagctccatgactacgtcttagatttctctatcctgtgcaccgatggatctgacggcggcgttggcttgccgcgcacgcgctcaactcatcaccgaaacaactatcggcgtcttttcatttatacttatgcttctcagccaaattttaaatttttaaccttaatttagagttgattttagagttttttcatcgaagtttattttccagccattacttttaaatcactaaatacacgcatatgaaaattttatttataaattacttttcgtttacaaatatattgtttggtttattccacgaataagtaaaacgatggggccgatcgcgggaggcttgcccggtcaggcaaaagctacgacaatatcagtttaagtctcgggcgtgcaactttctcaggcacatgctaatcaagcaaccaacccaacacggccaaacacgcatgtttcaatcagtgacaccccctgacccggtgacccctgtgacaccatcagagctctctaactcactttcgcaaccaactagccatgaaaaacattgacagaggcaaataaacaacattaaccttgggggcatcactacccggggaaaaaaaaacttggggcagatcctccgctcgatggaggaatagtttatctttcaatgcaaagttgccaaaatagcactgactgcaaatctctaatgcaaagagccaaagcctatatcacaaagcagacagagtaaagaacatataattccagacaaaacagactgtacggttggaaccattggattgtcaaacagttaatcgtgctatttagttattttgagcatacaagaagagagatcttttagttaatagaacaaaattataccaccaacctaactgaaccagaacaaactgatcacgacaaatgtcagcaaatgaagaagacaaggatacaaggatttaatagaactagataaattaattactctgaagtgcttcaaacaaagggggaagcgcgcacaggttacgacaatctaaagggccttaacatgctctcttgaagaattaaagcagagccaacaagtaagattcgccaatacaaagacacggaaaaatgagaatatgatccctaacaagtgagtattctagctagctaaacaccactcctttctcatcttcctacgtctctaccgcatcttttcctgccaagatagaacaagaaggttagatcgatggcaatgatgtagtaccatgttgcttgcttgctgcaaagggaaagaataataattttgaataccagagttaaaacagaattaagcgtttggtagcaacttcattagtagagaattacctggacgcgactgctaccagtccccagatgatctcgttgcatcttccttggtcgaactgtaagcacactggcttcaccgcgatccctcttattgggtggaataagctggcacagattatgcttcttgatgtgcttgaatatatcagaccccattagggatggagaaccagcatgccgccaacgaggaaggtgccaagctgacacaaacttgcaagtcaccatgtcaacgctgaaggcatataggctcctgtccttctcatcctccgcatagaactcacccatcaagagataaacgacaccatcgtcctcagtgctcagcatgggatgggtcggcgaagtgttcgtcggcagccctgacctcctgaacccctcctgctcccacaatctcccaacacggatgctaccgaccttgcgccactgccctgagctcggcatcatcaactcccacatggacagcagcatgttgtatccgggcaaggtgttgtatccctcgatggacacgaatctgatcgagttgccaacgcagcggatatcgcgatattgcgacggcggagcagtgagatagagcgagtcgaaatccacattgcaaccggtgggtagtgcaatgtaacggaattgcacgtcgtcgttggtattagagatgagatcgtggcagctgcaggagaggatgccttgtccaagatccacccagtaagatgaaccttggaacgagaaggtttgatgagcattgaacttctttggcttctcggagcggaagattggccttctggttccccagcaatggcggtcgaatggtgccgatgacggcagcaggcagaggacttgcggtagatacccatcgtcatctgcatccgcgtccatgtccattgcaaagaggacaaggaggtagccgtcgccatcggattgccggagagggagcggggtcacagaagggcggaacctcatcgggacggtggggaacatcttgagcgaggcgttgtccgtggcggcgtcgcagacgaggtaggagttgtcgccgcgcgtgccgggaaggcaggaggagagcacgaggaaccggggtcggcgagcaggacgccgccgaggaacccgcggcggccctcctcctcgtcgtcgtccgggtcgccgtcgaggcggatggacaggcgggagggccgggggggatcggcgacgagcgcgagcagcttcaggccgtcgtcgtcgaacggcgacagctcgtcgtcgcggcgcaggccctcgacgtccgcgcggagcgtgacgtaggccgtcgtctcgcacctgatggctgcccaccccgggttctcctcctccccgtccggttcgtggagacggacgacgggatccagcaccacccagggtggcaaagagcgcgcctccgccgccgccgccatggccggtctgtgttttcgcttctttctgtttttccctcttctccgagtcggaggcggtggcgttgaggaggggatcgatttcatttttttattttttggcgcggatcgtatgtccatcggacggtggatctgcgactgcaagaagcccacggccacgtgtatttctatttcacgagcgcccgtgaatccacctcagcttcggaattggtttagagcctacaaattcgatttcgttaaaaatagagagagtataaaatttgctaaaataatggagtagttacgacttacgagaacgaatttgtaggctcaaaagacattacgtctttgtccgaaaccgagcgtagatcagccatggcggcggcgcgctctttgccaccttgggtggtgctggatcgcaacgcctttctccacaaaccggacgacgaggaggaggaggacccggggtgggcaaccatcaggtgcgagacgacggcctacgtcacgctccgcgcgaacgtcgagggcctgcgccccgtcgacgagctagcgccgttcgacgacggcctgaagctgctcgcgctcgtcgccgatccccccccggccctcccgcctgtccatccgcctcgacggcgacccggaggaggaggaccgccgcggcttccgcagcagcgtcctgctcgccgacgccgggttcatcgtgctctcctcctgcctccccgacacgcgcggccacaaatcctacctcgtctgcgacgtcgccgccgcggacaatgccgcctcgctcaagatgctcccgactcttccgatgaggtttctcccgtctgtgacctactgcccgcaccccgtccggcaacaacccgacgccgatggcggcggctacctccttgccatctttgcaatggacatggacgccgatgcagaggctgacgggtatctaccgcaagtcctctgccttctgccgtcatcggcaccattcgaccgccgtcgctggggaaccagaaggccaatcttcccctccgagaagccaaagagtttcaccgctcatcaaaccttctcattccaaggctctgcttactgggtggatcttggacaaggcatcctcttctgcagctgccatgatctcatgtctggtaccaacaacatcaacaacaacgacgacgacgatttgcaatttggttacatccaattacccgatggttgctacgttggttgcgactcgctctatctcactcatctgccgtcacagtatcgtgatatccgttgcatcagtgactccatcagattcgtctccatcgagggatacaacaccgatcctccatacgacatgctattatccatgtgggatttgacgccgagctcaaggcagtggcacaaggttggtagtatccatgttgggagcttgtgggagcaggaggggttcaggagatcagggttgccgacgaacacgtcgccgacccagcccatgttgagcagcgaggaggacggcgtcgtgtatctcatggcgggtgatttctacgaggaggatgagaagcacaggagcctgcacgtcttcagcgttgacatgacgacttgcgagtttgtgtcggcttggcgccttcctccttggcgccattcgggtcctccatccctgatagggtctgatatattcaagcacctcaagatggataatctctgtcagcttgttccacccaatacgagggccaaggtgctccctcgtccaccaaagagggatcgaggtgaaggcaatgtgattacagttcgaccaaggaaggtgcaacgagttcatcatcaaggggaaaatgtctaaacttttttagggaaaatgtcacctaaattttcgtgtaagcatcaatattttttgtacatgtatggcaagataaagatcaacaacgttttccacggagaggggttattcggactttttttcaaagtgtatttacatggataacagtggagacaggttatttgagattgttttgtagttaaaatcaaatcaaagaaccctataacactacaaaagaagtgagacgcacgttttcactcgtaaaattctctaattgataaattcccattgagctaatcgccctcgtgttactgggatcgatagaaaacaagcattcactgattcacaataccagcgcgtcgtacggtccatttagcaatgcccttcttgcaagttgcaagtgacactctagatgcaaatcatttggctccaagaacttcttgaataagcctctcagtgagctccctcgggagtcctcgaacgctatccattgtgccgatctatgcaacataggaagaaatctcaaaatcagagcaatggattcgatattattgttgttcagacgttgcagtgacactgtccagtacagattggccgttctaagagtagtaatactagcaatggtggttgtttcgaaagaattgctcactaactgcttgatgaatggcagcaccgaaggatgtgtcagcttaaggcctccagccacgcaggtcatgtgtccttccttcacctaattgaattaagaagtactagtacataagattgcattaccaagcagcaacaaaacaggcttccacggtgggtgaaaatatatgtccaaatacttttgcaaggttcagaagattaccacactttggatgaaatcctctggtatgtggtgaaaatagatctgcagaaaccaaaacatgcaccgatttgatgatttggtatagatcatttcagttgaactcaaaacaaactcgagatcaaattcgcagccgtcatcactatgtgcataaccacataactaaaagctcagattatgaatgtgcagctacctcaggtatatcccatcctcctttggaagctccattgcttaggttagtcacaagaacatagttcactgcgaatgctttatcacccgaataccctaccaatagcagcgaaacacacagccaaaactttttagctaaatacaacaaatttactggtacaattcctaagcagagatttgagatagatatacccttgatgaactccctggcttcttcctggccttttggcctctcccttatcatccctttgctcaccatgacctgattgatcaattcaccaaattaattagtcaaacgaactccgttcaaatataaaactcaagttgtttatgactgaaactgatggccggtacctggtcagaggtgatcagaatagtaggctgatctctctcttgagcagagtcttccccatgcaacttcagtttgatggcctctgcctgcagttcatcaggaatacaattttagctgctctggttgcttgacttgcttcacctcgactgaacacagcatctagcatcttaaaaattcttaattaattatactgttcggtgtaattagcagctgaaccttagcttcagcgagggccttgacaagctcctctggcttctccctcctgatggccctctcatcgatgtcagcgcactgaacagttaaccagaaccaaacacacttaattcgtgagggattaattacagggtaatagcgagattaataacgagagagctccaagatgatatagccaatcaaatcagctaaccatgacggtgaactcgtatcccatgtccgccagtatctcgcggcgcgccggcgacgacgatccgagcacgacctgccggcgaaaggatcagtaatcaattgaacagtggctatggctaattggctagtgaatcaattcggatgaatggatcataagcaggaaagggagggagacacgcaccttgaaaggcgaggagttcttggccatggaagacgccatggctgaactcatcgcagagctataggactctgaatttctgaaacgcctgcatgatcggaggctacaaattctaaccgaattaagtacttgttgcttccttgcatcccaagtagtatcccactcaagagattataatagcatatcatgaggggattagggttgatctcaccacgtaaaagctggttggtttctgtttgaccgtagcgttgaccggagtgcgttgagacttgggagactgggagagtgaagcgcggcgagattgtgtagaagcttctctctgtccacgtgtctgtgctttgggggaaataggccaaaggcccactttgtcttgccccattgggcttctcctcgagcccgaggagatctcacagcgtggtgacgtggcgtttcgagccgagcgcttgtgggcccaggcgtacgatctttcatacacggggtcgggttcaggcggactcagcttcggtgacttaggtggtgtttacatctagggacttaactttagtccatgtctttagacactaatttagagtattaaatatagactatttacaaaactaattacataaataaaagctaattcacgagacaaattttttaagcctaattaatctataattagagaatgtttactgtagcatcacataggctaatcatggattaattaggctcattagattcgtctcgcaaattagtccaagattatggatgggttttattaatagtctacgtttaatatttataattaattttcaaacatcatggatgggttttattaatagtct

SEQ ID NO: 68819 - DNA, 3702 bp, Oryza sativa
cacaaaagcacatcttcttttcgcccaagaagagacgtccatgttttgtccttgcaatttgctgggcccaccaggccagtctcagcggccggagaatccggagccccaccgggccgatatgtcagtgacacaagcggatgccgtggtcccactgtcagagaagcaccccgcctctctcctcctcgcgccccgcgcgcctccaagccttctctttctttccaaggcaacccgcgccgcgcagtataaagcaagcgcagcgccaccattgccaggaacacgaaaagcttttggttagtggagcactagtagtcttcgtctgagagagagagagagagaggtttggggggtaggtgttgttgggggagtcgtcgagatggagaaagagggcggagtgaaggcggcggcggaggcggaggcggaggcggagggggagatcgtggcggcgccggcggagaaggtggcgtgcttcaagaagacggcgggggaggaggcggacgcgacgttcatggagcgcgtcaaggactactataaccagctcaaggagagctccgccgagaagcactggatctgcatcaaggacaagttccgcgccgccggcgagtacgtctcacagaagagcagctcggtaattcctccccgcttaaccctctcctcctccctcctctgcaaacttttgcttggatccaacctgtgatgcatcatgcatggtgttttcgcttctgagtttttccctgtgtgttttgtccgcgcgtgtaggtagtgtagtactcgtgcttcgtcttggattcttggtggttcgctggtgtttctcggtgtcttggccgcgcttgtagtcctagtgcttcctcttggtggttcgcttctgagtttctcagtgttttggccgccgcgtgtaatacgagttcatcttggtggttggttcatgtcgttttttttctttttctgtgtagttcttggcgtttaattcatctcgtgcgtggttagaatgttcgatcggtgggaatgtaatcgatcgcttaggttaccgttcgtttttttggtgaatagatcatgtcgaagacgcgattagcatacaagttctagtgccaaagcggttctgttaatttgacaagcatttgatcgtttcatagcaatgcgagttcgtgctgttcggcatcaagccttgtaggtgtttagggggaacagtcttgtctgcgaataggttcttatctctccattttaatcattggcggcttcaatgttgtatgatttgagacggagaagcatttggggggttttcccccttcgatcctgatgttcttttttgttgaatcggtggctgcttaagcgaacatcaggattaggatctctcttgctagaaattgtggagttctcttcgctacgcgcactctgttctgcttgctattagtactgccaagtctctgtttatgtagaaactccactagtgcttgaggtttaacaagcgttgtgagttcgattcttgcctttcattatgtttaagggaaaacctgcgtgaatgggttcttgtgtttgcgatttgaatcgtcatttgtggtcgggttcactgttattcgatttgcgacgtagagatcagagatgcagaggcattcgttttttttccctgtggatttgtgatgcttttttttttttgttctctattcatttggtggtggctattaacctgtgcgtacatcaggatctgtttgttgctagcaatcttgttgaaatagtggcaaattatagattatgttgcaaatggtctgcgcattctagattgccaatgtaaaaaagttgttaatgctcaatttaccccgtatgtttcttagctacatggaacctgtcctgctcaattttatcctgtcaagtctctctttctgcatatacttctaccagcgataaaatttctgcactgttttgcctttgtgctgaaatatttgcaaatgattgtgcgatctctatcttgatatatgcaaggttcagctgtatctgctggtgtgatgtctcctaaacatttgccatggacaatcatttgtctgcagtagtgtatcctagcatttgcatttcaaattagcaacgcactctaaattgcaatcgggttctccagttgcaacgaatagcatttgtcatgtactctctgttcttggcagacttggcagactgaagttaattggacttctttttatgctgttatgttgatagctaattacaacatgctgttgcctctgatggatctcgtgggctaatctgctgtttcctgtgatgtgattcaggtgttcggcaagaagaaggtcgagcccgtggtcaaggatgctgcagttccaggggaggcgagttcggtgacagtcgagtctcagtgagggggggctagcttctgatcagtaccaactttgatgagacaagtgtaaatcctcttaggtgctcaacggtggaacttgaattgtgaggtcttatcgatcagcgagtagtttttttgctatgtcatcttgttcgtagattctagtaggaagagtagtttggacatggttggctgagtggttactactgctgtgatctccggatgtttctacctgaaaaaatatgtgaaccttgaatctgcttggtagcatctatgatcaatctgcagtgcagctggttaaattcgtgccgctgctattctgatatagacatatagttatatgagttcttgtgttgagcatggggatgatatacccactggattcatcttggttttctgaatgcaagggtcaattagcactggttcattgtgaatgcaaatctgtgctttgtgcatgcaaagatcaatgcattggttaattggctccggtcaggtccttcctcagatccacagggaaaggaaaatgttccagttagtgcttatatcgtagtagtattcaaaccacagcctttgccatcaagcttttgcagatgcttggggggggggggggggggggttaaattcactgtatttgctgatttttcttggttcaccatgaattgttgggattttcctcaaaaagaatcggtagtatttccatcaggtaccggagttatcaccactcaaaatatttaggggaatattatgattcatgagaatttataaaaccttgaaattttctccgttccgtgtgcttcatcttcctctccctctccgcgagccccttgattaggtttcaggtttacgggatagtgccgtcacgggtaagatagagacattgctggggctgtggtggcattgcctcgcgagagaggaagagggcaatggatcagactcctcttaacatttttaggtaatattaccaaagatatacatacatttagtttattttggtaaacacataagaaatcctgctaaaattttgatagtattatcatcaacttaccaaaatttagtaagatttattttgtctacaatctgaatgacccctctatctttaaattccgatgaactatggatttacatgtcagagataaaaacacggtaatttgtaatttagaagtctaaaatggtgcgacgctgaaatgcgggagagatgtgcacagtgggccggatactaggtcaggccggctcggcccaagcctgaacacactgcgaggcccaaagccatctcgaacattccgggtgtttcctcccttcccgtgtgctatcccctccgctccgcggctttctcccgcggtttcccttcctccaagaaagaaaaaccg

SEQ ID NO: 68820 - DNA, 2819 bp, Oryza sativa
cgtttagcagcttactagcttagtatgagattttcactgccttaatccttaattgttaaattatgatctgatcgcacccaggcctcttgaaagctatagttctggaaacatgattgtatagataaatatgaaaacctacgtagaagctgttttttttttcaactgatttttgtaactggttttatatgcacaatggtttggtgcaactgagaaatataactgaacactcatgagatattgagatataaaatttgacattgaacttattttgtgcttctgcctgccctacaaaattgtttctaaactctgaaggttgcatactgagtagcgctgtttaactttggcattctcctttttgacacatgttgttgtagacatattattttagagctagaaaatttattatgttgctgccgttgttgttttgttcttgctatatgctgttcttcaacctcaaccataccgctttacatgttgaaagtttgatttgttcatttcctatgttatgttaaacatttggtggaaatttcattatgtttaaccttctacctgggttaagtgacagaagatgtcgaaccaatagttactccctatctctctttttatagttctgagttacttatttttagttcctaatgcagactcatgagtcatgatttgatctctgtttctgcactctctcagtttgatggaattccgaatttgtttatgttctggcttatgtaactataccacctgttgatggttctggtagctaaattttattcaagttgcatttcattgtgatatgacgaaagcgttcctcaaggtgttggtttctggctgaaaatatgcagatgttggttctggatcttgttatgttgatcttttcctaagaatccacacatcagctttactttgctggtttctttggtttatttcagacttcggatggaatccattaagacacaatctcaaggttctgcctcttctgttccaaagaacccagccatgtcctcttgtcggaagaagaagtctgacgacgctacgttcctcgaagatctgaaagaccatatcgacgagttcatccatgcctccatggatgagcacaagcattgcttcaaaaacaccatccagaaggtcagttgtgctaacactcagatactcggctcgttactctttctgcattttagacttgtttgacaatcaagcgtttcttgcgctctatacctcgcatcgcagatgtttgggatgtcaaaggttgtcgcagagcgttccgctgaagcaaaagaagctgaagtcgagagcgctttgcctcttcagaccagtgtctcgcagtaggatgccatggctgatggcagcttgtttgccttctgttgcctgtgttccgtcctgtggagcttaacaatcagtaatacctgtaatagcagtgaatatggagtctactgctttatgtttccttgtattttgctgtttttttcatatattttgagaacaaatcttgaacaaaatggggtataactaaaaagtctacttcaacaagtgtcgaattgctgatctgttttgctcatgtagcagattcctagtctatcctaaattcctaaccttgtttctggggtcaacaaagaattctgcccagaagtttcctggagctaatgatgagtatgggccgaatctcacgtgggcctgaccatcccatgtgggcccactaacagtgggatactgggtgaggtgtttctttttcatttttgagctgtaccctgtagcctctgctactgtccagctttatcacgcattagccgaaaagccgaagctactagtgtaaactactccatccagttataaatatttgaaatttatggtaatatttggttaaaattctgaaatcttaaccaaatatttataactggagagtgtatgaaaaaacttaggtcctgtttagataggagggactaatttgaggcccttaggccatctaaacagtgaaaaatacccgtataagtgaaaaagaactactcgttatactgctatcagtgaaaaagaactactcgttatacctcaaattagtattaatacccgtatcagtgaaaaagaactactactcgttatactgctcatctccagtgaatttgccttgctcgtttcactaattaatactgcaaaaaagaagtttgaacactggtgatatttctggctttctgcatccaaattgcggctctgaattttccaggtaccttgaaggcgacaggtgcaacgggtttatttaaatttaaacgaactggccgaaatagacgtgatcttgatgtaactaatcaaggttttttgttggaccagtccatgtcgattgtcaaattctgaactctctactttatcatgcctagtcttaatacgtgtattaattaacattgctgcgttgttacatcaaataatcagataaagggtctgttcactttcatgccattttcaactttactaaaaaaatttggtatagttgccaaaaaaaatggctacatttagtttgctgtaaaattttagtaactatataaaaaatcctgttaaaactttgtcaagttgccaaaattttgatatagttaccaaaatttttgtattgccaaaatttaataaggttgaaaatagcatcaaagtaaaaaggtccgaagataatcgaaaaaaaaagaactacttaggagatgttgtcaggaaacaggaccacactgtagtactcctagatggacggtcaaacaacactcaccagttgctgtgggcaaattaatggatttgtgtggattatacgtgtatgtgacttgggatgcgtgtcacgtgtaggcagccaccctttt

SEQ ID NO: 68821 - DNA, 1841 bp, Oryza sativa
atgatgatccctatataatttatgtgttagcattaactttgaggatcagcttaacagtacagttagccttgattagggtcatcactcatcactaacatatatgtattatgttaggtcttgacaaggagtagtttttctagaactccttgataagagtcactccgtccttaagaaaaaactaacctagatatagacatgcatattttttagtacaataaatccgaacataaatctgttaagattcattatactaggatacgtcacgtatttgtggctaaggtttatttttttgggacggaggaagtagttaattacatgtagcgtttaaaatttgtcttagaatatatatatatatatatatatatatatatatatatatatatatatatatatatatatatatatatatatatatttgattcttcaccaacttaattatctgactctaccaatcaaaagttcataataatcttttgtttaatttctctacttatttttatcttaactaatcacaaccatcctttatttaatttattctttccttaattaaaagacatcctctatttaatttcacgagtataaatcaagcgtaagcaaccgaccaatcatgtgctcaatgggagtcaactatggtcttagatcagcccactaattaaccggacaccacatcatcactcagatgaatgtattataaggccattcccaactcaatgaatagaattgtgttcatagcattaaataagctgccacataggataaaaaatgatgtgacaagtgaataaataagaaaagagaaggaaaccatgtcttgcatgagatatagtttccacacaacatccaagacatcatgtgagataagtagtattgaatttaagtatggaataatggtgtttgcattggaagagtagtgtatagtactagtttcttgatgatgtggagtttatagaaagtatgagtgtcttgggttgggaatggcctagatggttggcagatgcttattactactaactcctatcataattcgtagcttgtaagtaagtacctatgcttagttgtagccaaaataattgatgtacttatcaataacttgatgagttcatgttaaggaaatgcagctcgatccgatataaatttgtttactatatattgtgtcatcattggctacatgcatgcatgtgactgtacttggggttaactgttactatattaagttcctgagtacatgtgcatcaatgcatcgtcacttgatcagcatcaaagaggagcgacaatacggcatttcggagcacaaggacacaataagatcattttccatcactaaaagttaagatccaatttttttgcttctctttgttttttcaattgtcctgcctgcagcattccttccaattttatccgcgtgttttgacattattctcgtgttcaaaataagacatcatcagctaaatcattgagaaacgagtggttatatttttttttcttttgaacaagctaccaaacattggatgtttttgttagaaatatgaagaacaccttcatatatacacgccttgtcatacacaatcttggaaacacccgaaagttttccgactagattcataaggtagtgggcctagccagtctggattcgaagcctcaccccttctgtttatttgatattagattattctttaatatttgtgttttttttatcatacacaatctcaaaaacgtgtgaattttgcggtgtacgtatatatatttatataagacacgtatgccaggaatatccactatagtacggaatagggctagtagagacagttcagaactgccaattaataataacaaatttcgacctg

SEQ ID NO: 68822 - DNA, 5383 bp, Oryza sativa
  unsure (1)..(5383): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttctgagtacattaggccaaacagagtacagagcaccagtcaggcctgttttggcaagatcatgaacctgaccaccagagagcttttaagtgtgatcagtgctcggatacgctcgactctcagttgcgtaagttccctggatctcgtggccactactggttgtcgggagacgaaggcctctgcttctctccccaccaggcaccaggccaccaccggcactgtcgcactgagccattttctctgtgagaagtgaaacgctcagaagtgaaatggctttgtttgaaagagcttttagccgctgtaacttcttttaaaatccgtagctccttcaacagttcagattttcatcaaaattctgagaattgatagatgtaaaacatagaaataaactgaatgtcaaaaggtagaaagcataacttttcagattttcattcagcttcttatcagcatcttgaactacccataggtgccatttccactagctggccccaaccgtgcagtgatgattgtttcattgactagtttgaacatttgttgctccagccactgatctggccgtgtgttcctgttacttcatgcagtcgctcaataatgcgtttatgcccatgctagtctgatagtagcagtttcctagtgctagtggctcccatgattacgtcgtaatctatcactctccctcttgctttgacaagtgaaatctcttgacagactccatccgtcccctaatataaagaattttaacattttgcttgaccacttatcttattaaaaaatttaagcaaatataaaaaacaaaaagttatgcttaaaatactttggataataaagtaagtcaaaaaaataattctaattttttaataagacgaatgattaaacagtacaagcaaaatcccttatattagaggatggagggagtattaaggactcttttgacatatttgatgtttagtccgacggtgtgccgtttaccattaccgcatgttagcagggattcagattggatgacatggggtgaatcttggccctccgaaacaaatccaacggctgagattcgtccacgtcatcatgagtaaaagttttactcctagttaaatttttactcctgagtaaatctgcgagtaaaatgtttactcgtgatgacgtggatgaatgtcagccgttggatttatttcatagggctgagattcaccctatgtcaccttgtgacatgcctaccctatgtcacccaatcccaatccaccttagcggtaagcacagttactatggtaactgggtttactgttagggtaggggaatgttaatcgcaaagtaacccttccaaattttgaaagataatttaatttcttgataaaacttgtctatatttttcacggtttgttgtggttatcacagttatgaactattaactgtgcttattgtcaatgtctggcaatctagccatagccatacggttcaaatcaaccgtacggctatggctagatttcgtggaaactgttgataaaactgataaaaacagatgatatccgaacaaatcttgttataaaaaataaaattcaatttgttttttgattgactagagaaaccgagttgtttgtattttcaacccggttttttgtaaacccaaccagtgcctcgtccattgtgagaagaaaacactaacggtgtgacagtgagtgtttatatcattatatatgctgattatatggagaaaattgatatttagccattctcgggttagggtttcgccaaaatgccatcgccgaatgtggcttcgttataatgccatcttcaaacgactccatcttgccacactaccaatctaccatttcaaccgattttgattatttgcaaatgttttccactgttttgcttatttggtttgacccaaatgcccttacctcagccatggggcccacttgccaggagcgtcttccacctctgcccaccaccatccttctctctctggtgaactcatgcaacagtgttctctcttgacctccctcctcggttgttctcgccccaaattgaatgcaaaaatcggttcctcttgtcctcatcaattcccccaacaaatcccactcaaatcagcgtaactccgtggtgtattttgaagtccgacttgaatagcaagctccaccatgaccggcgtcgatctctctccccggcgaggttggagagcctgctcaagcggctggacgctgcgggtggagcaggtcgctgcccacatcgaggagctcatcagagaagggggtgacgccgtggcgcgcggtccggtcgagcacttggtgcgccgtgccgccgagccgaaccgtcatctccgtctgcaccgctgccttcccgtccccagccatgccgccgcgtcgccttccctgttcccggtcgctgtcgccaccgccgacaacctgcgggtgaacctggtgagctatgttgtcgagctggtgaatgcggcgaagggcaaggtgaacatggagtacatgcggttggtggtcgacctcatggtgaagcgcggtcggccgaaacttcacgatggttcgacgtggtgaaggccaggttcggtgacctcaacttcgggtgggggaaggcggcgtatggcgggctggcgaagggcggggtcggcgccatttccggtgtggccagcttcctcatcctgtagcggttcggcaacggtcccgagctgcgccgacgccgcccaccatctgcaacgaagagaggaataggtacagagagatgcaatgggaaccaagggtattttggtcatcttagcaagaaaaaaatcattaaactgagaagagatggatgaaataacattgcaacatgttgcgtctgtttgaggatggtattttagcgaagccacattcggtgatggcattctggcgaaaccccaacccgatgatggtaaaatgtcaattttctcgaatatatgggccgtcaaggaagacctcgaatccacggcccatgacacgatgggccctctcaggtgggtggcaatctgttccatcttctccggctctccagtgtgctctcaacgggaaacaggacacaggcctttctttgggaaacaggaaaaaaaatgctagaaccagctgcaatatcgcttaacaaggtatattggtggatccatttcatcccactttatgaccatgcaaattgtttaagacattttctaatttacaataattgttgggcgatctgccatttatagatcgtcttaaatcattacatggaaaatggaacacctactttcgcagcttcgcttcaacagatcaatgcagccagggcgtcattttgtttaccgatggacaaggtgacatgggttaatcctacgggtagaggtgacaaacggtgaaatcttacacgtgggagaaggagccaccatataaaataacaaggacagtcaaatgaaactggtaaaaaatatacactactatattatatataagggcagtagcaatgcaaagctacgtcaatgagaaacctcatattgccaaataggatgaagcaattcagaaccacactttccatggtgcaagcagcttgctgtgtgacctaagagtagatatttgcatttcagtccctattacctttaaatttacagtagtacaaaattttacactcaacaccctaaaatctacataataatatataatctctccccagtccccacctaccgccgatttctctcctctccccacctaccgccatctgtcctcacactcaccggcgccggcgcaccgggtggggaagcctagaagggcggcggtcgaggagctccttgggcggcacggcgacgagctccctggcggcaccggtcgctgcctctctgtcaacccgtcgacgacgccacctccgctcgagatccgccactggggcgatggccggcggcgtagagatccacgagcggtcgtggcaggcgacggttgcggtcatcgacgggctgacgggagggaggcgcggtcgtggcgggcggcggtggcggtcgtcgacgggctgatgggagggaggtcggcgacggcggcagtggcgcggtcgtggtgggccccggacgacggccacgcttggcgccatggctctttgttcctatagcgagatgcgaaaaaccaatcagagctatgaggtctacttgctttttcctccacgtagacgaggtaacgcgccatatacttgcattgtgaaagacctaaggtaccaatcaggaggcttatgtacaagagtgaaattcatttgaagcaatcaagaggcttccaaaccttcatcaatttttttatttcttctaaaaaaagaggcttccaatatttggttagttaatcgactgatcaaaccaagaagaaaataacaaatgaagcctcaaccttaagttcgtactggattgagtaacctctacaactatctcatcaatgaagtagtttccggcaaaattaatgtgaggtcgtttcttgccctggacagtgcacatactgatgatacgttatagatatattgactggatatctttatctttacctactataaggaaggccctacacgtcgggcgcccgatgcttcgggggaaaaatcgggcgctgacgtcagcgttcgattttacgtgcaaaattactttaaactgatttatctcttaaattacttatccaaatcatgatccaattgcaccattaaattcgttgcaattaaatcttcaaaacaagaccacacatggatatattttgacgaaattttttttagcttattattgaattatttttaaacattgcacgatgttccaccagatatatcggaattgtttcactaagtagatcgaaaatgtttcactcatttaaatcgggtgttatttcaccttatataaaaacaatgtttcagcaaatagcgaaagaatgtttcagttcactacacattagatctatacatagtgaaacattatgactacactagatgaaacatttttcggtggaacaaaaaataaaccaaattccattaatagggggtttccaaaatatgtgggttttttttgcaatggaatgtttcgttcagtgcaacattagatctatacatagtgaaacattgtgagtacactatgtgaaacattttgggtggaacaaaaaataaaccaaattcccttaatagagagtttccaaaatatgtgggtttttttttttacaaaaaagtattttaattcacagcaacattagatctataaataatgaaacattgtaaatatactaggtgaaacatcttttatagaaaaaagaggagcagaaataggtgggcccaagtagtcacgtggagggagggggcgc

SEQ ID NO: 68823 - DNA, 19612 bp, Oryza sativa
gcccgatccagctccccccgcgccgggcgaccagcaaggagcatttctatacctaattaaaaaataagtaaggcttccggttgatttttttgtccgtcattaaagagtgggcccatgtgattatttcgcggctaatctgtgaatccggatgcattacggcgatctctgacgctccgaaaaaaaaaagagaaacgaaaaaaagaaaaacctagcgagcagcccagccaagacggcagcaggccggcccaacataaagcaaacgcggcccagcagccagcccacagaacagagaagcagcagcccagtacagcatagttatgtgtgatactatctatatctataactaatataaatattcgtattttgttttcgtcacatctaattttcgtccgtacacaatccgatttggttagcaatagccatggaaaaaattgcaaaaaaaaaaaaatccgccgcaccctgtcatcgctacaccgtgccggcgagacaagaaggagagagggagagggagcgcggacgtcgtcgacgccgccgttgggagggcgccgtctccgccgcaccccgccgtcaccgcgctgtgccggcgagaagggagagagaagagaagggaagcggtgctggtggggggagagacgacgccggtggcaggggaggcggccggctggggggagggggagaggcgggagagggggagagggagcggcgccgccggaggggaggggaggggaagcggtgccggtggggagatggggagggggagaggcggtgtcgggacgggggagagggaggcggccggcttggctcggctgggggggagggagggggagggggatggttagggttagggttctcatcaatttcaaactgatctgaaccgtccatcaaaacgaacggctgagatcgatcgagggtttgggccgcaccacttgggctgcaccacttgggacgcacacgggccggcggtccaccaagtgagaggaggagtatgggggcattaagtagactttggtcgcttgcgggctgaagaagaaaatgggctgaaaaaggctcatagagaaaaaataatttttatttaaataaatgctgaaatgatatttgtattatcaaaattagcaattaagctatgtaaattccaagaaaatttcaatgaatgtaattaatatagaaaatttaatccaatcataacattttatttctcacacttactctacttataaattaatttaattatatacctactacttaaaaaatacctaaatatgtcagaaattttgtatttcatttaattagaatttaatatgttttaattcaattttatcttttttcttttcgttgcaacgcacgaacacttttgctataatttcaaagagtgtaattaatattgcagaaaatttatatgtcattaaattataattcattttcttcataaaaatagttcaaatcaaagttcagtcaccatattattatccggtgcaacgcacggatattttgttagtccgtataaagattgaagatgtttttgctgtagcttttggtacgtcatccgaattaatctccgtgtcgagttgtttttcgcgttaatcaccgtttccgatttcgcattggatcacaacgcgtgatgcggaggggtgaagatcgcatcagacgtgcttgtctaaccgaaacgggcttgtgcaacatctggtcctgccggtttgatgcagagccggccagcccattaacagcctaaccacggctttctctgtgtaggtcctgtttggtcagtcaaacaaatctatatacctaccggtatttttttgtccattgtttttttccgtatgcatttttttcgcacggtccagctttttttccgtccgaccggttttttttcgcacgtgcacgcggttttttcgcagggcccagtttttattctgtccgattggtttctttgggcccggttttttccggtccgaatggttttttcacgtggttttgttttgccaggtttttccccatccaatttttttcctttttttccatcctatattttttccgataagtttttttggtgtgcacgggattgaatcccaaatctatatatataccaaatttctactattataaaaattaaaaatgtttcgccgatactttggtatgtcgtccgtatttgagtcaccttgcatgctaatttgggacaaaagtcggactcctaattaatttacaattctcgccagaccataagaaacttttgcaaatacataaggagtcgtataagaaatcattttaaaaacctaacatgctaacttgggacaaaagtcggaatcctaattgatttataattttcgtcagaccataagaaagcaacgtacaatatatgatcaatactatcaaaataaaaatccatatacttttaagaaataaagtctaacaataatacgattaaaatagccttcacccgttgcaacgcacgggtattttttctatattataaaaattaaatatgtttttaccggtattttggtatgtcatccgtatttgagtcagtttttaagtttgttcgcttttgaaaaaatatagatccgtgttaaagtcagattttaagttcgtttgtttttaaaaatataaaagaagtcgtacaagaaatttctttaaaagaacttgcatgctaacttgagattaaagtcagactcctaactgcaactcatgattttctaaaaaataaatccaagcgaattcctaaatgtcatcctatctaaaccgtataacaataataatattaaaatagcattcacccgttgtaacgcacgggtatttttttagtcaagtttaaaaatatatctttgtatatatgtgtataggacaccaccacctaaggcttcttataggtaggtctatacctataagactataaggtataagagagtatataaatatttttactttcgcatgtactggagcacacaattaccaaacgtttgggcccgagagcacttaatttcactagaaacacaaaagcccacgtaaaacatcacatggcaaagtatggcacatgctgtccatgcgaagctcccgttccacctcgtttagtcccacctcggaaaactagcttcagacagcgcagcttaaatagcaagagcgtcccaccacctccagccgagctcagcagcgcgagcttgtaacccgagcgggggcattaaggtggtgtggacgttgccgtatggctgcgggcctgggttggcagtgccatagatggcccgcccgttccaagttgcgtagttgggccggcggggcttgagcgaaagctctggcctcacgtttccctagagtggcaggcattgcgtgaggctggcttcacagagcagcgaatactgtccgcttccaacggtggaaggataacgggccgccgcactgctggcccgcttgggtctcgcagcctactccaacggaccaccactttttttattattattttcccatcttgtttgcctgaatttacctctaactgacttgctgccacgcatgtaggccgtctttacggatcatgaacacgggtattcttgagcggtaaaaatccaacttgtatgtatttgtacacttcattatctaaaaaagaatgtatttgtacactttgttgtaaacaattcgatggaacaaaaaaaaactaaagctggtgaatttgtcgttgaatcaagtcctttttagtttttttttagttttgctgattgaagttctctgttaggcataattggagcttatgttgtttttagatttaatatatttcaattgttgcacagactgggatcgcagggaaacataattatttatgctaatatagtaaactgggttaacagcaaactgaaagcagcgggaagaagatctcaaatggaaagcttcaatgtgttcttcctgtagcctccagtctcaatcatttaaatactactccctccgtttcacaatgtaagtcattttagcatttcacacattcatatagatattaatgaatctagacatatatatctatctagattcattaacatcaatctatctagattcattaacatcaatataaatgtgaaaaatgttagaatgacttacattgtgaaacggagggagtaattacaaatttatactcattcttctttcttgatggaaatgccaagtgtaatacaggcagagcagcagtagttcatggagcaggaggcgtcagcttattgcccatttttctcttgttgctgcttgccgtcgacacgctgaagctgttggtgttgtcgtttgactttttttaacagaaagaattttatttaaaatgaaattatacccggcctctacatacatcctaggactcacacaagcgaaaaaaagaagaatatcctgagacaaacattaatgtatcatgtcatcagatcttctagtctctgttgccaaatgttgaagaaatcagacaaaaaaggagaggcatcattgctgaaaaggggatcagcttgcctactgatgtcaaaagaaaccgtgccatcagctcatcatccagcttatgttgttcaccagatctcttataattcttgtcaccagatccttagaccggcgaggagaagaacatcatagtttctgaagtcctgcactggtgctgcgccacaagggacacaagcaaaccttggtggattgcagaaaaggtgtgatttagcgatcagttccgtagttagctctcataggataaaaagtgatagtaattagtaggcaaaattggttatatagcatcgaaagttcacgtttttggttttatagcaccaaaagttaccggttcactttaatagcatccaaagttcaccctgttaccatttttagcacttccgtcaatttttctatccgtcttgatcgttattgatccagtcacacacatgatatgacatttctacctctcattgacatgcattatacttgtacttgtgaggggtagaaacgtcatatcgtgtgtgtggctggatcaagacggacggaatcctccgtttcacaatgtaagtcattctagcatttcccacattcatattgatgttgatgaatctaaatatatatatatatctatctaaattcattaaaatcaatatgaatgtgggaaatgctagaatggcttacattgtgaaacggagggagtacatatttcaaacatagagaagatgcattgctactattataagtgcttaagaaacaatggtcagtaaatattcagactgaagttctctaagtttcagatatgacatacattacttagtaagcttctcttttcgcaaattttctgtcggattgcccgagtaaaattttcttttcttttatatttttccaatgacaagtagtactcgtacttagtgaggttagaagtagactactcttatgttcttacgatgaaaagaacttttaaggtataatttagtgattgtatatacaacatattgtgtctaaaaagttctcaataatcaaaccgttaagaatcggaagtacctccaatcagggggcaagttcatcgtggaacttcatggttggtttaggggaggccaccgccgagagccagagataaaagatggtgtcaccagtactcccttcactccaaaataaattaatctgatacaaaataaaacatcattgaatataatgaatttgaacaattattctattatctaaaagaaatgaatttggacaatgtttagtgggcgcaagaaatctgaaaaattggcttatactataattagctcggaccaaatatcgtgagcttttcttttcctttttttttatagtttactcattctctattgaataaagttggtagcttgcgcattaaaaaatttagacaatgtttcgtcttacggactaaggctatattcttctcccatcttttccaactcacctctttcatgttccttgcacacactcttgaaactgctaaacggtacgtttttttcaaaaggtttctacacgaaagtcatattaatataaaaaaatcatattaatctttttttaaaataataataataaaaacttaattaatcataagaaaatgcgtcgctctattttgcgtacgcgggatgtgagttcccaacctcacctcctaaacacattctaaatttgtttctcctcttccccctctcgtgctgggatggatagaatagtcattaatgaaggttgaaactaagttttctagtttttcctttttgtgtttgtgtatattgttctgtgtgaggctcggagtctaaaaactcgcgcatgtttttggcagtatatcctttgacatatagagaccgaattaatgaaaaattcactattaaaagtttttagattagtttattttaggataggagtggatctatagttagcgtcagctttaggcgacccgacgacttccgacaaaaactatgattatacttattcatatattataatgatatagtctaagtataattagcatgtcatggtatcgatagatctattataataccaatgaattaatttctatatccatcattgttttaggagatagaggagaactgatatgaccgtggcagagaggaatggagctgggttgatgtggatatctccgtgatcgctacaccaacacctccaggttccgtactaccgtccatgtgccaaattgtggcgcaaaaccgtaccactcggccactccggctgtttcccgaacaaaaaattgtggcctagcctagcgtcaccctcaccgtcctagaaaagccttgcgagcgagagagcgacacgaccccgcccggccgcccctactctcctccccgcctcaccgcgctgcagcacgcgcgcgtggacgtgtcaccccgctccgctgcacgtggccatagccctcgctggccacgcgccccccgagccttccaggcgcgccgctctgcgtacgtgtcccctcctggtagagaacggcatcacggcgcgccgcgaattataagccgagcacgagcacgagcacgagctcccctctcaacgccagggcaaatgttacatcgcgcctcgcgtctttacccctcatgtactcgcttcgtttagctagcagcggcagcacgggactcggcttcgcgctcggccggctcggcgggaggagtggcggcggcggcggcggtggtggtttagcgcccgcgtcggcgtcgtcgtcgtcggtggtatccgctcgcacgaggaggaccgtctccgtgacgcccaacgccgcggcgccgactccgggcgagcagggcgtcgcgatggagcagggcaagcagcagcaccagccaccacctccgtcgcagccgcagccgcaacatgaaaaacgcggctcccgcgacgacgacatgcacaagaccacagggtacgtacgcacgaatacactacagttttggcgtgagcggctgcgtgcgccggatttaaccgtggcgtctgcgtgttcgcgtgtgtgcagggacgtgatgacccactctttcggggagggatactcgacgcggtcggacgaggaagggttcggtggcgtgtacggacagaacgacccggtgttcaaccctgggaccgaggtgcaccccagccaccctggtacgtgcactgctgctagataaaattaacgaatttgctatatatttatcgataaatttcctcaaaaaatttgtcaagatgcaattacagtacaatcgtagtgtaattacactgtaacttgcatgtaattacactgtaactataatgtacaacttgtatgtaactttcaacaatctctcggtaatatgttatttcagtaaaatagaggtcatggaaacaaatccttttatatatgtgtgtgctatgattttttttcttcctcaccagaacaaatcttgtaatagatctaacgattcaaaattacgtgaaacttaaatacaagttacagtgtaattacatacaagttacaatgtaattacactacgattgtactataattatatctgtcaaatttttagtagaaaatttgtcgacaaatgtataggtagtccctaaaattaatttgacacatccttaaatatccgtcttgaaaataggtacattaataaacatatccactacgaatcttgaatctggaaggatgtctaatgaaggatgtctaattttgtttcgagtaattttataatcttgagaaggtactgtaacgtatcaaaaattaaaatttagtgtaaaatttgatctctttataattttacaatagaaaagtgatacctccttgaggactaaaattgccttttgttttggtttataccgagtagttgggaacagtggttacaggagggacgtgaacttaattattaatctgaaaatttggattttgatctctgttttgattaataactggggttgctttggttgtactgcgatgtgtgcagagtacgacacgtcgcaggggtcggaggtgaaggagaaggagaaggcgcgccaccataaggacgacaagcacgcgacctaagcctagcagttgggggctggattaggtcctaatcgtagtttagtcgggcatgacggggatcacccccatcatcacctgtgcatccacgttgccctatctttgatgggcactagttgtatcttttgcttctgaactgttttgatgcatttgttttattccttagatgtgatgtaaaatctctacagtacttaattagctatgtactggtactgtgagttctccagcgcttgtgtctcctggtgtgtgtgatcatgtaatgatgagtcgattcatatatatactccctcctcctccgtcatcccttctataggattttcaaaaaacatcccttctataggatttgtataataaatctgtaataaaagagattttaggtggcttggatatattctgattttaggtggattggatatattctagtataattaatttaggcagatagtttttaaatttattgtatttttaaatttattgtattgggacgtgttacgttcataaaaatcccttataagatcgaaacggacataccagatgagctacggcagattcacaaaaatcccttataatttaggcttaagtgcgctccatgtgaggccgccgctctaattcgaccgacgactctttagggctcgaagcttctgtatcgtgagccttttgggaagggactcaaggagtgatgggctactcgctatattcttctcgaaatactacatccatactaaaatgtaataatttttagctaaacgtataacttttagttataaatctgaacacataattatctagattcatagctaaaaatacatattcatagctaaaataattaaatgtcctaaatgtaacaacttttagctatgaaacttttagctatgaatctgaacttagctatgaatctgaacgtgaacttagctttttagctatgaatctgaacttagctatgaatctgaacgtgaacttagctatgaatctgaacgtaaagttgtttatattcatagctaaaaatacttaaattttagattttaggacgggggagtaagtcgttaatgggcctctatgacacctaagaagcattttcttctcgaaataagtggtgtttggataagggactaaacttcagtaccttactctggcaatccatgtttatgtaccgagagaaaaaaatcactgtcacgcatcgaaagtttggacatttggtctattaaatatagactacttataaaattaattatataaataagagctaattcgcacgataaattttttaaacctaattaatctatagtaagcacatgtttagtgtagcatcatataggttaattatggattaattaggctcaatagattcgtctcgcaaattagtctaggttattgtcggtgacatgggaccgggagtatcatgactagagccttgaggcagacacaatcgcccacgtggcctggcaccctcggggggcgtcgggcccgagggtgatgtgttcgccctcctctttgtctccccgagggggtcggaccgctcccgcctcggccccgagggccgaggcgccccgaccccttgtgggttttgcgccgcgtatatgaggtaggtgagcatagcggggctcacctaaccacatttattgcggtttggacgagcgcgtcacgccgcatgtaacgcagtgcagtgcgctcgtttatccggtcagtgaccagtcacagaccgatcagatcgtgggttaggtggcgacaggcggtctgacgcacgcctcgccccatcccgtcaggatgagagcctccaagcactcgtccctagccggagccggcgtgttagctcctggagatggcacattggtcccggtcagatatataccaggcttcatcctaaccattacaagcaagacattgtatgaagaggggcgaacatgcagattgataaactgacgcgtggtggacaagaatgaccgatttgtgactggtctgacactggtcatgtcgtcagcagacagccatgttcccacgtcgcgcttgcttccggcggaagtggaggtaggtatgggccgtcccatcagaaggtcattcggacggcaatcatacaaatctccgtccatttatgaaaagataggataagtccccacaaaaaagagagagatggtgcatgtggtatccccttgaggtataaaaggaggaccttgcccactgagatggggactggacttttccaaattgggaacccagaacaagggagaggctggctcataccttgtagctccttcatacgcagatcacccaaaacacaggagtagggtattacgcttctcagcggcccgaacctgtatacatcgcccgtgtcttgtgtgtttccggtctagcgaaccttccacatacagagagcttagaatctcaccctgagtccccggccgaaccggcaaaggggggcctgcgcagtctcccggtgaggagcctcacgctccgtcatctggcgcgccaggtagggggctctgcgagggattttctgagctctcgcactctttcgtgtgcgccaagcttttcctgttcagcccaatggccgagccagcaaaggcacacgacctctccccgagtatgagcggtgacgacggggagccaaacccacgccgtcgacctcgtactccaccgccccttccacgccaaagtcctaggcgggagaaggcgctcgagagggctcaaggatccgcgacttcgacatccacaggaggtggagaagggcggcgagatggggagcgtcgcctcctcatctacggcgacggcagcacgccccagggcgcgctccaagctgcaggcgcgctcctacatcacccgcccgtcgcccatgacccggagtctccagcccaacgttggctggacgatttggccaaattggtcatgactgcacggcagcgcctagatgctggtgggcggtcctccgccaccaaggcctctggtgctgctaccaccggctccgcgtcgtcaagacggagggcgcggcgagcggcggctgttgctcgccatttggccgccactccttcgtcagcgcctccgacccaggaagatctgcgtggggggccggatgcccgcatcagtatcgagcgccggcgtaatggccgacgtgctgcccacgcaacggagggcgcctcctcgtccggagtgtcacatcaacacggacgcggggatcagccctccgtgcccccggttggtggtgtcggctgtagagcctttgtggcgagccttcggaacgtccgttggcccccaaggttccggcccaccatcgccgaaaaatatgacgggagcgtcaaccccgccgagtttctccaggtctacacgaccgggatcgaggccgccgggggtgacgacagggtcatggcgaatttctttcccatggccctgaaaggacaggcgcggggttggctaatgaacttgccacccgcgtctgtccactcttgggaggatttgtgccaacagttcaccatgaacttccaaggcacatatccgcgcccaggtgagaaagcagacttacatgcagtccagcgaagggatgatgagtcacttcgctcatacattcagcggttctgtcaagtccgcaacaccataccatgcatccctgcacatgcggtgatctacgcgttcagggggggtgtgcggcacaaccgcatgctcgaaaagatcgcctccaaagagccccagactaccgcggagctttttcagctcgcagaccgagtggctcgtaaggaggaggcatggacctggaacccctccggttccggtgtggcagcttcggccgcccccggatccgctgctcagacagggcggcgtgacaggaggaggaagaagaggtcagcccataccgacgacgagggtcatctcctcgccgtcgagggtgcttcgcgggccacccgaaaggggaggcctgcgagcgacaaaaagaaggaagccgacgctccctgacctcggctacttggaagagcgaaggtggcgcgcggcccttcgagccgcgcgcaaccagcagagcctgcggcgctaccatcagcgccacgtccgggcccgatcactctgcgtcgacgacctcgtcctacgccgtgtccaaacgcgtgctggactgagcaaactctcaccaatgtgggagggtccgtatcgagtgatcggcgtcccccggccgggctccgttcggctggccacgggcgatggcacagagctgcctaacccatggaacatcgaacaccttcgtcgcttctacccctagtgggggtcgggtgtcaggtcttgggctcgggccaaccccgcacccccccgggcgtgcagggttggccgggggcttatcttttttctcttccgtatttcaataaaagcattttcgatttcctaaaggctgtatctgtgctgttgtttccttttgaaggatcttgacttgaaataggtcactcgtgttcaatcctgccctcgggggctcgggtcggctaaaatcgccaaacggggcccagaaccgagccgtgccccgggacgtggtgaactccgggggggaatcggcaaaaacccacaatcgggtcacccataaccctcggtcaccacgctcccggcctggccagtctcgacatgtggatctccccaggcactagccttgacctgcgccgtttgaggctgggacctgggcacgagcccttgttcaagccaagacacaaaaggaccgtggcacagaccatcctcgtctcatacacagaacaaatgaaattgacacaaaaatttcctctttatttgattgcagattaaatcagcctataacaagaagaaggcccgaaggcctcggaagaagaaggaaaagaagaaactatttaaagattggcgggggcctgggggctcactccgatgcacccgggtcgccagcctcgtcgccactgtcggttttcccttgctgatgtgcgcgatttgcgaccaccgggattctgcccgaagagagagagagcagggaggagaggcccccgagccgaacggcggcccaaggcccccgacggccggagctggctctccgcctgcttgtccgacggtgccaggcgcccccgacccccaggatggccccgaggccactgcgggaaggccgcgcctgtcgccctctgaccccgaggtcgtcggcacagaagccgagtgcgccccgcgtggcctttcggatggagagcgccctggagatgtggcccctgacgaagaagatcggccccgccgaaaggtgcagcggcccgtctacttcgttagcgaggccctccgggacgccaagacccgataccctcaggcccagaagatgctttatgctatcctgatggcttcgaggaagttgcgccattatttccaggcgcatcgggtcacggtggttacgtcttatcccctcggccgaatcttgtataaccgagagggtactggacgggtggtgaaatgggcaatcgaactctctgaattcgatttgcgctttgaaccaagccacgcgatcaagagccaggccctcgccgactttgtggtggagtggaccccagctcccgagctcgtctccgtccccgaggccagctcgagcccatcgcagctgcctcacaccgccctctgggtgatgtagttcgacggcacccgtaggaaccggccctacctgtcaccaggccttagaagtggcgtcacgcccgaccgcttccctcggggagggcgatcgccctggcataacgccgggggctactgtcggtgacatgggaccgggagtatcatgactagaggcttgaggcagacacaatcgcccacgtggcctggcaccctcggggggcgtcgggcccgagggtgatgtgttcgccctcctctttgtctccccgagggggtcggaccgctcccgcctcggccccgagggccgaggcgccccgaccccttgtgggttttgcgccgcgtatatgaggtaggtgagcatagcggggctcacctaaccacatttattgtggtttggacgagcgcgtcacgccgcatgtaacgcagtgcagcgcgctcgtttatccggtcagtgaccagtcacagaccgatcagatcgtgggttaggtggcgacaggcggtctgacgcacgcctcgccccatcccgtcaggatgagagcctccaagcactcgtccctagccggagccggcgtgttagctcctggagatggcacattggtcccggtcagatatataccaggcttcatcctaaccattacaagcaagacattgtatgaagaggggcgaacatgcagattgataaactgacgcgtggtggacaagaatgaccgatttgtgactggtctaacactggtcatgtcgtcagtagacagccatgttcccacgtcgcgcttgcttccggcggaagtggaggtaggtatgggccgtcccatcagaaggtcattcggacggcaatcatacaaatctccgtccatttatgaaaagataggataagtccccacaaaaaagagagagatggtgcatgtggtatccccttgaggtataaaaggaggaccttgcccacttagaagggggattggatttttcggatggagaaggatcagagagggagagagtaagagctctctggttctccagctctttgtagcttcttcatacatagatccaccaaaacacaggagtagggtattacgcttctcagcggcccgaacctgtatacatcgcccgtgtcttgtgtgtttccattctcgtgaaccttccacatacagagagcttagaatctcaccctgagtccccggccgaaccggcaaaggggggcctgcgcggtctcccggtggggagccccacgctccgtcagttatggaataggttttttcaatagtctacatttaataattctaagatgtgatcggggctaaaaccttttaatcccatctaaacagcccctaagtctggttgccaaccgtaatatcaaaaaattaatttagggtgtaacttacagaatcatattacattcagtcttggataagaaactatctttgttcggtcggccaaaaaccacaatagttccggttgcaataaaaacccagactaaagatggtttttagtcccagtttataagcagaacgggactatatgatctttagtcccggttcacatgttgtcatgggctgtcagggctctccgggatctttagtccctgttgaagttaccaatagtgtatccgagatacactactggagaccggggaggaggggaggcagcggcggctgcgccggccgtgggcatgagaggaggacgggccggcggccggtagcgccggatttttgtcctttcttttttttaagaatttgtgattcattgtattgaaatgaagaatttgtgattcattggatggattgagatgtataatttcttttttgagaatctgtggtctgagatgtataatctctgatgtattgagatattactttgatttggggtttgattcggggatatgtatctcactcgatttgagagaaaatagttagggattaagtagtaagtatcaatagaaacaatgaaaaaaaaagaaactaaccggaactgcctctgccttctttagtcccggttggtaaagatcgatctttaatcccgagtatttgaatcggggctaaatataacgatctttagtcccggattcatagtcccagataaaaaaccgggactacagagaattataaactgggagtaaaaacgatctctccacccgtgatagctggttttgctagtggcatcctaaaatgaaaagaagaaaaataaaaaacaagtagaagatcaagactcaccttcttctactctccaactcttcccctcacccccacccaccccttcgcccactcctccctcttcacgccaacaagttgcacgtagatcgttaccaacggcctccacctggggcacctgttccatcgatcccgcattgccaccattactgcaagctcgagcttggcaatcaccttcccaagtgcccgccgatcctgcatggctgcatcgccaccatcactgcaagctcaagcttggcaatcgccttcccttcacacgatagctacggaacatagctgccgatcctgcatcgccttcaccacagctagctcgagcttggcaatcgccttccctttgcacgatggatgcggaacaaggaaggatggggacggggagctccacccagatgacagtggcgccagagcagaggaggcactgtgggccgctttggcgcatctttgtctttttgtcttattattattattattattagaattggcgcatcttgtatcgacatcccatttctcgcatagtcgcctgccttcccttcttgcggcgggcgcatagagtggtgtatcgtgggtgctcatggtgtccgttgtttgttcgaaggaccattgacgtccggccccagcaccaggcctgcgtctatcccttagcagcctgcgcggtagtgtgccatggctccatgccctgagaggaaaatgaatcattggccagagtaagggactaggaggaaagagaatcctggccagatagctaccacttgcggccttgcaaatttatcacaaagtgtaatggtagtgttaagatttaacgctaaaatatatagttttgctataacttattaaagctataacgttatgatgtttttttaatatgcagttctatgatagatttgctataaaatctgtagatacgccttaaatatgtagtattgcgatagttttggtcaaattatatgtaattttgtaaaattttactttaaatattactttttaatgtataaatttgaatattatttttaatgtataaacttgacaataaattctttggattttggacaataaattctttggattttggcgatgtcaaggggaaaaaaatcccatgtcacaagcttaatggctcttttaaaatgacaaagaaatttataaaatctaaccatatcatttataatagagtaaatttcacaaaactacatgtactttggtcaaattattacaaaacttttgtcaaaaaaattattacaaaactacagatttaagataatgtatcatagaactacagatttaacaataaatttatcacaaattacatgtttaaggctaagtatcacaaaaatatagatttaataataaaattatcacaaaactacatgttttgggatttaaatcgttagcattaatgttatgttggacttataattgttcaagttttgtgattaaattgtaactaaacctgtagttttcatgatattccattttaaacatgtagctttgtgacaaatttagtgttaaatctatacttttatgataatttgatcaaagtacatgtagttttgtgaaatttaatctttacaatattcagaacaaaccttttaaatatatgtattccgaaaggagcaatgctatacgtaaatatctatctaatatatttacggtggcagagccactgacgttttggcggaacttctaaaaagtaaaaaaaaaaattaaacctaagcgataattatattcgacttttaaaataccaacgataataaagagaagatacaatggacggccgtagaagagtataatggtagcgtttgacgggacttaacccaacacgacaatgaactctaaaaactataagatccaatttttaaaagttccaagaaaagtgaatagaaacagtgaaatatcgagcaaagcaagtagggaataataattgggtgacttttaaaaactataaaattagaaacatgataatgataaggtttgatattttaaagtcttaagaaaacgagatatctatttaataaattttaagtaaaacataataaaaaatatataattttatagggttactagcccgcgcaagcaagctagtttttattaaaaaagcaaaaagatgtgagataataactttaagaggtttataaggcctaaaccttcggtaattatccacatcgacggatcctcatcctaatccgttccctttgtcctgttcccccatcttttacactgttgcactctgcaaccgacgcatcaacctccaccgcccttcttccccgccgtcccgagaaaggaaccggaaaaaaaaaatccccaattccccctacgccgagcagcggcgtgccggcaatgtccctccgcaagcgccagcgttcggcgagcagctcccgcctcagcaccctctcctcctcgccggctccccacaccgccgccgccgccgcctccgcctcctcccctccgctctccttccccaacgccgacctcgtcctccgcctccacctcgacccctgccccgacgacgacgcggacctcgacgccggcgaggatcaccgcccctccctcgacctccacgtctcctcggcgtccctgctccgctcccgctacttcgccgctctcctctccgaccgctggagccccgcccccacctccgccgcgggggggcacggccacctctcgctggccgtggccgctccgcgctctgcctcgcaccctttccacgcccacgtcgaggtcgtccgcctcctccacaccctcgacttcgccggcgccatccactcgcccgccgacgccctcgacatcctccccgtcgcgctccagctcctcttcgacgcgtgcgtcgaggcgtgcacgcggttcctcgaggcggtaccctggtcgcccgacgaggaggcccgcgtcctcgagatcgcgcctctcctccccgccgatgaggctgccgacctcctcgctcggatcacgcctcccccagccgcctccgcctccgccgccgggggcgaggccgccaggtcgccctccgaggcgatgctgcacggcttgatccactccgccatccatgggcacccggtccccgccgcaaccaaggcgttcgtcgcgatgctcctcaaggactacccctcccgtgactgcgtccagaaggtgctcgacgaggcgttcctgtcacggctggagactgtcaaggagctcatggggaagtatgccagcccggatttcagggtcgcggtggacagcgatgagcgggacgcgatacagaggctgaacctgcagtccgcggtattgaatgtgagacacttgctctggctcatcgagaggatggtcgaaatgagggtggccggtaatgcggttaagctgtggagtgagcaggctgcactgactgctgatctgcagaagttgctgaatgatgtggatatgtggaagaatattactcctgggcttc

SEQ ID NO: 68824 - DNA, 15804 bp, Oryza sativa
tgtttttgggaacaattttaccacgaggatcataggtgtaacattcctttatatttttagtgcaataaactagtggctttttctggatagtttgggtgcatacatgtgcatttttaagagttccaggttgttgcttgaagtcttgagcattagtttggagttgtttgcaatttgcatccagtaaacaagtgctaaatctaactgaacgaatgtccatatgagcaaatattattttgaaagtagttagtaggctaaattgagcttacccagagttagtacctagatagttatttccaattcccacaggttgtcatacttcttctatgatcattttgttctgcggacagatttttttattgctcctctgtaatgtattccatgtttctttttcttagcgctatgcttgtaatcactcatggttttaccatttttatgtatgatcatttcattccatgttcacagcttgtttgatagtttctttgtattgacctctatactatctacaatggctgtctctggttggttgcaactcacttttaagtgtgcctggaagtttttatgtgtgtatctgtgttggatcaactcgggtgggtctatagtttaataagacagtaaaacttgaaataattgtatcttttcagtgtacaggagcagaaaactagacatgcatcaatctaaattcgattcatgtggaaattactgtgcatatcagtttggtgggttcaataagatttttcattagtaatactttaagaggttgagttgtgagttggataaaggttactttgttgtacttgtgttgttgtttaacttgatgggtctctatgagtaaaaaaagcatatgtccctgcctcctcagatagccaagctctcaactgcgaggcctttgtgtatatgttttttttcttctctctggccaggcagagttggtctaaaagcatttggcagatggtaggccagctcttttatgaataactttggcaagaaaagctagcaggtcatccaaatgagatgggtttttcccgtagatcagtgtattaaagaaatgctcagatctgctattgtgcttgtctaagtaccatgtcaatccactaggtacacaatcaacatctagttgtatgatggcaacaatgacaagcacattttacaaccctgaactttcatgaatatatgcacaagaattaaaaagtaaagctcaactcaaactatactatcaaattatgaactatcagaactgttcaattttcaaccatggtacagatagttttggttgacataacattgatggtgtgtggcctgaggctgagacagttttttttgggactcagctaatcctcttgatctctggcatagctgaacacacaattttatctgatgatatccttgtagctctctgtctagtattgccagattttccatggagagctcatactacattataatacacgcttgtagctttgttcttgtgtttaattgggtctgacatatatgacatttctgcttctcaggtgaggacgaagcttgtcagaagttggcttcctgtcctaaacgtctgcaggaacatggttcagcctatgcagtgtggatacaagtcaccaaattgccaagagctagaggagacatttcttcagatcatctccaccttgcctgtcccagatgctcaggagttgctgcaacagtgcctcgggttctcgactcgcaacgtcgacgactgcccgcacttgatcgcagccttcaagacatggttcaggcgtgctggccgggctcctcaaggtgcagaaaattgagatgagcgctgcagctagtgtctgccaacagtgggtgctgtcttgtgcgaaatctcacatctagttcaatgtagttcctaacgctgtttctgtacattgttgtactacctaccctatctattgccatgtaaggtatatgatatgtacataacaacatttttctgttcgtgtgaaacatgttacccaagtgcagatgaatgatgcactaaactaactattcacgcgtgcaatgttcttcccttcggaatgtgaatataacttgacgacaaatgtatattcagctgatgatttcttctgtttatctgccgcaagaacactgcagtccagtgagtttatcggtttctcttgtctacaactgagaattgcggtcccggtgtatcactcaaataagctcatattttgtgttctgcgagtttcagaattcagaccattctcttcaaaagaattcagatagtactactgaattgctcgtgctattctctcgccaacgtggcaaagcagtatcctctgatctggtttattaattctttctcgtttgctggaacatttagtggagaacatgactaagttcaaaagtcagaattcggtttcttcctcattccattcagaattcttttcatataaaatagctgtggtaaactcctagtctctgcagcaactaaagtctccccttaaaatataggattcaaatctggaaagaggtctacgcacgaaatgtcactatttcagcacaagtctcatgttctacgtaagacccagaatgtttagttctagaagggacagtgattatggaagttgttatgaacctgagttttaatctaaaaggagattaaagatttaagacgctctcatctttcactcgccaaggacacgttttctacattattacagtacattacgttgggaaggttgatacttagcccaacccaaaatacaagtggccaaaagcaagccaaatttgagagattttatctcgtcgtcttccttcacatcgacattacacaaaggaggaggagaaaaaacagaaagaaagaaaaaaatggaagaaaaattggaacgaagaagaggaagacacgagtgacacgccatgaattctagcaccgaattgtacacatgtgcgacgagctgcggcgacgacgagccgacgggacggtgagagccatggcgtgcaacggcgagctagtagaagccctgcaccggccaccggcggtcgggatcggggagccacgacgagcgcttcttcttcttgtccttcttgtccttgctgccgccgccgtcctcgccgtcgacctcggcctccttctcgccgtcggagctcttggagtcgccgtcggaggagctgcacccggcggccacgccgccgccgcctcctccgccgccggacttgttcctggaccgcacgtactcgatgagcctccacgccgccggcttcggctgctgcgaccgcggcggggacgggggctccttggccggcttctgcgccttccgctccgccgcctgcagcttcggcgtccccgtcggcgtcggcgtctgcggctgcggcagcttctccgcgggcggcgccggggcgtcgctcttcatcagcgggtccgcgtcgtcggggagccgcgccgactgcgacagccgctcgtactccggcagcggcaccgtctctccgacgacgccccgccctccttcccgctgccgacgcagtccatgagcagcagctgctggtggctgcccccgcccgccctccgcctctgccgccgcgccctgaacctcgatcccctgccgcttccgccgccgtagcgcttctcctcctccagctgctgctgctgctgctgctcctcctcgtcatcttccgtgtgaaccaggacgtccatatttatctcggctactggcgccacaaaccatgcaccgtctctctctcccgatctcgcgatctcgcgttgggagtataaattttgcgcaagtgatgatgggggtgcaaatggatggcgagagagggagggggaatggggggaaaagctggggaatgccaagtttgacaaggatttttggctcgcgaaatcgcgtttttattcaagcgtgtgggcgtttgacccgcgcgcacggaggtcggggtcgtggtggtggtggtggtgggcgccgtggcgaggtgatccagccacgcgcagacgcgcccgcttggctcgcgtcgcgtgccgtggcgtgcgcgttcgagggcggggcgcgtaggtggatttggacagttttgacggcggagaaacggcaagccatggccttctttacttggtgaaaagaaaattttttagttacatcagacgtgaccggatatcagaaagggtttttaacacgaatgaacaaactaatttcataacagcacatgtggttactgcagcacttatggttaatcatggattaattaggctcaatagattcgtctcgcgatttccatgtaagttgtgtaattagtttttttattttatttatatttaatgcttcacgtatatataaaaaagttgatgtgatgtttttgaaaaaaaaattagaaactacaccaggcccatatcgtgatcatcagagaggccgggtagtacacaaagtgtgcgttaactagtgacacttgcgaatttcgggaggaggcaggaacgaacttggtcaagtcctgaactctgaccgcattatatcccaggtagtacttctgtttgtgttgcaaatttatacaaaagggaatataaaatcacatttcaagtttcaacacatctcactaaacgacatccgcttctccgcttatcagccataaccgaaatttaagttttaaatttcatttgttaattttagagttgattttgaggtttttattattgtagtttatttttagcattgacttttaaccattggcaacacatgcctataaactattctttatttggtttattcattttttccattttgtattcacggtagttcaaacatcagagcgtttagtagagagttaaaaccgtcgttttgtgagacgatatgtgaaaatgaaatgtagatatatagttttgtgaaactaattttcaaaagcgtatttttcttttatttttttttcatttacaacgtagactaatgaaaggggtaaatgactaatatcatggactgcctattttttccacttcacaaatattgcaagtagagtaaataattacgtagaaatatattagtgatggttatgtcaactaggtttaacaaaacgcggtttccgtgaaaattggactttttgaaccggctcgggaaaaagtgctcggttttcacttttcagttgagttaaaaaaatagattgaattttagaacttttttttgaaattttctgacaaatttcaccattagtcaatggttttcgtgaaaaaaagggaaaaatctttggtccctttctttaagtgattcggttcatgaacctgttgtcaattatatatatgtaaatggggagagtacatataccacctccggaattatcgacagtaaaggaccactcgcctttcaccccagttgcaaaatacaaacataacaaatttccagttgagctaatcaaaaaccctattttgtacgatcattggatctagacagaatggatcaaattaagcactcctcgatcgctaactggccactccacatgacggtggtcacgatctctggggacgcctcgtgtcgctaaacaaatgccaaaaccacgagacgattatctctctataggatctggtaatctggtatttctagtcctccaacgctaagccgaaactatattatagttgcatatggcatctgcttggattagaccaagcagattaagaaaacgagaaaggattttacgcggcgagtcggcgtcgatgcaggcagtcgatgccgtgctcgcacgctggcttcgctgcctttacacgccacaaggcccactcttggtcaataatgtactgatcttaagactgaattaatagggaaaaggatctcatatgcttagcatgatcagcctcgttaatcgcgtaggagtactaattaatcacccggcccagttcgtcattgtgtcctgaaaattaaagataactgtagcgaaggcacatctgatcggcatgatgatcctctcctagattggcgtaattaacatgtaataatccccggggaatggtacggttgcaggctgcactccgtgcatgtagcccactgaatcttgggtgaccggtttgataaggagttgttgtcccccgtattcaccggcaggcagattagtttgatgctaaacacgccggagatccgctgttggacggcggcatgttcatcgttgcaagcgatttggttggaccacatcactcgagccagctgccggtagcatgtgcatacagccatgcacacgcagcttaaaccttgcttagttagcgagatgaaagttaactttggagtagtaaccaacttaaccatgagctagctaagctgatgagccgtgtatacatacaattttggacgttggaagcaacaaagcaaaccgatcgaatagattgtaggcagcaatcgacatgatgcaatcacactcgtggtccttgccgctttgcttcgcgtctcaccgcgtgggtggtcgtaggcctagtccacgccggtcgccggaggcgagaccgagaggcatcagttgtctcccgtaaggttgtgatcgagttgatcaattatagatcgagttacctcccacttaagtctcctgcacacaccttggtcagggatcagcttccgtcttccggttgtagtacttgtccagcgtacgtctccctcttcgccggtgcctgtccgaccaattcaccttcaccatccagaccatcgtcccggcgcgtcattcgggctcaacacaaggctgtttggtcgctggttgcgatccgtttcggcccagtaaatatgggcatgcagcacgtaagaaaaagatgatcgagtatgttttagtatgttttaacatattgatcgaatcaatttgtatctcttaactgtcattgatatgtgcctgcaaggatgtataataagagagattcaccaagattggtaaatttccgttcgtcgcacttattttcgtctgccaattgttcgattccttctcccctctcgcacgtgcgtgcgtgacgaaatacatgtcgcatcatagtacagcagaaaaaaaaagagggtttggatagggctttattcctaggtcgataagaagcggatttgctcaaattcttagaaaaacggaaagaggaggaaataaggattgaaacccctcaatcaatctatctattatattattaaaacagctttgaaaggagacaccacgttcgctggggagactagaaaatcccacattaatcgaagaaaaagaaaaaaaaagaaaagtagagtttaagtagaagtacaatattaactaatttttttaaaaaaaataaattctgaaattagaaaaagaaaaataagatttcaattaggaatataatttataactaactaaaatatgtgataaaaataaaaactattgaaagaaaagaccatataaaacacatgacgagataaattaagtaacaggcctataaaagagtagagtggtggcggttgatataacatataaaaattgttaataaaacaccaaatagaatcctaatgacgattaaaaggagggacattaggcaggcggtgaagctaacaaataaggcggttgctgggacttctagaaagacaaaaatacattgataatcatattcgatttttaaaatttcaatgacaataaaaatgagaagcaccgggcagggtgtataagagtatagttgcagagccgccgacggttgacgggacttttagaaaataaaaaatgaattctaacgatagttatgttcgatttttagaatcacaatgacaattaagagtaggcggcggacgggctgtacaggggcatagtggcatcgtttgatgacttctaaaaattataaaaaaataaaattacaagtccaatttttaaaggttcggaacttctaaaaaataaaaaaaacaatgataatcatgttcgattttaaaatctcaatgacaataaagaatggaggcagcggacgaaccgaagaggagtacaatggcaaagccactaacggtttggcgggacttctagaaagtaaaaatgaacacaaacaataattatgttcgatttttaaaatctcaatatcaataaagagaagagacagtggacgggccgtagaggagtataatgacaacgtttgacgggacatctagaaattataaaaacgaaacccaacgtgacaataaactctaaaaactataaaatctaatttttaaaggttctaagaagaataaatagaaatagtgatagatcgaacaagcaaataaagaaaaagatgacataaggagtagcaactggtgtgacttttaaaaactatataattagaaacacgagaatgataaggtttggtcttttaaagtcttaagacaatgagatagctatttaataaattttaagtaaaatcatactaaaacaatatatgattttgtttgggtgctagctgcgcaattgcgcgggtcacccagctagttatctccaaagatacgatcggatttcacagaggaggtggcttcagggaggcatcgggaagatgaggaacctcgacggaggtaggggaagatactgtagcgatgggtccacaacacagttagaggacatggggggattagtagacttttggttgcttgctgggctggatacgtgattgcgggccgaggccgacgggagaggaataagttcacttgagatccctcatgttgacgttgagtttgaaatacatccctaaaccgcaaaaaccgggaagaacgcatccctcatctttcaaaaccggtgcaaatatagtcccaaaggccaaagcagtattgaagatggttttaggtgacgtagcgctgacatgacacaataagcaaaataaaaaaataaaaaccacataggacccacatgtaactatgtaagggtgtgtttagttcacgtcaaaattgaaagtttgattgaaattggaacgatgtgatagaaaaattgaaagtttgtgtgtaggaaagttttgatgtgatgggaaagttggaagtttgaagaaaaagtttgaaactaaactcggcctaagttatattctttttatcccctctcgctcctgtcaggcggcggccattgctgctccgagcaaggagcagcggataagagcgacggcgggcagggcagggcgagcgtcgacacctcgatctgggtcaccgccgtgcttgtcggcaaccacgaggagaggaaggagagggggccaatatgtgtgttgttgaggaaaaaaaattatgcgtagaccggctgcaaaacccgcagcgtgcatacccgacttaaatgggcggcacatggacgagggagcaatccgacggcgcccctgcgcagctccatccgcaccaagagaaggctcagctcgctcatgtcgactcccacaaccaaaagcgcgcatcgagccgagcgtgaggaatggactggctctggcttagcgactcgctcgcatccttttcttccgcttttctttcccccgccgccgtcgcgatctccttccccatctcgcctcatctatctggatcgtctctcctcggcgccgtcggctagccggtaatcccctccgttcaacaaccgatgcggtcacctctctcgcctgctaccgtcgtcgccgcctcccctgtgttcccctccgcgcgcctcccccctggctacgggcgccattggtgacggcggcggcggctgggtcagctaaagcgagcacgaggtgtgttcccctctacctccctcctggccaggggcatcgggcgccttcggtgaaggccataggcccacagcggctgggttggcgaggacgagcagaaggctatggaagaacatgcatcgatctggactgcaaatctgcaatgcaacgcgtcgccggaagtcaagcaacgaagaaagtagtagttgatatgtctgatcatttgcccatgtctctctgtctttcatcaaaatgctggggtgttggtttctgcaatttcgctattgtttaaccaaattagttcctcagacctcagctagtcttgctgaaagtgatgggatgtatgatgtatcgctcgcactgagtggactgtttgcagcaatgacaaaagcttatgaactatacggcatctttggtgttatgtaatctagaatgtgatggattgatgtgtaaaaaagattgtgattgtttgtctggttcctttcaaattaaaatgaaaactgaattatgtaatctgaaatcttgaaggtcaaacctggaatgtgatgtccagaagataaatcattctcaaacaatattgttgatcatgcataagtgtaaccagaaagtattttctatacctggaggccatggcatctaggcgtatgcatgtaatttaatcgctcatctagttatttgatcgatagtcatgtttcttcctattagttgatctgtgactatatatatgctatagattgcacaagctagctttgatcattcctcaagttggatggctttagattttatttccatttacatgttgcactatgttccttaactgtactcttttattatgttacaccataatttattttcttcgcagtgtcttccagaaaatactttcgagtcgagcatacatgtatttgtattttctgctcctcatcggctccacgatcccaggcgactacgtcgttcgcacgcacaggtgagagaaacgggtccactacggcaggcgaatcccggcggctaggtcgaccttctcctgtcttcgatctggcgctggaagacgaagccgaaaaaaggtcgcttttgctgggagctgagtccgcgtcaggcgccgtccttgccgccgcaaagcgaagccggccgatcgctcgagtgggagtcgacgcgagatcgcgagcgagccgagctgagccttctcttggtgctgatggaacacgaagtcgtgagcgagccgagctgagccttctcttgatgcggatggagccgtaagggggcgccgtcagattgctcgctcgtccacgcgtcgcccatctaagtcaggtatgcaccgcgcttcgtttgaagccgatctgcacagcatttttttttccgttgttgctgttgtcgacgtagcaacagagaatacaagagagttcgttggcgctgcatatataggagtaggattcattaaagttgtagtggcacaagaagaagtagcagcagcgtcgtgttccacttccagtgacactgccgcatccctgctgctgtcgactgcatgcacgaaacacgaacattcgtcatctccggcggcatcccttcttgagctccgcctcgcgcacaacgccttctcccgttctcaaggttgtcgaccatctccgggaacgacgaccttgaaggtgtttcgaaagtttgacgtcggcaagttcggcagcaaccaataacctctcctatgtgcagacctccgaccggtagtcgtgcaagcgcgagcagatggaggccagctcgtccaagaggtgcccatggtgttcgccacgctgttcgccttggccgtcgtgatggcgctcgtgcctgccatgcctgtgctgcaaccagacgaagccacgtccgcgacttcgaccgcggcggcgacatggaaggcctcgacaagaggcccgccggtgtacatggtgaagctggcgccgacaacagggaagcggagcacgtacgtcgtcgctcgatgggcaccggcgcgccacatcggccgcagaggtggacgaactggacgtcatcgtgaacaactgcaagccgccggacgctgctcttgctcggagcatggggaaaaagggagattgttgtttcacttacaggtggatcccacatggttttttttttatttttgtttattgtgccacgtcacccaaaaccaccttctatatttacaccggttttgaaatatgagagatgtgttctatccggttttgtggtttagtgatgagatttaaactcgatgtcaagatgagggacaaaaggtgaacttattctgaggggagaagaagagatgaaagcaggtcggctcggtcgtgggctgagggagacaatgggctaaaaatggcccagagtgtaaggagggtttttatttaaataaatactgaaatgatatttgtattattaaaattagcagctctaaaaatttcagagagtgtaactaactttggagagcttaataaaaataaatttagccatattatttttattttccacacttactttacttttaaattaatttaaacatctacctatttaaaaaataccaagtattccagaaaatttgtattttagttaattacataatgtaaatctttcttaccttatcctcaattttctcatcttttcttcccgatgtaacacacatgctcttttctggtaacttttaagttcaatatcttgaacgtataatgtatggtaaagaacggaatgttgggtgtggttgtgaatatatttccgtttgtgtttttatgaacttatataaattaatccttgatcttcttttttctgtatatgcacgaacttgtacaaattctccaatgaatttccttgatcgaatcgagtatttgtttactactagcacgcatcatgtgaggcaatcccttgtcactccatccgtttgtctgtgtcgtgacggtgtaacgctttgagctgatttatcggctctcggccaccgcgccgcgcgccgtgacgttgagctcggccaccctcactttcctcgccgcggcggcgtcgttgtcgtcgtcattcatcagcctgaccaccgctctcgccacagcctccgtggccgccttgctggcagcctcacgtacccgcacaccaacgcggagcacgtcgacgaggaacgtctcgttgaggaactgctcagcacacagcggtcacatcgcgagtggcacactgacggagacggcatccagcatcgagttctagccataatggctgaggaagctgcccaccgtgcggtgcaccaggatgtccgcctgtggcacccaccgctcggccaccaccatgcctcttattttgggagagatgatgcaattgcgcgtgggttaaggtccaggaattcgcggctataggaaggttgtgtttagttcacgctgaaattggaagtttggttgaaattggaatgatgtgacgaaaaagtttaaaatttatgtgtatagaaaagttttgatgtgatggaaaagttggaagtttgaagaaaaactttggatctaaacacggtggaaatgcaggcacgacgactcggcgcataacatgtgtgtgtttttgtgttgctaatctgcacttctgcagacaaccttcatttcagtttcaaacattttcttcagtaagggagttttagaattcttttttctttagcaagtgaagtgaaaccagtgacggagtcaactcctgagcagtttgggcagctattcgaggtggtgaacccataacaaaaaaatacccgaggttagtagcggatccaaaaaatttacttaaacccgagcaaacttaatagtacataataattcataaaaactctacggattataaaccattgaaacggacacataagattaggtttcatgtgagtttgattaactaatttagcaaataattacatagtatcaagtactaatcaacaactatacgcagcgcagcccgtgcacctggccgtggtggccatgccttggctccgtcgctgctcggggttttatacatactaagtatatatactaattaatatgatataaattagttataattagataataaactcggaatcctcgggaagatcaacgtaggaatgcccctagctgttcaggctccatcaatgacgatttcactatcaacctttcgtcaatcatcgaaaaactctaattgtagtttgagctgcacggtgctactagctgtgctactcggaatgacgaactcccggtctttctgttttggtttgagatagatcagatttagaggtgaaaactactgtcatgtaaattccagatgttggtggttcgtgcgttatattgtaaatactaaacctgagcttgggattaatttacatgtgaatgatctaatgaattattagtacggccattgatacttgtgttcttatgaaatattgatcctgatattaggtgcatctatgtgtgctatgtattgtgaacattggtgggcataggtgctggaggtgcagcttcactaatatttgtattttccaaacggcacacacttgtgacggctatctacgtcaggattaattatcctgaagacgactgtttggcaaattgaaatttctccgacaaaccagtcctaacaggatttcctgatggtaccacggcaggatgtatttccctggcgtgataatggttttttcctgacatttgtggctgtcaggtgtaatctggttttttggtagtgttgagttgctaaattgctcattgatttttcggtaatctatcggtgcttgatggtgtttcatcggattgtcaccgtcactgtttcctcccgatcgatgaggcagtcactggcaaattctattcaattttgaggttgtaccgactaccgaccaaccacctgatgaaccttgtacagttatttaatctcgtataccgacgtgctttaatatttcgataatgacttaaggttacattgctcgtttgctagttgcctttcaaaaattcacagctccaaaaaggaagaaaaaaagaagatagagcggacgagctcggaagtagctcggtttttattactccattacagtgtagcttctctcttatggaaagtcagagaaatgtgagtcccactatcatgagcccacatgtaagtggtctacgtcaaaggagcctcctctctccactaccgatgctatgttaatgctggatttcctttagaaatcataagtttcttcacagcaacaggacctatattaattgttgtcaggtgtgacgattcacagttacacaaatccaaaatctcaaggaaaatccacacaaaaagaaaaataaatcgcaagcaaagactaccagtgtgccataaaacataaatcataggatggtttaatacttgcacaagaaaataattcatcaatatttcataacgcgtgacatcatccaccatatatttgtgtcatcatatcaacttccgtttttgacaatgaagtatcacaccttaaattgctgatttgtttccgtggagacacatgagcattagttccttcctagcttgtgtcaaaacagaaaaccggggcttcttccgatatgtttatacaaataaagtgtgtgttcatagaagtgagtgtgtataccttgtgaaccctacgtttgtactgtttctagaaaaactaaaaggaaaaccgttgcttctcatcagctcttatgcacggagtgtccgtaagtccgttccatctctcaattaattagctaatatgtgaggatatatagcggagtggttattacacaaaattgaattccagttaaggttcatcgcaacgaaaccatatggtgtcagcgagcggcacaagtactgcagatgctgcggggatggccgatggcatgcatccgtcgaacgaaatttgtttggcatcgaattatttattggtttggcatcgatgcatcacctcatacagtatatagcccatccaaaattttgctcttgctatctttttcttgtcaccatctcaaactgtatatagcccatgctattgttctatctctatctcagtctctatcttcttattgaacagaaaatggtctgctcataaggttaaaatgatatttttcatgtgagcaaacacagtgcgatggatggaaatatgacgtcggtgatatttcttagacaaaattcgtccatatgatagcattttgtagaaaacttgctctcgttaatggccaaaaagcgtagaattgaacgcttgtcaatgctatttgttaaaatttctccttattttaatgcgatcggttcaacttgctggaaggctggaagcaata

SEQ ID NO: 68825 - DNA, 10148 bp, Oryza sativa
cgttcgttagtgtgtgttctatcttctctcgtttttcacgtacacatttttcaaacaactaaacaatatactttttttaaaaaaaattatatgaaagtggctttaaaaaatcatattaaactattttaagttagttttagctaatatttaattaattatgtgctaatgatttgctccgttttttgtgcggaaggagaaggttcccaaccaaaacaaaagaacgccggaatgaggcttcctcttatacatgtagcagccacctccatctatgttcgtgttgatgtggttattaatataatgttctttccaaatcaaccgaaccgtaaaaatgatgattgtgtaaaaccgcaagaatgatgatggtcaacaaaagtacttttacagttgctaccgtccaatactatagtatatttagggatggtttggtttgtggtctaaattgatcttaccaatttttggcaatgccaaattttgataagttttgacatggctaattttggcaaggtaaagttgtgtttggattgaagccaaaatagcctaacttaactattgaaatggcctattttcttaggcatgccaaaatttggctttaagccaaatagacactaaacactattgaaattgccaaatattggtaaggctaatttaggcctcaaaccaaaccagcccttaataactttgtaaatactactgctcaaacttatagttagggtgtgtttagttcacgtcaaaattgaaagtttggttgaaattagaacgatgtgatggaaaagtcgaaagtttgtgtgtaggaaagttttgatgtgatgaaaaagttgaaagtttgaagaaaaagtttggatctaaactcggccttaacattgtctgttcgtcgccatattcccaactttctatcacatcatatcacatcaaaaactttcctacgcacataaatttccaactttttttttccaaactcccaattttcttcatacttccaacttttttcagaaactaaacacacccgaagataggagatccgaacatcctccccaaaatcactgcaccgctcgcctctaactttattcaaataaagacaaaaggatcgtaatcccatatagctggagttggaaaggggataataaattcatccattttacatcactataacaagtctaaatctaaaatacaacaagcatttaataaaaaagttatgcatgaaatctgactaaaatagaagatacaataacgcatataccaattcctattatactcattgttgggttttaaccctaaattattattaggtttaacttttatttttggtgtcgctcataatctataacgaggctaaggataggaatataatggactctattttcatatatgtattatatatgttacttctataccgttagacttttataaatcatatcatcaaccatgatcgtacatttcagttatacgagtttataatataataatatctggcacatatatgttagccacatgcaggagcggatctaacgtgggtgcaggggaacttgagtcccccctacacccacaaaacccatggataccctctaagcccccctttaattttttcatcatagttgataagataggaggtgctaaaggtctcataatagtattttagcatagtttaatactaagattatatgtttatatcggtgtactcagtatgttgagtcctcccaactttttatttttggatccgcccctgcccacatgcccacatatatataagattaattcaaatacaaccgtataactcaacagcttatagcaggtacaataataaaaataataaactataagttagctacaatcttatatggagaagataaaagagaagagagaagataagcggattacagatttgtagccagttgcggcatgaactccaaaacgttatgtgtgcataacatgtgggaccaattattaatgagtagtatatatttgaagttaactattatatgaattggctattagattaactatagatgatttgaagctagtaattgcctatactattaaacttgctcttatagagctgtctctataaacaaacctagctacttcgcatgcacgatttccgggatcaaaacacatgtctcgaatatcaactccttgagttagattgcacatcaatcgtaccctattacgtaatactttcacactttactataattccaacactcgtatgatacgatattacggtatggtgcgtccaccgtgcacaccattagggtcaggatcaggcatgggcaaactagagcttgagtatcatgcctagctccataaaccttatcatgtcacttttggattgaaaattcgtccaaacaagcttgtcattttgggagtatcttttgtaacatcaatcacctctaatttaaaatgttctccatcttatcctcaagtactaaccatatattacttaatagaaggcactatagtgatttttcctaaaccctaatctttgctaaataatctagaacgatgattttgttggaacggaggtagtatatatataatttatgaaatatttaagcttccattagctcagtccactactaggagaacggtttttctatgtggttaaatttaattttcacgtgcggtgggctacccgcacacacccaggggtctgagaaaatcgtgatttttgcgtgtgggtggcacaccgcacggaaaaataaaaatcctaaaaaattaaaaaattaaaaaattgaaaacctagaattgggcggcgccgccgcctcctcctcgtcctcgtcctcgtcggcggcggccgaggacgccgctcccgcacggaaaaaatcaaaaatgagcttatttttccagacgcgaccagttataatccgtgtgtaaactaaatgcctccctatccaagaaaatagtttctttagagcgggtacaataagtgactaatagctaaccttcgcctacgtggaagagagaaagtgttggagagagagaggaaagcagacgcttgcatgagagccggccaagcacaagcgcctaggccaattccccaatctacgaactgctgcatgtcagtattctaatatggcccaaagggagcaatcctggtggtcccacacatacataaaaaatggttctgtcaagatgctttgaatgacgtggatgtaaattggagctgatgcttactccactattaaacctgctcttagcagtctccaatgtttatgatcataagtagcattaaggtgggtcccattattcttatagttattaccacaatgtttaaagcaagagtaacctttaagatgggtcccacaatatactattctagtacttcttttattagccatgtaaatttttcatcctcacattcattttaccctattattttattgcttgtggtcaagccataagcttaaagctttcttttgcatttaatgccttatggctttgtttcacaatatatatggtcactataaaaccttatggcgtcttcttatggccacattgtggctgccctaagggcctgtttagatccatttggaatagcaaatggtaaaagttttggtggcaaaagttttgtcattgcaaaagtactgcatgttaaagttttgtcattctagcactaaagtgagagagagaaagagagagggagtggtcccaaagcactttttggcacaatttgctactatggactagcaaatgccaaatgccaaattgccaacttttactactagtatttagatccaaaatggcaaaaagtgctacaaaatggcaaaacttttcccattttggaggatctaaacagggccttacaccatatcacataatactttcacacttattactataattctaacacttttctcactaaccattccgattttacttcggtttccgttagcacgtttttcaaactactaaatgatgtgttatgtgtgaaaactttatatatagaagttgctttaaaatatcaaatatataaatttgttaagtttataataattaaaaacttaattaatcatatgctaatagctttctcgtttgacatacgttaatttaatattcatcttcatcatcagccacctcacacgatgcagtaggccaaaattttattccattatgttaaaagaatcagccacctcacatgatactattatgatatggtgcgtgcgcactaccgtgggtttgatcgtgacaaactacccaaaaaattgtacagcctgctgctgcgtacgcatccagaagaagcccatccgtcggcttctccgcggccgctcgtcccacggatctggaaatcgcatccgcatggtgtctggtccagtataggcccatgcgacgccacgccaggtcccgctcatctcttcaacagaaattagatggagataaagattttcgtgacacgttttttaaattactaaacagtacatttcatgctcaattaatctaaaatatcatattaatctatttttcaaattcgtaataattaaaactcaattaattatacattaataccaccttattttacgtaaaaaacttaattttcatcttcatcttcgtctttataagaaaaaaacaccacccctctctctctgcggcgcctagaatttcttaatctgagacctagaccctgtttagttaacaccaaactttccataaactttcaacttttcatcacatcacatccaaaacttttctactgagtttattttcaaactatcaactttccccgaacttctcttcaatttcaaaaaaaaaaaaaaaaacactgccctactggatgccccggccacgaaaagagattcgcaatcgcgattgctgctgcagctgcatgctgatcccactgtactctccaggtaggaggacgggggtgcgtggtacagttgacatttgatacttctctcgcctttctttattattctcccgctcccgagacgacaggaggaggtggagggggagagccatttcttcctcttcttctctcgccggcggcaaccctgcgagcctgcagtgacgccgccgccgccgctgcgtcggttctgagtttgcttcgtctccgggctcgctggtatggagactttttcttggtttccctcccttccatttcttgttcttggtgttcggcttgggatgcctgggatcgatggctgctgcgatgcgagagattcgtgcctcgttgattcatcgcctggttaatacgagggttcttgtattgttcttggtccgggaaaatgttaggtctgtttggtaattgtaatcttccatccatagcaccgtagaggtagagctcaatcttcggctaaaatcttgggtattttacggttctgaaaccaaaaatcttgtttttttttttctttttggtgatttgttcttgcggtaattaggcataattcatcttttgaggggcaatatgggtagtctcacaccacaggacgtcacaaaattgcgaaatcttgatgatgaattccgttgtatcatggtatcttgtcagatctatgatttctgaccgtatctgtatttagtggggtatgcggtagatgttagattttgtttttgagcagttgcagatgttagaattaacaggttctaaaaccactattatctttatgctagaattaacaggtcctaaaaccattattatcgttggtgaaatttctcttagtcaaagtccaaaagaggatgctgtcaatgctgcctcggtagtcatatacattgatcggtacattccaccccccttttctttgtccatggagtacatttcattgaaatgtcgaagtcaacaaacagaaaattgcaaaccaagttagggtcacaaatgtaaagcaggatccgtgcttgccatgttgtccttttctttttctgacgagcgaaatgcccgtacattgttacggaattaaaaaaaaatcatatcggcacatgtcaaagaggaaatctattttgaattaacatcaaagtttttgctgttttcactcccgtaaaatgggctccatttattactagcgtacaaggattatcatgattgagagctccaggatctattctattcgtgacttctactgttctaccgttattttggtttagtgggaggatagacaatgatcccgtatgtcagaatttgagttggtggttggttggtagcaaattcaccactcacgatcaccactacttcctttagatggagtatagattcaatctgatttctggcttcagtgaattgcttgcctcttacatgttctagacttgtagtgtgatgtcaattagttaggacttacttcatgtcaagtcgctggcttactgaataaatatgtgatagtcaattgaggagaggcacctgtcacagacaaaaagtatgaagtttgatgcacaaatatgggtccaaatccttttagtattatatattttattttatttattcccatctagttatggtaatgcattaatggttgcatctgtgcatggctgattggctggatgcgcataagtattctgtgaaatatcaatattggtgcacagagaactgaagatgttacaaacatgggcaaacttattgttacactaaaatattacaaacaacaagactataagtatacaggaaaaaagtatgaagtatctcacaataagagcttctaggcaaatttctgctgatgaaaatttttttgttctgttcttcggacttgtgctgtcttgtaagctggtttccccagcaaatgatgccgtgttggctttctataaatgccaggttgtatgacctactttctaaaaaaatcattgaatatccatacaatcttttttattattatttgtctagtataggtttacttctctcaaaagtcttgtaaacttctctagaagttggatttatcaagaaaatgctgttagccactattgggcatagtgatcttgtttgcagtctatatatgtatgttattcagctgttcatttagttgaacacttgcatttcatatttcattattcttcaaatatattataatcacacatgcaatattcaaaatcttatttcaaatgaatgatcaaagtggttttacacaagagcgatgaggttaattactaattatgtttgtgtgatgaagccctatatcctagtattagcgtccttaagttctcctctacatttattgattcaagtagttatttgaccactagcattggtctgtcttacaccatgatatttaccccatttcttccccttttggggtaactttgaagttgatcctcgtttagattactcatctagaaaatagtactctctgatccatgaggatgttgagcaaaggaccacattatatttgaatcaatagcatgtaatttctgtttcaggattgagctttgtcaagagcagaagaagtcatgtttagctttaggaaaaagcatgcctctcgcttcgattcagatgacattgagcaacaagaagcaaaggtactttcaaaagctatcatgtcatcttttataatgtaaaatacatggttctgaattacatcgacacactttttgaatatgttactacaatattgattttaatataaataaaattgtccaccttcaaaagtatttttttagaatgacaaatatgtttactgtggtatgaccatgctcagatgagtttaaattgcattgctcaagctgttaatttttatgggtactgttttgagtcttggcaacggagtgtttcaaatctactatgctgttgccaatttctcatccaaccatcttcaatgagcagatccaagagctcagagctgcacttgggccgttgtcttcctctggtaagaaatattgtactgaagcatgcttgagaagatatctagaggcccgtaactggaatgttgataagtccagaaaaatgttggaagaaagtcttaagtggagaacagcttacaggccagaagacattcgttgggtaaatccactattcctttttcttctcttgctcaattgattatttcccttgaaatcttgttgagtgactagaccatcctattaacagctttcttctgtaattttagcccgagatttctgttgaatcaaaaacaggtaaaatgtacagaacaagttttgtagatagaaaagggaaaactggcgtcattatgaaacccgcaaaacaaggaaaaattctggaccaacgttctttttaaccttttcgccttcaaaaaaaactaatgcttcctattcactgtttcaaacattcaaaacacatcgtcccatgaaaggcaggtacggtttcttgtatatacgttggagaatgcaatcctcagcttgcctgaagatcaagagaaaatggtttggttgatagatttcacaggatggaccttggcaaatgcgacacccataaagactgccagagaatgtgcaaatatcctgcaaaatcattaccctgagaggttggctatcgggatcctgtttaatccccccaaagtatttgaggctttttggaaggtacaggctctgattcgttttcataaatgaaatattgtgctatggatattgttctactcacatattagaaaccaagttatagtgtttgatacgggggaaaggaaatcttgattctttttgtaactcaaatgtttcaattgccttcaggttgtcaaacatttccttgacccaaaatcaatccagaaggtgaattttgtatacctgaagaacgaggagagcatgaagatcctgcacaagtacattgatccagaagtccttcctgtagagtttggaggaaagaacaatgtggtgtacagccatgaggagtactccaagttgatggtgaaagatgacattaaaatggcaagcttttgggcatcggatacaaaaactgaccatgttaacaaagtcattaacgagcactccgtccccgaggttacgcaacagtcgtcgctggtggctgcgaaagcgagctgaggagtatcaatctgccatgatgggggttataaaccaaaacaaattctaaaagacgatgtagaggactattggtatgttcatgataaataaatggaactgcagaataatttacctgggatgttacagctccatgtattactgctaaaaatctttagctaaagaccagtctacaaaaaatctttagctaaccgacctgagctacagattcagagattatagcgagttcattacaaactatcaccagtaaaaggaaataacagactttaatttgcccggtattatgtcttgtctctggatgtttttatcttaactctgccattatttgtctatttggatgttattctcagtgttctactttctttaattattcctattccgaacagcaccatgaaactaggatggacaattcggattctcttcaggcctttagtggaaaaaactttataacaagttgtagggcatcacctgtaaggtgatgcaacttctttcaggcccaatgtctttcaaccattccctacaatcatttacacaagatgctttttaagaaatggtataagaaaatttgacactgttaaatacttcatccgtctcataatatagtaaactagtactagtagtagtagggacacatcggagacacattattgtactacaaatatccacatttataataccatatgtcccacaagatatttaaaacttggcattgtttaaataagatatttgcattaaaaaatgccgcgccaggaagggttcgaaccttcgactttttgtttaggaaacaaacgctctatccactgagctacaggcgctctcaatgatgatatggccaccacttcttcttgggccgggccggcctgccacaaacggccattgcaattttggccttttctgataggccgctgtctcagcttggccttttctgaaccctgaagacagcagctcacctagaattgtactctcaaatgaacaaacaaacagattacacaccatcaaactatttacagagaaccaaagagacgaagattctgaaaagcagcacagaaaccaggcactgccaggcgtgaatggaacgaacatttctgctatgatcaacaatgaaacaatcaattacagtagggaagaagaaaaagaatcagctcgccattctttctttttaatcaagaggggaaagaaaaataacaacattgccaagccatttgtccagatcatgcattgggcaccaaccactaatccactatacgatcgcttcc

SEQ ID NO: 68826 - DNA, 10438 bp, Oryza sativa
cattcgttgcagcatcatttgatgcactgatacctagccttccagtcaccagctccaacaaaacttttccaaagcaatagacatcatatgaacatgatgcagatggagaacctggttaaattagaggtttgtcaatgcacttgcatccatgaacctaaaacatctatagatacagttatacaacacaatttaacagtgtcatcatcagtttcaaacattaggcagctaacacttgaaagaaatgaaagcaagcatggatgcatggacttaccagaagatccttgatccgcagtcctacatttcccagaaaacaacacaacattagaaaatgagacgaatttcattcagtgcagcaaaaagaaattacataaaataaactggcagcagaacatgagccatatcaggatctgaaatgctaggagaaagtttccaattactttcgctaccaacgggcctactagcactatttttgtcctgtgcatatagaaaccaatttggaatttgcttagctgcaccctcaatacatgggagaggaaggataatatagtataattgactaatatatattcggaactcaaagcacaagtttaattcaaatgttagcaaaatgaataggcatgatgaactgaacagcgaagtgcaatcaagcattttatggatattcgagtcttacacgtagagctaagaaacagagtatgcagtgctaaaagttaaaacttacgatgaaaatctcaacagctttgtgatgacattttggtggccttccccttcttgaggacacacctcgctcaaactcccaaggcgcacatcaaatttatcatcaagaagaatactgctagcttgcacgtccctgtggcagatcatgatctcattagttcaacaaccaagattactcacatggtttactgcatgtttcactttaataccaaaacaatgctttcctagcgaaatgaagccaacaaagaacttctgatgcatttgcatgatatcaggaggggtgctcaaatctttaacattgtctagttggtagtaatatagtgcatagaaacatctcattgaaagtcacataaaaggatatttggaccaactgaattacggacaaggtgatcacacatattcagatttaacttgactataaaatagcatgataataaagaagtgcctatatataagatggaggatctagcaagtatacctgaacatagcatgccaactcatcagaattgcaacgtccaataaaaaacaatgctacataaccgccctccatttcccgcgaggtggataaacaaaaaacagtgctgttcatattctgatttttttcggtttaagtaagctatggatcgtataattagtacacagcagtaattcagcaatatccaaattcattaaatatgtggccagagcattccaactgaaataattttttcattcacataaatacaaagaagtttatacccgaaaagcaaacatccaactgaaataaattttgtattcatgtaaatacaaagaagtttatacctgtgaaccattggtggattacactcgtggtggagatagcatagtgcctctgccactcctgttgcaattttcagcctctttatccagtccaaagattgcaggccttcctcttcctcccctgactttctgtgcagtgcacttgataagtcgccattccggacaaatatatacacgagaaatttctcctcctctttatcaaggcaatgccccatgatcggcaccagcctttcatgcaatcctttggcaaataaatctagctccgccatataagcatctttcttagccatgctggaagttatcctcttcacaaccacagaggtcccatcatggagcgccccaaggtaaagatcacctgagtgaccatgcttgataagcctatcatctccaaagtccgtggtggcttcgacgagctggtcataaccgaatgaatcaccgacctttgccaagtttgcaggcgatgcagaaggttgcgtgccagcagtaactgcacccccaccagttccagacgctcccaactgtgtgttccgcacgccactttcccgctgatcattcctactcccattcctcctactcccagagcacaccaagcaatacaaaatggcagcaatcacagctaccaagaggacaccgccgcaaatggctccaatcagtatatacttcaaattcttgtgcccctttttccttcccggtgaagctggcatcgcaggctgcggtgtgggtgcaggacctgaaacattatacggcaaaccacgtgcagcatagaactgctgacattctgcctggctacgctgtccagtgacatcaacgaagcaattcaactcaaatgagaaattcccaccatcaccattggatacacccagtttgccgtcgaagtaattcccagagatattggccagcttcgtcctaccgaaaagttggccaaaggatcccggcacgccaccatagaagaggttcccggacagatccaccacctgtacattggatggaagcgcgagccctgtatccggcaatgcgccggtgaggttggtccgagacacatcgagaacgctcagctccgggagcgaccagaccgccttgggtagctcgcctgagaaggcattgccagagaggttgagagtcttgagccgagcgagcccggcgagagcactgccagggagctgccccgagagtagattccccgcgaggttgagagtggtgaggttgctgaggccggcgatggccgaggcggggatctcccccgtgacggcgcagccggagatgtcgaggagctggaaggtgggcgcgagccccgcgccgagccacgccggaagggagcctggcaggccgaacccgggcgcgctgaaggcctcgagccgcgtgaggttgcgcagcccgtcgacggcgaaccgcggcgccaggcgccccagccgcgtgcggcgcagcccggcgaggtcgaccgacacgacgcggccgccgctgcagcgcaccccggcccacgccgtgcaggggtcggcgcggcgcggccagtcccgcgcgcgcagcccgagcgagccgcgcagcgcgtagagccccgagagatccgcccgcgacgtgaggttcccctgctgcgccaccaccgccccgggcgccgccaccaccgccacgagcagcagtagccgcgcccagaccccaccaccaccacaacaacaaccaccagcccgcatcatctcctcctcctccatccaccaccaccaccaccaccacctccgccgccgccgccactccccattcctccccactccaaactatggatggaatcgcggagaagccaggcaggcagcggagagacggaattgggagggaaattaaacgcaataaaggagaggggcgcagagcaacgcagggtcgcaggtacagaagccaccaccaccaccaccctcctccttgggggctcaccttctctaccccgccatcaatgcccaaagttacactcccccaactgcctcccaattattaccccctctcctcctcctctctccgccgatccgaacccaaattccactccactccaccgccgccgcggtcacgccaccgggtgcgagcagccgccgccgccggagccggcgaagagagacgacgacgacgaggaggtcaggaggaggaagacgaggagatgggaggagggagagagagagagctgatatcgtggggggtttcggttgtttaaggaagctgttaaatgttttttttgaaatcaaatcttccgggctgaaatggcatgcgatttccccgacgatttccccgatttccctgtgcactggctggctcgctcactcacaacttgccttttctccctggctgcgttgcgttttgacggcgctgcccctggtgcgcggggctcaattgccggcggctgccactgagagggtgagggtgagtgaacccggccgcgcgtggtgggtgggtctcgctctcgcggcgggtttggttcggtgcgtggtggctgcacgtacggccggttgcgaggagggggggtttggtggggtttttcgggcgggtcaacgagggccgtgggcgcgggcgtcgtgcgcgttatctttgggtgggttgaaattcagattttacgtgattttcgttgacatgctttttaaattattaaatagtgtatttcgtaaaaaaaactttctatgtaaaatttattttaaaatattaaatatatttatttatcaagtttataataattaaaacttaattattcaaacaccaatttaatctttatctatgtcagtttcatacaccactaaccatcgtagatgtcgattctgattcatttttgaattttctttttttctttgtgcttcagataagagtgaaagtcggatgtataatctgtgttgtaatccagagcaatgttagatttatgttgtgtgctgtgcacgtagagatatttttctttattttgggaggacattataacgggctaaatagatatgatatgatatgatacgagcatttgatgggcggcagcatttaggaggcgaaaatacgacagttcgtttctacagttgtttacgtgcaggggtagtgtcaattaaccacagccaggcagccagcctcatgctagctagcacgtgagcattgaatgtaggatttctccttttaaacggatggaattgatgtattactggatttgcaccctgcaggtttgccggactgggaatgagatgttgtagaagaattgcaaaatgcattggctgctgctgtacccgcaagcgtttcatagcatccattgatttttccttcttttttttcttcttttcccggctggctttgacacggcagtaatgagtaatgacaggtctagtttgtggtggccactggacaagccactactactactacgcggtggagccatcgcgacgggtggatcccaggtcggacgcgtcaggtaataaaaacgaacagaagagagcgcggcacgtcgcgcgagcccaccaccacaggcggcggccggcgtcgcaaaaccgcacaaggcgaggcgaggcgcagcgcaacgcaatacccttcacgtcacgttcgttcgttcgttcgttcggacgccggcgccgcggcggggtggaggcgtatcccattcccatccaccgaaccgtagtccattctgttagcaatgtttcatgcatggcatgtctgtcaatatgtttccttggattaccaatcctcatgattcctctcggtgctgttccataaaccgattgagcaatcttagaaaggttttcgtgtatatgtactccacatctcaatcaatggatttgtgcgttgagtcaatcactctaacatggtatcagattctctttccgcttccgctccccaaccctagctctcgatgtcgctccctatgccagccgacgccatgtcgtcgcctcctccccccgccgcgcacgacgccgtcttcacccggatcgtccaagccatcgccgactccatccacgccagctacgacgtacccgccggactctccgtcgaccccgacgtcatccgctccgtcgccgacgccgcggctgcccaggccaaaacggcagctcacgacgccctcgccacccaccttcgggctcttcttcaagtgacagaacacgacgcgtcgtcggccctcgtcgacaccacgtcgccggccgccggccccgtcgccacacccacgtccggcgccatgcccacgctggtgatcttgtctacttccgacctggcggtcattgcggccattgagcaatcttaggaaggttttcgtgtatatgtactccgcatctcaatcaatggatttgtgcgttgagtcaatcactctaacacattcgtgcgccgcccgcgcgccgagagaatgtctcggtttggctcacggtcgcctgcctcttccttggatttttgcagagtgcgcgtgcccccgtactttgacggcttctcccgtcccgttgacacaacacatcatggaactatctaaaaaaatgctagtacaattttttaagggaaaaactttcaaatctaactataatataattgtaatataattttactacaactataatataactcgtacataagtattaaaataatacatgcaactttatatctaacttatatagatattacaatgtagttatagtgcagttacaatataactatagtataattatattataattacactacaaatatactatacttatacttacagttacttacatttaaaaaaaattgccaaaaaaatttgcgacagttttttagcaattccttagattaataggtacttctaaattatatgtagtatattatacatataatttttttctagaaaacaatatgggtattatcttataatagtgtctaaatcaaacttatttacatctttaaataattatcacaacccattcagcacaaaataacacaaagaattaagaaacgatcagaagtgttacgtaagcgtagttcaactagtgtttttctctttttttaactaatccacctgagttcaaagtcgtagtgtttaacacggatacttatatttacggttaataatttttattgtatttaaaatatcaaaagtatttttttaaaataaaacttttatacattttttcagtgattatagcacaggactgagaaatagaaaacagtgaaaaaaaaggcacaaaactagttccattcttcgactgcttctgcagtgccgtggaggcgtggcatcgtctcttggatccttctgaaattccatctacttctatcttcttttatcatgagctgtattatatataaacaagaagggacatcgatctgttgtactagtattaaaatttctatgcgtatcaacaactgccactagtaccgatactctacttatgtctgctaaaacaaactgcacttccaacaaccatgctccgattcttcccgtatacatacagctcggatgtgcaactgtgggtgggccccctgcacgcaagtattacaccactagccgtggaggcggcctcgtgttagttagaaaatcttgggtaaataatatggtcaagctgtggatgatactgcactattctaacctaaaaaacaaccaaacctacctatacgtgcaatgaaattattgagctatagcagtagctatagcagtatatgtagcactatctctcagattattccccagttgtaaagtgagcgatcgatcgaactgcgccgtttcagtaggtgcggtctccacacagtccatatacctgatagagtgagctgtccatctctctgtgtaccctagtactgtattactgtaccagtcactagctcgatcctctgacttcgggaagataaggcatgggtgaacaggaggtgcaaaacagaaatagataaaaaaaaccctcaattattatactacatccgcttcaaaatatatcaacctaatattaaatgagatttatacatacttctaaacgggtgttttgtgttaaaaaaaggaatcgctggaaaacttctgcaagtttttacacataaaatttttagatttgtggccatccaatcaccttgagatttgtgaatgaagaaaaaattactagaaagaaattctcacgcatatcacgcgtaagagcatagtgctagccaaccaaatcataggtgaataaaagttttatgtaagttatatctgggttacattgtaattacactccaattttaatatagttttatctgaaaatttttcactcaaaaaacttattgggatactttactagaacaacatatcaactgtgtaggaaagaacaacatatcaactgtgtaggaattatttcactcgtttatgccctcaagtaactataaaaaattagataatccatcaaattcaactatcccaatcaaacggggcagtgggagatttagttaagcttttgaaacgttggccatcaacgattcctcaaatgctaggtaaaagaatgtgcagattagtgtaaaaaaatgcagtatcgtagtactataagatctttttacaaacttattataatataaaatttaaaatcttgatcatattttgactacatatcaaatatgagtattatttacgaccagggtactatttaacaatgtgcacccaataatgattccaaaattaaaacaccgtttcatgggtactgtttacaattgctgtgccgtgttatcttggtcgcccaccatgaatcagacagctactctacatccaaattcatgttatatggtagtgcttctcttgacttgtttctgtgaagttatggaggagtactatacaaatcctcacgcaataggtaaacaaatgattctgctgggatatatatgtgggtgtgaatatcaatattttaaatagcgggctaaggtatttagcggttagcttctcaaacagttatagcggcagctatagcgggttaaatagagttatagcggctaaattgtacacgagagcaaatagctagaacccttctcaaacagctatagcgggatagcgggagatttaaaaccctggtgaatatacgatgatatatatgactgcattattagattaattattactaggcactaattagcatacttatgcttaacctaaaatagatgatactggctattgcaaaatgcaagcaggttgttgacaagattagaagcttgagccaattataggagactctagtcgctggtataatagcatgcacaaagtactactagcccagtggcacagtacagccagtaggttaatttgcttatcaatgcaaccaatagcactagcatcaacggttagaaggaagttgtacagcattacataggcaagctagccaagtagcgagacgttgatctccaactagcaagaaattaactatgttggtactaattaatgaagtctattctaccgatcaatcaacagtgtcaagtaggtaaatgcgttgagaattttgtgaagacgccaattaaacaattgcgtggataaatagtttgtccaatcgaacagtatgcaaccatccgataattgaaaatttactttaatttgcacgtcttctacttgtaagccacagctgcttggtaatctctaaattaaagtataataagatgtgattctatcctagctcatacccggcctccaatgaagttccatagatcttaaagcacttacttaggggtagttaatagtcaacaacaattgaagcaaagcgtgagtgtaaatcacttaggaatactactcagcaaatttgagagttatatttcaaatgacattaaccaacaaaaaaaaattaacctccatgtagaattattcttgacattatatctgttataatttgatttctaatttattttttgaattcgaattctgaaacttgaattgtagagacattagtactgaactactgatgaactttctgatggtgctatcaacgggacaattaatcattcaccatgcttgctgcttcaaagccaaccgttgatccattccaataaaggagggaagaataagaataaacacgtctgatggcatatcgtccttttgaaaaggaatcaagcgctgtacaaaagtcaaaatggctataaagcccactaaaagcaggtacaatagcatgctataagccagctgcaaacatattttaagaagataaatgaggagagaagggcagcggggtacagatttgtagccagttgtagcacggattctatgacacagcgtgtgtatgacgggtgggaccatgtattaatagtgtagcatataactattgtatgaataagctattatattggctatagataaattagagccagtagttggctatactattaaacttgctctaatgatagtatacttttaagatgatttaatttcacacgcatgcgcctgctataattaatttaatttcagcttaggagacaataaaatgcattgccgttctgcaaagaacactagaacgaacatgccagtttttcgaagcatcaaactaaaatacgatacgttatgtagatttttgttaactttaggtggagatttacaaataacttgaataaatgcatgtctcctttagtgttagagcattagtctttatatcgtgagttataggattgcatgtgctctctgttgaacaaattgtgtaataagtggttgtaacttcgttgatgcaaaggccagattttattccattatctaaaaaatctaattaaagataacgtggaggagtcgtgaacaaattatttctctcgtcagggtttgaagccttatgcctatgaatattatgtacatgtggctatttcagtgattagttttggtttaccctttccaagaggaaaattttgagtgcattactatttgtttggtacacatttagccggcacgtcagtttcacaggataggatataattgaaaacgagcatgatataattgacctgatcactctctctctctctgtgtttttcttttgcagcaatagaccatactaggtag

SEQ ID NO: 68827 - DNA, 745 bp, Oryza sativa
tttgacaaggtttttgaacttatagataggtactgtcataagttcctatgttaattaagaatcttgttataattaattgctactacggatcatagctttaaactccatgtagggcttggtatcggttccgtcatttggtccgcggcaattggagagaaagacttaggcggaagtttaattttcctgtgagtacacatgctctaaatttatattgaatctccaattcaaatacatacaagtgtatattaattagatctctcaccatttgtcatttatatatagtgcgcaaagcaagcccagggaactaacttgtgcggctactacgtgtgcgagtattgccactgccttgcagaccaaatcatcaccacaagagagctcgatgtacgtacaaataaattcaaaatttcattgcgtacgtatcgatttgttgtttactaattaatttcatacattcatatagtttattcgtataagggataatctcacacacaaggaatttatcgcggtggttcaagaacaacttatgggattcatcaacgaacaaatccttgatcccaacggtgaattctactacgacggaaatacaattcatatgttcttagcttctgagataatgactactactacgtcgaaatcgtagctagctaggacatcataatggattgtaattaatacatatctatttttttatatgcatgtacacatttctttaatgtaaatatatattttggtcatatatatatgc

SEQ ID NO: 68828 - DNA, 773 bp, Oryza sativa
cactgtcgccgtcgtcaagtcgaagagtgccgccgcctttttcctcgcgccgccgctgtccgttgatcttccgccgtcgttttggtcatcggtgagttcgccgcgacgttctctacgtgctggtgccctccgttcacgtccttgcgccgtcgttcgccggcgagcaagtgctcccgagccgccgccggagatgacgtcgccgctgacgtcatcatggccgtctgccgtggcccggccgtggatcggttgatctcggccgttcgttttggataagatcgatctcggccgtctgttcccgtgaaccgctgccgtgcgcctggtccaccgcaaaaccctagccgctgacgcaataaatccctttttccttttcaaaaataattcgttattgcgtcataattcaattaaaatccatataagtgttttaatccgatttaatctttaaaaattcataactaattcatcttagctcggatttagttggttcaagtctctaaatttttctaaaaatgagatctacatgttaaaaatatccacatgtactgttcatgcttgtttatgtgctgttttggtgattttgcttctttctgtttagattccggcgtttccggagagtccgttttcgcaggagaagaatttgaagagttccaaggccagcaaggcaagtcacacagatcccaaacaaccctttgagcatgttgatcccgtttaaagctattgtttctattcaactattgcatttattttcgaatgtcatttggtggaattaacctatt

SEQ ID NO: 68829 - DNA, 799 bp, Oryza sativa
cccttgcaacatatatgcccctttagacaccaaccttaaagatttgaaacggtccttcccaatttggtgaccacttgccgaacttgttatcccgagttccaatcgacaaaatcaacttccatataagttcaccttccgaaaaatccttaggcactactttcttgttataatgcctagcaactcgttccttatctttggtaaccttagcaagggctcgtaaacgcgattgaaccaagtcctccctctcatcggccataaggttataatactcaccggctgtcaaactgtcttgcaactctatccttctagagccgattctaacttcccatggcaaaacagcttcatgtccataaacaagcttataaggaggaacttgaattgatccatgacaagccatccgataagaccacaatgcttcggccaaccgggtatgccattgctgaggataatcagaaatcttccgcttaattaatttgatcaagctcttgttagatgcctcagcctgcccattagcttgtgcataatatggtgaagaattcaacaatttgatacccacgctatcggcaaactgaacaaactcatcagacacaaagattgaaccttgatcagttgtaatagtttgaggaataccaaatcggtagattatatgttcttgaacaaattgaattgcatccccagaatcaactttcttcaaaggaatggcctccacccacttggtgaaataatcagtcgccaccaatataaacttatgccctttacttgatggtgggtttatcataccgatcatatcaattcccca

SEQ ID NO: 68830 - DNA, 5160 bp, Oryza sativa
tagtctacatttaatactttaaatgtgtgtttgtatacatcaaaaaaattgccaaaacaactaaacacggtctatgaggtggtaataattatttcctagtttttaatttgagagtggttgtgccttatattttagaatagagggagtataagattacttatataaacatagtagagccttgtagcctagtggttacaacagtctcagtagcaccttaggtcctggagtaacggctttgtgctttcaatggtaggcgacgtacccgtcgacaacgagatgtctgcggtgacttcgtcaatctccagatggatttgctggccagtcttcaaatatgctcataggggtagggtgagtgtgcatgcgttgttgttagatgataaaacatgattaatattttatgtgtgacttgtctttttaattttttttataattttttcaaataagacggacggttaaacgttggacacggaaaccagggtttgtctttttttggacggagagagtatgtataagataccaagccggtcggcagtcggcaggaaaagtagtagcggaatttgaggaaattaaaagtgcagggaccctttgggaagagaaagagagaaagagagaggagagtagcaagagagcgacgaggcagtgtgttgtgtgtgcatagaggatctctgccctctctactgctgctgggctcttttgttggcgagcgaggtgaggtgagctgatgggatagtgtgaggtcaaatcagcaaaagtactgaaaaagccttcccttctttataattgcatgccctgcactgccgctgccttgccctgctccccgcaacaactctcctctgtacattcactcccgtcttgcttgccctattcaatgcgcctcatctcatatgagcgctagtactagctcgtttcactttcaccacaggaaaggtatctatcgcatctgtaaacgtacaaggctacaggaattgaaggagttgtctgtcgatagagtatatagtatagcaagcagctcgacagcgaattggagagctagcttgtagaaaaaaaagaaaacaatgtaaagacactgcatatatgacttgagataacttatcccatgtatgcaaatcttcatgaacatattacatagaaatttgctctggtccaacaaaaaatatctcgagatgtcaacaactcacagtaccaaatcgttttcgatcgttgaatctaactatgcctatcctgtaaagctagattcaacgattgaaattgatttttgctagaccggagcaaaattctattacgtatgtcgtacaattttttactggttatttggttccgtagagaaaatgtctatttggggattaccatcgccctggtcatgaaagctctacgtggtcatgcatgctgcacacacatcgatcgaccatgatcgatcacacaactttccttcggctaatttggctttcgatccgtttcttctccatggtccatccgctaggcgactcccagaggctcagagtccgcgtgggtttctttcttctgtgcgcgctgatcgctcgctcgtcgtcttctctttccgatcgatctcccctctctcgcgcgctctccccaacctctggcgccgcgcggccctgtgcttgcatgcatgctgctcctgctcctgctcctgtgctacagagcgctgccggccgcgccgcggcggccgcctctctcgggaataacgacggctacatcggccgcagcaacggcagctagctgctagctagcgcatgcagtgaacccacccttcctaccgtgggcctttcaccacgggtaactcgtgttcgcgcgatcgatcgcggctctggtcaggttgtaaacaggagttacggcgtgcagcttactgttcatgatcacatgtttgtcttaggctaatttatctgctagaacaccattacgacgctttccactgatagtacaaaacaatttgaaccgtgatcttatttgatcgaaaggtttagatctatttgaattaccacatcagttagcagtatataatagaaatgtcaagggacatcattatcaaaataaaaaggtgtgaagggatataattatcatttatagcagtgactaaactataaagctttgctacggtttctttttttttctgaaaggctaattatgtagttgaatatttttttataattattcaaggtataaatgaaagaatatttttacaaaataaattaacttttataaagttgataaatatattaaaataatactatatgaaattcatatatagaatatttttacaaacatcccatcgtttagaaactcgcgaacatgtatatccatccaattatccgttaatccaaattcctgctggaaggttgtggctggaattataccatgcctggaagttagaatgcgactcaaattcaaaatttaactaatgagataattgaaagaaaatgtttttctttatttttaatctttgctaaaatagcctagatatgcttgggagggcatacctgatatatatagagtgttttttttcagaaaaaaaaaagaaaaaccaaaccgtgaatcacccgtcgcgccaacttaatttcactgcagtaataaactagttctagcagtactaataatatactagagtacgcatattgttttgccttttaccatttctctgaatactcggctagcttcctcaaaggatcaaacgttctccttcgacgggttgtaaaattttggtggcctatttatatatggagaacagttatgttgcactgttctgtcgtaacactactacagtgccaaacacgtcgatgtctgtcgtgtcctcatacaagcaactcgttcaccatggcccacaaccagtccaagagcgatgctacgatgcttttttactagcgatgcttcgatgctttttaatgataatattatactgcatatagtaatctattaatataatgactatgagttactttatcttttatatttttccggttaaatcaatctataattatccattttgttggcatcgctcatattccatcgaaaaagctaaaaaaaaggaaaagtttagttactgctaaatgacgattacactcctatcgtaacttttttttataacaatccccctccatgcttctactatcgttaactgggacagtatatattataaatggatatgaatcattcgatcaaataagatcaacagtttagatttctttctacttccagtaaaataagcatagtgagctcgtccaaataacactggtagagaaatcatctttggtcggtcgacccaaatccacaatagttccaattccaataaaaaccgggactaaaaatgatttttagtcccggttgttgttaccaaccagggctaaaaatcatctccaaccgggactaaagttcatctttagtcccggttgattccatgtcaggccgtgtcagggccctaagatctttagtcccagttagtaacaaccgggactaaaaacctatttttagttccggttgatgttactaaccgggaataaaaatcaaaacacactatataatccctagtaccgatccttttcccgtccacacaacaaactcctccctctatctcttttttcctctctaacttcttatctctttccttatctctaactcctagccttctctttccttttttttccttccattcacagcgaagaagacggcgggccggccggcggcgcggggggccgcgcggcggcggccggccagcacggaggggaggaggcagtggccggccggcttttttttttttacaatttatgatttatcctgtgatatatttgatttgtgtgtgatgtgaatctgtgatatattttttagaacttgtgatgtaatttttttaagagtttgtgatgtatttggagatatctatttgaggatttggagatgttctgtgatatgtgatgatttggatttgggatttcttggcatgattaggggatggtgtgaaatcaatattcaatgctaaaaacaatgaaaaagaggaaaaaaagaaaaaatatatttattcccggttggtgactaaaatgctccatctttaatcccggttggtaacaccaaccgggactaaagattgatctttagtcccggttatttgaaccaggattaaagatagcgatctttagtcccggattcgtagtcccgattaaaaaaccgggactacaggaggttacgaactgggacttaaaaagcacttcttcaccagtgtaagagtataagacaggaggaagctttcataaatgatagtggcggcttgtaccatcctcgttagtaattttaaataaaaaatataggattagcaagatatatcgagggacgaagaagcaaattaatatgttgacatgtaggttgtgttttttttatgggtacaaggtcacttaagtatcgatatggaaggagattacatcaatgccaaaaaggctatgtacaagacaaaaacagggatcttaattaggtgatatcttccaatatggttagttgctcccgcttttgacccaagctatgtccgcttttgatccttgtatctcttgcaccggccattgttccaaactactaggatgatgagggattttaatttatggacttcttggggatgcctggcgttgagaatagctgctgccaccattcctccccagtccccaccacatctcgttctccccattgctgtatacacaggttgtattttttttagttttgttattgtttattattgattggtatgttgatgtcatctctcttcttcactcatatgaattttatgtagacgcctcatcatctaattaaaacatccactactagagaattgatgtttactcggatggcaaaaatcatattagtcccgattcaaaagcctaggggtactttttgatctttagttccagttttttttcgaggggacaggcagagagttcctgtaattcattatagaagaagagagttgatcccgtttataaggaaaaccggaccaaaaaccttataacatcatgattaattaaaggaaaaccgacaaaaaccctaacattaattgacgtactgatcctaggagcaacagtccaacaaggaaaaaactcctaaaacgaagtcttcaagaagggtacgccgacagaatgacgacatcgtccgatcctaacgaatctaaggttt

SEQ ID NO: 68831 - DNA, 1538 bp, Oryza sativa
aggggaaatgtgacattaaattttatgaaggataaaaaagtgatatcatgcagatctagccaatggctaggcagatgaagacaaacaggagcattgccgtttgctatacaggaggaatgagtacaaccaataaactcatcccaaagccacctgtttcaaccttgtgagccaatgagctgatcagctgaacatgggaaaatgagggaagagaagtacctgattcagcaagaagaccccatgggaacagaaaaaaggtataggccaggaagacacgaatgaatgggctgcttgtgtgcaatgaaacaatctcactgaaggagaaacaattgtgtcggtttgtgtccaataaatcaagatgaagattggcgaatccagctgttgtgctgcaacaattagtttcatagaaaaaggggaggctaaaatgcctgctaaaatgctgcatcgaaccgaagccaccagatgagttggacatgattacatgagcccttttacagatggaaaccgcgctaacaggggaaagggatttgatggatctttgtatctggaccaggaagaaacgttttcgtgggtatggatgaacaacttgttagtgccattgctaccaggtatacatgtatcctgtaggatagtagttggacgtgggtgtagccgcgtaggcgaacagattgattcgttgtgttgttgcttgtttgtgggagctcagcatgcaagaagatcctttaatagctgcccttccagttcttttcctcttatattccttgagaagtggaagaggctgttggtttcgcagagggagagaccgtaggatggtggaaccatggaagatgaaccaaatgacagtttttgatcgagccatcaaggaggaggcgaatcgatgaggggaagaggactcgacaacgcacgatggaggaaggaggaagaggaaaggttcactggctggcccaggtgggaaaattgggctgggctcagcgagcaagagaaaaggtctcgaggaagcaatctgcaccgttaagaacgtgaatccaacggatggaattaagtggtgatgtggcttaacctcaaagcaggaaattgctaataactatactaagtggggatgatttgtataggtatataggattcggtctaatggtttatctttactccacaccctctaatctcaaatcttggcttcgcccctgcgcagcagcctcgtcgttgttgacatttccgccttgctgcccacaagtgcgcccgaggttgacctaaagacgcactgtctgaagaagttagcaccccctctgtcccttgtgtgcctctagtgctcccgatctgggacgccatggccccaatccagccattgtgccgctgccagcccttagattgggcttcggaaagcaccatttcgacgcccatagccaggtgaaggacttcatcgccatcatcctcctcaaactcactctctcaccaccctgaaatggttcagcttgtcttcgagtggtacatgtttctcgtgcttgcgcccaacgacgaggtgatgaggtgatagggagagagaa

SEQ ID NO: 68832 - DNA, 1245 bp, Oryza sativa
cttgttactgatgatttagtgtgtcttgttagattgttactattgccttctagcataatggatatagcaagtatgtttagctggatagtaatgttgtgctctattaaaaacaaaggaacaatggagcggattgcccttaagtttctggtttctccgcgtggtcgaggctctgattggcgactttggtgggcaaagcccttctctaatatccttattgtttaagtttccaaagtgtatacaacctctatgtactaggtggcatctaataattagggaatctgacacaaactaggaatatcaaatagaatacataaatcaagctaggactagaattatgaacatatctaacgcaccatgccaatgtttcctgcacctatggtatttgatcccataacatccgtaacagataacctgtatgcagatggaatgttgcaaatcatgagtcctttactgacagcaattgtctaggagaaaattctagttagtgttgcagaaaattaggtgcctctttgccagcaaattcgacctttgatgccatcattgttggtgtagcagaaataatgtcatcaatgttcaatgcagtctcagttcaatgtaggtcaaatcaaaactttacaagacagatgccaacttcagttcgaaatttgagtaaagcttgttacagttctttttataaagttaatagttaatggctacggggaaaacagaagttgaccgctgttatttttgccatgcaggagttcatcaaagagtctttaattgatcgattatccttagggataattggttctaattcggtctacattgcaagccataattccttcagaagtacctgtcacaatggcagcacaatgaaaagtggaaaacaaaagcatcctgccggcaaaacgacttgtggctgaagaacaatgatgaagcaaggggtgacgcagaagtatttattttacttttggccgggttataacttataagtcccttgatcgctgcaggttataagctctgggaatcttcattgccctaggtctagtgttgaatctatgtagttttttatgtagttttttcaaccaaaatcaatcttgaagtttgctgtttatgtgtaattacgatttgtaccaacaagattagaatgtttagctatatgccttggattgattaactaggctcagtttttctctcattcaagtgttcaatgaatgaaatgtatggttctctagcttttcttttgtttcaaaatccttagttttt

SEQ ID NO: 68833 - DNA, 3400 bp, Oryza sativa
gttaatgaatctaaacagactttaaacagacttttcagtatataatgaatctaaacatatatatatatgtctaagattcattaacatctaaatgaatgtaggcaaaaatcttatattgtaaaacggaggaagtagcaacatttctcaagctccaaccaaacgatgaaatttccatggagcagtttacttgctgaatagttgaatcaattagacgattgaaacaacctcttccacacttcaaaacctgtcttatctccacaggggttaaaaacaaaaaagaaaaaaaaaagcgaacaaagaatcaagaaataatagatgtagcaggtacagtaggcaagcaccaacacctcccctccaacctcacactatggaaactactaattttttacagaatacaactcacacttcaagatcagcttcagggcaacagaggcaagggaagtttgatattctccctaccacagattttcgtcggtttgtttgtttacgcgttctcagctgctgcatgcgatcgctttggtcgccactctgtgtgtgccttcacaatgtcagccttcacaagatggtcgcactggatggcagaagcctgcttgtcggcgccaatgctggtgcattcccctgacacggtggtaagtgattgcagcacgctgtctcggccacactccttcctgtaatccagggtcatgcttgcaagctcatgcttctccagtactgaaattggagcactctgggggaaaaaattagaaagaactcagaaacatgtttgaaagccttctgactgaccagatgtaagactaatgacaatatcaacaatacagatggtcagatcagaatctctagaaaataattgcaagtactacataaaatggttccctaacaactactccctccgtttcataatgtaagtcattttagcatttctcacattcatattgatgccaatgaatctagacacatatatctatttagattcattagcataaatataaatatgggaaatgctaaaatgacttacattgtgaaacaaaggaagtaccatataaaaggataaagccaaattatttttctctaaacaatgaatataagggacaagaatacccactcaaggatccaccccaatatatttaacattgttcacatgctgattgacatcgaggtcaccccatctaggctgttgcagtaaacaagagtccatcaaatatcatttaaaataaatgaggggtgagatcaattattactgtttttcttagataaatgatagcagttgaggcataatgataattcagtatgtaaccatgtctagctgacttacagtgagcccctttcttatgaattgctctgtagcatcatcaccaactttatttcctgtctaggctaacttttcactctgctcctctgttatagctgaacggtcattgaaatatgggcctatttcagctctaacttcatctggcatttttgaaagtcttctagttttcttgtgcatcatcacccaaacactgcaacaaatggattggaaaaggagcacaattagtgattatcaatgatgtgaccaagcagaaataccaagattggatgtcctcacaaaaaaaatgatacagatgattcttgcaatagaatacagttgaagcccaaaccttgtagctctcaagattgttcggccagagttgtagtcacgaacatgccagtctcgacgcatgccatttttgccagcagcagcgacccatgtgtcaacttgaaccatatctcccctaaaaccatagcaggttggtacaatacatctgtcattctttttgatccacagaaagacatcggcaattgtatctgaactaaaaaaacagtttgaaattgcacttccatttttctaactcaaaaccccaaaaaagaagttttcaaccacttgttgacacagttgacaagaggatttaaacataacgtgtgaatagtagtactagcaccacttatttgatgaatgatgaccacctataaatttaaactgacagatgctgttcaacaaaagttcactgttctagatcggtccttagcttctcccatgatatggcacagcattaattgcttttgttcttttctacacgatggaatcatttactgcagcccaataaagggaaactttctgaattgtgatcccttgaggtgtggtaccctgtacagacgtcttttaattcaagatccaagaaagcacaggacagaacatttaatgaggcagctctgggcaatgaatatgaagtaaccagtcaattatctattgggactaaacctctccctctatccactaatcagttatgttttcgggagagcattgtcctgctaagtgatgttatacttttcaagacaaaacagggcaacagagttaagtgctgccaaactcaggccttggggtatcgtaactttcatgctgcttgtaataaagctagacaataactttaatatgaactacccgagtggtaaatttttgtttataaatgcaaataaatcacttgctaatttatttttaaaacggagcttatcgctggaaaacgtaagtacatgcccgttctggcattcccactcagcataattcaagatccaaggaagcacagagaagacatcatttaatgaggcagctttgggcaatgaataaggcgtaacaaatgaagttgctcttggatctaaattactactccactaataattgacgtctaaaggagatattactgttcttttaactgatgttgtgtcttttgaggacaacatagagcaaggagagctacagacttacagtgctgtaccaaaaaggccttggggcatcataacttttatgttgcatgtactaaagctagattatgtctttaatgaggattacccaagatgcaaatcctgtttctaaatgcaaagaaataacttgatagtttgtgttataatcagggctcgacaattggaaacaaagtgcatgctcctcccacttaagtaggaatatattcatttcttcctaattggaaaatttagtttgccacaaaatctatccttgatccaacaaaactggagctgatattactacacatttcttagtcaaccaaggaggaataacagaacctccaaaacatgaggcctatcacgggaaatcaaagaaaaacatggccttctatagcagtataaaaacttcaacccatattcttgcaaacctgcagcagcgaaatttacgagcaagtaaaagattcacttgattttcatcaaccaaccagtgtatggagaaatcagaccagagatccacacaacaatatgataaaccatgttaaagtaaatattgagctaaatactactgttgcttgtgtaagaatcttctttaaacaaataaaaacaaatatgcaaaggacacacagctgtaaagtagtacataaaa

SEQ ID NO: 68834 - DNA, 2142 bp, Oryza sativa
ccctcctccccagcacgcaaaatgaagttcgttttattgcatgattaattaagtattaactgatttttttaaaaaatggattaatatgatttttttacacaactttcatatagaagtttttgcataaatcacaccgtttagcagtttgaaaaatgtgtgcgcggaaaacgagatagatgggttaggaaaatgggggaaagaacacagcctttgaagactatgccaagtttgatcgtaccttaataagtgagatgaatggagtactatgctaagaatattagggtatgatattttctaatatttttatcaaaataaaaagattatgccactttgatttaatctacaaagtctgttttttctctaaagaatttaagcattggagccatgtcaaacagggctgatttgccttttatgctgcacatatgggatgacaaatcttggaaactagatgataccccgcgcgttgctgcggaatgttggtgtataacatagttgcaaaactataatatgtaaatcaaatattgtaaatcccactaagaaattagtcattaacagtcaaaacaggatacatggaggttagaaagattatgcaataatcttacccattagcaatcacgggctagccaaagtacaaattgcagttagcagattgtattatcaatgttctcataaattaattgttcgaagaattaaatttattaaaaaaaagtgaagttttgtgagaacatctcaatcaacatgtttaactcgtacatcagacttcctcggccaacatttaaatcatcacgttaattcatactgctaacttcactggctcaaaggatgataaatatatttatgtagagattaagcttatatggtctattatataactatgaaatactactacatgactaacacatctaggaatagaataagaaaatcaccttatgaaatcatgaagttgatttatagtagctgacatatataaggtctgaaaaggggtaaaatcacatattattcattgcgctatgctgcaaactggatcgaattctcacctgtggaatttttttctgcatgatagaaaattatttgataagcagaaaaggagtgcagccttgaaattttccgtatcactctcatggagaggaaaactaagttatcgtcagcaatcgtttcttggaaacgtaaaattctcttcaggaatcagaacagaattgaatacaaaggtagaaatgtctaatcaaaatttacctcgtcaattagggtcagatcgatcatgtaagtgacattacaaaagataaaacatagcgatattatcaagttatatgtccaaaaatggggcaatcagaagaacacatgcatgctattttacaaaaaggcagaaaaaaatgagtacaatcatcaactcacctaatagctatgttccaatttggggatcgagaaaataaactcagcattggagaacggaagaaaacatgcacctgatcaaaaacttgaaaactgatgggattaagaacggtaaacacaaagaagacaccatgcaatcggctaatgttgaagctaccatcaaatcatgtagccgaaggacaaattaaccatgaaccctgtaatatgcccaatatagtttccagccaatggggcagactgaagaatacctaaagcttcgctatttgatgtaaggggagaaaaaaaaagagagtacagtatagacatcagcttaaccaaaagctgataaatttgggatcgagccaatgaactcaacgtaggagaataaggggagagaaaatgtacctcatccaaatactgatgggagtaggaaagataaacaccaggaagacaccaatcgcctgatgtcaggagctgcaaatgaaatcatgttgacggaggacaaattagttgtttaccctgcatatatgccctatatagatctcattcccagccaagatcgaccaatgttttctgaatcgaaagatcaaatcaatgcccggataatccatatgagccaccagatgaattggacgggaaattgatgaaagccctgataatccgcatgagtactggataatgataagatatcgtggtgagcgccgcgccgggattgaaagcctgcatacttgatactcgcagagcatcgggagaaagcatcgatatttagcatga

SEQ ID NO: 68835 - DNA, 890 bp, Oryza sativa
tgaaaatactctctgaaagagcataatattgtaatcagtggcacatctctcttttttttttctcaggcagaaaagcttttcattatatgaatatgcagcagcttacaaaaataatgcatcgatcaagcacatgtaatgtatatatgtacagtacctatagaatgactaactttggccggccttctatatttcttgtgtgtaaaaaaggctatgcatatataaaaagaaaaccataagagatagatatagaaaagaatgaagaactgcaactatatatatactttgtaggtagtctatattactccagagattctcaaggatgaaagtacaacaaaaacaacccaaaggatcatgaagtacactgatgttgcccaagcccacatcctagggccaccaagctcggcgccaagtatgacgcgacgaagaaccaaaaccgtgatgcaaccgaacgacgtcgcgaagaagaccagaagggagaagctgaggccagcagcattgtctatgtacaggggcttcttgtagacaaaactagcatggtggcccgcgcacattgcgcggctagcatcattatattttctctcatataaaagcatatatcttttctcattatattattataaaatatattacaatgacaacataattttaaattttgcaataacttttcaaaactactaacgtgtaataactactctagtctcctcttctaatatttcttattttttaattctgaatttcagctatttctaaattgtatttctatatgtactctgccttttctttttctctgattaatgtgagaatttctaggccatgagagcgaacgtggaggctcctttttattccgaattttagttggttttaaattccaatatgaactctatactcta

SEQ ID NO: 68836 - DNA, 3655 bp, Oryza sativa
aggccagccacagtactgcctctcttgtcgatcgatcgacagccacagcctgcaggtgtggggattcggctggccgtcgccttcgtcttcgtcttcgtcgtcgtcctcatcatgtcgtcctcgtcctcgtcgtcggctgtcttcccactggaccacctcgcggcgccgtcccccaccgagcagctctgctacgtgcactgcaactgctgcgacaccatcctcgccgtacgtgctgtggcgccgatcgagctagccacctacctaccgacagcgtgctagcttcagagcttcttagcattaattcttcgtttgttagttcgtttcttgttttgatcgatcttttgtttctcttgatgcatgactaacctgtgagtccccgtgcccaacttcgatctccacgcaggtcggcgtgccgtgcagcagcctgttcaagacggtgacggtgcggtgcggccactgcgccaacctgctctccgtcaacctccgcggcctcctgctccctgcgccggcgccggcgccggccaaccagctccacttcggcccttccttgctctcccccacctccccccatggcctcttggtatgtacccacctaacttgctctatatatctctctcaaatcctcccatgctagctctcacgttttagtgaggtgctcagctgagaatcatacattatattcatactgacgtttagctctcatgggtgtgactgtgtaatttccggtgtaggacgaggtggcgttccagacgccgagcctactgatggagcaggccgcgagcgccagcctgagcagcatcacgggccgcagcagcagcagctgcgccagcaacgcgccggcaatgcaaatgcctccggcgaagcctgtgcagcaagagcctgagctgccaaagaacgccccggcgtccgcgaacaggcgtaagtacagtactactactacaagcttggtgttctttctttgaaacgctagaattttgtagtcaaaggtacttatgcaccacagtgtgttctcctgctagcttgttgcttattcaccgttgtttgggaggtttaagaacagaaagcttgctaagagggggtaattagctacttatagctcctacttaggcatatatgcacacattagcgtactagtgtacgtgttgaatttcaaatttcaatccagtgtttctttcgagtgtgtgaaattaatatgtactatattcacttgaagaacgctcctcagcactagaaatgatagtacagatcaacaaggcatgcgatcatgtcttgttgtggcagggccatgtaagcccatgcttcgatcgatccggtcagtatttgcagacagcatgtatactgatagcttaggtgagcttacccatttgtccatgtttcctcggatgctgtctgatccaaaacttttgcagctccggagaagcgtcagagagtcccatctgcgtacaaccggttcatcaagtaagatttctctataaaccttctgcctaattaaaactgatggatcctcctttgagctttggttaatcagtattcgtggtatcatctcgtaaaaaaaattaattctgcttataatgaattgctacacagggatgagatccagcggatcaaggccggcaacccggacatcagccaccgggaggcgttcagtgcagccgcaaagaatgtaaactttcttcgtctgatccgcgcattaatgaactcctactcatcctgtagtatctagcttgatgctagctgttcgcgtgtcttgatttgactggacaccttacattgtcagcacggacacagcggcagcttgtgcccggccgcttgcgagatgccgagagcaagcggctgtggtttctgggagcttttagccccacagctgctatagctagggttcgttcggatttgtttcgatctcctttactgatccaaacctgcctttgctttggctttactttccttgtgcttgcaatcagtgggcccatttccctcacatccattttggcctcatgccggatcaggggttcaagaagaccttcaagcctcaggtaaccagaatcccgagagaattaacgtatactactatgggagacacaagcataacctagttatctgtgtaacctgaacactcatatagccttatcagaattcagacccacccggcaaacactgcatatgcactgctcttatttactttagtgctttgcgagcaattcatctgtagccgcttcctgtgtcgtgattttcaggatggttctgaagacattcttctcaaggatagcctgtatgctgcggcagccgccgccgccgctgcagccgcaaacatgggcgtcactccgttctagcgagctttggcaaagcggccgcaagcaccgaattcttggtggtggccctagctcgctctcatgtgtggcgccattctagctatatagcaagggtttaattagcatcagatcatcatctcttaatatcatgtgtgttgcttaattagagtacttctgagtgtgtagaagagagatggggaatcctgttgagtgcctaggtttatgcttataaccatattcctcgtagagacttttttccctgtttttctcttttcttttccttctttatttttttatcctttctttctttcaggactatcttcgtactccctattcacctgtagagtgtagagaagttgctgttccgttgcctgattgtgtcccaaaagacgtgtcttaattacgaactcatgaacatcatctagcaatataaattctagaaacccatgcatgcatgcgttgctttctttaatatttcatgtgcttttcttcaatagaaaatgttttgggtttttatcaccatacattcgttatgagattaagtgcttagtgctaagattttggcaaataaatttgtaaaatttcaaaaagagaataatataacttctttgattccttcaactaaaaaaaacttttacactctgtctatgatagttacaaaaatcccttgccagatatataatcgactaccacgacattggttaattactatatctgttcctttatatttgtcgtcgctaatataagcattgttcatatttaaactttgatcatttatcttttttcttaaaaaatctaaatacttaactagatgaatcttatcaaagtgtattacatactaaacataaatttaatttaaattttcatttatcataatctaaccatttaaaagtttttagcggtccatgatgagtacgaacagagataaatataaaggaatgtatggagtagtttcatccttaaattgctagctgaagacacaacaaaatataaaggaatgtatggagtagtattttggaccttggtacgcaaagatattggtttaaaataaattaattgaacttgcatgccttagctcgaattattaaaatataacgacctataatttagttatatgaaaattttcgtcaatctcaatataaggatttgctaaattttcgtcgatcaaaaatcaagagaaaaacttccaatatttcgtccatcgtataattacattaccattatattacgttgtagttacattagatttctttcaaaattttatcgtagtccataaatatattcattattgaccaaataaaacaatgcacatactggtttgacttggcaccctatttttatagtat

SEQ ID NO: 68837 - DNA, 3433 bp, Oryza sativa
ctctgaaagtattttgacacatcaatggtggtagtagtgatgccatcttcccaaccctctaaatgactcgtccatgttgcatgtgacaactcacgctcgcaaaccagaacctagaggacgactacgattggagcggtgatcatcttaatgttgtgtattctatttattgtttgttgttgcttcaagaacagactgcttgacctacaaagcaaacaatcgtccccttccaccctccgcctttgcctccgtgctgctgctacttcaatatagaaaggacacaaatagttaaaatggacaatcgtttgcacataccctctaatttattggtacggtcatatatatatttttttgaatgaatgcattattttaaaagttttcacgagatttaatttaatttcttcaaaaagaaaaccaattccacctatttcttgaaagtcgtactactatgtctatactaatatgattttcacatgacccagtaaagatcagtctccggtaatgatatatgtgtatagttattgtatttcaagcaaagttaaaaaaagtaatccattaagcaacactgccgcaaagatagcatacctccgatccatcaccgcccggctagatactcccttttttttttctctcgcatggaccggccggtcggcggacccgggcgtatatacaaagcctatttctccgtgcctttttgtctccccacccaagatgagcgtaccgcacagtcgcacacaccctccctgccgtagcgtatataggcccagaaagcaagagtcgagagaaacagaaagacgccgagacgcggagaggtgctggccggcggccggccgcgcgcacgcccgcacgcgcgcgcgcgcatgtatatgctgtctccgatccgacgcgacgatgctccatccgatccgacgcgacgtgtggagctagctagcgcgagccgcccgtacgcgatgtacgcccgcgcgtgccgcggtcaaccgggatgtggagtggatcgcacaggatcagtactgctgctgctgctcttttattgctgcgcggagtgtcggagcgctagaccgagagcccggccggccctgaatcacgctcgggtgtgaccccatgaggtgactagtgatacggtgatgccgcgagctttgcctcttacggcaagtacaataacttgaaattaccggctaatagtaagcttacgttggattttatacctacgtggtggagagagagtaccaagagaaaaacatcgtcgattaatctgtcgacgatcatgcacgggcaccaatacacctagcactggtttgaagcctttctatcgacagcaccatcgacggaacaaaaaattagcatgaataatctttcctgattggcttggaggaaagagaaaagctgggaaggagcgagagagaagtaattaaataattattgatatgtgtgctgcagtaaatgtaaagagacaactattatatttattatctattaagttacctccaaataacgtgtataaagattagagtaagcagtcgtcttttttattgcccttgcccttatctcctctgatcacaactacctcgactgagtgcgtgcgtgggccatccgtgtgcctgcctgcctcactggccgtcgtcatatgacaagcaatgtgaatatagtgcaccgggcacggcctgtttgctgcttgcattccctgcgcgcggcaatgtatactgtagatgaccgtgaaattcagcagtcgatgaaaatctgaaatacttccatcgagagcatcggctctgcgccggatggccaatatcaatcaatcagcatttaatttgacaattttaccttttgtaaaaactaatttcgcaaataaaccgcggccaaaactacccttttatttagcgtcaaatcgtatggcgctaaacttagacatatcagcgtcaaatagcacggcgttgaatgcacgttggcacgccgactcagcctcccatccgcggtggcacagcattcagcgccagttgacgtgatgctgaggtgtctaagttcagcgtcatacgatttgacgcttaacaaaagggtcatttttaaataagttttggtcgcgattcatttgtgaaattagttttcggagaggatcaaattataaatttttgtgaatcaatcagtccgtcctccatatgtaatcaagagcgaggaaaaagtacaccgaaggtccctcaacttattatcgagttataaaatcatcccccaaccgcaaaatcagatatacggcgtcccttaactaatcaaaatcggtcccaataggtccttcggtggttttgaccccgattttgtcctacgtgacggctaagtcagcgtgggacccatgtggggcccacatgtaaggatgccacatcatccttctctctcccctcttctcttcctcgattcctcctctctctctctctctatgtgcctgtagggcgccggtcggcggggcgaggcgggagaggaggagggcggtgccgcaatggcggccggcggtgacggccgcagtggggaagcacggcggcgcgggcgggcgacggggaggcacatgcgcctagttggtggtggcagcaaccgtcgttgatgcctggcacggagaagcccatcgccgtcgcggcggtgcgctcaaccgcggaggacggggtcgaagaggtcagcatgggcggaggattctggcgggaggaggaggaggtcccggtggaggagcatggggagcacgagctggaggtgagatgagggggagttctcgaagctgccgacgccgaaaagcgatagccgcatgggggcgaggcgacgcggtggcggagacacgggagaaggggtgggcggcggcaaggcgaggcggcgtcggcaggcgagcgcggtggcagagaggcggcatccgcatggtcgcgggcgacaaggaggcgcgggcgtcgacggggagacgggaacggcgtgggcggcggggaggtacggccggcgcgggtggcgaccgccgcgccacagcgacgtcttcacggcccacgccgccatgattgttgccttcttcgtcttgcttggggccgccaccacgccgcgagtgccaccctgcgcgcggctaggccggcccgcatgggcgccacctccgcgaccacctcggtgccagcccctcctttccattaccaccgccgcgcatagtcagccgacgctcaggcgagcacggctgcgagctgcgccgtggaggaagaggaaggcgggtggacatgggcatcggtgaggagctcaaggaaggagaaggccgggaaggtcggcgtcgtcttgttcctcttctgccattcgccaattgcatctagggagagaagagaagggggaaggagacaagcaacagcccctctccgctggcggccattgcgagacagaaagaagagaaaagagttgggactatcatgtgggagccgctgctgccgtgttgccc

SEQ ID NO: 68838 - DNA, 2070 bp, Oryza sativa
cccttttatcactttcgccttttttccaacctcgctgctcttccaagtgaccaatggcagccacacagaaacacctgtggctggtaaattaattaacacgcctagctggctctgcacttcttcagcttgttcaatgatactactacatcaagcttgtatagctagctagctgtagtagtgtacagtacagggccacagtatgtacagatctgcaacaagctgtacaaatactcctacatgagtgatcatgctgcaggaaaaacgtacaccagaaatcagaactcacatgagcatgagcagactagactgatctgctgctctaccagagcacctgtattccaatacgctcctgtcccctcaacctttctgtagtatatactaagatctcaaaaaaaaaacattctgaatactatctctgtgactgacttgtgggcccggaggcgatggtgctcacagggttgcagcgtggtgggcccggaggacgatctgtaaaaatatctgcgcagagcctttttgcgcttttacagttgtatttgtatacgctgggtagagtacatgcaagtgtacaaatacagtagaatacgggttggtggcgtagagaaaacctggagactttgcctgccatgatggcgtacaccgagctaagctgctgctgctgcaggtgggtgtgtgtgtgcggggtggggcccgacgaggattggcgagaccgcaacgcgccctccccattggccggcctgggccccacctcgctcgaccaaccgggaaacgccacgtcggacgcagagcggtagctaatgattcgtggcggtccggccgtgggtaaataaccgcaggtaattaccccgtttgtggggaggctttatgattgggcttaaaaaaaaacctagacaatatcctgttggaacggaatactcttatataagatagtacctgatatctgttgtggtactagctgtatggtacctgatacttgtgatacctgttacccgatacctatgatatctaggacctgatacctgtgaaactcgtgcaagagaatagttaatatgctttatcttgttgtaatgggatcccgttttgtagcagccctcttaggcttaaccaccgccgcattgtaggagagatgtgtttttaccgcgatggcggccggcacgtcgaaagatcaaacgacacgcgtatgtatgtacgtatgtagatgtgtaagtaattaaggattaacagcggattagcctgcaacttagcgagtggtacgtaggttctaatagctgtaaacgacttgactatgagtggcgttttgatgcgttgcgtgcggcggtgcaatatttttcgaaggctcgcttttcttaaccggagaaagttacagctcgtactcgatgggaggaagaaagggagaagaaaaaaaaagttacagctcgatcgttcgctagctaactcgtccatggccttcccataattctgcatgcaagtggataagatgttgcgtctgtgggtcccacgttaccgggacgggaagaaggaaaagagaagaagccccatgatcggtccatcgatcgatcattccatatgttcatgaccatgtcgccgcaccaggcaaaaatatacattgtggttcaggtctgcatgatcggtagcattggcatggatgcagattcttgtaccactaaaaatctgctaacctgatttttttttctcaataaattaagttttgctaatcgatcgcgaacacaaaaattcctaatcttgtgttaattaacactgcctaatgcctgcaacccaggaagttaattagcctcttcatacgcatgcagctgcagccggccgccggcatacttgaggtctcttgctggccgtttccaaactcgtcgttgatgatcatggccatagccaccgcatggtgcatgcatgcgcgagaatatgtatggccgcaactgctgttacgtacactaatatacggagtataccacaggagtgcatgccaagcgcttaaacctaggtgcaaagttccaaatcacaagtcaaaaaggccaaacaaacagtacgcacgcacacgccctcgtttgggcagcacgc

SEQ ID NO: 68839 - DNA, 14824 bp, Oryza sativa
  unsure (1)..(14824): unsure at all n locations
ttccccagtctgatggtagttgcctacttgggacagccgaatctgcgaggatcttcggtgatccggatcagaatttccatgtctgttccaaccgctatggatcggctgcatgtatcagcaggagttcttttttttaatgctacaattctccaatctctgaacatgtgaccaacaaccaaacagttttttttttcttttttcatagaaacttgaaacagggaaatcaatcagtggaatattagatcgaccacgatgcagcttatggcatactaattctcaaatcaaacatgcatgcagttcacaggatctgaggaatttaagctaagcattgacgcgggataatcttgaattcttgacaaaaataagaggagcagtttatgacagcaaatattcacattttgaaagtgtattcctcaaagattcattctacaatgttctgtagttaaaaccacaaagttccaatatcctacagcaaatttggaaaaaaaatatatgatgcctttagactcttgtttaatgttcctcttcaaagagtaggcaaagctagcagcaatgcaaaaatagcttatcttggcagaaacagtcattttcacgggtccggaactgagttgaagacagcatgataattggagagatcatagaacgaagttgactagtccctgttgccccagtttcagacgttcctcccaactctagtgctcgactgagggaggctaactttgactctactcccaatatatgtccttctaattcaggtcggttttagattgcataaattaattaaggcctaattatgctacagcagctagtaattagcacctacgattttgttagatatgactacacagatataaaatctttcgatttgccgcgtgtaagcactaaacaggacaaaagtactactctagtacttgcaatgggtcctttggagcttcatagggccagatttaagttctatattagttaataaacacagaaaaaaaaaacccaacgctagctataattcgtccaaaacaaatcgacaatggagtactacgcttgcacgcatgataaaagttaattagcaacgttaacaatcaccaaaacattgttttgaagtccttaacgtacgacgccaccatcggattggttggcttttgagttggctcttctcccactagactaatctcctgaaaatctaattaatctttgcattggcctggtccaagttgctgatgactaggattggcacgatcaacggatcaagcctagatcatgacgagagccatttgccggttgtcttctcccaagtaggcttgtttagcaaacttgctctatttgttttcggcaaccagccaaccacggctcttatcaaaatggaaaagggaaaaaaggtaaagtcgcaatgaagccatcgaggctgatcactgatctgttctttctctaccgatcggccggtacggtcagtgtacggctctaaagaatcaggcgagctcggcgttgtcgcgttaccattgcactgaccccagctaaccacttgtttaattaacccgaaaaaaattggacatggtcaccttcttgatcgctgctgactcattttttttgagagagagagatgtaacatatgcagttgatgtaagtatattattactctaatgctaatgcagtggttggccattaggtcagtgcatggcgatgcaactagcaactaggcagcaccagctagatgctcatcgtcggttagtgctactgttgccgtcatgtgcatatcagcagatgcatatggagtttgtttagtagcgagggagctgactttttgagatggcaagtgatcgatggatcgaacgatacgattcagggaagccctatcaggctatcagccgatggcgtgtaaagtatagaagacgctgatcaagctgtgcgtgctcctaccgttctaacgtacgaaaacaatatgctttttgcttgattaaaaaaagaaaaaaaatcctgccttttcaccctacatacatgcatgctcttgcttgattagaaaaaaagacaaaaaaaaatcctgccttttctccctacatgcatgtacatacatgcttttgcttattagaaaaaacaaaaaaaattaatccctctagaaaaaatatatttgatgtataggataagatttcgttaaacttttaaattctaaataatattatgataatatttattaggaaaaatatacgatgccactttttagtttctacactagcatttaagaaactacttataattaaagttttataagtttaactggtccgaaacattaaatatattttattgaagggatattgatcgaagagcaagagaaggataaatatcaataattatgtagtgtatctacatttaaacatagagcttacctattaaaaatacaagataaatagttcggggtctttaatgaaatgaaaggataaatagatttaatttccatgcgaattcaangtaaactccttgagaaataaaattaagaataagctacttgggagttattttcgtgttgtttgacagctaaggggccatggccagcttcctttgtgcttgcgtaactgttcctgttagctgcaacgctgttgcagccaggtagccgagcagttacaatttattttagaaatgttattggtaactaattattttacgctaagtatttgctttccttaaaaagttagccaatctctgtaggtagccgcatccagctggctggcttctccatctcatagagtatacaaatcgtgtttataatagtcctactaccactctcagttagtgccgtacggcacgccccgtaattttgaacggcaacatttcttcctaactctgcatctcacccaacaagagcacttcattcgtcaaaaaaaaaaaaaacaaatctgtgataggacatggaccaatcttaatatatatatggccaaattcgtaataccagaatattacatttaatatggagtagattggtttttaatatatgtatgtccaaattcgtaataccagaatattacatttaatatagagtagattggttttttatggaatgaagagagtactcaagacttgattatgcaataaactactggagtaatggccatccttgatttttttggtctgaactctgaagaaagatttcgcccacacgtttcctaccaataacatgtgaccagtccacgcaggctctggagtaccgtgcagggtttgggccatccgtaccgtaccagcagtccagtccagccccagtgccccactagctcactagcacacgattttgctaggttacacatggctttcgctgagtgcaagcgtatgtgtaaagacgtggatccaccaaaaggtgtggctctatttcaatcaaacttataaagccgattaagtggtctctgtagtactcactctatctatttttaatagtaatatttcatcttgtcacatagactaaggataagtaattctacttatcattcatataaacatgctactagtcattcctcgtaaacaagcgattcattgatatttacgtttctcaatgcccatgtagccaatcatgtgtggaagaatggagagtcatgcattaaatccgagaaagtcattaaaatgatatgttgttgaagtgaaatatgcttatcaaaaataaaacttttagatttggaaatatgactatctaaaatagatggaggaagtaccatttaaaggaagattaattgggttcactcgttttcaaaggcctacatcaaactttacataaagtgagagaaatgccctatatctcagtaaccagaatcttccaagtgcaaaaccgaactagtacaaagaaaggaaaagaatttgcacaatttctggccaaacaatccagcacaggcgcgagtgactccgatccgcacgtgtactacttgctttgctgcttccaaatcttctacgactactaaacgtaccatgatagtacatccaaagcgatcgaaaccggaaacctcctctcacgagtcaaaaacaagttaacatcacgcttggaaaccgggcacccgagccatctagcagtacacaagtgtaccactcaagagtactaccgttccatgcatccatccggccaaaacgccaaagcgcgcagtagaaaaccagcagaaaaaaaaaatcctcgcgaaagttgccgtacgcacagggatgactgacacggccgctctccccgtcgttgccacctccatgtcccctacagactaaccggagatgcccccgccgatgtgaaaccgatcggcagcgtcccgtacgccgtagctttccgcgcgacggaggcctctacacgttcgccttcgcacgcgtgcgcgcggggccgtcgatggatggagcgagctaagaatcgaagaatcgatgacacgggcgccggtgtacgctccggccctccttcgatcggtttcttcctgccgaccttccacttccaaccaaggcgtcgccatcggcagtttgggtagatattgacgtgggattgtagtggtgcagtgcaaggggtgtcctttgctggcgttactgcgttttgctcgttcgagtgcgtacattctgatttctgcatcctctggctctgtcccgggatttggacgtacggcctacggcgcgtgtacgattggatggaccgggtgacggggtgagtgaggcagcttaaccaaatcgaactccacaagtcactgatgaataatgctgaggagctgcacggtcgtgggaaagtcttccagcgaattaaggacgtcttggttgagaggcggtatccaaatcaaccactacactaataactagctgccttcgtttgcattttgcacgagtttgagagagagcagcggggccagatccgcatctcgcgctttattcgtttctatttgaccggcgaaatgttactttggacttgtggaggattaatatatagaggtgttacctaaaagtttcagtttgcaatttgccagtagtgtgcatgtttaagaaaattatctacgggggagctttccaaattttatctcagggttgcatggtaaaaaaggttatccatgggggaactttcatactgtttgctcccaaatgctttgatgacatggatccatcagtacttttacggttactagtagtacatttctttaaggaaagattatcgcctctttcccccttgctcgctttgtcgacgcacttgcctacatcaacagcaccgctttttgacagatatgactgcgaaatatgatcttctaccgatttgctagtaatgtactcctacgtagtacgtaacattggatgcaaaaccattggtacaagattatcaaacggagggaattaaacggacgaactgtgtgtatcacatggaagagctcgtgaacagaacacgttgtagcactgtacggtacccgtcagagaaaccgtaaccgagtaaccgaccacgctcgggaggtcgccagtggccacatgaccgcaggtccgcagccgtcacacgaaccaatcatgcatagatagaaggccaaatggacaagcagacaccaaaaccaggctagaaacgagagcgagcctcgcgcacatgaaacccctccgttttctcggcctcgcacggggaaacgacccgtacgcgcgccacgccgtgtctgctgctcgtctcctataaaacaacccgttgtcacgctcgccttgccattacaacgtcgctagcttcttccgctcgtttagaaaacgccaccaccaccaaagtcaggcacccccgccgagagagttagctagctgcgcgcatgcaggcgaggcggcacagaggattccggctaggccggaagctgctcgggctctggcgatgggcgctctgccaccggcggcggcggcgcggccgcggctacctccgcctgcagccgtgcccgggagctgcaggcggccgctcccctctgctggccgccgggagcgtcaagaagcagccgccgccgccgcagcagcagatcgtcgtgcatcagcgtggtggggagaaggcggtgctcaagtgggggcggtcgctggcgcggcggatgaggctcctgcggcggcggggatccgagcggctcctggaggaatcccccggggaggcgacgacgcccaaggggcaggtggcggtgtacgtgggcggcggcgagcccggggagtcgatgaggtacgtggtgccggtggtctacttcaaccacccgctgttcggcgagctgctccgcgaggccgaggaggagttcgggttcgcgcacccgggcggcatcaccatcccctgcgccgccgcgcggttcgagcgcgcggccgccgtggccgccgcgggcggcggcgggaggaaggtgcccacctggtggtagcacgtggccaggccgcggccggtgtacatacatacacacgtgtcatgtgtgctcgatcgagtaggactcaaacgtgtacgtgtattctttttttttttggttttgttttttacttcttattgttcctcccctttctgtgtggatgcgcatccatctctgcatgcgatgtgaggaggcctagttagatttacagacggaggatgctactaaagtaatactataattctttttgactcgatcaacgtgttcgcatctttgcaattaggactgtgtttaattccacgttaaagttgaaagtttgaagaaattaaaacgatgtgacggaaaagttgagtttgcgtggataggaaaatttgatgtgacgaaaaagttggaagtttgaagaaaaaagttaaaatctaaacagggtctagacgaccatgttggagaatgaatgataaaacgtgaacgtccagtgagatcgatcctgttcatgatcttctttaatttgctcctccgcacgagcgacgaattatattgtttttttttgagaggacaaattatatgttcttgtactccataggagtagtgttgctccagttcgtgcaggaattgattaagctgtggagttctaacgatctgctacttcctgccggcttcctgacctccagtatcgctgaagcgtgtgcagtggtgaagtacttgcgtagtccgtacaaactggtcagtttggcgatgcagcaagcaacttccacgcaagtggcccgtgctgtactgttaagccttccgaagagatgcttgcataggccctgtttgaaacaaagaatggacaacacaggaacatgaaaatatacaggaataaaatataaggctcttttgaaacaaatgattttagaggaatttaatcctacgaaaaaatttcctatgtgatcatttgggtcaaagaaatagctatccaaaaattctgtgaaattgctttggattggctcaaaacatataaatttggaagaattctaacatgagcttcaacctctggggaaaaaaatccattgtgtcagtctctcttttcaattttttatgtttttaccgcgctccatcgtaatttctataggtttcccacatttttttcaatctataggatttgaggtgctatgacactgcaatcctgtatttttcatgcaattgtgttttgagaatattgtgtttccgaaggagcccttaatttgtgtaaggtaaaaaacttaggaattcaagtacatgaatagtgaaaattttgtgttgtttggatcacatggaaaaaaatatacgagagagacatacaaagccatgaatggaaaaaaaaactgagaggaggaggagaatttcctttggctcacacagtcacactgaatgcttttctttcctatggaagtggaggatttgctacctttatatacaaaggaattcaacaacatatttcctttgtcccaaacaggtctatagggaaaaattccaaagcaatgcaagcctctaaacttccttcaaaaatacattgtcccaagcaggtactgtagctgaagccggaaacagagtgcagcttgtctgccgttgcagcggctccggggtcgtggtcactgcacctgcacctgcaccccaatttgagcacatcgcgtagagtaaaattcgtttattcgcttgagacatgagaaggtgtttggtatctgtacttctccatggcacctatcatcaagtgagagttcagaaagattttagtgctaatttgtaatttgagattaattggccatctaatcatcatctgctgaagttgttcgggattttggacatgatgagccatcctataacatcagggctcatcttctcattgagcttggaacttgatttttagagaaaagttcagaaacccggcttttaattgaaagccgcatagcttggaacttaataccatgaacgtaagaagtttctcgtctacttgtgttgagctagacgcccatggctcgtacaatgatacaaatgatggagatgtaatggactatgagggacaatcatgcacgatatacagtatgttgatgtccattctgaatcccagccccaatctgacttcctgtgctcgcgctatttttgcacgacggcgttacgctatcgagacgggcccggggacgtgtgggcacccggcacacaaaaagatcttactgatgaacatctgaatgattggcctctccgaattaattgctgaaactatggtgaaagttacaacaaaagaatgaacgcgattgacctagtaaaactgatcagaaaactggcgcaaaaacagagtagaggagcttctggccaattgaagacgacgactagtgggatactgcgttaattataactagcatggtggcccgcgcagattacacggctagtatcattatattttatctcatataatagcatatatgttttttaattatattattcaaatatattaaaatgacaacataattttatattttgcaataactttacaaaactactaatgtgtaatattcatattgtattttttatatgtgttagttattaattatttttaatatcaaattttagttatttgtaaattatatatattcctaaatggactctagactcgtcttttaatatttcttttttttatttcgaattttctgtaaattgtatttctatatggactctacgctcttcttccaatattatttatttttatttctgaatttttattatttctaattgtatttctatgtgggctctaaactcatctttcaatattctttaatttttaatttcgaatttcagttacttctgaattgtattcctatattgactttaaactcttcttcccatgtttttcttaatttcaaattttagttatttgtaaattattttttatacggactctaaactctacttttaattttattatatttattttaaattttagttagttttaaattcctatatggactctatattctacttctaatattccttattttttaattttgaatttctattattttcttaattgtatttctatatggactctatactctacttctaatattccttatttttaattccgaatttctattatttcctaattgtatttctatatggactctatactctatttctaatattccttatttttaattccgaatttctattatttcctaattgtatttttatatggactctatactttacttctaatattccttatttttaattccgaatttctattatttcctaattgtatttctatgtggactctatactccacttctaatattccttatttttaattccgaatttcagttatttcataattatatttctatatggactctagtttcctcttctaatattccttattttttaattctgaattttagctatttctaaattgtatttctatatggactctgttttttctttttctccgattaatgtgagaatttctaggccatgagagcgaacgtggaggctcctttttctattcctttaataatataatagatagattgttatggcgatgataaccccatccactggataaacttgtaagctactccctccatctcaaaatatttaacgccgttgatttttttaaatgtttgaccattcgtcttatttaaaaaaattaagtaattattaattcttttcctatcttttgatttattgttaaatataattttatatatacatatagttttacacattttacaaaagattttgaataaaacaaacggtcaaatatgtttaaaaaagtcaacggcgtcaaacatttagagaaggagggagtacttcctctgttttataatgtaagactttctagcattgttcacattcatatatttcccccgtttcataatataagtcattctagcattgtctatagatgttaataaatcagtatgacttatattataaaatagagggagtacaatatacctgttatggtgaggcacagaggaagttccttgaagaatctgagtacagtcaggacctatcatagtatcttgtaccactatcggaaaatttgggaggtagtacggagtagtatactaggactatgtcatttttgtttcctttccagaagaaattagttaagtttcttttttttttgaagggaagttaagtttcacaccagtgagcagctaacacactaatgaaatgggagaattatatagtatttatatactcaacggatacatcaagttggcccatcaagcagacttaacaacgggagtacattatgttatctatcaaccgggtctgtatttctttcttctttttttttaaagaagcctgtatttcttttttttttctttgcctgatgaataagaatcaacaagaaaaacaagcaccatggcccatgggatatcacctctaccttttctactctttaattgcaacaacgataggggaagacaaataataaccatgtgacgttaattttttcttcacgaacatacaaaaaggattacacgtagttctataagaataaagtagtaacatgttacacagcgtgacagtaagaagccatcgcagcgaggatgtcaaactaatatatatattcaatgaacttttgtgagagttccaatcccaatcctgcgtatctagacatcgactagtttagtacatggaacaaacagaacttctgttcaatctatatagtatagaaatcgatttgtgggacccactagaacccacacgtaaagaaaatctcagcctctcccgcgtcttcctctctcacgctcacccctaacgtttctttattcggttgtatgcgactcctatctggaactcgattttttcactgacacacatgattcgactcccacagtgtatttggtttggccttttcatgctaggttagatataatcctcacgttggatgtgctcttagacgcatctggctaggaggttcccctgaaaacatcaaacaggaaaaactatggaagcaggggaattctgagagagaaaacgacagacaactgctcttgtgcagtactcccttctgctattgcgagctgaagaatcccgtagttctctcttcttgtaagggtacatcatgacagaagagaatggtgcatagttgcttgaaggggacagggtcattgtccaatgtccacaccaggattgttcagattctgcgaacaaaggtcacacgtaatcccaatcccgtcttgggccagcatacataggcctcacggagcccgcattaccgttccggcccaacacgtataggccgcacggaggtcgagctcccgttccggcccagtacgtacggtggcgcgtggcttttggtcgccacggtgtacaggaatctctggtgcgagcaacgccgcaccaaccgtccgcgtcgtccgagataagtagcttctagacacgagagggcgcgatcaaaccaagccaaactaattctcgtatctgcatgagctacactggtcagtggtcgctgcacgctccctgatcagctacgcccatgcatctactcagcggctgcgtcgtcgccacggccgtcgtgctcgtcctcatcagcctcggcgccgcgccaccggctgccgtcgacgcggcgacggccacgttcatctacgcgggctgctcgccgtccaagtacgagcccaacaccgcattccagagcaacctcaactcgctcctctcctccatcgcctccaccgcgtcctcgggcgccgcctacaacagcttcaccgccggcggtggcgccgggccggacccggcggccggcacggccgcgtacgggctgtaccagtgccgcggcgacctgagccccggcgactgcgtggcgtgcgtgcggcagacggtggcgcggctgggcgccgtgtgcgccaacgcgtacgccgcgtcgctgcaggtggacggctgctacgtgcggtacgacgccgcggacttcatcggccgcgccgacaccaccacggcgtaccgcaagtgcagctccagcacgagccgcgacggcgcgttcctgagcagccgcgacggcgtcctcggggagctgcaggcggcggccgggtacaagctgagcacctccggcacggtgcagggggtggcgcagtgcctcggcgacgtcccggcgaacgactgcaccgcctgcctggccgaggcagtggggcagctcaagggcgcgtgcggcacggcgctcgccgccgacgtctacctggcgcagtgctacgtcagatactgggcaaatggttactacttccgccctaattcaggtatgcgacattgtaattaaccaaccaagcatgtcacgtactactaatcgcgtgcacgttctaactattcatttcttcctataagttggaataatagttaacctttcttattataatttatatcgaacattttttttagtatttggagaagtttgaagtgcacgaataattcgaatatttagtatttcaaaaagcaggggcgatccaaatcttaaaagagaacctgtgtgtaagggccctacctaatgggcaaaatggtagtagttggctagatagtgatcactagtgagtgaggtgaggtctctatggaagtgagaataagattccaaactggtaaacttccaaagctgataaagaggacacgaagaatatattcaccggcataaacttttcgacccttttggatcgatgttaattaagtatttaacactcaagacttgatgaggcgttctagctcatttagtcgtctagcttagcgctttttagccgctatggagaaaagctagcgcgcgtttgctccccgtgcgtgcgtgcggatcgctttgcatatatatggttgttaattagtcatcatctccctttggcttggtgacagataactctggagacgatgttgggaggactgtggcgataataatcggtatcttggctggactggcactcctcgtggtgtttatttctttcctcaggaaagcatgtaagttctctgaattatgtccacagagagatacactttaatatagccaagtagctaaccaattttccaatgcactatacgcaggttagcagctgtcggcgtagccagcttgggttgaggacgtgaacaacaggcgatcgaactccattcacggcatcgcattcattttgttagttatagcagagattcactgatgctctacttgcctgagatgcactgtcttgtttcagtcggtctgcagtctgcaaagaaaaagaggttgatctgcgtgtaacgtaccatttgtttgggttgcactgaagattggagtattgaactgcaacggcagttctctcctcactgccgagttcagctacaacttactccatccgtcccaaaataagtgcagttttagcactgttcatgtccaacgtttgaccgttcgtcttatttgaaaaaagattataattagtatttttattgttattagatgataaaacatgaatagtactttatgtgtgactaatttttttaatattttttataaattttttaaataagactgatggtcaaaacgctgagcacacatatctgactgcatttattttgggacagggtagcactttcgtacctacacaattcacatcttgcttgctgcgctggagattgaaacaatacacgtaacgtacggccgcgttgccagcccactacaaatcaccatggccccgtgccctggcccacataaatcctgttctcgaccaactagaatgggcctcaggtaagtcgcaattcgttcccagcccactacaaatggcccaacgcaatcctaaccatgcagggaataagtccactttaactcccttaacagtgacccgaatttaatccatgactctcaaccgtaaaaccagataggaagtctatccggttaaagtgcactttctatctagttttacagttgagagtcatgtattagatttaggtcatttttaagggagtcaaagtagacttgttccaaccatgcagtcccccgagacgggagaaaggagcagccggactcggtccactaaaagaagggttaactggatcgagcgcatctcaagcaagcagagcgcctcctcttgccgtccttcgtccaggaggacttcagctgccgcagcagcagtggcgcaggtagggaggtgccaaagggtgccaacaccctcctatctaaacactatcaccattacacccctatgtttttactctatattaagttagctaagataagtatttatctagtttattttgtatagtttgaaagtattatcagtttagttagttagcaagtctaaaaatattagcaaaaaacatgatatacaaaattagtttgtgatttatcatctttttcaaagtaaaataaatgatacttatttgtaagattatttaatagtttacattaaaagaatttagcaaaaaagactagtttcaaactttcaatgatattattaaagagctaaaattcaagtttttcttaaagagctacgtattgcttattattgacggtgactatttaacctactttactatgtaaaaactctctttatataaaagct

SEQ ID NO: 68840 - DNA, 1807 bp, Oryza sativa
aactccagtacgatgaatgcattaaggactgtgataaggctgtggagaggggaagggaacttcgtgctgatttcaagatgatctcaagggcactgacaagaaaaggaacagccctagccaaacttgctaagacctctaaggactatgacattgccattgagactttccagaaggctctaactgagcatcggaatccagacactctaaaaaagctaaatgaggctgagagggcaaagaaagagttggagcaacaagagtactatgatccaaagttagcagatgaagagagagagaaaggtatgggatccagtagggtatcatgctgtcatctctagttctcccccctgctttatttatgtcctcacctgtcccttgcagagatttcccttgctgccatattttttagagttgcaatgtgccatttgtaggttgactggctagctaatccttatggtttgtaggtaatcagcttttcaaggagcaaaaatatccagacgcggtaaagcattacactgaggctatcaggagaaatcctaaggacccgaaggtaatttcttttggccctattgcttgaacttgcttgttcgaactttggaaatataaataatgtactcggtttcttcattttcttgtgttttgaagtttgacttggatcattgtttgtcatgtgtgtatgtgtgagtttcaactatatattacgcaccatctaatctatctgtatgtatgcataacaaaaacgtcttttgtgtattactgttttggattgctctatatcatcattatcctaaattactgtcatttttatttatcacctgtttgcatgcatcccttaacataactgcttggggtttcaattatctacaggtgtacagcaatagggctgcatgctacaccaagttgggagccatgcctgaaggtcttaaagatgcagagaagtgcattgaactagatcccaccttctccaaagggtatacaaggaaaggtgcaattcagtttttcatgaaagaatatgacaaggcaatggaaacttaccaggccggtttgaagcatgatccgaataacccggaactgctggacggtgtgaaaaggtacagaagcgtcatagcacaaatcactagtgatagttattcttatgattgtatctctctttgctcctaatgagttagggcatcgcatgaatccgtctcacctccttgtttccccaatagaatccaagctcactcacctttttgtttgcataaaccaactctgaactattgcacatgtttgcaggtgtatcgaacagatcaacagggccaacaggggtgatttgactcaggaagagattcaggaacgacaggtaagcctgttgcacttttcatgccccttgttgctttaaaagttaaatactgtacaactgtattaactggtccttttttttttgtgtagaacaaggctatgcaggatccagagatccagaatattcttacagatcccatcatgcgacaggtaacacagaatatttgttcttagctgaaatttagatgtcagttcataaagtatcacaaatacctgtctgtccataatcttaatgatatcgaaaatgttttgcaggtactggtcgatttgcaggagaaccctagggcttctcaggagcatcttaagaaccctggagtgatgcagaagattcagaagcttgtaagcgctggaatagttcaaatgagatagtcgaccaaagcaagaagcgctgttcgtgtctatgttcattgctccttactttttttccatgctcagtctttgtggacttaagatttacacagtttggggc

SEQ ID NO: 68841 - DNA, 6572 bp, Oryza sativa
accagtactgccaaaacaatatttttacagagcagtttaaagagggttttgcactgggaaaattggaaaccaaatataagaaaagagttcaaatataatagctttatttctgaacacacttgagttggccaaaagcaacagaatgacaacacatataggcttggagatcaaagttgcatcttaaagatcgtgtcaatatccaaaacgacgtgttttttaacttgagtgagtggattgccaatattgacagttgacagatgcctaatccaaattcctttgctagggatagcagtagtggtagtagtacacgactacacgggtgtagagttggacggcggtgtgacaaacgtttcaggctcttaagccccttcctcatcctctgacgacgtgttgaatcgtttatttagttgcgtgaccatcgcaacacgcagagcacggctgaaactttgtgctgaggctctcgagtttctcaggaaagcaaagaatgagtaatattgtaatgaaagaacatcttcagtcttttgttttttttttctcagcaagcttttccactgctgcgcttatgttccacgttggtcgtgtttttttctttttattcaccgaattaatcaaactgattatgtgctccatacttaacaaattacgctttcttttaaagaaaaatttcttctaccgcattaaccacttgttttaagttatttattaaatattcaatttatctcttaatcagatagataattcgcgatcaacaataatctaaatcaaacatgaccaaacatagttacatgttttaccggttcaacaagacaacaactcaaaacaaagggtgtggtctccctttttttataggcccacactccttccaacctgcactggcttatgagtccaccatgggtcacacaacaagtcacaactcacacggctcagtcgagaggaggaattagctttaagctggtccatgggcccaattgggcctgaagcacacttggcattaaacacgatagtcatatagggaataaattcactttatatccctcaatttgtcgccgagtcttaagttcatccctaaaccgaaataccagatataacatgtcctttaactccttaaaacagtgcaaacttgaccccaagatggtttggatgacgtgacgtttatatggttgatttgactgggtcctcatcccacgtggtgaggcacttgcaatcataaaaaatgggtgggacccacatgatagtgttagattaaaaataaagaattattgtgagaccaacttcatcaccccttcctctacgctctctctctccctcccctttgctctccctttcctcattgtccccgacaccagcgcacgttgcagctgttgccgaccctgccgacgggtgtgggatgctcgctccccaccattggttgcctcatcctctcctacgcactgatgagggaagaaggctggaatccattgggcaatgttgaactcgagcttctcccacggctaggagtgaacctcgtcgatagtgtgggcccagatgccaagacgggcgacgctcggctgccgcccttctccacacctcccgccgtgcctttccacgccgcccgctgcgtgccgccctaatggagatgggaagggagaggaagatagagggagaggaaaggaagtaatcgaacaacacaggcggagaatgaactcctacacaatggtgcgaaagttggaggtgttgatgatgagcacggtgttgggcggctggtaggatgctctcagacgcttcttcggcagctttgacgacgtcggagagggagggtgcggctgcggcgcttgcaaagagggcacccgcgtaggcaagagccacgcgatcgaccacgacaggagaaggcgagacgggagatggaggaggagagtcctaggagcacggtggccggtcggtccggccccaacatcgaggaaggagtggagggcgttggccgcgggcgacggggagatggtcgtggtggaggcgaagaggctgcgcagttggttctcgcgaaggcgtgggcacatagatggatggacatgacgatggtggtggcggcgttgttggcttgtggtttctcgacacgattatgcgtgcgccgataatgagtcgacaatataagggaaaaaaaagaggaggaagggagagataaagagggttgatgatgtaggtcccactgcaacttttttttaaccaaacactgacatgtgggtcttacagtttttttaaaaaactttaagtgccacattaacgccacgtaggcaccacgtcagacgaaaccgtcatccaaacaaccttaggatcttatttacgctagttttgggagttgatgaacacatcatatctagtattacggcaacaaattaagagacctaaggcgagtttagttccaaacttttttttcaaacttcgaacttttccatcacatcaaaacttttctacacacataaacttataacttttccatcacatcgttccaatttcaacgaaacttccaattttggcgtgaactaaacacaccctaaaatgaacttattcttagtcatagatagggttcactaaaccgttttgggtggggttactaccatctcacggtaaggtggttatcgcaataactatgtggttatcgtaaagatgcattcgattatcatgagatttaccatgattttaaaaactgacaaatggtgtgttcgcaagtgcaggatggaaaaccatccctcctgcacgtaaaacggagcggcctttgaacacataattaattaagtattaactattttttataaaatggattaatttgattttttaagtaactttcgtatagaatttttttgcaaaaaaacacaccatttagtaatttgaaaagcgcgcgtgcggaaaacaattaagaggggctaggaacatggggggaacatggggttgcaaacacagctagacccttgcgttcccgattgagcaatcgaagtaaaaatcgctgccctcagagacaatagcttttggacgtgaaagtacagagggagcacgcagagaacgaagaaaagagaagcaacaaaaggcagtactcctacagtgggggtgtgggacaccatagccttttcaggcttcgcagctcctaggacaccggcaacaatggagcagtcagccagtcagcagtgtgtcctcccctgtcctgtcctgtccgctcgttcggtgaggagatcgtcacgccttgctgttgctggccctcgggcggtcgggcactcgggcctcgccgcctcggcgacttgggctaccggacacaacggcgcggctcccgagccgagaccgtaccccacgccacgtcgcaggccgcgacgatgaccgatgcttcctgccgcggcagagcccaaccacacacacactgcccccacttagagcaagttcaatagtatagccaactaccggctccaattcatttatagccaatctaatagctcattcatacaatagttacatactgcactattaatacctagtcccacatgttatagacacactgcgtcttggagtctgtgctacagctggctataaatctgtagcccgctgcttttatctctcctgatttatctttttaaaataatttatctttttaaaatatgtttgtaggtgacttatagcctgctattgtacctcctcttaatattcccgcgtcaccagcctacggcgcctatacaacgccctacgcttgtcgtctccagcgacctgattccaattccatgcgtgcttgcaattgcagcccgcaggcgtttcgtcagtttgtcactggcgccggcgtaatcaccggcttttgcacgcccccccccccccagcgggttgttgcagcggcgcatgcatgaccaagattgcgagaatgcaacatcgagcttgggaattgggatgaaaaccaacaaaaaccatgcgaatggaagagcattatgccttcattaatccatatggacgacgcgacgagcagcattgtcacgaaccatggaagaacaggtactagtagtactaggtggtactctgtaatctgtactcgatgaacatcacagagctagctgaacaagctccagcgtaatgtactttgttgtcacttcgtgtctgcgtcaccggcagatcggccggaggcggcggcggcaaagctagaagccggaaggcatgcagggaagactgaagagggagcagcggccacctggtcggttgtctggctagggctcgccggcgcgcgacggcgcgcggcaggtggggcaggaagcgcgcgccgcgagccacccgtccacgcaggcgccgtggaagccgtgcccgcacgccgggagcacgcggacgcgctcgccgccgccgtccgccagctccgacaggcagatggcgcactccgcctcggcccacccgccgaccatcgcgacccccgacgccgcgctggccgcccccgagctacccgtgttggcgccgtcgtcggaagacggcttgggcggctgcgcctgcgccagcgccggcgccagcgccggcgccccggagtcgcggcggcgggcgaggcagcggatgaggcaccgcgcggcggcgtggaggcagaaggcgaggagggagacgcaggcgaggatgatgaggatggtggccacgttggagaagaacgcgcgcgagctggcgtaggggccccacgccccggcgccggcgtcggcattgccggggttgggaagcggcagcctcggcggcggggacggggtggcggtgatcatggccgccgccgccgccgccgtcgtggcgttcacggagggcgaggcggtgtggttggcccggcgcgtcatggctttctcggggagtggcgtgtgtcgcggcgtgggagtgggacggtaggaggtggtgtccttgtccgcgcttcggaatggtcgtcgtcgtcgtcgctatgcgtggccttttgtacgcttcttttctttcctccagaactggtaactcgacccagaccccacgcttcgctttggcaggcacgaattttacagctttttcttttttgaaattcaacatctactactcctaaattttgccgccattttaaggtcgccggagggcatgaatgaaatcctgaagtttttatggcaatcagttcgtttaataggaatcagaattttttttgttcattttgtaagaggcctactccctctgtcccaaaaaaaagacaatctctggtttccgtgttcaatgtttgaccgtccgtcttatttgaaaaaattatgaaaaaaaataaaaggataagtcacgcataaagtattcatcatgttttatcatctaacaacaatgaaaatactaattatagaaaagtttcatatataagacggacagtcaaacgttggcacgcaatccgcggtttgccttttttttttttttggacggagggagtagatgggtctaacattacatttttctactcctacatgctcaagcatgagtatacattttatactctaccgcggtagtacagccaaagcatgattgtcccggtgcatgatgctagaaagtagaaaaaacgaaaccgtaggtatagcataatggcactagtgatcaatcaagatgcaaaatcctaggaaataggaataccactttcctaaaccaacaaacggcaatagttaactctggtcaatgccattcgtcccgtaccaagaacaagaaggtcctacgggaccatccactgcgtccatagggccatgttgtagtagtcctccaacttttaggtccctcgtcgtcttcgcctcatcgaacccatcaaaaggagacggccaggcccattgcgcccccccccccccccccaccccactggcccaatcccccagaccttgaagttgaaggagggttggatatcgtccagcggcagcgctcgtgactcgtgtgagttcgtgagcaggggagtctctccgcgccgtgtttgctgtgtgcatggcacggcaggcacgcagctttatttatctttgggcgtcgcaaaggcatgaaccagtatcatgactcccaggcgcggggcccaatgacccaacttggcagcgttgccagcgttcttcataaaacaaagcgatcaagccaggaaaaattggtaatttggtatagacagactccagtttgatcagattggaccatggttttcccagccgaccggttaccgtgaggtaaccgtgcgttccgtaaagttaaggtaggggtaatcggctatagggtttgataaattttatctaaatttaaattttcaaaaaagaaattggaaaaattcttgtaagtactacttatacaaattttgtgataaaaaagagagaaggttaacataatagactcttatcgtttatgctagttgcattaacacagccgtaacagttatacctgcacagttgtagttctttttttttcattgtggatgttgttcctgtaactgttactaggggtggcaatttttccgttagagccagggccgggggagaattttcacctgcgggtgagcgagggtggggatcggaattaacccacgggtaacccgaaggggcaccggatgtgagttacttcctccgtttcataatgtaagtcattctagtattttt

SEQ ID NO: 68842 - DNA, 1658 bp, Oryza sativa
cggctcaggctctggctccacctccctcgccttcgcctcgggctgctcctgcggctgcgacggcggcgacgagctgggctgcgacgattcagaggcctctggtctctggatcttgatgttaagcatgaggccgagcacctgcatcatccggggatcggagaggtacatgttgaggctgctggggttcctctgcacatcccgcagcatctgcatgaagtcgggctgctcgaggtatgcgcgcgtggtcgggtcggaggcgatcttggtccagagctcgggcccctggaacatctggcctatgccgtcaacgccgctgggcggcgggcggcgcggcggggcggcggccgccttcttggcatcggcgaggccggccttaaggccctcgttggtggggtcgagggcgaggcccttctcgtaggcggcgacggcgctcgcggcgtcgccgaggccgaggtgggcggctccgaggcgggagtaccccttagcccagtcgggcttcagctcgacggtcttctcggcgtcggcgagcgcctcggagtagcggtggaccgaggcgagcgcggcggagcggttggagtagaggacgtggttccccggggcgagcgcgatggcgtcagtgaagtgccgcgccgcctcctcgtagcggccggccgagaaggccgcattacccttcgccttcgcctcgtcggccatggcacgcggcggcgatcagatcggcggcgcgggctccggaagcttctggaagggctctggcggcggggccggaggagagggaggaggggaggaaaagtctggggttagatgggggattaaggtctcggagaagatgaagttttataaaatcggcgaccactatgattgttgcggcgtggcgtgggccgtcggatctctctcaagggttctcgaagcttccgcttagtactattaacgcttattacgctttctcctcatggaagcgaactctttagcgtgatgtaactctccgctttgtccgccgtacagtctccaatgtgggctgggctggtttctcatcagttggtccggcccgtgttaacttcgcggcttgacttgttttagttgggctgggccacgcacgccgaggcggcgggcggcggttgccgtggctgcagaagacgacgaagcggcggcggcgccacctgtccacctcacgccccacgcgtccgcgccgcaggctaccctccttgcatggcggcatggcgcggcgcctacttcggtgcttcccttcaaccacctcggtgtcccgtagagtcgtaggcgtggtattgtcgcgcgcggagaagaggggagggatatggcggcgcggtggtgcttcgcgttgctcttggcgctgtcggcggccgcggcgggggccggagccaagcggacgtgggagccggtgattcggatgccgggggaggtggtggaggaggaggtggccaccgtgccgcgcggcagcgagggcaccgaggaggaggagaaggacggcgtcgggacgaggtgggcggtgctcgtcgcgggctcctccggctacggtaactacaggcaccaggtaagcgcacgggtccagtactccagtgtcgtcggcttcgccgtcgcttagttcgtgcgcgtctggagctcgatttggggggcttggatgatgatgcagcgtggaactg

SEQ ID NO: 68843 - DNA, 993 bp, Oryza sativa
ctttcgaggtacttagagacagtgtcatactctgggattgagcccaatatggttggctcaatcgtgttctttaccgcagccaaacaattcttgttggctgaagaccatttcgcatgttcaatgtcatacgacatgatgagggaagcattgtccctctctctcttttgccattcagcatctgactctttttcacctctgaaaatttcagcaggttctataggacatggggtagtcaacacccagtccacctctcccaagataaaagcaaggtcgagttctcttttccattcttcgtagttatctcctttcagggtcggaatatctttaatgtaacccatcaaggagtagccacctaagataatcatgtattgtgagaacaaaattaacattaaaattattatgtattaagtctacatcaccgttgggcagaaaatagacataacacataaagccataactataacattgcaattatcaacgttggtcagaaaaattacaacatcatagcacataattaatgttcctaaaattaaaatctcccgttggttcgaaatttaattttagaaacactaattttcattaatttcatctatttgcagcggaagatctatatacaattcatataaattgtaacaaaactctgttgtttacgctctgtaaaattctcccgttggttcaaatttaaacagagataaaacatgtaaaacaattcaaaattctattgtaatttgcatgaaaaatacaaaatacatgttcagaagcatttctcacatttatctattctctaaacaattttcacgttggttcaaattgcttagaaataaacacaatcattgaacatattgaaaatgcttccttcggccgagggacttttattaaacttcctttcttttgattcggccccgagggacctaaaatgaactttttcggcctttgccagtcggcccacggccgccttgcgcgcgggcgggcgccccctcccctttccccagg

SEQ ID NO: 68844 - DNA, 4112 bp, Oryza sativa
tataccagcttccactgttttgcacatcccaatccaatttcccgacctctgtatccaattccaatatgtagttaagcattgtttactatcctgcatatgtcatatacaatgtttttgatcagtaacctttttcactttattaattagagatagtcaattagcaaaaagatatgtttatttcaaacttccactgtatttattttacaggagcagtggtggaaaggatgtgggggatcaagcgagctcatcatcccataaatcacaggatgctgctgtgggttatcttgtccacatgctgaagtctgcgcggccgctgcgagactctagcaattcacctcttacatcaagggttgaatctgttgaaggaggtaatgtcagttctttcatgtcccgtaggacatctgatgcgctcgaggagcttgaatcttttaaagaaataaaggagaacctgcttgcccgtagtagatcaaggatgcaagagtcattggataaatccttgcgccattcttaacatagctggtgaagtatcccaaccatttaaggaggttgtgtggtaagagatgttcttaccgcgggcatctccatgtgtataactgtcaaccggcgcttgttatgaaatgaggatatacaagtcgttcattcttaaactcaagcaggatcatgatccacctttgttcatagtgttttgtatgcaagcaaaaccaaccggatacatgcatcctgctggaagtatatgatgatcaccgtgtgcgtacgtgtgggattatgtaatcatactaaacctgtttatttattctattttagctcttaccttactgctcttaatataccaaactgtttgtttattgttacaaattttttaagtcttgagctcttttttttttctgcacttgtaaataccgtcctattttctttgttcttctgatgcgtgaagtgtgcttgaatggatatgtgacatgaactttctcgaatttttttgtaaggttgaattttctgctctcagcttgttctatgttcgtatcccgtgccatcctattgttctggaatttgtcatcccggcgagctttttagcacttcctacttgggcagtggatccgatttattcttcccgtttccctctcgtgacgccgacctttcttaagggagacgtctctgtgaacaaacagcatgcatctttgagtgagacacaactcgctccattctgctggatacgctacttgttgtatccaatcagttggtggttacggaaaagtaagatgttactcacaatatgtcgcatcagtttcagtttttgtaagaattattttgaacatgtaccattttccttcagctaaagcatcattcctgaaaagattgcgcgatgagaagcatctcacattttcactttcagtgagagcactgcactggagcacatctagggatgaaaacggtatgaaaatttcccgaccgtaccgataccgtttccgcaaaactaatataataataatatttttttaccgatgttaccgttttcaaaatttagtttttttaatttctgtcagcgtgacattgaagttggctctaaatagatgaatttgtaaatataaaaattttccgaccgtttccgtttgttttcgaagaaaataataaaataatataccgtttccgactatttccgaccgtttggcacatcccttgaatcagcgagtccaaatcactcaaaggggcaaactgcaacaactcccacggttagagttaataccgatacagacttgggacaaaacgccaacaagcaaatcggagcaccgaagtcattgatgcaagccacggatggcgcgcaacctgatggacgcactccagaacgagtcatttccttgtttatcagtcgattagcagtctaaatcgagggaacatcaggtgagacggtgcataagttggaaatgcgtgccagtattgtatacgccttcatttgcatggatcactaatgacatcgctccgggttggcctccaaagttggtagtacactagactttatactccatgcattagatggtgcagccgaaagccttaacgcacaaactgatgagaaaataatatttacggttaattattttttatgataaaatactgtaccataaacaacaagcggccgtactgagtttgtcaatatcaaaagatacatcaatctaattgatgcaagtgtgactgcgtgtatgcgagcacatttgtttataccgtacctctttaaaagtgagatatcagatacagtagtacaacgttttccttcgggccacacagacacgggagccaaatattgcagtattaatatctggaaagtcaccggccggaagaaagagctcggcacgtcgactgcaccggtgaaaaacacaggatcggtggccgcccactgcaccggcgagcgcaggacgatccaacacatgtgttcccgagcgaagccgtgctcggacaccggagtagctagctttattctcgccctcatggaaggcacaaagccacgccctcgcccacaactaaactaaaaaaaaaatgctcgcattacaaacgtcgcgccaatgcgccatgcctctggaccatgcaagacgtcgctgattggaatagaaactctctgtgcaaaatgtgcgcattcttaatcctcgcccgatcgatccaaggagtgtcgtttacaccacaaatctcgatcaacaccaaacgtttcaacgctcacgatcacatccatgtatacgttcatttactccgtattataggtacattttgttactgcgttctgaaatgtgccaactttttcccatggtacaacaaaaagatcgcgatttcgctataaatacctctccatgactccatgcaagctccaatattcccagttcaatctccatttgtaataagctagcttagctcagcttgtcgttgatcttgcactactctttgcaaccatggctatcgaccttggttgtcacgtcggctgtgcatcgccagagacgaaacaggaggagacggcggatcccacggcggcccccgtcgtcgtcgacgacgtcgaggcggcggctggtgggcgccggccgggcgacggcggcggcgtgaactacgtggcccgcgcccagtggctccgcgccgcggtgctcggcgccaacgacggcctcgtctccgtggcgtccctcatggtcggcgtcggcgccgccaacggcaccaggagggcgatgctcgtgtcgggcctcgccggcctcgtggccggcgcgtgcagcatggccatcggcgagttcgtgtccgtgtacgcgcagtgcgacatccaggcggcccagatcgagcgcgcgcgcggcggcaaggacgccgacggcggcgaggaggaggaggagctgccgagcccaacgatggcggcggtcgcctcggcgctgtcgttcgcggcgggcgccgcgctgccgctgctggccggcgggttcgttcggccgtgggcggccagggtcgcggccgtgtgcgcggcgagcagcctcggcctcgccggcttcggcgtggcgagcgcgtacctcggcggcgcgggcgtcgcgcgctccggcgtccggatgctcgtgggagggtggctcgccatggcggtcacgtacggggtgcttaagctgttcgggatgcatggtgtttaacgggcaagtctttatattttcaccacgtaaataattaaaccaaagggattattaccaagatactccctctgtattcaattacttgtcattggataatactctctctgttttttaatgacgtcggtttagttcaatgtatttaacgatggatgtagtattcattttcaaattgactcttattcgaagaaaatgtataaatacctaagagtatcctatatcgataaagtgttgcaccctaaatataattgtcaagctttcatacattatgatctgatcattcaaaatttttattgatggtcaagctaaaattacaataatagcagttatttgaaatcggatggagtaattgattaaacacatggtgttaactactctttagactttagggaggagtacgttgctaatctaggtgaggctgccggctgagccattctattttcgtttcaagataaataaatttaatatgggatacgatatatccta

SEQ ID NO: 68845 - DNA, 2721 bp, Oryza sativa
cagtgccagcagtacatagtgccaaatgatgtaggtttagtatttttgttcaacacaatttgtttcacatcagatcgaaatgagctgatatattgctgcccaaagtattccccgccctcctcccccccaacccaaaaaaaaatatttgactaaaggagtggaggatctgatcgtttggaaatggataactaatggaaaatatatagtgcaaagttcaccaattcaacggaatgaaatctcaccataaacaaaactgtcttgggaggcatggcccctagccaaatgcaagatcttcagtcggctcgcactacaaaatagggtatggacacccgtttgcaactcaaggggtggcataataactacttcagctaactatgcttccgaaaccttaaaaccattgaccacttactgttcgaatgctcagtatcagcgtaaattcggttcggtgggctcatgtggctactgcaagcacacatcatcttgaggtggaatacgagtaaagacttgttgattggtggatacaaagaacaaataacccagaaacaagaaaacacaaagctctcaaatcagttttcttgcttatcgcttgggaaatttggaaagaaataaatgcaaacattttcagagaacaacaagcaacagtccaccaaaatagttaactgcattcaggagctgggctgttggagtttgcccaccgcacaacatattgagttgttgccatgggaagcgaggaggattgacatgcaaggatgtttgcaatcaagcgagtacaattctttcttcttttctttaacttttggttatgtataaaccctcttctattaatatagggttaattggatccatgccaatgcaaatttcccatattagaaaaatatcgctactattcacgatattggttacgtgccacaggaatttagaaaaatcagacccatgccactgccgtcaagtttactgtcaacctccatcaactctctccctcaacttttcttcttttctcttctcttctcttctcttcggcaagtgattagtcgagcaaggatgagcggtgagcggcgggcgggagggctcgggagccaccaccgttgttgtaacgctccgcttctcgtgagacgttaaaaactaattcggcaaatcctaattgtgaaaaattttgtcctttgagtgcgagtctaagtcgtgccatggatctcggtttcaaatcccattgttccctctcatcgaaatcaaaatcctccgcctcaaatttcctcttccaattcaagtctccgaaatctaattccgaaagtcaatcccttcctttgaatcctcgccaaatacatttccgaatcccaaaatatccaaactcccgttttgtttccttccttgactccttgaacccttgtgtacaaagtatcaaatttagattcaaaacccaaactccaaatctctccaaatcaaaatctttcagcaaaagtctattttgcctcccttgtcgatgggctgattcctctatctcccggcccatcccctcctctcggcccagctctctcgcgtgtgcgtcgcacgtgttcgggagcgagagacagcgccgtctcctttctctctctctctctctcggcgtcgcttcccgccgacgccgccccaaaattccggccgcatcaccatttcccgcgcgctcgcgcatggccgaccagcaaggacgccgctaccaccgccttcgcccttcccgcgcgggttcgcgcgtggccaacgccccggtcgccgctgcgtcaaaccctggcgccgcctgcgtcgtgccctgccgcgctgccgctccgccgctccacgccgctagcttccaaggccgagagaggcagcccctgtctcactcccctctccctcctccttttcccgtttcggcaagggtcaagccctcatttccctcttcctttcccctttttcccgaccaccgccgatgtcatccatggtcccagcagctcgcggccaaagcgcggacgctggtcgtgcgactgcaccagctcaccgcagctcctcctccttgaccgccaatgtcggttcttcctccctaaaccgacattgccatctattaaaccgagccgccccatctccctctcgttcattccctcgccaccaccgtgcccttgccgctttgctaccgccgtcctcgcctccctcctccatcgcgcgtgctggtgaagccggcgtgcgcgcgaggagctgacgcgggactccaggcactgtctccttccccttccctggcccgaggccggagagctcgctcccgcgtcgtcggccgctcgacacagcgcccgtctcggctcggtagtgcatctcccgttctccctcctcgctccctctcctctccttagctctgggcagtagtgcgagtagccttccagtagcaagctggcgccgccccaaccgccgcagctgctcgccgtaggctcgccaccgtcgccgcccaaactcggtagtagctgctcgtcgccggccttcctcggtgtagctccacccaatccgactctagaaatgaactctggaggtctcgtagatgctcaagtccctaggaatcgagctctcgtcgcatcgtcgtcgtttccctctttagccgccgccggcaagcgccgccgcgattcgtcgtcgccggcctccttccggtgaatccgagccagtggatcaacccccttccttctgtatcgtcgtcccggtgtactccctccctctcgaatcgtcgggttg

SEQ ID NO: 68846 - DNA, 1766 bp, Oryza sativa
cggcccattggctcggccgcgccgtgcttatcccttggcccgtacccgagccgcccaaggaagtctaaatcccatccctccttccttttcttatccaaaggattaataaatccttttccctttttcataaatcaattccttattcccaaaattccataaatcatttcctttggtcccgcgcgtctgtgactgtcaataatattcttgagaatattatttctataaattccataaaccattcctcttattccagaaattccaaataaacttcaaattcatatctctcgatccgtaactccgattgactccgttacacttccagtaattctctaaaattgagatctatctaatggcactactaattagtctaaataggatctttcttttggtcttttgtttaggttttcgattgtttgcgtatagttgcggttatcagatttttgtcgatcgcgggttttctcgaagattcgtgaagctccgtgaagaccttgagcgaggcaagtcaccctttgaccaattgatcctataattggaaaatcattattattttgtttgcaacttgcattagtagaatcacacacttaacttgcttggcctcggtttgcgtgccaaaccgacggacctacccagtagtcgcactaattcctgtaggttgttctaccctgattccttgtcgttccacctttgtggtacttcggtatccatgttctctgagcgcgtatactaactattccacatacaccgttgtttgtcgataatttgggaaatgggtttgagaagtcttgaaaacccgacatgtggcgtcggtgtgtttgaaaacaaaatagattgtgaaaactcacgatgcgggggttgtgcctatgtggtactgtcctgtattcgcatataaggaccgattcctgtgggaaattcatccgagcatataataagtgcgaccacacgggtgcaatgggacgcccctggctgagtaattagctaatcgggggagccatgatgccaagagacttgtggattcaacggggtggtgtcggggagaaccctcgggcttcctggcacagtatggtctgggacctaatctggtgttggtctgggacccctctcgttggcatatggtgaacctgtgtcggctttcgaaatgccttgtcatgaaagccttaaggtctcccgacgtggctgatctcacgggctgggtgatccgggttagtaatgtcgtgtgggtaaagtgtaccccctctgcagaggttaactaactgttcgaacagccgtgcccgcggtcatgggcggatgtgaggtgtttcctgtagcgtagatttgtttgcctgtgttttgtgaaaagttgttgtggtgtgggaatcgttaccagaatcagcctatgtggtagatggatgacctgagtggtcaagaaacgaatctgtgtgattcgggatgtctaccggcatcatagactaggcttctcgagtagaagcggattgttgtgctactaggcagctggactctgggagtccgagaaaatgaaaaaggctctgggagccgattaatcaagtggaatggctctgggagccgagaagtaatgatctgacccgggaggtcggtacattactaaatgagctgttaaaaaacatctcttaaggtcgaaacgagacgcaagtctcttttcggcccaaacttagaaagaaataaatcacttagtgatttcaaaatgatttcaaaacaaaagatttgcaaaaataaccttgcctctcttccaagcttgcattaaacaccta

SEQ ID NO: 68847 - DNA, 891 bp, Oryza sativa
tttctgctacatatatttcagtaaaaattaatcactgaagtattaaccactaaatatttcagctgatatttctttcgtattaaattgatccctccattttaaactcatcatatgttgggccattttttttctcaatctggcttaaacatggatattactagaacttagaacccagaaaaaattgaaaacttcaaattcgtttgcttatccagaattatattgctgctcacgccattttcttccttgaaatgagtctaggcatcagtctgttgaacttcctgacaaaaagactaagtacaacttggatagcgatgtgtgcaaatcatgctgagattgaactactagcactctgcagtccgcacacactcacatgatcaaacgtacatagatcaaggcgcatcgtcaggggtttgacaccatcgcaaccttggtagcatggacaatttggaaggagagaaacaatagagttttcaatcaaaccagcagatcttgggtggacatcgctcgggccatgacaggcgaagctgatctttgaaggctggctagggcagccattcctagcgtagtaatccatgcggatagggaggggtcgccaaatgattttggagattaggctttagtactcttgatcctctcctgtatcccatccccatcttgttttgcttttgttcccgccttatacataaactttatttcttcttaatacaatgatgtgctccttgcgcattcccaaaaaaaagatcctggggctgctttcagtagttcacttctcatcaagcccaaatcgttaacttattgctcagttaatttctttttttttgacggaaaattgctcggttaatttcagtactgaaggcaaaccttttcgttttcaaaagctaaaaaccgaaa

SEQ ID NO: 68848 - DNA, 11704 bp, Oryza sativa
gagataaaagagacggggcgcgcgcgtgtcgagctagccagcttgccagctgctcttgcgcggagcagcggataaactcatcggaggctacctaattaaccaagcttgcttcctctctgcctacctttgcctacaagtaggtgatcatacgatcgagccgggatgcgtatgctggctggctcctctcttatccgtcttgtcgatcttttattcttttgtacttgtgcccggccggcggccggcggcgccgttgctgtatgtaaattctgccggtcgtctttggcacaggttgtgagcgtgaagggtggtggtggccgccatagctatagctcgtgggattaagggcagccgcgcacaatcgacctgcaaagtgttgccgggagaacagacgcaaagaagggagaagagggcgagcttgacaactgcagctgatagggttgttggttgatctcattgtgaatttgtgatcattggaacaaacaagatttggtgctcgggagtggtgtggattgcgcttcggttcttcctgcagagtaataatatcagtgatctccctccctagctctctcatcatgcataattttttttcctatacaaatttaaatatgttcttgatatagtctctagctactgaatgttttcaccaggaaaattttcctatatacacagaagacataacacatcgacaacttctttattaattgttttcggtctggtgttttttttttcacctaaaaaatctatggcagtttgtgtgggtgtttgtcatcataggggaggcatccagttacattatatcagggtccagtttggctgagatgatcatttcaaagctatatcatccaaacaagctgcacatgatttccatgatttttgtatagaacattgaatatatcaaaataaagagttataatttcagatacatgcatataaacttttccaaatatgaatttctctaagaaatgtcaatcaataataggtcagaggtaagccattactagtctatactttctgttgcttatgatcgtttgttttgtgaatattttaagaagtcatgatgattatttcatgtcataccctaattaattttaccaaaaaatatgttctaaccgtgcatggaggaaacaaggggaagtatgtcagaccttagggtgcatgccctctcagttcatttcatgaattcgatctagacagttatgattttttttttgaaataactgaataacacggattatagtgtcatatcttagggcacaaacagttaaggtctaagttatacttccatttccgaggaagctagggttatgacattaggatatgcttctcttttgtttttttagaaacatagtataaacgcagacgtttaaaacacgtgcacactcatctctttaatttgattgatgacaaataaaaatcttctaagtttacttttacttattttccacatcagttctctccctctcatgagatagaaaataaatgcattgttgtatttgaagttagacgtactatactccagagattctctacagtcaaatgcacagtgcctttgttactgacatgtgagcctagggatcatcggaaccacgtattagtaacaaattaagtcatatgacttcgactgtagaggatcctgatccatacactccctcttgtcgatagtatttaacgttgcgcaccggccggcagctaatacagatatagttgattttttgtcaaggctgtgtatttatcaaaagggatgtgtacatagatagcttctttgacacaaaaggaaacctaaaacattgaattaaccaggtaatcgtgtatatgatgaaagtatggcactttttatctagtgtcatgattgctagcttttcctgaaaatatcatcgatccaattcaaaatgaaacaaaagctaccgatccagttgtagaagaaatattacaaacgatcatgccatctaactaccagacttggttatgaagttagcaatgttacagcagacgaaaaggagataaaaggaatttttcgtgctgtttaattgcatatataatatgttttttttcttttgtgttttctcattggtttgatgatgcttatttttgtgtgatgtttttggatcattctttatgcatctagatgctttgttgtgtatttatatgttagtactattctttatcctgttgctaattactacacgtactggacttaattaatatgtcaacgccagcatttcaaaaacttatactaaaagttatgcatgtccttgcagtcttgctactagtccattagtgaataagatggacactttctcccatgtgccacctggtttccgctttcaccctactgacgaggagctcgtcgattactacctgaggaagaaggtggcatcgaagaaaatcgacctcgacgttataaaagacgtcgacctgtacaaaatcgagccctgggatctccaaggtaattagcatgcatgcaagttgatcgaagaatcaaaaaaatcaaagttaggtttgcgattgaattgagcatccaacatgtacaaatattgcagagaagtgcaagattggcatggaagaacagaatgactggtacttcttcagccacaaagacaaaaagtacccgacgggcacccgcaccaaccgggccacgggcgccggcttctggaaggcgacggggagggacaagcccatctacgcccgcagctgcctcgtcgggatgaggaagacactcgtcttctacaagggccgtgcccccaatggccagaagtcggactggatcatgcacgagtaccgcctcgagaccaacgaaaacggcaccacacctgtatgcatatatttgatgtttggaatttgctccggtccaataaaaaggtaccgtaccttatggtaccaaattgttttttatcatttgatctaacaatgcccaccctgctcagctagatcaaacgatcaaaaatgatttggtgtcatgaggtaacttgagatattttttattggatcggaataaatctcttgatgtttagaatgagattcggtcaaaatccgcctcatgcacctaagtctgactaagtggttgactgatcattggtgcgtgtaggaggaaggatgggtggtctgccgggtgttcaagaagcgggtggcgacggtgcggagaatggccgacggatcaccgtgctggttcgatgaccacggcgccgtcggtgcgttcatgccggacctcagctcgccgaggcagctactgccgcaccaccaccaccaccacccgggctcgtcggcggcgctgtaccacggccaccaccaccagcagctgcagcagatgtacggtcactgcaagccggagctggagtaccaccacctcctgccgcaggaggccttcctgcagcatcttcctcagctggagagccccaagccgccgccgccgcctcctgcggcggcggcctacattggcggccacctcggatcgtcgtcgtccaccgcccttactactcacgacgacgaagcctccggctccgccgcgcagcagcagccgccgtcgttggaggctgtttacatggccggcgccggcgtcggcatcggcgtcgacgcgtcggtgacggactggaggctactggacaagttcgtcgcgtctcagctgctcagcaaggagtccatgtccagctacggatcccatccggctcaggtgtttcaggctgcagacggtggcaagcatgaagaggctttggactacgcttcgacgtcggccggctccggcggcggcgaggctgatctgtggaaatagcttcactttccacataaatataaatccactggacaacatatatacacacacaatttataccatccaaatctgatctagccaagtgtacaaatatatatagctggctatatatatatatcaagagaaacgcacgcatacgtaaataataagtatgtaaccaaagtggttcatattgtttgacatcagatcgcgggatctggtgttaataagttagctgtaaggtgaagccaaggggcttcagtaactaacttgacacaatttgtaaaaaaaaacagtcgagctgtagatggacgtctatttgtgcagtccatcattcgatacggcagctatggtcgctgccgatgcgtcagaaatgtttgtgaacttaacagatgtatcccaattcattgaaaagaatgataagtttatttactgacagaagcactccattggttattagctagtgcaagcagtaaccagtagatatgcaaggaatgaattcggcaacactttgatatacatatatatacggcatcagtcgttcagtacacataacttgtctacagtcctagtttacctgatctctctgcaatgctacaacattcgcaaaacgagaacaatttctctgaatcctgaaccgatctgctttgtcttttgttcagtctccaatgtatatacagcattcagtgctcaatttctgcagtatgctggataattcttcttttattttgcgtcacacataccagttgcttcatcgcagaaaccatcacggtccagaagtttgggtggtggagcactcaaaagaggggaggaagggctcccatatgcatttcggcgactgttgccgcatccaaggcttttccgtgtgctgacccctgttaaagggtttgttccatttgcatatttgcacaaagcctacataccagtttgcctaatattagttatcaggattatcttttgttttctgtataaaagagaatcagagaactcatgcaaaacattgaagatagaccccaacatggcatcatatggtgattcttttatgtatcatccaaaattagttttgaccactgctgaaacagtatggcaccggttctcaacttcaaattcatatgtcacagatgcgggacattaggattatgcaatgtttgttcaagctaaagattgtgttgttagcagttgagcacatggaacttccttcccgaagacatgagacataacagccaggagataatagtcaagttcatgtcaagattctcttgtctgaatattcggttttctcttccatgacacttacttctgcatccatacacagttcgttggccagtgtttaaaaattagtaataccaaaatcagacagcaagcatccataataaaaggaacatttttagaatctgacatgctcaactgcttatcaaacacgtcaaagaagaaaaacccgtggaagaaaaataaaaggaacatttttagaatctgacatgctcaactgcttatcaaacagacccgtggaacatgcaaaaataaaccttagtttgataattactacacgtgatagtagtgtcattcaagtttcatgtacctgtttctgtgtcaggtcaataacagcatcactgaagtctgcaccttcaatgattgctccaccaagatcgctacgcgtaaggactgaccgtacaagcacagcatttgtaaggttagcttcattgagcacctgtcaataacatacaaactttcaatacatgcttaaaggttactttgccttgaaattattattcctgaagaactaaacgatgttgtaaattaagaacaggagactccagtagttgccttaaaaactggtacattgaacctggcttcatattgaaagtaacaatgcattcataagcatttagcaccaaaactaatatatgaatcatttactacactgatcaagaattctgatgcattatctcttttaacacactgatgtcaaattccgcatttgcacaactaagtgcatcacccatatgcccttgagcatcacaagtccataactatatacatgtatttgcagaagatactttgcacaagaaaaacatgacataaagaagttgtaggtttaccatgcgatccatcaaggtatcactcaaatctgcacctgcaaaagaccaaacaatagtacagtgaaattgtgtcataaataactgcatgggaaggttgaagtattctgtaaccattcagatgcagtcaaaagttacaaggattttgaaaaatcagatgcaggactctacttctgcaattgctttcactaacaataacaaagacctaagtaccatgttggttccaattggaacaaaagaaaatgaagtttattgtttgcctcctgatcagagtttaaactgggaaggccttagtggagttcaaacaagggctctctatgatatctctagtgcagtgtctccctgttaaggcatatcactagagtacaggactactaaccacaaaggcacaaaacaggggtaattatttgcatcaagcatgagtgtataataacttcttggagggagtttgacacatccacatactgaaaagatgttgtttcacttaccagtaaaatttgctctataagcaacagccttttcaagataggcaccattgaatgtggaaccactgaaatttgactccctcatatcagcagcagtgaagtttgcccgcctatattgataaatgttgtattaaaaaggaaaaaaaatgatctctttcttgagccatagggaaaattcataacagaaattgagggcacccaacctattaattaagcatatcaatatatctttcatatgcagagaattgtaatatatgctaaaggtggacaaccatgccaagctgaagcagtgatggtaaagattcaaaattggctgctcatctacagattgttttttatgtggctgattactattttgcgatattactattttaatcttccaccctccacataaatgccaatatgttaagcaataaatgccaatatgatagtactatagtaaaactgcttaactaagcaaactttaaactgcaagagcttttatgtcttatctatagcctgcaatggaatcaatgcttgaaaaaaaatgcataacccactggactccagagattgtgtctatctatccagaatactaagatgatgatataacagcataagcatgagctagagaaaagtttgtatcaacacttgcagagaaccaaaattactttataacccaaacaggcatagaccaaatggaatttctgtttatagctgaaattggaaacacaggattcatttggttcaattattacataaaacctatggtaagcagcaaacatttagcaccgcagcacgaaagaatactaatttgggatttgtgaaattaggcatccaacctgaagttctcattaacatggacggccttcctgcaatgatacaagcacggggcgaagaatatcagcgacacgaggcaaaacgaaaggatccgaaaggggaaaggagcccgcgtaacgtacttgaggtcggccgacccaaactgcgcagcggagccaatgccgaactccccacgctgctccgcctcgaacttgttaagatccgcgtaggccggcgccgcggacacaatcgccgccgcgagcgccgcggacaccgcggcacgccacctcggcggcggcgacgccgccgccgccgccgccgccgaggtgctcaacgaattgccgtcccgagaaccccctcggttcgcctggcaggagacgtgcgggaggcggcgaagagggggcgagcgacatctccacggcgtcgggaacgcgcagggcctcgctgcggccgcggcgaggggggaggtggtggggagagccatggcgggggcgtgtgcgcgcgcgctctcgcggcgtgggaggaagcagaagaagagagtgggtgtgggtgaggtgagacgtgttgtggctcgcgcgcgaacacgtagccggccgcgcagccgtcgcgccaccgccggcacgacgcgggggatgcggggaaaagatccagagagcgcgccttgtgggccgagagcctgtagtgggcttccgttatcctccttatgggcctttgccatattgggctccatggctagcaaagcccatgcaggtatctggcccgatgtaacataacaagatggctaaacttggcccatgaatgccagtgtagtagtagactgtagacgttgacaaaaactggtgatgagtacatgctatactggccttggccgtggctagttagctgtcatttctgtcttcacgctggccagtcacttcgttagtatagctacagtagctagtagccgtaattgagtgagctagtagacgcgcacatgcatgtattatacgctcgtatcgtatatatgtacagtacagactacagagagtacacttgctgcaacctgtagcaggctatacggctatacatatacgtataccgggcgcgcatcatgtacatatgtacgcggtactgccttgtcgtaaggttactttgatttgccgcgagatgccggcaatgacgacggtctgggttggaatctgtaacgacctgacccaatctgctcaaccggcatccctatcatttctgggctctgatgatcagatgatccttcagaacagctagctctggcctgtctgccggaccacagcgaagctatagcttagcttgagcaaattttcttttctgaaactgttactacttactgctattgcttgtgtattaggagtacagcattttctttcctcttctcttacgcttgtttaattagcgcaccctgcctgatgcctatagtatatagctactgttgtataggagtgtattagggggtgtttgagagagagggactaaaaacaccctcttttcatgcagatgcagctagccctaagctagctacaagcaggagccatggcatctaagttgacttggggattcaagactgtctactagctgctgctgcatgatgggcgtcttcgttgctggagtatcctactactacactgctgctgcacgcgtgtcatgcataagttttcatatttactccattattagctagtacccctgcattgcctctgcatctcagcatgcagaattgcagatgcagggtaagctgcttgcaggtttcagcctagtacgacgctttcctcagccccggaccattctatatatccgtattttatttgattaattatgcaagcgtaggctgcaatgcagtataagtatatagtagtataatacgattagtatatatgcttctgtattaatgcatcatttagcaagtatttcaaccgatagcatgtaccagactcgcaaccattcaggccattcccaacccaatgactaggatggtgtccatagcattaaataagctgacacttaaaataaaaaatgatgtgtcaagtgaataaatgaggaaagagaaggaaaccatgtcttgcatgagacatagtttctacacaacatccaagacattatgtgagataagtagcattaaatttaagtatggaatagtattgtttgcattgaaagagtagtgtctagcactagtttcttggtaatgtgaagtttatggaaaccatatctagtgtcttgggttgagaatgccctcatgcagtgctcatttaacgcgtgcatggaagcatgcatgatgcatctaccggtcgatcagtgcatgcctagtacgtgtgcatacggcgcatggtcagttaacacaacacatactccctccatacttgtaaaggaagtcatttagtataataacacggtctccaaaacataactttaacttcttatttctataaaaatatttattgaaaaatgatatatgtatacttttaggaaagtattttttaagacaaatctatacatataatttttacattttcaaactcaacaacgtgagaattattcatgatttatattttcaaggcttgacttaaatattgttctaaacgaatttctttattagtaaggagtagtatactatactcgtactacgttatctgagcaagtcgatcgttgcattggtccccggctctgccatgcatgcatggctagctttgcctctccttttttttttcttcttctctcgaagagctaaatacttcaattcaattgaggaagaggcgtgtcacactcacaccggtatacgacgaattatgtctcaggaccggccggatggccggctgaccaaaagactgagctagctgaggcagctgagtagctgaccgagaagggtacgtacgtctggaatctctagctagctccggccatggcatcagctcactctcgattgcagtttaattactactctctccatccataaatataagggattataccaatttcaatactccctccgtctcaaaatataataaatttagagttagacacgattattaagaaaataggtagaaatgaatggtggaggtttatgattgcatgagtagtagagagacggaaaatgtgaatgctggagggttgtgattggtttgaaaaagaatgttggtggagaagttattatattttagacaaatcttgagtgctaaagttgttatattttgggacggaaggagtaagaattaattaaggaagtggtaaaaggacatgtgatggaacagaaggtgatgggtgaaagaataaagtagtataaaagttactaggtgagagaataaattaggataaaagtagatggtagaggaataaaatattataaaaattagtaggtggagaatatagtactatgttaggattctaaaacttatattttaagacaagttggatagagaaagtcccttatattcacggatagagggagtacttccgtactgatcgagggccggagaggaagctcgagagagagaaacaacaccaaacatgtatattacgtatgtgttagctagctagctagcctgcaaaatctgttctgccattttctgtggtgttgcaagagattagtaactaacttctgaagcactactatatatatgattattctgaacgagcagctagcctaatagatctcagacgggatataagtggtcccttgggaccaggtcatagactatacacgaatatcgattatcacgtgtggttgcttaagaggacgtaccttacgcaatacggccacatcgcatgcagtcctctaatgtgagaccacacgcgataatcgatctttgcgtacagttgcttaataggaatgatgcgatgatggtgatcttcgcggacctctaagagcagaagttatccaaccgcacgcgaaatcgtgtttcggtcatttggaaaaatcttttctaactcctattcctaactgtgcagctgatcacgcgcggcttcgctagcttcttgtggtcgtggtaaatcaccaaaatggcgcgtagactaatttaataggagtgggaattaatggttgatcttcggacactatattaataagccattttgcgttgatacgaaaatgtgacttaccaattttctgacaatttaaataataaattaatgtgctagttcggattaaattcaacaaattggtagtgccatgtttcatttggctaaattttaaaagtttcttcactataatattaaattctggcttcatactgttctcaatctaaacataagctagctaattctaccttaccaattcattggtaatactaaagtttatttagattttagtactaccaataaatcagtaggatagataatcaaacaagccctatctagtttgctgtagcttattagcgatcgtcgatctcacccttctgaaaaggtttctttgtattccctggccatgaaacgacagggttaggcacaagcagcgaagggaataaagcttgacggtgagagcatatctcttggtgtgcgtgaatgccctgcaggctttatgtaaacaatgaaagaaagaaaagcaatctaaactatgattatgtttacttcacttc

SEQ ID NO: 68849 - DNA, 865 bp, Oryza sativa
aattttatttctttgtttggtttcagtatgagctgttacatgacaagtccgaagagaagctgaaagctctgagggagatcagtgacactgttatgcataggaagcttcttgacagcagtgttgatcttgtcggaaaacttctctttggatttggaaatgggccttctgtgcttcaagctgttagaccttctggtcagccactcgttgatgattgggattgtttgaagagaatggtaaagttggaaacttctttatactcggcttactgagaactgacatctgctattactccactgcgctccaatagttccatattgtcctgaaatctcctagtttccattgtttctgtttgtctgactttaatatgagtttcttcaggtacggatctttgagtcgcattgcggaccgctcactcagtacggtatgaagcacatgagggcgtttgctaatatttgcaacaacggtatctctggcgcttcaatgaaggaagcaagcatcgctacttgcagcagtcacaactcgggtagatggagctcgctggtgcaggggtacagtgcttgatctgccgcaacacgtgatatagcctcaaaacttatgccttgtactcgtacttcctcaaaacaataccttcaggactgcaaataaccgtccaaggatgtaccgctgtatgctactgtacctctatgtgtgcaatatagatgccctgtatatacgagtatatgaatgaatcgtgtgcttttacatgcccgggaattgatcgtgtatttgatagctgagaatgctgagatcgagatagcaaggtagaacttgtgtttcgaactgaatgaagttcgcctgagcacaactttgctgcggcgtcgcaact

SEQ ID NO: 68850 - DNA, 1156 bp, Oryza sativa
tcaattttgcagctgctgagcttatcctgccattaaactgtgctatgtaggctgactttgcgttgtactttccatttgccatccatcgccaagttatagtgtcctcaacaccttctgtgagtgcaatgtcgctattccacacgtggtagaaaacctcaaagaattccttgactagctcgactgtgaggttgtgcctgatgtctagtatccattggtcatttgctaatccttcgtagaccgtcctacctttccttttggcatgattgtataaggctggggctaactccttccgtggttgttcgccaatccaatttgattcccagaaactcgcttttcgaccatcacctatcgtcacccttgtagcagaggcaaacaaccttctgtccatttcatcacaagggggaggtgtccctgcccaaggcttatttgggctctcccagctgaactatagccatcgcactctcaaggctcgagcaaatttctctggccaatttactttgcatttgcccccactaatctctttgtcgccagcccaaaggaatctctttctaattttatccatatcatgcaggaaattttttgggggtttcagcgctgtgaggaaatatgttggtattgaggttagtaccgaagagacaagggtcttccttcccgcctgttgcaacagctttcctttccatcctgcaagacgagagtggagcttgtccatgactggttggagatgcactctcttgattctccccgttaacagaggtagtcctagatatgtgatggggaaattagtccgctttccattgaaattgttcagcacttcctgaagctctatgttctcacatctcataggcaccaccgagctcttacttaagttcacctgtagatctgtggcatgtccaaacttttctagcagggtgatcaggttgtccacatcagctcgacttgggttaagaaagattgccgcatcatccgcatatagcgatgttcggaacttagccaccctgtttgttattggtgacaagatcccttggtctgtggccacattcagtatcttttgcaaagggtcgattgctaatatgaagaggtagggtgaaagcgggtccccttgccgcaatcctctcttatgtgtgattgcctctcctgttgtttcattcaacattat

SEQ ID NO: 68851 - DNA, 848 bp, Oryza sativa
tttatcaatgctgttgacattataaaattggggggcacatatatacaaaaaatgaaaaataatgaaaaattagaagttatgttaatcggcataaaggatagtgaaaacagcagggtattaaggtatcttagccgattacaagaatttctaagtcctattacacaaaagttattgagacaagtactgctggatagccgaaatatctctttgcctaatttgttcgacttcttcaatggcttgggcatcttgagcatcagtcccgagaatgatcttcagggacttggttacgtcaacaacattcttgatagccgatttgagccttgctttttgctctttgacagattttgggagatcggctagctttttgtgctccatatccaattcaacattgcattgttcaagctgtgccaagagatcgatcttgcgggcttcaagccggttgatattggatttgatcggaccttcggataactgatcgagtttgactttttcttcatacacaagctgccgattgacttggattgtggcttcaatctccttacgctcacggcgttcggctaatcttagcttggctttttctagtttaaattgatgttgctcaagataagcggctggagttaggacatcggccagttcttcaggaattagaacttgaactttgtgcaatcgtgtcctaatcgatccacagtcgaccactaagctatccatagaagaggcttctagccgacgcgagatatcttcaagtgttttctttgcatcgtcagataagggagctagagctttgcttgaagtatcttcttctgcctcatcaagataatctttgatatcaaaagaaaagagatcggcta

SEQ ID NO: 68852 - DNA, 946 bp, Oryza sativa
tttacatacagtgaaattgacaccgtgctatgccaattcattaaaaagaactgatggattggattgaaaatggaagattaaacatcacgtatttataaagattactgccatcgaatcagcagtcggatcaattactgctgctttaaaagtggaatccttctttcatcctctcctagcctctctaatctatactacttagaaaaaccatagtggtggtcttgatttctaacgtagcagacgtatcaggtagacacgtacaatcacaaccatcggttcgccagattgaaaaagaccggtcacagaatttgagagtcgctttgcatggagatgttagcgatgtagaaaaacagatccattgcacaagttgagagtcgttttgcctgtttcttgattttcgctagcgagcaagataccgttgagagctccttgggtatggcttccagttaacaggtttggcttggtcgcgagaaatcacaatacgagcatgtcccaaattcttatgttcctttaggttagttcttgcatggaaagcattaagcatagctgcaaattgagtcaaattggaaagcaagacgctaacacgtttctctcggtgaatgtcagttcatttcgatctcatgtcaagcaccatatgcctaactgaaaatacagcaaccctcctgtctacatgagctagcgcccgtagtacgtatgcttttcttagaattcaaacaaatactgatgagccattgctgtgagatgtcaaactgcgtgtacactcctcgcatgcttgcgatgctagatttgactaagatgtactaaaggactgttcttttctgctgctaggatgtcaggatgagttattccttcgtttattatgaacatatttttcaaacttcgaaataatgtgtgtgtcttttaaaaaattgtatctaagttttcttaaaatatcaaataaatcaatctt

SEQ ID NO: 68853 - DNA, 3017 bp, Oryza sativa
atttagacagaggtatgctcaaattctaggttggttttttatgagacgatgagtcgacatgtttttgggaatacgcgaggtgcgcatttttattaagaaagaataaatgtatgtacaagacgggccgaacaaattaaaaatgaagaggacagggtacaggaggggggaagaaaaacagaaagcctatcttctagggaatttggtgacccatctatcaaagaaggaactaccatggccggtatggctgccctagccatccaccaaaggtccgcttcacccgtcatagccctagcgatctccggccaggttctgctttcctggttgaagagccgattgtttctttacttctagattgtccaagctaccagtgtggctatcgtgtcaaaccctcggctatgatccttggtcatcctcttgcggctgtcacacaaccaaacatggaaggactgctcgttgattggaagacattcggaatgtatgtaagcgggtcgacatgtgaatctacttatatatatatcaaataagtgataattaacaggttttcatatcatggtccggcttattatcatacctagaaatataagtgatcgatccataaacttatttatagattaaattagtaggtaatccacgagttaatctacggccactaaattttacttataagtgggtttatgggttggtaacttgatacacttacatccctagctagaattatatggccagtgggaggaatacgatcgctccggacgtactgagagccggatctactcctgttgcaaatctgatgtgaacaactgcaatttagtccggtgaaattgactaagctcctccacaattacttgttttagataggtcatcggtcaatatattgaaactttgagtatgaacataagatgttttttctttcctcgcaatataacatggacatgctttttaagtggatttgtatacctcttttgcgctaataatttggagagcatataactctttcggacaattctagactctagagtgcaatgtatgattgtatctgctcttgtcaagctaacttgggcgtgcagcctgctctttgaaatttaatcggcacgcttggcaggagtaggttctctactgtccttttcagaagagatatggtgcagcgtcagaatcaataacatatgttgcccatccaaacagtaagtgtgtacacaaatcagcgtcagccttttccaagttctccaagtttggtggttccttccaactactacctgtaagtcagacagtccctctaataaggtcctttttgtttcattttaaaattattatactctagattattaagtccaattgctagctataagctgaataataataaactaaattagaataaattgtaagttgtttgtttctctgaattatttgatacatgaattattgggtttgaaatattaatgtctatcatcttcttggctattttggatgcttgttcacttttttatcactgtatataggaaatatataattggtagtggctaaaaaatattgtcatatatatactacagtggcaatataaatttttcttggtagaattttgtgacatcaccattcacggttactcgtattagctattgtcgttgtccatacactgcatacaaattataggagtactcccagttcttttattacacatgaagaatcattgtctaaaacaacccaaatctacaatggcatagagcaccttgaaaacctgtatagcctattttgttttctaattaggatgtaacttttcttgcgaaaactttatagacatgaagttgctataaaatattaaataaatactttttcacttttaaaacttaattaattactacctccatattttaatgtatgacgccgttaactttttgtttaacatttaaccattcatcttattaaaaaaaattatgtaattatcatttattttattgtgacttgattcattatcaaatgttctttaagcatgacataaatatttttatatttgcataaaaattttgaataaactgaatggtcaaaggttggttgaaaagttaacggcatcattcattaaaatacggagggagtataagctaatggtttttctcctattatttgtatcacgatatctctgaataccaggaagtcaagtcaactagccatcgtgacgacaacgacatgccacccataaggagttagtactgtacactatacatatacgaatcgtcgtcctatacaaaatccagttgcgactgtaccagttagttcgggaagaaaaggtaaattataggcggcgttagctcacacgcacggtccaacaatgcgacgcaccagcagtccgtccagcaccccaactccccgcgagtcgtggtccggtccactgcgacggaaataagggaaagaaaacacgtaggtgtggtactatttagtatatacgtcaagacagatcgatccagccacagtgtggtacgtggtggacaggtgctacctgcccgatcgatcgctgggtcttcagtcttctgccgccgttgctcgatcggttagttgagtgagacgtgcacgtacggattggagtgcgtagctagccgtgaagtcgttcggggtgcagtgcaccaaggaggcgcagtacggtgttgcgtgacgactccggccggactgccgcccgcctgcggcctgccggagggctggtgtgatgcggccatggcccgtgggggcgcgttccgtttctccagcgagaccccgtattcgggcccaatggaatatgcatatgggccccttctccgaaggcccgtttagtgtttacaggacgattagaggccaccggtatcgctcttgaggaaaaagtgcaccgaaggtccctcaacttatcatcgagttacaaaatcgtcccccaactgcaaaaccagatatttggcgtcccataactaataaaaaccggtcacaatagctccttcggtggttttgaccctagttttgtcttacgtggcagctgagtcagcgtgggacccacgtggggccca

SEQ ID NO: 68854 - DNA, 3013 bp, Oryza sativa
ccatggcgactccattaaccttgtcaaagataacaaggaaaagagccacaggtcaccctcctcaaaagaaaaacagcctcagcatctgcctcagaagcaacagtttacagttgagacaagatcagtgtctacattgcaagaaaagacattccaagaaagatcatcctgacttcctgacagtgatcatggcaaagaaaggtgagaacattattacatttgtaaagaatctcattatgattggttattctagatccacatggtggattgattctggagcaactattcatgtgtgtaattgtttaaagggattccgttcaatgaggactatgcaaagaagtgaaagatccattagagttgccaatggagttgaagcaaaagttgaggctggagatcttcgcctagaactcgcgaatggcttcacacttttacttccagacgtttttatgttccttctttgcaaagaaacttgataataagtgtatccaaattggattttgatagatatgattgccattttggaaatggcaaatgtgaatgttgtgtcctcgttgacaaaagaaaagaaagcgaacttctgatgtctcatcgaaattatggcagtgttgtttatgccatatttcgagggggagaattgagagactggttaagaatgtagttcttcctccattggagttctcagttttagaacaatgcatacaatgcatagaatgcatcggtgcccaaaacaccgtatgagctatggatcctccgtgtgtgggggagtcctgcaaaggataaagtatttaacccaaaacagtaagctgccattttattggctattctaaaagatcaaagggtcatcgtttctactgtccaaacagttatacaaagtttgtagaaacgggacacgtcgtcttcttggaagacgaaatgattagggggagctcggtaattcgagaaattgatcttgaggagaggcgggtgtctgtacccgctccgtcgactcaggaacctttcttctctctacctgctaatgttgtgccagcaatgcatgccgttgcggtaccaacacctgttgttatctctcctgtggcaacaatgaatgaaagtgaggaacctgttctacaggattcaacagaaattattgccacatcagaggaggagatgaaacagcctcaaacagataatgtgccagaataggaggcccctagaaggcctgaaagagtcgcatatggaggatgatcccatctcatatgaagaggccatgagaagccatgaaagatgaaatgaaatcaatgaaattaaatgatgtctgggatttagaagaaattcctaaaggagccaaaacagtaggctataaatgggtctacaaaatcaaatatgactccagagggaatatagaaaagtttaaagtgcgacttgtggcaacagttttcacgcaaagaaaagagattacaatgagacattttctccagtctcttgtaaagattccttcatgattataatggcactagtggcacattatgatttggaattacatcagatggatgtaaaaacggaatttctaaatggtgatttgaagaaaaaaaagtatacatggcacaaccgaaaggtttcgtcatgaaatgaaacgaaaatatgggatgccgtataaagagatccatttatgggttaaagcaaagcttcgagacaatgctacttgaagtttgatggaacaataaagcaatttgggttttcaagagaatgtagaggacaactgtattgattcaaagttaagaatgggagactcattttcctaattctgtatgtagatgacgttctactggctagtagtgatgtcaatctactgcaggaaataaagaaattcttgtcctcaaactttgacatgaaagacctcggtgaggcttcatatgttttgggcatagagattcaccgaaatagaacaaagtatgcattgggattttctcaaaaggcatatatatagaaaaggtgttgaagaaattcaatatgtacagatgcagtgctacacctgctcctatagtcaaaggcgaaaagtatggggcatcgcaatgtcccagaaatcagtatgagctcaataaaatgaaaacaaagccatatgcgtcagctgtaggaagcctacagtacgcgcaagtgtgcacacgacctgacttggcatttgttaccgggttatttggcagatttcaatgtaatccaggcccagtgcactggaaattggtaaagaaagtcttgcgtgtttgcaaggaacaaaaggcctcatgatgtcttacagaaaagcagaatcgctccagatagtggggtattcggattctgactttgcaaaagataatacaaagttaacatcgggatacatgtttaccctggcagcaggagctatttcatggaaaagctcaaaacagactaccactgcagggtctaccatgtatgccgagtttatagcatgccatgaggctacggggcaggtgaactggctaatgaagttcatacccggttttaaaggtggttgatagtattgagaaaccactaaagttatactgcgataaagaatccacagtaatgtactctcacaacaattagtcaagtggtgctgccaaacacattgacataaagtactatgttgtgaaagacaaagtccgggatcaaacaatcagtctcgagcacataagaacagaaaggatgctcgcggatccgctcatgaaaggcctacctcccaacatgttcaaggaacatgtagcatgcatgggttttaagggaagccttatgaatcctggactatagggcccaaaagttaaagtatctgtttctgaatagagatgtgtatagtggctgtcgaatccatcggtaattaaccgtgacgatgaaacatgctctatatgtaaatctgtgatggaatagaaaaagctaaaggaaatagtgagatcaagggggagaatgttagatggatctccctccccttgagcccaacggctcaagggggccttgacccgcgcctgatcggggggcgcccagcccaatg

SEQ ID NO: 68855 - DNA, 2109 bp, Oryza sativa
agagggagaggtggcgcccggagctcctcgtcacgcgcccacgcacgcaccggcctccccggtgcttggcgacgaatggcgacggcgcgagcagggcaggggcaataaggcggcgacggtggttcggcggcaatggcgcggtgggtgtgaagcgagtgaaaacgagagaagaaggggtttggggcgcggcttgggttttatagtggaggcaatgtcggtttgggaggcgggggcgagctgctgcttggctagcggccgcgagagcggcgttttcgtgcgcggcgcgaaacatggcgacggcgtggatgcgttgggcggcgaaggcggtggatcggacggcgaaaatcgaatacgggtgaacccccgcaaaaccgaggactagtatgtgcccatggaaccttctgctagcgtgtggggagctttgctctctgcatgtgctatgcataataacgtcgatgttggagagattgcagcatttaggctatttgagttagaagaaggcagtgctagcaattatgttaccctctgtggaatttatgacgcagttggtcaatctgatggtgttgcagggttgagatcaaggatgagagaactcggcatggtgaagacgcctgggtgcagtcggatcgatgtgaagggaagagctcatgctttctaccaggggagcatcccacgttatttgaggggatgaatgctttgggtattagatcagttactagacgatatggcaaattcagattctgaagatgagcttgctgacttgtactttgagttaactctgcactgaagttctgatggtgaaagtcatgtattgctgcaatcaattttgttcaaggaaaagcatggatcttccttgatggctgccatgccactcatgaacaaatttgaatgaagaccaacaaataatcctaagaaattggtcaatctagatgccttggaagctgaaacttttcaggaccagtatctggagcaacatcctgcatcatggtatggtgccaggatgagagcaatagggtggctcttctggtccaaacgactggtatctagtctgaggtgactgcaatgacagtaatacatgtgtaatgttgtcagtctggtttatcggcatatggctcaaatatagtgcttctgaaaatatgcgacaatattggatgcaggagaaattgtgaatgattggcatataaaagattatctcttggattaaataaaagagcgagaatgaatggctagtatttaaaaatgggtggaaaattatttccctttcccatttgacaaacattgccttatagcaaaactgaacgatttgctcagcacctccgaccgagagcaggacaccgcgccgacaagagagcgcgcgagccgcagccgcgcgagaggagcgaagcaggccaagctattaggcccattgggcttgtcttttttgtgtaaatggggcttttgactaggaaaccctaaacccaaatttcccctttctccagttctcccatccccaatctgtgcccgtgcgcgaggaggggcgcggcagggcgtatagcggcgggcgcgcgcgcgggtcggcggcgcggcagccggcactggcagcgcggcgcagcgcagggagcaaggcagaggcagccaccaaccaacagggactgaagtcaggcagaggcaggcaacaagctaaagaggaggagaggaagaggagagattaggaatgttgaggtattgttgcgtttctcgtctatttaacctttgcaactgggatgatggattgtgaactcatatgactagtgcttgttgctatgcttaatgtagacgtgatggataatgctgcgtcgtataatatcgtgaattgatattgcttttttttttcccttcttattctgttctaattctcgcgcgctagttcatgtgccacacctaattttttttctgtcctccgccactgaccttatatgcgctagttcatatacgattttttttttgtcctccgccactgacttatatgttctttagtttgctaaaatcctctcataacatacattttagctccttcaagaagtggctcctggttttcttgctctcctcttgcgatattgctgggtactccctctgtttcataatgtaaga

SEQ ID NO: 68856 - DNA, 11515 bp, Oryza sativa
aatttttccgttaggggccagggccgggggagaattttcacctgcggatgagcgagggtggggatcggaattaacccacgggtaacccgaaggggcatcggatgtgagttacttcctccgtttcataatgaaagtcattctagtatttttcacatttatattgatgttaatgaatttatatatatatatgtgtgtgtgtgtatgtatgtatgcatgtctgtctgtctgtttagatttattaacatcaatatgaatgtgagaaatgctaaaatgacttacattgtgaaacggaaggagtacctctctgaaagtagcccattgcaataatataggcccattaaactcattccaaattgacatataaaagctcaagacgctagtttccctcgacccttatctctttccttacttcaaccaacccccttcttaccgtctactatttcgttgcatcaattcatctccacatcgcctcgtcgtcgattcatctccacatcgactcgtcgtcgccgagtcaccaagcagccagccgctgtccaatttgcctcgtgctaatcattgtctattatgcatcatttcaattagaagatagaccatatgatgtatcaagtatgtatatgtgcttgatcatttcaattagaagatagaccatattatgcatcatttcaattagaagatagaccatatgatgtatgcatatgaccttgatcatgtgctttatgtatttgtgtactgaccgatgagtatacattgctattgaaattttgaaattttatcatattattattaggtgcattgtcctatttttatggagtattatctttatccgggtgatgcggggcccaagtcacccatgcgggtcacctacggggacgggtgatgttttccacctgattgccttcgcgtgaccggggctgaggatacctacaggaggatgggggcgggggcattccagcccaacccgaccctgccccgccctgttgccacccctaagtgtaatgcagcggcaagtagcacaactaaacaaccccatattctcaagccaaactaataatggattaaaaatgaccaaaagaaaaaggaatagtgaagattctttattgctggaatgtaaaaagtatagcaaaattcatgtcaaattttcttacattacatcaatacgtagttctatatgttcgaaatgcctccaacatactccctcaattccaaattgatctacatattttataggtacaccaagaccaagaaaagctaataactctctcatattatatttactctagcaacaaactcaatgcatgcaccatccctactattttctagccaatagcaaatcaagatattgcatgtgggttataaatgcttgtgtgcatggatgcatgcatcaatgtccatttactccaatgcacaaataacaaatagacctaatgaatgaacacaaatatgtatatcatttagaaataacctaaaaaaactatatgtagatcaatttgaaatggagggagtattcttgtagttatcctaaatttcctcttgattttctactgcgttttcccttttttttccccttccaaacagttcacaataaccgcagcttaccatgtggttaccgtctgaaatcgcgagtaactatctcaaaactatggaaccactgtcagatcaaaataatttgtttaaaattttgacgaattttatacggtttttcacagctaccgagcaacacccataatatcgtgaaggtcgataacccccgctgaaatagtatggaaaaacgatggattagacatccggctgaggtactattgcctcaaaacctcaaaatgtggatgccgtaaagattaattctccgggtttcataattcttgatattttgaacaatgaaacggcctttaaaacatatttttaactatatttttctatttataatatatacaataaataaacatttttttatttttattatagtactttgtgaaataaatctatatatgttattctagtgattataaacaaaataaattttaaagccattgatagttataaaagtttgttctcatgttcatcaagaattatcaaaccaaagagagtaaaacctactccagcttgtaaaaatacactccagtcacatgcggcattctcttcggcatttctagtaagcacagttatatcaagcggatctacaagcaaaatacgagaaactagcacacgttatacaacacaacaccgattggctctgcggcgatataatgtcagcagcaatcaaagaccggcggcggctgggcagaaacatgcacgaggccggcaacacaaagggcgcaaacggacgccaccatcaattttgtgcttcctaaaatcctatggacaatcagaacatgcagatacaccaagatcgaaaaggggaaaaaataaaaggagaaaaaacaaaagatcctttggtcagtcgcatcgtcgtgtcagccttgtttcgtgtgtggtcgatccaaatcaggcgaacgaagggatcccgtatctccagccgttggaggatcgccgccgggtcggctgctgctgcggcgcgaagctgagcccgaacatctccttgagaacttggcctggctcctggagcccgatcagcttggcgaccagggacgcgctctccctgacatgctccaggtctttcgtctcggtccagaggcggcgagcgacctgcagtttcctcctcttggagtccagcgagacaccccattttgtgtacgtgtgctccctctcctccgtggacagccgcttctgcatctgcctggcaagcatctccctctcccgctgcagcttctttgcgctgcattacagcagagcacggggcttatgagttgctcgtgatggtttggcgctaattttaaggttatggcacaaaagaagtgaatgaatggaaacgagtaatttacgcacctcgcaacaggggaagtactcaggctgcctactatcgcattgctaggggtgctcccccttgagtatgtatctctcaggaatgatagccttcgaagctccacttccatgtagatcgagtcagctgcttctcccttgaatagcaagaaaaagtaagtcctgtggaccaaggaaatgctgcaagcttgccaaagctcgatgatctcttgctgcttcttctcgaattccaaaggccatcgagaaggtgactgagaaacaccctcgatcgggtccaatccgatgctctttccatttgcattctaaaacatggatgaaatgccaataatttaattacttgctgaagcatagaaaaagaagtattcagcagaaaacactatttattttagattattagttggaatgctaatggtatgtggcttttgaggggtgggagaaattgttgaaattctatgatagagtcccaagagccaggatgttaaaccgaagcaatactatatataagcatgtattttccaaaccagcatcacataatcacatttttcttgaataaaacaataattaaatgaactgcagagctaagtgccctcaaagctaattagataatttcatacctggtcacctaactgcttctgataatgaacctgggccatctctttgagttcagcaacaaattcaccaataccagtgaattctgtatcgcatgcaacagacccatttgtctttgcatccttaaaagtgctgatctcagaactcatggatcctgcccttgaaagtgtgtcggtctctgcatcatagtgcagtgcagatcctcttctatgagattccacaggtcttcctgggaactccaccaaacttctatttagtggagtgcaatcatccatctccatatcgtcaaacatagtagaacctgtcagtgatctacagctcctgcttctaccaattactcttaagtttgatgagttacgtgttgaagatcctagatctttggctagactgacaaaaggccttctaatattctccaagtgttcctccaaagtaataggagcttcgccagagggccttgaatgcctagaattcactgatgcatttgaatcatttccatgcaaaccagaattcatatttgaatcttgtgggctactactttcaccagctgataagtccaactggtcatttcctcctgtccgattgctttcaatacatcgcacttccttgtaaagatctgaatcatcatgagagacctgagaactatcatctctgctgacgcttgggggcattccaacagatggagggcttctgactgaatgctttccttgaacctaaaatataaacaaaacaaacatgaccctgccggaacaacgagatgaaacaaaactaaatttcagaagtcatggcagagaatatacttgacggttcaggtcatgatcaccgacagattgcagcaaatcctgcaacctggattgagccaaatcacgttgtgacttcagttcttttatttctttctccatctgcaatggacatgacatgaaattttatggatgtgtgcaacagaaacaacaaactttttttgtcaagtagaatagtgtggaaatactcgtaatggacaaggcaaaagtggcagcaagtaagatagaccagatgcacacaaaaacaatagttttctgcaaattccagtatgagccgtggaggagaaaacagggaggtaagaaaagtgacaagtaactttacctttctgatttggttgtccttttccttcaataatgtttcgagactggaactctgaactggatgccgcaactcgctctccaatctagcaagttccttttgcaagtgcttaaccagtgctttatcagacatgaccacattaacctgagcatttgtaactacttcctttgcacaactcccaaatagcagagtatttcttgattgctcaatgtggctagtggcagggctcagtgtacaaataattgcagttcttgcattacctcccaaagatggctgtagtatgcgtgtaagctttgaatctctatacggtatgtgtgcattacttcccatgctgcattaatgaaaagatataactgatatcacttgggcgaaattccaagcaaacattactgtaaacatcccactttattgtacactatataaaatcccaaaagaaaatacatatgcataaagcatgcttaaatatgtcagcacacaaaaaattgtgcaaaacatgacatgtactacacaaaataaaatgatatatattatctgttatcaaacaaatgcaaccctattgcctttttatgttttacatatctaacaatatttttgcacaaattctgtgcacataatacatgctccaaatatatatctttcctagaattctctaaagcgacaagtgtgaaatcaaaacatatatggagctacatgactacagccatccttaaaaaatcatactctgtcaagcaacaaactattctctaaataagacaaccaaattttcctataatgtggattgaactaaataaaattgcacagtttcaagttgagattcggacctcagttttctaatgacagtgccaagggcaagcaaactcctattaatgtgacaaccttctttcagtcttgtgccagctgacaatgcctgagatgcacgctcacttccagccagatcaacaaagttctgcatggggagaaatggagaatgaataatgcatgcacctaatttttccaataaaaagaactccatgatagacttgtaagatgttattcttactgcactagccacaagtgtagttgacttgtcctttcctaagaactcgcgagcagagctttcaactgtctgaattgcttgacaaatacatcagccaaaatgaagcatagactcaaagataacaatttataccaaagtactacctccgtcccaaaataagcgcagccatgagtttctgcgcccaattttgatcgtccgtcttatttgaaatttttttataattagcatttttattgttatgagatgataaaacataaatagtactttactcgtgacttctgtttttaattttttttaaaaaagttttcaaataagaggcacagaaaaccatggctgcacttattttgggacggagggagtaattcatagatttgagtaaagaacaaaccaatcgaagtatctgatgggatctagaacttttttcgtttaagaaggtctccccaaaatttgcttgaggaggtatagaatattctcgtctgcgccagcagcttataatcgaagtatgacacaaactttttttttgtattgctctcatgtaattcaggatttttgatcacttgatatatatatatctaaatttattcccctgttaccaatttttctctccatggcaacgagatctgattggaataattcaatttttcttcacgaggtcttttacctttgcactgtttactagcctgccagaccactcctgtttggtttggtggtgaagtggtgaacaccttttctcaaaaagccaaaaaagttcttttaagcttgacactttattagttgctgaactaggtaggttgttactgtactgtagtagccattattttttcctgttcatatgctaacattttgttgatgttagtatttctgatggaaactggcatttgtgttataacaggagctgggagtactgcagttctcgtcttatactaggctactagcactcctctgatctgatggccaacattaacatggcagatactgctccttcctgtgatacttacctgttgaattattgttaatatcttggtaatcctcttagagacttagaccagaggagaaaagaggaatctggaggtcaccgccaggaaaacgctacggacaacatgggcggcagatggggtgggagctacccagatctgcgccgacggtggcggccgaagaagaagaggagaagacgacggttggggagagagccatcctccattcgcgcgatggcggtggccaggtaggatcatggattcagatttttatgccatcgatttcctggtttgctcttcgtttactaatcatatgaattaatatgcatgtaaaatgactctgcctgctccaccatgattatgatgaataagagcaataccggcttcggccaataggagttttctctacatcagtccctaggaagatgcgattgtaggcgtttagttctcggtagccacaatactagacaggacacgctgatatgaatcatatctgaaagatctcaaaaataaaggatcctttgaggacgcgtcccggaggctccgggtgctccacaccgtggagaccgccggggtgttcgacatggtggcgcggtggcgcctcttctcatgcaggccgatgcccacggccgcctcgtgctctggtgcctggagcaggaggacgggtcggacaaaggtgttgtttttcttcttgcatttgccttagcgtaggaacaaaaaggttgtttattgtgccaaaatcgaatcactacctacttgctaagcttccatgaaatacgcagcaatgttcataaatttttgactgaacgtagtgatgtagaaggcaaatgttaagttcttatgcttctgaaagtgttctatcatccatgtgaatgttgcacgatatggtaccgtctcaatcctttttcgagtagtacactgctatgtacttgccgtaaaaattatttccataatctcttatcgattttcttatcgtatatggagctttattgtacatatgaaggtatagcgtattcgtatattccatgactcgtacaccaccttacaatggaagctattgtaaagtggttttagaaacgataatactaatttctcaggcgtggagaccgctggagtgtttattttttcaaaataactttttttagataataatcacacaaaataactaaatgtatttaacttatttcctgtaagtactggtaattttgccacctactgtgcttaaaccaagcctggatacacctttttttttttttgctttggatacacttaaatgacgttcaccaaagatcgtcaccacctgcggacgggatctagacatgagaagttccggctatagctctatgttaaggattgtgggaaggagctttttactctaaaagttctgcttcaatcttttgctcaaggtactagattaaaggctaactatcaaaaatcatgtttaatccctaaaaacttgagtgatggaaaagatgagatgcttgctagggtttttgtctcggaaagaaacctagagggaaccacttaaccgatggaacactgatgctaatttcccgacatttttcaaattaaggagtatagtttttcaaatctgggcataattcacgatatgctgatgtattgtgaatcaggcgagtatagtttttcaaatcttaaacgccgtggtctcttgggaattagacagtctccatatcagaaaccaagcagagttctcaatctattcaggtcctatcaaagctatattaaacgaagatcaatttttataggactagagaaatttgctatgcaaatgccggtcactggccttatccatactaagtgctctagtaactaataactatggcgtggtgtctaggttagagattatctttgtttgttgtgtatcccacggatttgtcagaggtaggcggcaggtggtgaaacttgagaatatgttgggaggagtaaaacgtacgtacatactatatacgcacgtacggctggaggggtgggaggatagttgatttcttttgatagatttaattagttttgtgttatctataacagatctaatggcataaataatgggcccactgatttaagtgaaaatcaatggtgggttatttttagaaatttttaatattttttaatttactaaaataccacatgccacatggcggcttgagagcgtttataggatgtctatgtggtggcttgagagtgtttgtaagaagtttcacggacttgatgctgcaaccttcaatatacctttctagattttaatataatactagtccatctcttaacactagtccacactattaatattatttaaacttttaaatatttttataaattataatatatttcatataaaataaactaattatatatgatgttatttgtataccttctgatatgattcatatcagcagggagattgctctaaaatattctagcataattctcaagccatatcatagtcgagtggagctaagataacaagatagggaatactagacaccgtggagaccgccggggtaaactagacttcttaaacgaaaagggacatgaactagcgcgcgagaagagcaatacaggacatagtcgagtggcttataatgaagttaacggtcaactgacagtggactgatggcaatggcataaaagggaggagaaacttgaaccggtggcataaaaaggagaagccaatttgaagtggtatataagggagccgattaatttagagtggcatataagggattctctcttaatccaagcccttcatttattttccaatcccaatctcaaccctcatttctcattatccaaacacaccctaattgtgtcgtcatatttctagttagtactagatttcagtcagatttttgtgcattggatttgtgttaagacccgtgcttgaggttgaaaggccgttggatctgtgttgatgtaggccggtcggggctgatgttacgggacattatgaagttcaattggcaaaatttactacatgacactcaaaaaaacgtgtaattggctgtgagacaccgcaaaaaacgtgacacagctgatggacactagaaaaaatatgtatgagctataggaaactttcgtggtgctgagctgcatcctctgtccgggagaagctcgctgctgatttcaaccacatcctccaaaacttcgcctcagcaaacttcgtcgtgggaggaaattcaccaggtgacacctccagccagatttggcatgaccttggcagcatcaaccacctctgttgggataggagacggtgacgactgctaggaggatgtggggtggggggtgggaagcatggtgaaggcagaggtggtgcagcgggagaggatcttctgatgtcactgttcaccgtgcctgacatgtggacccaagacagccaccaaattagtggaagttacttatattgggattagcttttgattttaccctggttttcctatatatatgagttatattttggtatagtatagtatagtaagtatgattgtatgaaatggtttaatttcaggatagagaaggcttaagtttggagtttttttgagcgtgtgaaatgtgctttggtaaaggtagagtgctcatatgtcctttttgtcctctattcaatttttttttgtattttctttctctctgtatttaatttttgtggttaccattatatgtactagtatattagcctttttgctgctactctaataatttggtgatgagaaaatatgtggccaccaaattagtggaagttacgctaaaggagcttaatccggtgcagtagcggcgactggcatgcggtggtaaaagtggccacacgggcacatgggggcgtgctgatgcatgagctgctaatgttggaggctaggattaggatggaatagggtggggagtatatagctgatgggcttagttctgtttcctggacctgtgataggttactgggtcaaattttccaaactcagtgttcggtcagatcggataccgacaaagaagaccgaagcaccggaaaaagaagagggaatagaaaaggaaggagaagggttaatgcaaaatataagtacattgtgactatgtgatagataattatttatgtggatggatgagtagtcttgatggttccctagtttcttggtcctccagtacttttaccttctcattttaatttattactgcacaaaacatatcttcttcaattcgtcctcttaatccaaattggttgcgcatctctctcacacacacacacaatcggggtacatatacattgcttttttcttggatggaggagggccatctgttagatggatctccctccccttgagcccaacggctcaagggggccttgacccgcgccctgatcgggggcgcccagcccaatggctggtgggcccccgtcacactgtgccatataaagaggggtggaggacgggacggaaagaaggacacaaggaacgaggttcgtcgccgccgccgccactccaccccataaaccctaaccgatcgagggggcgcagccagtgacgggaagtccaccgccgcgccacgcctcgtcgttgacaccgtcgctgctgcaaccgcatcaccgtcgccgtcacgaccgccatcgccgccgccgcccacgtcaagcagagcgacgacaacgacgatggctgggacttcctcttcatccaacgcgtcaaccggtcacatccctaaaccctttcccttattctctatttttgttcaatcatccatcgcaaatagaaccacccgactagatctaaacctaggtgatccaatagacaacctaacaatggtatcagagccaccctagagtttagattggttggggaaagaaatgcaaaagaaaggcaaagaaaagcaa

SEQ ID NO: 68857 - DNA, 3829 bp, Oryza sativa
  unsure (1)..(3829): unsure at all n locations
attcctgcagccnnnnnnnnnnnnnnnnnnnnnnnnnnnnnnnnnnnnnnnnctctctctcaagaaaaagttaatcgccggctaaatttattaagatttgcaaggccgtgtggagcaaggcacaaggccgtcactcttcacatgctttcatcaaaacaccaagattacatcacctgcttcatggcgtcgcctgccgtttacggtgtgcacccttgtcatcggtttccatgatcatctcatatattctctcatctactggctgcttgatttcgattatattgagttgcttcctcttgtttgatttttgcattgatcgatcggtggtccctgcagtgattgccacgatcatcttcgttgtggcgttcgcggcgttgctggtcaaggtgtaccggggcgccgagagctgcggcgccgcggtggccgccgagatgaaggcgacggcgcactacgccgtggtgcccgacgccgcgatgcggagcgcgacggtggagaggttcctgtgggagatggcgcacgagaagcccatccggttcacgccgcggcagctcgccgggttcacgcgcggctactcggcgcggctcggcgccggcgtcttcgggacggtgtacggcggcgcgctccccaacggcctcgccgtggccgtcaaggtgctccgcggcggcatggacaggaggaggtccgaggagcagttcatggcggaggtgggcaccatcgggaggacgcaccacatcaacctcgtcaggctgttcggcttctgctacgacgccgccgtgcgcgcgctggtgtacgagtacatgggcaacggcgcgctcgacgcctacctgttcgacctgagccgcgacgtcggcgtcccggcgcggcgcgccatcgccatcggcgtcgcgcgggggctccgctacctccacgaggagtgcgagcacaagatcgtgcactacgacatcaagcccggcaacgtcctgctcgacggcggcatgacgcccaaggtggccgacttcgggctggcccggctggtgaaccgcggcgacacgcacgtctccgtgtccggcatgcgcggcacccccggctacgccgcgccggagacgttgatgcagtccggcgtgacggagaagtgcgacgtgtacagcttcggcatgctcctcctcaagatcgtcggccggaggaggaacttcgacgaggccgcgccggagagccagcagtggtggccgatggaggcgtgggccaggtacgagcgcggcgagttgatgatggtcgacgacgccgccgccgccatcaatcatccgagcgacgagatctgtagtggcagcgacggcgaggccgtggtgaccgtggccgaggccgacgacgagcggcggtgcaaggaggcggtggtgaggatgtaccaggtggcgttctggtgcgtgcagcagcggccggaggcgcggccgccgatgggcgcggtggtgaagatgctggagggcgagatggacgtcgcgcctccggtgaacccgttcctgcatctcatggcggctccggcgccggtgccgaatccatgggcgacgacgacggcgagcagcggaaacgccgtctcagaaaacgtcgttgtttctcacggaagtgacggaatcgtctcgctttgactactgaaatcttttgtctgtgcgtgtgggtcgccacgacctcgtttctttgcattctacaagtagattgtttatcactacatcataatacttcctccatctcaaaatatttgacgccgttaacttttttaaaaatgtttaaccgttcgtcttattaaaaaaaaatatttgacgccgttaacttttttaaaaatgtttgaccgttcgtcttattaaaaaaattaagtaattattaattctttgatttattgttaaatattcttttatgtatacatatagttttacacattgcacaaaagttttttttaataagacgaacggtcaaacatgtttaaaaaggtcaacggcgttaaatatttagggatggagggagtactcattagatttggaccaacaaatcttacaaaactttcaaccagtgaatactacgttttcaacaaaaaaaaaagaacaaacatgttaaaaatagtaattctagagacaaaagcagttgtaaaatcaatttttttataatataactgagtgcagatacactgtaactatttgtaagtgttctatagtatatataagcgttttgtaaatgagtgtaattgtaagttgggtctacataaatataaatctttgtgcagatcttacagacaaaaaataaagaggctgctatataatggaatcccgttttcgaacggaatgatcccgagtaggtaacaggtgtgatacctatcaagtatcagacgattctacacaacatgatgatcccgagtaggtatcaggtgtgatacctataaggtatcagacgattctacacacatttcaggtgacacttgcaagtatcatgtgatatttatcaggtatcatgcgatttctaccacgtatcgcgtgatactcgcgaggtatcatgtgaaacctgtcaggtatcagacgatttcaaccacgtatcgtatgatactcacgaggtatcatgcgatacctgtcatgtattagacgatttctaacacgtatcgcgtgatactcgcgaggtatcatatgatacttgtcaggtataagacaatttctaccatgtatcgcgtgatacttacgaagtatcggatgatacctaccaggtatcaggtgattcctactatatatagctgggcatcccgttgggggaggagcaccccgacacgtgcggtcggccccctgcagatgtcccttgtagatgaggacggcgacggcggcggtaggggacgagcgcggcggcggcgggggattgcgacggcggcggtggggcatggacgcggcggcggcggcgtcgtcgacgggggacgggtgcggcggcggtgggggatgggcacggcggcggcggaggcgacaggggacgggcgcagcagcgacgggggacagcgacggcggcgagtgagcaggcctggtgcgtgtatggataagaatcacgttatggaggaggagctatcccgttgggggacgatatcccgtcccctagcattcccgaaaatagaaaagggagccaaaaattccatcgcaaaggcttgaagggcgccgatggactaaaacggatggcgcggaatcaggtgatcgatcggacaaagacgacgtacaaaaatctcttcacaaaaacatcttcaattttaataatagtagtagaagtagagatagagactatgggcccacatgtctgtaagacaaatgataaaaaatagcgggacccacatgtcagtgggccccaccctcctccctatctccagcaactcctcattcggtcattccccttctcccccttcttgccggtagcttcctcctctggctacttcttctcgccagcggtggcaccggctgctgtgaggaggcggcggcagcgtcggctgctgcaaggaggaggcggcgtcgaaggcctcgatagcctggttggaagccttcacgccctcgaagtctgctgccatggcacgctaggcgctgaggatgggttcggcggcggtggccggttagcaagggaactcaaagagggagtaaggagggccgggaggaagctcgaggagggagcggggcagctgtgtcaggagccttgatggcctcgaggtcggcggtcattgagcgctcgccgctgaggatggggttcgcagcagtgactatggcgcgctcggcctccatgctcggccgctattgtcctcgttggcggcagccggttggcgagggaacccgaggaggaaggaggaagggcc

SEQ ID NO: 68858 - DNA, 3209 bp, Oryza sativa
accgccgccaccgcccatgcttttgcacggagtagagggtggagaggggggtttggagtcagctataacttaaaagagtgaattttatggtccatatagaaaaatgaaagctcggtgttgtgaaaaaatcattttaatattattcttctccaaataaatttataattgacttataattatgattatccttgctctgtgggagaacctatggactcggtctctaccctctctgtttatattatataagtcgctttgaatttttttaagtcagacttatttatgtttaactatatttatagaattttttaaatatatactgatctgcgataacaaattagtttcattaatattgaacatattttgatgatattttgtttgaaatgttacaataattttctataaacttgattaaacttaaaatagaaaaacaaataacttataatatgaaatggagacggagggagcaccacaaaattaacagctagtagctagcaaaatacaactcggtcgacagcttcggactcggtaattcatacgtatatataatcaatgtatacgatcgagccagctatagagatcccaagcacgtacgtacgcacagatcttagacgtacgcgatgcctgctgcatccgatcttgggcgggacgtcgttgttgtacctccagccggcatcatggacgacgatgatgaaagcacctggtcaccatggccggatctccagccggagctggcaggcatggtgttctgccggctgctgtcccacggcgaccgcctccgcttccgagccgtgtgccgccggtggcgcctcgccgcgtggcagcagcaccctctgccgccggcgctcccctggcttaacttggacggccgcatcacctaccagagtctccccgacggcgaggtgcaccgcatccccgtccccgacgagctccaagctggaggcacggtcgtctgccgcggctcgttcgatggctggctcctctacgaccgcagcgagcagctggagtgcttcctgatgaacccaatctccaaggccaggattgatctgccctaccactggcactgcgacgacgacgacgacgccatcctccccgactacggggaggagaaagagggacaacgaaccatgtgcttcggcgagaacgccgtgcggaagatcgccgtgtgctcgcctgatctcgtcgccgccgtcatcgccggctctggcgttttcttctaccggccgggaatgcactcaacctggctgtttgcctccggcggcccctgcttcgcgcgcgacatagcctactacaatggcaagctctactccattagcagtgacggggagcttttcgttcacgagttcagcgatagcatcagtgcagatatcgtgatcggcatagctcctcaagcctagagttgtcaaggctacagttggcggagcactttttacctcgtcatatcgtgcgctactggaaggctgatgatggttcgatggcggtggcatctccccatattttacaatgtacgccgttggggcgtcgacgagctgaggaaggagatcaagctggacgtgttcgaggcagatctggagaagcgcaggtggttggaggtgaaggaactaggtgaccaagctctcttcctcggcacctcctgctccagggcaattctttcatcggattatggcagctgtatattcttttcgagcttaaacataaccagattatgctctgatgggatcatcaatggcattggtgactgcgcctactgtgtgtatgacatgaagaacgacacattcagatttgataatccggtgtccataaaaagggaggggttgtcttatgggtcggatggaagatggagagctgactggttcttcccatgtgagtgaccttttttttttttaaagatgcgcgtgagtacatgcttgtattgtatatatcttggcccgtggcatctttaaaatttgtatgacaaaatatagcacatctattatgtaccccctccacataataaatattatgcaccccttccttccacgtcaatcaaagcgttcgcacgtcgggcagactccgatcaattgatcaaatccacctgctgacttcccccatgctatctctttttaggtccttctcgtagaaatggcgtaataacatgatgaccaaagtacacctgctgacttcccccatgctatctctttttaggtccgtctcgtagaaatggcgtaataacatgatgaccaaagtaggaacataactgctttatcatagtaacaatgttaaaatatagtcacgatatcatggttattgcaagaaaacacccgcccaaaagttgaaatactgcaaaatctgaaggatcgtaaagggcctttcccaccccaaaagctagccgttgaggtgaggggttcctccactaatatcttaggtcatttgcccttccacaaccaatgtggaactattcaacaaaatctagatttaaaattgaatcaggaatttttgaggttttcggggaggggattttgagaccttggcacatagatcgaccttaaagccacaccaagaacaaaagtttttgaagtggtccagccgctgccggaagtagcgcgtttcgtagtcgtaccctctcaccgcttcttcggcccccaccaccccacgtcgtagccgcgcgtggggcaccgggaagcggggcggctccctcgccatggccgacgcggtagccgcgcgcgacgacacgagcgcgcccacgtcggccgagcaggacaaggaggcggaaaaatcggagaagtcgccgcgctcgcacgctgcctccgccggcggccatcgcggcgccgccctcccgcctcgcctcggccagctgcagagaagtgagagagagagagagagagtgagagagagatgaggaagggagagaagaggggaaagagagggtgacgtggacacctggcatgtggggtccacgtgggtcccacgctgactcagcgccacgtagaccaaaaccggggtcaaaaccaccgaaggatctcgggtgaccggttttgtatagttaagagaccccacatatctggttttgaggttcgaggatgttttttaatcccgacgacaaggtgagggaccttcggtgtactttttccgttccaatgggttgtctgggaacacccaagaatttggcccatcccggcgacggacggcccaacgagaaaaaaacagcccagtcgccctaggggagtcagggt

SEQ ID NO: 68859 - DNA, 2998 bp, Oryza sativa
atagttgaacacaacgacgatgtagtgatgggacaaggaagcatgacagtagaaatttcaatatgccaagttgtccgataatagctaacccctacgtgaggatccctttcctctctcaaaccgcgctttagtaaccctgtattgctctggtagttcaagctgtacaacacggctaggtggagttagaacctttctggtgtctatccattctctgtattgacatctccttggtggttcctgggaggaaagaatagatgtaaagcaagcaaagttagtaaatgttgtgagaaaataaggattcatgtaatcaaaatattcttaacatatatgtagagttcaataatataacataacattacgtgtcgaagtccgacatacatcagcatacctaaagacgttaggcgccttagtccgacgttacatcacgagacctaaagacacgacatgccgaagtctgacattacacgacgaaacataaacacatcgataagttcgaaacgaattacaagcaaatccacatgccgacatagaacataagaactacaccacatagccagacgtggcacgacgacgcctaggacgtggtcgagtggaggtagtgccttcacccgtagggcgagctccatctgctgctgatcctgatagtcctgcctccgccgcacttggtttctccttgtctttaggataatgcttgtaggtgtgcccatgttcatcgcatttgctgcaacgcttcaccctgccagcctccgactcgtccatatcgttgcggatgcgacgagtcctcctccttccagccttgcctcggagcttcgatgggtcaggaatattgagtacttcatcgttagtctctgtgaactccccagctatgccgaacccataaatctcgccgctccatgtatgatatattgcttgcttactgaagtactgtgacacatatactgcatctggtatgccacactccgctgcggcagcaatgacatggctgcatggcctgtggagcagcttcggctttgcacaagagcaatgacatgtgccgtcggctttgagaacacactcctgcttcactctcttgcggtagatacccctgcctgccttatcttgacatagtatctcaaacctgtgctgttgggtaccttacactagagctcgatgtttcatggcctttttacgcaactcctctagctttttctgcatgaaagctccaaacaaaatgctttgttcggcatagagggaagaactgcctggaaccgatccctaaaatacctgcatgtcccatgtaaaatgaactccactatgccaactagtggcagtccacggacaccgcgcatcacctagttgtaaacttatgccaaatttgttgtcattattccatatctagcaccacctgtgtcatacgccttggcccatttctcttttggttcatgcagaatccactgagaaaatttccgaatctccaatacagttcttctaaccaatgttggactatccgttgggagaggtccaagagcttgaggagggtcagcaacggcggtcgatggagccgctgcacgctgatcactacatttggctgtcaactcatctaatctcttccaaagctcattgaattttttctcctggttctgattgcacagcctcttgaacatgttcatgagctccttgttcttgaattgcttgaagaaattagctcccatatgacgcatgcaccacctactctgtacatcttcccaaacaccggggtatcctcgttccatactcccaaactgcaactcttctatcgctcgcagaatgccagcgtgcctatcatgtatcaggcacacatttggcctcataccaacaacttttgttttaaccaatttcaggaaccagtaccagctgtcggtattctcactctcaacaaaagcaaatgccaagggcaatacctgattgttcccatctacccctattgctgttagtatctgccccgatactttcctgtcaagaatgtcccatcaatgcagagaacaggacgacagttcacgaatgccatcttgcatgcatgtagagctaagaacgccctttgcagcacactcttgctaggatgttcaattgaggggaatttcttcaattcgtaagagctcccagggtttctttcctcgataacaccaagcaggcgtggcaaattgtcatacgaggcttcgtaagttccaaatctcatctctattattttctgtttggccctccaagccttggcatagctaatagtatacttgtatgtctcttcgatgtgtcggattattgaccttggttcatatgtgagattgtcgatgacatgcgcatacatctcagatgcaacaaatgcacaagtaatgttcctgtggtatttctgaacaccagatagaaaacatgtatgcttggtaacgactgacactgtccaataatccttccatttccccttatacgcgtgcactctccagggacaaccatctttttccttaatacactgaacttcatattgcgaccggttcgacttggcaacccaaaactctctatgaagtgacactgcaaaatgttttaccgcctccttcatatcttctgctctactataaatcgctccctgaataacctcattttctttgtactcccatctcacactatcctcttcagagacgatcagcccagaaaaatcctcactagcccattctgctggattaatatccgtctcatcatctgacgaatcaccttcctctacacgctcattgtcagaatcctccctctccatttcatccacaatggcaccgacagtctccccctcgtcggccactccacctggttgaatgcccactggagctactacgcccccgtcctcttgtgcgttgacctcctccacagaagtctcgtttacttcagcacttggtccctcgccatcatccatattcatctgcacacctggatccttcgggtgaacaaacggaaccaaagctagaggccacccgcgttacaatgcattttccaaatacca

SEQ ID NO: 68860 - DNA, 21602 bp, Oryza sativa
cttctagattagtataactaaaaccctaaaaatataatgcatttattcaaacaaatttttaaaaatacacactatttaactcaatagtcacatataggatttatgaatattacctgaaatcggcgtctgaatccggcagggcttcgccccttcttctcttctcctcccctttcttctttttttttcactgaaattgaggagagaagaatgagggctgggggctgggcagcaggccttttataggcagcgaggcctgccgcccggccagagggcggcaaggggccgcctgcaaaatagccggccccgactggcttttttgcattcgggccccttgcagccccaccagagggcggcaagggttttcctgcaaaaaaaccctccctccgtcaccgcccgttcctcccccgtttgccacgtcagcttgccgccccagaggtgggcggcagggtctatttttgtaatttttttggccgatagattatttctgtaaatatttttttaaaaaaatctaaaaccgaaaaaaattctgcaggcgatggccaccacgcatcggcatcgacgcatcgcgccgcctcgcgtctcgggctctcggcgtcgtcgctgcgcgcgaccgcgccggctcgccgcctcccgcccctgagagtggagacaggggcaggcgacgcgacgcgacgcgacgccgccattctgcccccgccaccccgcgcgccggcgccgggtcccctgggctctccgcctcaggcctcagcgcctcgctcgccttcgactccctgtccctctccagctctcttgctgccctgagtgcaacggtatagctctactgctctagtctctactctagagtttagtctttagtttttcatttcttgctgccctgtgcactagtgcgtagtcagtacagtagtgctagtgcttccctgttcttctagttagcgaagaagatattataaaaaaaatgaggactcagagagtacataagaagaaatagtgtattgtaatcttctacatatctatgtaagatgtttgaattatttatgttgtaaactttcgttacttcaaacttaaatgttggttttaagcaatttgtgatgctgtgagatttactgctatatttgaattgaatttgtgacaatgtggtaatttggagcgtcaagtaggaccacccaacaaattgttcgtggagccgccactgccaagcacccaccttttcatcccaacctagtttccaccgtggggctgggcacccagctggggcgccaaattggagttttgacatgccttaaatcgtgtaagggttcagaattcggatctggaaaacgtcagtgtttggctgtttgcaacacgcaacgcagggttcttgctgtagtacagagtaacgaacttagtttttttaatctaatctgtgttcttccccctgaagagagacaagtgaacgattgtcggaagactttgtaccagaaccactacactaaaaaggactgattgtgactatgttcacaggctttagtgtacagctaatgaaataattgtaccttgtacggtatcaagctaagagcaagtttaatagtatagccaattacgggctccaaatcatctatagctaatctaatagccattcatacaatagttaactataaaaatatattacaccattaatacccggtcccacctctcatacaaacataacgtcttggagtctgtgttgcagctagctacaaatctatagcccgctttcttctctctcttctcttttcttctcgatatgtggttatagctggcttatagcctgctattgtacctgctctaatgtgtttacggaatcatgcaacattgtgatatcttctgcctctagcagcaaacaacctgcacaatgtttttaagcatccttttaattcatagcaaacaacctgcacaagtttctcggcatccttcaattcagggaagcagcattgaaaaaattggtttgatccgttaattcatgaacagcagggcacattctagtttcgtatgaaaatggtagttttttctttcgtctgctttgcgtttctgcttctcttagaattcttttacttttgtattatgcctccgaatatcatttagaaatgatttctgatgttgatgtttgtcatgcctattgttacttattgagttaactaattgctcgaatgagtttatacatcagcattttttatttatttatgcagctctaaccacaagtctggaacatttctccaggtgacctctgtgagtctgggagcaggtaaattaagtaaacatgatatatttgttctctaaaactgttctctgatacaggtatactgcttggatattcttggcagcaatatcaccatctccccagttttcagtcaatggggttggatttacggatgagcctttctcttttcctcaacatttatatctcctctctaattttcttgatcgtattccatgtcatattttttggcccgtggtatcctggccttgtttctcgtatggcagaggaaaagtcagatatgcttattataatccaagattgtgcagtaagtttcttggtatcaataattatatgagtgttctgtattttcacctaatcttgtttagttaccttttcagctgtcccttatccatgtttctgcattttgtgccttgttgcaggttaaagtatagcttgctctgtactttacagccactgacccgctgtggtaacaagacgtcgtctcaagagataaatctattaatcgtagaactgctagctggattgtgttctctctgtgggaaaaaaaaacatgaggacaattcacttatttcaaagctatcacgtatgcataagtttaaagagcagatttgttcatcctggtttgtctctgctagtgattaccctcttctatctgaacgggcaatttatggagaagttagtacgcttcaccttttgcgtttctattgctgttttttttaaagttaattcctatcttttatgtttgatccagttagcttctaatggatcctgatgttccaatgatatttcacgtgtctactcattatgggctacatgcattggtctttacatagccagttgtggagcggtccatcgggtgtgccaaccatctgaacacatccacctgataattctctattggtgtgtgttatgagaattcagaagtcaaagatatgggttctgtcataatgagaaagcaacacctgatattggaaaagggaactaaattcaccatttgtttatctaactgggcactatatatacgaactaaaaggaaatcccatgttcacatggtgtaattgtattacatccaaaaaatagtagaaactaaaagtctccttggtttgttcagattttttttaaactcagttttcgtatcttttgtttcatttgagttgcttatagatgggctctaacggtgggtatgaaaaaatgaagaaacagctgaaaccagattttgagggtactctgggtatgctgatgaaactctaccttttgctatcgcacttgatgcaatgtacttatacggttttggagtttccgtattgatattagtgtactccacaaagatggtgatttttttccttttcccgcagacatccaaatccgtcctcgttttcatatgaacggcatcttttcttccctttctagtatgccttccagccacctgcttggtataaacttgaacatgtagcattggtgaaacccgagtttctgagctcaggaaatatcatggacgacagtgtcttattgttcttggaaaccatgataagtgttactcattgctaattttgtgcagtcccatcatggtttacaacgttttcttaccatgtattccttgccatttgctgacatgttttatttgttatgctaatgatgttttggcatggaatttcccacgatatttcaaagacactactgcgggttgatctatcaaaaaataggactgataaaatcataattgttttgagcagattggttcactgcacacattcatgaggtatatatgtcataaaagttggctgggtgagtgatttctacctcagaagatcatgaattatttagccttaaagcttcctgattggtggtgggtttttggccttgatcaagcacttcatgttgacattgatatctggagttcaagtctttttcagagcgtcagaagaaggtaattacattgtgccatcttttaaggtgttagcaaattaattttgtggcctatgctatggtgtacatttctgaatttgatgattcagttcttctggagaaaatgtaatttgattccagtacaccagcaacattactctacacattgttgtcatgagcaaaaagttgtgcaaaattccatgtgaagtttgctgcgtggggatttttcttagtgactgatactagtgagttttgcaggttgaacaacaagaagtgaagaggtttgtcactacgatggtgctgttctgcccttttggcaagaagttggaagagtggtgtcttcaggacatcctttgttgcttttttggtgttccttctgcagtcctggaactgatatttatatgtgcccacaattggtgataaatgacactacttatctagataaagagtcctgttgttagctccacaatctctttagctaaagagacaagaatgctatagtagtatgaaactgtcaagtttctcgctttactgttgttttgtggctgtaccacgaagactcttgtgtacaagcagaaactccaaaagtttcttgcactagaacatctgggagaacaagaacacccaaagggagaaggctttaaactgagaagtagccaaacctctactcgcactccggaaggctacatccagtcaccattttgcagcctcagaaatggcatccatcaaagtcgaaaccgcagaagaagctatggtacgggacaacggacttgatgtcgttcaaggcattggtgctgaaaccacgggccctgaacaactcttgcatctttctcgaacctggctgaaggcagaacatccgaccaaccctggccatatggagaaaaatggcgccgccatggtgagcgaagccgacgaggcgaggtggactgaaaagctgaatcgacgcgcgtagcgtccatgccatggcaccggcaccggcacctgccgtctccctcacccacacgttcagcacgaggtcatcagtagatgcgaatcctagcccacccccctccgccgccatcagcagcgcggcgcgtcgagcgtatctccgggctcggtgcggcggcggcggcgactccagcacagtcaacttctcctcgtccatgtcatactctagtggggaggaaaagcttccttcccacaaggacgcaggccttggtatcaatctgatccttctccttgtgcagaatctcatcgctccagccatcggtgtaggaagagtacatcctgagagagctgtaggagtccatcgtgcgagtgcatgcggcgacgaccagaaatggtcccccgtggcagtgaagatgatcgttatggcactccaaaaggccacacatcacggccgccgtccagtactgcgtctcgacggggaagggaaatccatcgatccactgctcctcttcttcttcttcttccaccattggatcccagactacgaatcgctcctcctcgtcggagcaaaccctcacgtagaagaggaccaggccgtgtcggctgtcaaccgctgatgcgaggtcgtatatgtcgggactcgccctgaatgttgtcgtcatgtggacgaatcttgcgatctccattggctttccgggttcatcctcgttgatgaagtagccaagcataggaggtggatcatggaacttgcggaggaggcggatgaagcaggggtcgccgaggatcgcatgccattgcttgcaaaccagctggagtcgggcgaacagggctgggtcctccggtggggggcgaaggagaatctcggtcaccatatcttcattgagcacatcgacgagtccgcagcggctgcttgaggccgtggtgttgatgatggcgtcgccggcggagctcaagttgaggccgtcacttgggagctcatcatgagcattgccgaccggagagaggtcgacgatgtccttgtcgccaccgccggccacggcgtctgacccgaacctccacccgccgaacaagctggggctctcaatccacggaatccacgacggcggcggctcgtatggcgtcgccttgccggtgaggccatcgtgatcgaggacgccgtggccgttggggaaggggacgatgtagctgccgcctaaaacactagatcaccggcatacctagcgtttaagatttgtaaacaaagataataggagccgaagtcaatcccttaaaacactcctccccgaacctcctcctgtatctactattggttgactgaaaataaaccaaaagcaagggtggttgcacatcttctgaaaagaaaagggctcggtatcgagtcatctactaaaaaggaccctccccgctgtgcgcccctccttgaattattcggtcatgcaatactttttttaatacaaagaacaaaatgcatttcgacctggagccggcctcctcctgatcctggacgaggcggccaccgatcccgctgctctcggcgagggaggtggaggtcgtcgtcgtccccgccgccgccagcaccagcgccgcgccgggaccggtggtcatcatgttgccgacaatggcggtgcccccgctgtcggagtcggcggtgtcgccgccgattaggccatcgatgggccgtggctcgaacggggtggggaggtggcgggggccgttgggatcagccatcgtcgcgaggcgtgatttgaaaggggcgaggcgtggtttggtggtgggggagagaaggtctcagagagagcaaggggcccgtcttaaatagacgggaggtaacttgctcggtaagccagcctccaccgccgttgctggctgccgtgctcggcctcggcgatgagaagcttgaagctttttctcgccgatgccaacggccatgtggcgattaaacaggaaggtgactcgccgagtgctcttctcggtttattgggccagaggcttttcggcccaacagaagtgtggaccttttgtacttgtgaaaaagtttaccctttgatccttatcccttaaccgtaaaaccatgcaggttttaaggacgattttcgctgacatggcatccatgcagcaatctaattatcagataattaagaaaatagagtggacctgtttgtaagtgactcccctcttctctcatctatcctctccaatccgcattcttctcgacgtcctgtaggtcctacgctggcgtcagccatcttgcgatgcgccacccacgtgtccttgtcgaagtttaagataatcgagcacactatcacagaagaggaattgaacacacagtagaaatctactctagcaattaaacgtgtaatcaaaatctgctcctgcaaccgaacgtgcagtcgaaacctgctcctgcaatcgaacacggcaagagggcgatcatggacttcattgctgtcaagaataggagggagagaggccccatgggaggatggatagagggaggaagaaagagtgagagtgtggatgacacacatgtttcaggccactgacatgtgggcaccacataatattccttgatgacatagcatttttaaccatgtcaacgtaccacgtcaccaataccactatcaatactatcttatgaatcattttgtaccggttttaatagttgaggtattcgttatatccggttttatggttgagggatatgaattagattgacctataatttaagggagccaaattggaatttttagttttactctcaacaaaatgagacccacaattagattaccggaaataaaagggccagctatcaaaaacttcaaagcaattacaaatcgggcgcccgatttgtttctcaaaaattgggcgttgtttcatttaggggtgaaaacggagcggattcggacgataatggtcataccatatcctaaaccatatattttaagcgggtgcggatagtgtacggatgcggatacggagcagattgtttcggatgtcgaaaatggtgcggaatcagttcggtaacggattaaatttatcggatgttacgtgtgtacgcaatcgatacaacatcgagttagcaatgcaaggaacaataatacaataatcaataaacgacccatcgtaataattatgtgcttaagtgttaatcaacatgaatatatgatgcccataatataaaagtacagctacgacagtgtgacatgagacagtgaaagcctcagactaagaaatctaggttaactgatgaattaggcaattggatgaaccaacttatgtaagatgcaatagatagagtggttacatgtgttgataatttcggattatctggcaaacagcctatcggataatctgatagaaatgtcggataatccgtattcgctggattttagagataccatatcctcatccgtatccgcattgtactatccgcatccgcatccatatccgccatatttctaaagcacataccatatcctcatttcggacggattcggagcggaacgaatcgatccgttttcacccctagttccactagtcgaataaaaatgtttcacctattagatcgaaaatgtttcaatcccttaaaatgttgaaacacatttgaaataagactgaatcattttggtgcaacatatgaaacatcgaatatccccctactgaaacaccaacaaataaatatcaaccaaggacaaagatatgaaacaccatcaaaatcccatcgcaacatttcaatccaatacaaaagaacatcaaattacaatatataaacaacagtttcaaatatattgaaacatgaaacacatctgagtatatcaaaaaaataatgaaacaccatcgaaaaacccattgcatcatttcaatctggctaatgaaacataatggtgcatgggctgaaacatcaaaaaattcaagagaaaaacctagatctatctcttcctccgctctagtggttagctaccacatgaactgggatgctgtcacgcccagaaatttagctcaaatttccagactattttatgtattaaatccctgtccaggatcaggcagggtacataaaacgacaagtaatatacagttccaaatgcaaataaaagcgtaaatacttacagaagagacacttaatcctcacaccgaaacgaaagcaacagcagcggaaaaaggcgatcctagcggggcttcagctccactccataggcaaaactcaattggggtctgagccttggtcttctaacttcgtcttcagctcagaagcactacacttctgaaaagggggaataatagcaaggctgagtacaaccaccgtactcagcaagccacaccaacgatgcagacgtgcaagaggaacacaaggacggtttgtggctattgcataaaggcggttgtaaaacattttattgagcaaaacagtaaaattgttgagtaattaaagtaacattaaatctcaactgatcaacgctacaccacgttgaacaggcccaatgtggacccccgtttttataacaggaatcaatcgtgtaacagtaccatttccctggatcaagtagtctggtacatacgagttcatagctgaaataccaaatacacatacacgagagtctagtgcgaattattacatcataagcccgcaggcatagtcttagatcatcggactgagcggtccggaatacattccaaaagcagaagtagataaggcagcggagttaaggcagcggcacgccattgccacaggcaacgaccgtaactaagacctactgagcgccatcgtcttcatcaccctcctggtaatagtcatagggatcctccgaagcttcatctccggcctctgattaagtttatatattgcaagggtgagtaccaaccgtactcagcaagccaccacagcaacaatgcacatgataggggtattcaaaggatggctatggttcttttgcgcaaagtaagttttgtaattcttttcacaagcctaagacctagcatagactaatcaaattttagtaccagtgttcacattaaacaacgacggttctatccaccatccattgtgatcccaagaatagcttctggccattgagtcgtcatggtttttctgaggacgtccatcttccctcctctcaggaaatggctccatcagtatagaaatcatcatgcactatcccatcccacacatgttaagaatttagagtctagccaagtgtaatacatgtcccggtgctcaataaccgcgagcacggctattcgaatagatttggtttactcacactacagtggatgtacactttacccgcactccgcaactgcccaacacatgagcctcgtcccaacacatgagacgtgtcacggcaaagctttttgataacctcgcattggcagtacccgctccatgaactttacatcctcatgcactctaggcgtacacggtttctagcagtgagaggagttctggcgcacccgggaaggaaagactcacacatgcattaagttataagtatgtttagattctcacatggcagtcctgccgatggcgacaccactgtagacacccgcctcgcggtcctaccaatggctgctccaccgtagagcccctgcctcacacatcaagaaaccattatgcatggatactgcctccgctcagctatctactccgctaggtctatacccatacgagaagtgcggttgtacggggatcgtttcatgcttaacttcatggctcggtccttaattaaccggggacggcactagccttttccggacaccacccaaatcctccgtccgctccagtcgaaaacagttgtttaatttttatttctcctttcataaatcatgtcatcaacatcatggcaatgtggcgctcatgtctccacatgccgcatctcaattaccttcccaaaggtaattgcccaagcatatagcatttgataaatatgagtatgcatgattctaaaatagcatttctaagcaattgtcataattgactagggactcatacgtaaacatggttacgaaggcataagggtaaacaataatcaaggcatggcataatcacaagtaggatgttcataattgcatgcaattttatttgtaaacaaaataatttcgcaattgggatcgacatgttcaaggaatagtgatgacttgccttgctcgtagtcctgcgggtcttgatccttgctcggatccgcaaccccctcgggctctaaaattacgtgcgaagaaatgatttgaattcaattagaattcaaataaaatccaataaactcaaataaaagtcgaacgcgaatcgatctgcctatatcgactacaaagtttgcgaaaccacgttattccaattttagtgtcattcaacctaagttatttcgtgatttagaagtacactcctgaggattcaacataattatttagctcttaataaatctaaactcctaccgcgaattgattacttatagagattaccaaaaataatctataattatattaagttttgcaattctacgactataattaatctataattaaattctaattattctaaattttctaaacctccttattctctctctaattttctatttatttttccttttctttttctctctgttttttttctcttctttctttctttcttcttttctttttcctctccttttttttctttctcttcctcccggcttctttcttcctccctctctcggcttctcctcacctctctctctctcggctcacggcctacccgggcggcgacggcgaccggacgcgaggggagggcggcggcttaccgacggcggcggcggcgacggcgccgcaaggcgtggtgtcgcccggcgcggcacacggcgcggtgcggcggtaccgagggcgtcgacgcggcggcacaaaggcggcggcgcagtggagagggtagagaggaggaggagggaatggagtggggagaataggggaggtggggtttttatagggagagagggaagagggggccggttaatggcgacgcgacagcggcgcacagagctcggaacgacggcgacgcgcggcgacgcgacggcgcggggcgcaaggcggcgaggggacgggcgcgcggcgacgggacgggcgacgcgacgacggaacagggctcgaggcgacggcggcacgcgcggcgcggcagcgggatggtgacggcgacggcgcagcagcggcggctcggcgacgcgacggcggacggcgcggtgtggggcgcaaggcgcgagcgcgtggcacgaggcggcgacgggacgatggcgacggcgacggcgtgcggcaacgcgcgacaggcaagaggcgcggcgcggggcgcgaggcggccagccgcgcgcggcagaggagggggcaaggctagggaatcccatcgagcacctagagtgcaatgaatagtgtattttcctatttatccctattttagcctatttcctatataaattttattctataaatcctaatttttgcataaatgaagtgtactcaatatttgtgttattctaaccaatagatacaccctagattaatattacccatattataattttatataatttatttgaatctttaattagggctaactcttattccaacgcacttaaatttaaatttaattgatactaatatggtcgcgataatatttttatttatttctatcctcacctaatctttattttaaattgtattccaactatttatttagccaaattaattttagggtttattcctaattagttactctttattcgcgattaatgaactccgaaatcaaaatccaatgaaataggcaataaaatcggcatgatgcaatttatttaaaaagtttttgaaaatccgtatttttagagttttgattttgttggtcgaattttcagggtgttacacccaaccaacccacctgaactacagtgcattgggtcgatttattaagtgtgagactaatcacggtgaatctggtcgaccgcccataaccgcgggcacggctattcgaatagttttactctgatcagaggtgtacaactgtacccacaagacacagccccacgacatgtttccgtgcgctgacatgccaccacgacataccggaaagaggccgtgaaaggacccttcgcataaccccctctaaccaagcacaccacacctcaggtttaacccccactcctcgcaaggcagcgggcagtcccctctcgtgcctaggtgaatccggaagccgcataggccatcgcagggcccatccaaactccatcacgcccacccttgcctagatgcgtaagctagaggaaagctacactacaagcccagccgttgcccacgctggcttgtggtaagcacgataaattcttccagggtttcccacgaaccggtccttaattgccatgggcacgactagcaaaaccatgcacccacagcccaccatgtagtcgcattttagttggataattacgaccatgaagcatggccagatgtctcgagcacgcagctcattctgatactaaaaagggtctaatactgtaattatcccatcaactgagctagtggtaattaagcatggctaagcatatagttttagctaggtcacataagtaacatgagctagtcgatttattacccaaggttgacaaaggacagatatcaagtaaatatggcacaagcaaacagataggtaatacccagatcccatgtaattagcaagacatgcaattttatttgcaaacgataaaacatttgtaaattaggatcaaaattctgggaatgtgtgactgtaacgtcccgccttcccccaggccgggcccacttacatatgatagctttcataggtcgtaacatgagctagtcgatttattacccaaggttgacaaaggacagatatcaagtaaatatggcacaagcaaacagataggtaatacccagatcccatgtaattagcaagacatgcaattttatttgcaaacgataaaacatttgtaaattaggatcaaaattctgggaatgtgtgactgtaacgtcccgccttcccccaggccgggcccacttacatctgatagctttcataggtcatagactgccctcacagaccaacacatgtcttttctgcacactttgtcctcactcgtgtgcacccgggaagaataattcttcccggtcggtcacccatcccaaattgcaccaggccaagcacgcttaaccctggagttctttggagattggcttccggaaaagaagttgcaacttgttgatataagtattctattaatcctattaagccctaggccgggatgttacaccctcacccccttaagagagatcgacgcccccgtcgatcaaccctaggccaggaacgtcctctcttggccacgtccatgtgtccaactgcgacacacgcgcccgtgaaaccgcgagagtcggctctgataccattttgtaacgtcccgccttcccccaggccgggcccgcttacatctgatagctttcataggtcatagactgccctcacaggccaacacatgtcttttctacacactttgtcctcactcgtgtgcacccgagaagaatttcccggtcggtcacccatcccaaattgctccaggccaagcacgcttaaccctgaagttctttggagattggcttccggaaaagaagttgcaacttgttgatataagtattctattaatcctattaagccctaggccgggatgttacagtgacttgccttgcttcttcacaacaaccttccgaactctgatcctcatgaaagcgatcttccgaaacgacgagagctacacgctcgcacgtaaaacgagaaaaaactctaataaaaaccaataaaacagtacattaaaagtaaacaaacatgtagagcttaattttatatgaattttgcaagttgagtggcccaattcagagttcgaatgaattagatatgaattttagaagttttgagccatttaaatgaatttctagaattattatttatttattgcgcaattataaattattttctcagaggaaaagggggatgctgacgtcatcaaaggggccggcgctgacaggcgggccccatgcgtcagcgggccaaggggagggtgcacggtggaccacgtccaccgcggcctcgggcgcgccgtggaccaggaccacgccggcccacgggcggccacagggcaaggcgggcgcggccgagaccggccggccgagcggcgacggcggcctagccggatggccaccggcggcggcggcgcaacgcgggcgaccagcgaaggggagatagagggagagggagggatgctcaccaagctcgcgcaacggcgaggagacaacgggaacgcggcggcgatggactcctcggggaggcacggcaacggcgggactccggcgacgtccggcgaaggaggagcggctggggcacaacacagtctgggagagaggatagaggggttaggaagggaggaggaggcgcggtaccgaggggaattgcggccggaggcggcaatggcggaggtggctcgggtacgtggtgaaggggtggtttcggtggtggcgaggagaaaggaagcggtggccgggcttgggattgctgcggtgaagccggtggtgacggtgacacagtgcggcggcggttccagccacggggaacgacggccggagctcgcaaaggcgatggcggctcgggttgacagaggggagggcggctcggtgggggattggaggaacgaggcggtggccggtgctcggcttggagcggtgaagccgatggcgcaagcggagcgccgcggcgacggccagggctccggtggcgcgcagccggagtcggtggaggcggtggagagaggtggtgcgcgtggcggcggtgcttcggagacggggaggggaaatggagcggatgccggggtgcggtggggcgctgcgatgctataggtggcagcggcgcagtgcgggggcgacggaagcggcgacggcgcgcggctggagggtcgccggcgtgcggcggcgcacgggaacggcgtggggagctcgagagagcacgcgggagggggcgatgagttggggaaacggatgaggggaggccggggtgcatttttataggccccggagagggagatcgtggccgaggtgggcggcaaccgccggcggagggagctccggcgacgtgggcgagtgaggctcgaacggcgccgatttttggggaaaataggggagaacgtggaggaaggggaggacgtggggtggaccacgtccacacgcgcgcgggagcggggagacgcgcggaggaggcggcgtcgtggggcggctcgggcgtccatggcggcggttggagccggaggaaggggatgggcctgacgggtggggccgtgggtcccacctatcagccaaaggaagagaggggaagccgggtgggggttttctggactttgggggagaggggagccgagctggccgagcggcccaaagaggagaggggagggaggcggcccggccggaggggaaaggaggaaggaggggaatgggccgaaagcggcccaaagggagaagagggaattttatttgcttttctttttaattaattgattacatgatctttgtgctattaaaattattttttgagctccgaaaattcatgcgaaaatttcggagaatatttagggcacaaagagtattgcaaaatattctcggccaatgatttttaaaggaaaaattttaaattctcccattatttcacttgattgaattgacttaacttttatttaatttctaaaaaatatattatttaatgatttttaatcccgaaagaaaatcggggcgttacagatgccgctgtggatgaggaggtggcaccgacgtaccctagaatcactaccacgtgctcatgtggcaaatctgcaccgtggtcgtcgatgcagaccaagctcagccacaaccgcgtggctgccgttgtcgatgccgtgccgagctcggccatgtcagccacaactgcgccgccgccatcgtcaacgccgcgaagctcggccgcgtccatagaagagggagcgagagaagcgaggaagagggagagcgagataagaaacgagtggctgagaatgaggagcgcccgatatttttatttttatcgggcactcaggtaggaactttttcccataaacctgttttgggctgaaagcccatatgtgttttgcaggaaaaatagtactctattttctgggggaaaaagtacaccgaaggtccctcaacttgtcatcgagttacaaaatcgtcccgcaaaaccagttatccagcgtccctcatctatcaaaaccggttacaataggtccttcggtgtgtttgaccccggttttgacttacgtgacggctgagtcagcgtgggacctacgtgggccccacatgtcatgctgccacatcaccctcctctctctctcttttcccctcttatctcccttcctcatctctctctctcccttctctgacagccgccggtgggaggatgagggtgtcggcggccggcgaggggcgacgcggcggcagtgatgacggcgacgagcgacgcggcggcgatgggggagaaactgcaagtgggcggcgaggaggagcggcgcgcgggcggcgaggatcagcgcgcgggctcccccgccagccgccgcccaccgcccacgaggcccacgaggcagaggaggaggcggcgagcggcacggcggcgacgacacggcaaattacagaggatatcaccaaggtccatataaacaagataatcaccaggcaaattactgctgctgctgctacttcaccatttgtgcatttcctcttctactatcttagctgcagctcgcacgctttgagtacgtgcattgttcaactgccatttctctcctcaattcaaaaaaaatatattcacctttttctcattcgagctaaaccatttcgatcaatggaattcggacgatctccagcccttctactcctcgttggtaagtccgagaaactttcaggccggttaactttaggctgttagcacacatcttcttcattcttcaacaatggcgtgtctcaatgcagggttcctatggtcacagctgcagttcggcgctgaggcagccggcacgacggtcttcacgctgtgcaacaactgcacctacaccgtctggccgaccaccttgtccggaaacacagcggtcgggggccatcgggggcggcgacttcaagctatcgcccggcgccaacgtctcattcccagccccggatggttggtccgaccgcttatgggcgcgcacggactgtgcaccctccggcaccgcgtcccttgcctgcgccacggggtacttcggcggcgccgtgagctgctccctcggcggcgcgccgcccgtcaccctcgccgagttcacgctgggcggcgccgacgggaaggacttctacgacgtgagcctcgtgggcggcggccgacgggggagtccgcgcgccgctcctccccccgccgcacgcgctctgctcctcgccgcccctccccgccgcccacccgcagcttctccccccaccgctgccgcgtcgcccctcgccggccgccaacgccctcctcctcccgccggctgagtcagagaagggagagagagatgaggagagagacaagagtggaaaagagagggagagaggaggctgatgtggcagcttgacatgtggggcccacgtgggtcccacgctgactcagctaccatctaggacaaaaccagggtcaaaactaccaaaagacctattgtagttttaatagttgagggaccttcagtgtactttttccattttctgggtcactcagcgagaatgaaagcccacctaattggtcaggctggtctctttcctttcatccgatcagtcacgcggcgttgccaacttgccgtccacgagagcaagcaaagcaacttcaaagcttctcgccgcggcagccacggccgccggagtccggacgctgtcgtgcggagcacgccaccctcatctctctctctctctctctctctctctctctctctctctctctctcactgacacctccatccccaccacggccccagttcaattcaaatcacaccgcctcgcccccctccaccgacatggccgatcccaacggccaccaccgctgcctcctcgccggtgccccagggtcgcctcaacttggcctccgccccgcctcgtcggtctccactgcgacgagcgcgtcgtccgctacgacgaccgccgccgccgacttcgctcccagcagccgcgacattcccttgctccccatcggccagtttcctcaggaccacgtcaacttgggctccgcctccgccgccggcgacgccatgatcaactccgccggcgctcccgctggagctcaccagtacatgaccaacccatacgccggcgacgccatgatcaactcctccgcgctcgctggtgctcacccgcacatggtcaacccaccaccgtacgccggcgcttcttcctcgcgactccccactgcttccgccgagtggaacatggattggctgcacgacgcgatggcagaacagcagcagccaccgcccccgccgcagtggcaggagcagagtgtcttctccccccccaccgcctacagcttcatcccctctccatcactccatctggttcacgctccatacccatcttcgccccctccaccttttccacgatccccaccatccgacgggagttcatgccggtgccgtgtcaagttccagccccacacgcgccgccattccccgcaacctatcagtatcccggcgctcttcccgccgccaccacccacaccatgagggactcctcgccgatcggaacatggataccggcatcaatgggagatcgcaagacgatgatgtgcgtgaaattcaatccgcacgggtggtgcaacgaaggggatgggtgtcaattcgctcaccacgaggacgagcaacgaattgtgccggggaggaggggcagccgctggtggcatcggtgcaataagttcgcgaccagaaaatggtgcaagtacgggcgcaactgcaggtattcccatggccatgggcgccatggcggcgtataggccggaggagcagcgccatgggaggatgagtccttcgtcttagcagcagcagttaccacgcgcgcggaggaaacacgtcaggttagagtctggatcatatggctgaatccatccgaatcatttggttcaaatgcttgcttctgttgtggaccttgtggtcagatgaaccactgcgtttttttttttctgtttgtgatttgatttgagtcctgaatccatccgaatctgagttcgacgaagcacaagtgctgtttgtttctgttttggtcagatgggacatggattttctacacctaggtgccatggcatctatcatttgcatgtaactcaaatagttatagaaaaaattaaaaaaatttagtaacatcgtttgtgatgatacaagtctatacacaaacatacatgactaaatttgatctacaactagagaaacaaaaataataaaatcagacagtgaatagtacgtacagtgcagataaaatttgttatttttgtttcttcatatatcgatcgaatttagacttgcatgtttgcatagtgtcttatattattatggactatcttataaaattttataaaatttttatataaatgtttgggtgtagaaaatactttctgtggtcagatgaaccaatgtgtttttgttgtcacttgtcagggtctagtcttagtctaggggaagaagacttgattagaacccatgcatttgatttgattctgagtcctaataaacttgatgcctcgatgatatcgttgattgttctggtatctggtttcgatctggggttattacaacattgcttgcttccttgctctggatttgggaatgtggtgtgtactatgtcgctgtttggcttgctctggaagtctggattcggtttggtaacgttgatgcattgagatattgttatgatatctggattcgattggggagaatgtatattggttcattgctcgcttcggaacgtacatatacatgccgctgccttctgcgctgtacgacgcggccagttcatgatctcgacgaggagcacgactaagttattggtcggtcagaactatgggtcatctgcttttcttagtttggggcatttagattttgattcattttgatcaagcctgcattgtccttgtgttttgggttgctgtagcctgtaaactgatgagagacagacatgtagctgaccttgttctgttgtagactgtcatttctattaatggaaatggagggctatgcctttgcttaaaaaaaagagtagctatattcatggtattatattttcagaattgctaaagctctgtcgacagaaaatcctacctcaaatcttgcaaattttggatcattggacgtgcttcacgattcgtgctcttcttctccaactccggcgaccacctcttcttctccggcgccggcgaacccaaactccagtagagggccgacgaattagggtcccggggtgaggtgggggtgtggggggaggggga

SEQ ID NO: 68861 - DNA, 6385 bp, Oryza sativa
  unsure (1)..(6385): unsure at all n locations
gggggccggccgggggggcctcgccggcgcctttgacaccattcggccagctggcgaggccgggcggcggcgcgctagggcggcggcggctgtggtggaggcgctgaggagcggcggcgcgtgaggaatcgggagagagaggagaaaggatttttagggtttggttgcctgcacgaatcttaaagcaatcgggtggtctaaaatttacaagatttgtgagagggttttctgtcaaatgatctatagacattcccttatattttttaccaaaaaatagtcagcatgtatttacattgtaagtctgtaaattacatatgtaattttagtatgtttataatgtaaataccaaaaattacatatgtaggttcaaaattatatgtgtaattagtatataattacagtgtaagtataatgtaatcatggtgtaactaacatgtatactaattacccatactcaaatttgtttatacgtactcctatatctttctactatattaaggccctgtttgcatccggagggctattaaatagccctccgaaatcttactatttagaaatattaaacatagattatcgacaaaacccatttcataactcctaggctattttgcgagacgaatctaacgagatatattaatccatgatttgttacagtgatgctacagtaatcatccgctaatcatggattaatatacatcattagatttgtctcgtaaaatagcctagaggttatgaaataggttttgtcggtaatctacgtttaatactcctaaatagcaatatttcggagagctatttaatagcccgaatatccaaacaaggcctaaataggtggttcctgtttacgctaatcaccgacagcctacgcgcgtaatactgctgcacgaatctcaatggagcatcaatggtagaaaatctgactgaggttgtgttcagttcagtgcaaagtttggattttaattgaaattgaagatgatgtgactgaaaagttgtatgtgtatgacatgttgatatgatggaaaaggactgaagtttagatctaaattttgaatctaaacacagcctgagattaggaacaaaatatggcacaacaagtttagcaaattcgaaaaaaaaaatgtagctgactttgctgaaattatgcacgagtagttaaatactgtgcataatttcagagtttatggttaagtagaaactgaagaatggctcatggttcttcaccgtcagagcttttcattgcttaattctccatttaattaccacggccgccggcgccatggtaccgcagacgccgtcgacatgagatgcgggctcactggaggcacacgacattggctagattgacttggacaccgagacgtgtgtcgtgtcgtgtcagcgcgcgcggtacgtacgcccgttcactcaacgggcgtgcgtaggcgtagcgccattctttgcaaggaaaaagtacaccaaaggttcctcaacttgtcatcggaaaaagtacaccaaatattctcgaacaacaaaaccaaaatatgatgtcccttaactatataaaaccggtctcccgagatccttcggtggttttaactccggttttattctacgtgacggctgagtcagcataggacccacatgtcaggtgtccacgtcagcctcctttccctctttcccctcttctctcccttcctcatctctctctctctccctcccttcgtcatcttcgtcaatgtcgcggcgaacccgcggctcggcgaggccgtgctccgacaggtcggcacgtcgactgcgatggtggatcggctggtggagatgctcacctggaacggcaccgtactctgaactggcgccagcccatacccctcagcttcatgccccctgagcaccacatcgacgtcgctcttctcgccgccgtcaccaagatggtacacatgcacctcatccacacaggtcttggtagccaccgtgtacggcctctgcggcatgcagcgggcgtggttgacctcgccattgtgcggcaccgagcgggagatggacacaagcggggtcgggacggcgccgctcgccgccgaggctgccgccgccaggcagggtggaagcgggagggtggcgtcggcgagcaggaggtggttggcacgtctcgtcggaggtgtgggttccgaggatgaggcggtaggagagggtggagtccggtgaccgggagtgggaggggagccactggacggtgagcgatggccactcgagcggctgggagatgacgaggtcatagagcaccagcgcgttcttcttccagttttggtgctcctccatctcctccgcggacgacctcgtcgccgggggtggcggtgacgttgaggaggttgaagatagagacggcggaggcgtagagcggtggggaggagcggaacacgaggtaggcatcgcagggccccgcagtggcggcagaggtgacttcgtactcctgctgcgcccaaggcagctgctgatggccctcgcccgcgccacgccgcgatggcaaggaggacgaggaggaggtgacctcgtactcctgctgcacctgcgctgcgatggtgaggaggacgaggaggagcatggcgccgccatctcggattcgccgtagtgtctccgccatcggcgaggtcagcggccgccgccaccacttagcctcgccgccagctgcctccccgctggccgctgtctagccactgacatcgtttttgccgcgccgccatcgacaagatttaacgcgagagcttcgcatgacgcctgccgtttcggcccatttgagccaatgctatttcgggcgggcggcggtgccgccggccgccggacctcctctccccttcccccggtggcctccttcccacagcgctgcctgttgccggcctgagaaaagtgaaagagagagaaatggagaagagggggaaataagagaggggttatgaagtggcatcctgacatgtggggctcaggtgggtcccacgctgactcagctgtcacatagaccaaaaccagggtcaaaaccgccgaaggacctcgggtgaccggttatgtatagttaagggaccccgtatatctggttttgcggttcgaggacgattttgtatcccaatgacaagttgagggaccttcggtgtactttttccttcctgcaaacaacgcagcctcaatcgacttcggctacaaatattgggatcacgcgggaaggcccattatactcttcccagcccatgagcttttatcgggcccaacaccgcatcctacctagggttatcagaagggcgccgcatataagaccgaggtcccaagctcgcgccgccgccgccgaaccgagccgcttcttctccagaccttggagctcgccgtcagggagggagaggaaggacagaggtgagcggcgcgccgccgcgatgagggccaaggtgagtgactcctcctcctcaactctcacgttggatggatcttgttttgattttgtgggtgttctcttatttgtgtatgtatgtatggttctcgctggttagcaaacaagtttactactagtaaaatcttatccgttccgttgtggacatggggtcaatcgaagcatttatctgagaggattaccgtgttaaaatgttgtttgattgagtgattgtataccttttttttttccggattggtttggcatgatgaggaaatcaatcgtttctaactgatccactggatgagaaattcctcctactcattctgaatgctaaaattttctttcataattccgtgatttgtgtccagttttgcggtcattttgattaagcacgccttgccttatgtgagatgctgcgaaaaaaaaactgtctctgttatgccctgatggcctgatctaagatatgagcagccagagttttctgtgtaccgactgcattttgggggatttcgtgtttccttgcaagtttttgcttctgtttagctaaaattctttgctctggtacgcagtggaagaagaagaggatgaggcggctcaagaggaagcgccgaaagatgaggcagagatccaagtaatcccataggcgatcgactgatggaggaggagaaagcgtctttggctctcactgctgtcatctcatctatttaagttgtttagtttcctttagtaagagagaaaaaaaactaatcaatgtacttctcttgatctttgtcatgggagtaattgattgtactggacagcaatgtttccataattctattacctggagttatctgtcagcaattctcattgtgtctcttctctgtaagagaagctgttcatctgcgattgtgattgtggagatctgaatttttttgcttctttccagtaatccagtgacagtttgcgtcttgattattttgcattctgtcggagtctctaagatagcttgtttttgtcattttgaattggtattcagtttcggataccattcagagattgcgaaaaatgcattcagatagcttgtctttgcggttgcgaatcggtattcagtctctagatagtttgcagctttacacttttctacacacgtaaactttaaacttttgaactaaacacaacttcaaacttttgaactaaacacagcctcagatggcttgtagattgcggttgtgaattggcattctgtttcaggcagcgctcgcagtgggagtaatctcgattttggcattctgctggttgttctattgcatttctagtgctctgtccactgtatatgatgttacctgtttgcagtatattgaaatctgcaagcaagtggatattattcacaaattctcactcactcaaaacaaattccctgaacctcctgaaatctggagtggacattaatatttcgaattacttgttgcagcgtggattcgccagcttatcaaatgaacacagattttatacactggtgtaattagtttaattgattacagcgctgcctcagattttgcacgcacagatcaccagttcactactccctccgtcccacaatataagggattttgagtttttgcttgtaacgtttgaccactcgtcttatttacttttttttaaatataaaaaacaaaaagttgtgcttaaagtattatatataataaagtaagtcacaaataaaataaataataatttcaaaattttttgaataagacaagtggtcaaacattgcaaacgaaaactcataatctcttatattaggggatggagggagtacttcagttcatcatctagaaaaagcacctcggtagcttgtacgtcaacgacacaggaaggcgtattccatgttcccgtcaacgagatcatcaagacgaggaaaattggaaaagaatccctctcctcctcctcgtaaccgacacgcccccgaaatcttgcgccgtttcgatgggggaagcngaggcttcctcctcctcttcctcgcggaagatttcaaatccctcctccacttctccaacgccttcgccaactggaaaccccgaattccccgccgcctccccacccgcgccgcaaacccctaaaccctagccgccacctccacggcggcggccgccgtagccatggatttctactccgacgactccgacccggacatcgacgaggacctgcagagggacctggacgcgctgcgccaatcctgcatcctctccgggaacgaccccgacgcggcggtcgcgcaggtctccgcctgcctcgccgccccgccggcggcggcggcgggagcggaggtgaatggcttgtctgatgacgacgacgaggaggaggacgaggatttggccctcgtccgcagcatacgtgagaatctcctcctcaacaaggcctcgccgtcctcgcccctgccgcgcccgatctgcgcctggccgccctccgactcggaggacgacgaggacgacctcgagacgctccgcgcgatacagcgccggttctcgcactaccactccggtgagttgattcgctctccctttgtttgttcgcggcatatgctctaagataggttccatgtggtgtgctaatcgatttatacattaggacaggaataggatgattttgtatgatacgacctgggaatccgaataactgggataaacttgcaaggtacttgactctttgatcaaaacataaattacccaattcaactcgtcttctataaaatatgctcttgcatcggtatataatgtttttatgggttctctagggtttatacttccttaattgttgtagctgtagaagaaatttaagctatgtaacacacttgctacatatggtgttatcttcatcagaccttacttctaaaacatggaatagaatctgtgcaaactatatttgttccttagagccaccaatataatatatataattgaagaaataatatgatgtaactaagtctctgacgtatagatatatagtaagtaa

SEQ ID NO: 68862 - DNA, 937 bp, Oryza sativa
attcctgcagcccttcaagtcaaaaataaaataatctaaatatcatacaacagaataagcggtgaatcacatcgcattaccatgacgccaccgttgttggccagaggctgaggatactgccacctctgctgcttatcatggaagtactgtagcccgtgctggtgttaaggttgccaaggacatcgagaaggcaaaggaaggcaggtcggtgaggttagaggaggcctgatccggtggtccctgacctataagcgcccagatttgatcgcctagctagcgatgggaacggaagggagaggaggaggccaccatctcccaccagggcgatcgcccctgatgtctaggcggttgggtgggaggggaagggagagagggaggccaccatcatcagccaggttagtcgccccaggcgtctaggcgggcagatatggtggccttgccaccagtgagggggagacaggtggaggccaacatccccgttgttgtcacagtgacaacatttgccaggctgaccaccattgtgccaccttcgtggcttcgttctcccgagcggcctccgttgcctctctaaatggtgaccaggagatagaagagataacaaggaagaagggaaagatcaggaggaccacggagagtttgacgggaggcaaatgtggctggaataatccatttattacgagccaatagacttaagaatctgttccatttcgatcggtttgggctctaattatcggtgccggtttacctacaaacgcaacattgatgagtacccattagtgcctgttcttggtcgaattgtggttgttgttaagtagaaaaaccctaacagtgttgttttttttccaatcgatggtgataaggcggtaccaatcaatgtgttgtacactccgctgcactgatactgcagaagaatctttggcttgtctttgtatcgaaa

SEQ ID NO: 68863 - DNA, 23523 bp, Oryza sativa
ctcattcagtccccccgtggatcatactgcttaatgcatgccaagtcttatcatgcatgcatattcttttgggcatactctcatccccgcttcaaaataaaactcaacatgcctgggcaagtctttagccagattatagatcacgtcctatgtttagattagattattttggaacggagaagtagcgcccaacctacctatataattactctgtttcaaaacaaacaaacaaaattagtacgaaacatgcatggcgatatatattgtatatatactaaaattttaagttgagttgagatggtttcttgctaaatggaagctaaaattttgatattggccggttatgtgcctattagaatgtgttacttctccttctcgtaacaattccaattgtgatattcttatacgtacgctatatatatttacaatgaagctactatattcaaccttgtattttttccacccaaaataaacaaacataatatatatggaatgtgacattgttcactaggatgtgtcattcgtttatttattttgagatagagggagtattatcctgctataatgtttggaagtgcatggtggagtcagctctccggccggactgtgcataagtcaccacccgggcgggctcgatgctatatattgtgcccactctccaaagacgccgaaaacaaaacgtgagtagatattgtcccactctcccactgttcgggctccatgcatgccaggcattcatcttggatccaccacttctatttacctgaccatgcacaagcttataattaattgtgctgacaatgtgcttcaggtgacgtaattgactaatacgaaaaattcagacgacttataaatagcgaaatttaattagctatatgcatgtgttaagttggcgcaaaaacgagcttgcgcgtaacaagcacgacgaccatacttagttgaaagagagtacaagcttaattaggaagatagtgcaaattaagagacacacaaacatgccatatatatatgtacaagtgatgaaattgagtttcagccccttacatcggggcaattgcttagggtgttctcaactacacattttaatttctactccttcgtttttctcgctcacgctttctaaattgttaaacaatatgattttttttcaaaaaaaagtaaaatttttattttcaaaaataatatttatccattttaagttttttggcttatatttaattaatcatgtgttaatatgtcattctattttatcagatgaaaggttcctaaacccctaaggccttgttcggttaattcttttgtatgaaattattttccctcaaatcccttccaacctctttcaactggaggattaaccgaacaaggcctaagtgaacaacgcctaatatttatacaaccaagtgtaattaattgcagtgtacaatatagacctctgagtatagtaagagatttactctatttatatatgatgtacactgccgtgtaggctcatgtcaaggtggtcttatactattgcacatgccttgactgggtgtccatattttcgcagcgttaggatgcaacccacttgtaaaaagagggaggtgggggggggggcacaacttggacatgacgatcggtaatagaggctcaatgatctgatagtgatcgatggtagtggctttcactgtgataggcagacataatcgatggtagtaggctcacttataaatggatttgtgggttagccactctatatccctaaacgactaaacatggagtcgttgtcccagtatagtggctcatgttcttggttatgtggcattagttaatgatcttaccggacgagcgtggaaagtgataatatggcttagagaggtttgagctaaaggcgcccccatccctaccgatgaggcaggctgatcaagggcatgaagtaaaagacgaagtgtagctccgtcacccttctataaggatcctggaatggagggttgggtcactaaagatctttccctccatgttgctctaacggaagagactcaaacccctctgatgtgaatttgggggttccgattcatttaggagttagcctccatattcatgtggtatatcttaacatcttttcttttgggtggccttgcatgttttggttcttctatcaggaatacactatgactctctttagggaattaagattttgttaaacatttggttggtagccaacttccgagaatttagaaaagttaagtctttcgatttctagcttctagttttattttaagattttatagctataaattcttagaatctggatgagaatctaaactgttaggaagcggagatttggaaaaagctatggctagaaactccttcaaacaagacctaaagctctgtccatcgaggtgatgccggagggagtttcctcttatcgcaaatcacacctttcaattccaaatcatgcctttgtacgatgggtaaagggcttaagaaaaaagccaaaaaatttattacataaataaatattgatagaaaatgtatactcttcccattgtactatttcacatattgtggtgtgtactcctatctttaattctcctgtgcaatgcactactaccacattttcaaggagtaatgtgatggaaaaattgaaaatttgaagaaaaaatttagaactaaacttggaatttagataaatacattttcaggtagcccctacctagctatagtactactcatatactagctcgtccaatgcactactaccaccttggttggctctattaaaggccaagcccactagacgcattctgtcacgtctctctagtgttactgcgtaacgtaggtggccgctgccggccatgtcgtcgtcgtccgctgccgcgctgggctccgacgacggctgctcgccggcggagctgcggccgagccggtacgagtcgcagaagcgccgggactggcagaccttcacgcagtacctcgccgcgcaccgcccgccgctcgagctccgccgctgcagcggcgcccacgtcctcgagttcctccgctacctcgaccgcttcggcaagacgcgcgtccacgagccgccgtgcccgtcgtacggcggccgctcgccgtccgccgccggcccggtcgccgccgccgccgccgcatgccagtgcccgctgagccaggagtggggcagcctcgacgcgctagtcaggcgcctccgcgccgcatacgacgagcgtcacgaccgagccggggagccagacagccgtagcgggcgccggcgcggtcgccaccgacagtacctcctcctcctccgccgccgccgccaaccccttcgccgcgcgcgccgtgaggctgtacctgcgcgacgtccgcgacgcgcaggccatggcgcgcggcatctcctatcacaagaagaagaagcgcaggggcggcaacatgaacggcgcccgcggcggcgccggcggcggcgcgcgcgcgggcgtgaacgacggcgatgcgacggcgccgccggtggcggtgaccccggggctacctctgccgccgctgccaccgtgcctcaacggtgtgccgttcgagtactgcgacttcgggagcgtcctcgggggagcacatggcgcccatggcggccatggcggcggcggcggcggcttctacggcgccggcgtctacttgccatttctgtacaacaccttcagttagttagctagctagctagttcgtcgtgtatttgtctgtgcttctcactgtggttgcttcagtgtactagctagctacatgtgtgatgtgtctgcatcttgtgatcatcttgatctgtgctttgatgctgatcgatccagcatatccgtacgtgttcgttccgttgcttcggatcttaattaactaatttaattgtgctaattaattttgttagttttggtgatggatgtcgattgcgttatgttcgtgcatgatctgattaataacatgcatgtgttacggtatttaaaccaggctgaaatcgctaaatgagggtgaacctcccaagaactaaggaatatgttgagaaatataaggtctataagcctcggacacaaatagaagatccacggttttgatttatttcacaaaatatcatattgtccaattcttcatcttattctgggtgtccggagagaagcaatatatttcccaactttttttaaaaaaacttttttctttgcactcttgcgaaaaaaaacttactacaaatgaatgaacatttaggtttcttactatacaaaattactgtgtaatggcaaagatggcatgaatctccttaattaaggcttttcccgctgtcccgctcccgtaggccgcaacaactctccggaagcgattttttagtttttttttctgaactttttaaatttttaattttaaaaataaacccttttaaaacttatttccactatctgaacaatttggctaaaacaatactagcattattttgtcacaccggtttgattggcgtgataacgttatttagtcacaccaccatagctgcatggctggattaaacatccacacccgctatttgtaacgcgtcagtattgttttgctacatggcaaaaaaaatttagattctgaaaataaactagttttgtaagggtctattattaaaattaaaaaatttaaaagttaaaaaaaatcgtcagaagcttccggcaaaaagaaccttctccttcgttttcgcaagtaaaatgggcctgtttctccatttacgccggcccaaaagcccattcgtattcagaaaacaaaaacatttgcggcgcgcgggcaccgaaatgctggtgcaggtgctccgccgcatcgcgcagagcggcagcgtcgtcgtcatgacccatgaccatccaccagcccagcggccgcatcctcaacatcctcgaccgcctcctcttcctctcccgcggccgcaccgtacgtctactccggcacgccgtcggggctcaagaccttcttctccgtcttcgccgcgcccgtcccggacaacgagaacccagccgagagttcgccctcgacaccatcggtgagctcgagcaccacagcacgacggcgccgccatgctcgtcgaattcaactccaagtggcaatcatcgctcggcgctttcctcatcgatgccgacgtacgcgaacccgccgtacgtggaggtgtgggtgctgatcaagagggcgttcaccaacacgaggcgaatgccggagctgttggtgatgcggctccgcacgatcacggtgacggggttcatcctggcaaccatcttctggcgcctcgatcgacgacacgcccaagggagtccaggagcggctgggcttcttatttcgccatggcgatgtcgacgacgttctacgtctgcgccgacgcgctgccggtgttcgtccaggagcgccacatccacatccgggatcgagacagcccacaacgcctaccgccgcctctcctacgtgatcgccaacaccgccgtcgcgttcccgccgctggtgtccctgtcgctggcgttcgcggcgaccacgttcttcgccgtcggtctctccggtggcggtgctgcttctcccgtggcgtcgagatgttcgacggcacgccgatcgtcgggttgtcgaaggccgtgaagatgtcggtgatggacgccaatcaggcgtacgctcggcaccactttgacggcggacacctgcgtggtgaccgcgccgacgtgctggcgcagcaggctgggatggatatcggcaggtggaagtgcctgctggtcaccgtggcgtttggtttctttttccgttttctgttttatattgtcctgctctttgggagcaaaaacaagaggcgctagctaaaccttcgggtgtgtgtatgtatgtaatatttcaattttgaagattttgtattcatatagctgaaaaccgtgttcaattataattatctgattagatttgatgacaaaaaactcaaggaaaggtttaaattcagacgtatgtagtgaacacgattttttatgtcctacaacaaattttacaacggtattaatacattgttctatcattttgtccacctattgttcaccagtatataaagacgaaaaaagatgtttatactgtagcaaatcccatagcaccggaccaataaatctcgcaactgatatgccgttttcataattattagtggagtcaggggcggatctatccattagaaagggtgagtcgatcgatccaattatacgacatgtgttgccctacacctctaaaacccccctatcctcttataatagtcatgaaaaattatgtataacaaggtctgaacgtctaacagatcaagtctattttttcacaatgcacgcaagccacagacaataattgagacaattatgcgattgaactataaatacgatatgtgttgtgttctattgctcttatcaagtaaacatctccgttctccaccccacgtatattttaaagctgcgtccgtcagtcctagagggctagaccgctagaccgcagcagtgtgcaggagacgttcacggtgcatccgacccggtggccgtagttcgatcgatcggttgcggtgcgccgccgcacacacgacacgagcggccgggcaagcgtgcgtacgtggcctgtgtcgtgggccccacgaaatcccacttcagccaggaatttgaatatctttgctctcatctgcgttgggcccaccaaatcccacttgctgggaggctgggaccactagtgtagttggttgggaccactgccagatcgtgtgccagatggattccgtgggacccactatgcattcaaaggtgcttggagaaccctacgatgacgtggcaggtcattccgactatataaaccccccgtgagagttcaagcagcccccgtttcttccacctctcctctccttctccccacctcgcttcgccctcctcttgctctttgcatccacacgccgacacgcgcgcgaggagatttttcatctcgccgatcggatcgagtcgagtagctagcggagagaggtgagcgtattttgatcgatcgcgctgtgtgtgttctggttttgattttggtcgatcaaaatggtggtggtgcttcgttttcgtgaatcgtgatcgatttttgaatgtgatccatggcgtgttttctgtgctgattttgcgtttgatgcgtgtggttttggtgctcgatctgtgtgtgtttgagcagcatggcggactcggaggatggagatcacgttgcgacgacgacgacggagcagcgctacgacgacgacgggcacctcgtccccagcagcggcggccaggaggaggagggatccggcggccgcgacgtcgtcgtccccggcggccacgtcgctgaggattaccgctctggcgttggcgtccccgtcggccgagacgcaggcggcgccacctcctccccgccgcagccagtccacgtcaccccgagcatcctcgtcggcagcatccacgcgccggtcttccagggcgagctcgtcggcatgaagttcggggtcgggtcaggctccatgggtgccggcaccagcgcgaccaggcgccttcccgcgaccggttttggtgctctgccgaccagcagcatggcggaggatagtgccgaccacgccgacgacgaccacctcgccgaggaggaggaggaggaggaggaggagcactactcgacgacgggcccctcgtccccagcagcggcggccaggaggaggagggatccggcggccgccacgtcttcgtccccggcggccacgatggtgaggaggaccaccccgacgacctcgtcgccgacctcgacctcgacctactcgtcgacggcgtagtcggccctgtccccggtggccacctcaacgcagatgcccccgccttcgtccccaccacccgtgggcgccaggacctctattccgccctctcctcatccgcccccgccgccggttaccggtaccgccactacatcacctcgtccgcgctcgcagaagccggccacgtgtccccattcctcggtctcccgtacgccacggccttcgattctccgctcgaccgcgagttggtcggcccgtcgtcagcgccgccgccgtgctccgccgctagccgtgcctggttagtgcgctgttcctcaccgctctccgactccgagtggactcggcgttcgatcctggcgcgagaggctgcacacacaccggcctccaccgtcactgggcgtgggcggttcgagttcgtgcccattcccggcgcaccctatgctccgccgccgtcattcgcccccatcgccgccggagctggaccagcagcgcgaccgctacagcagctggcattcggactggaggaacacaagacgaagctgtgcgcggaatattattcccgtgggcttggttgtcctcgtggcaacacatgcaagtacgcccatggagaagatgacctgcgtttggtggtggcggtgagctctctagccgacgccggtgagggctcctcgtcctcggtgagtttaattgatttcgtcttcaatatatatataactgattgattcgatctaccacgcaatacctagtcatcttgtcctcatgcatccagatttaatttactatacagagtcgatgcagatttcatttttggttttgaacttttgatcatatatgcattcgtttgcctttgcaggattcgtccttcgccgctttgggaggggaagacaagtacaagacgaagctatgcaagacgttcacgagtggtggattatgcctgtttgcagccaactgcaggttcgcgcatggggaggtggagcttgggaagaaggagccgtgctggtatttcttctccggtcagacctgcccccgcggtgacacctgtggtttccggcattcctactaggccattgtcttcgcatcgatcagttacatttatcccaccaatagcaaagcgcaaggaatgggagcagtagattgatcgattacctttgcgtgcacgagatacatagatagttctgatgcttgtttgttccatctcgttcagtgtatatccgatccctgtgtcgaacaacacatttacaaactgcatttctacctatcctagctacagcattgctcgggtaacaccatgaggttttcgtctacttagtacttgttaaatgtcttctttcttcaatgtaagaaagctttgtacatgcatgacttcattgagatactccctccgtattttaatgtatgacgccgttgacttttcgaccaacgtttgattattcgttttatttaaaatttgtgtgtaaatatgaaaatgtttatatcatgcttaaagaacatttgatgacgaatcaagtcataataaaataaatgataattacataaatttttgaataagacgaatggtcaaacgttggacaaaaagttaacggcgtcatacattaaaatatggagatagtatgttgcatgcctgcctaatcactgcatggaggttttgtctacctaattatccactgtctgcgcacctgacatgttaatttctgcttctggatatgcctagtacttttccccccaaacttactctgttttggatcacaactcaggggatgggtcaagcattgtactatttttgttctggaatgggaagttaaaagtttggtgcttaaattaaagccctagcttgctgtcatcctagagttgtccacgccgggtgaatgctaattaaaggtgaaaagggtttcccgttgacccagacgatttccgaaaacagagtgtatactgtatagtattggattcggaaagtatgttcctatgaattcttgtcttagtgtcggttccttccttcagtagtagtgaggtgcggtactaaatctggtaccgtgcctggaatgtcacgtggaagggtgacaccataattttgtattggcatatcagttgaatgtgctttgagtgggtgcatcctgggagtggacataaccatttgagtgacatgcaaataacgaggggacattccttcgagggattaaaatagtttcccggtgtatccttccaaatttcgaaccctaggtcccccgtgactgcgtgacaccgaggtcgtacaccgccgtgatcctcgcccgctgttatcctccgtgccagggttacggataaggcatactctctatcctacgacttatggaatatactgataagatataccttcacgtatacggttcgtttccgtgtatgccattaggaattcgcctcaagtcaagttatatctctacaaagttaaaggaattgcagaagtcctactcggaaagggtaaaatctctaatatatcgtgttggtttacatatctccaagtcttacttaagggtcaaggtatcccacatgtcacgccccgaactagtcccgaccggaactagcccgtgacgctccaaattaacctgttaatcgataccagtcccagaaaacagtgctggtatcacaggaagacagaatatcacagcaacagaggtctctttattatagagtaggagtacagtcatgttgggctgcggacagatcccgagctcacaactgcattacaaaagggaagtggaagccaagacttggaccaaacatcacaggcgcgacttgggaactaggccgaaaccctaaaactcatcgtagccggcttgctcctggaagaactcctcgtcagcgggatccgcttcatcttcttcagcaactggggggggttatttatatagagcaagggtgagtacaggagtactcagcaagccatgggaaataagtgtttaatgtaggcttcaaagaaaggctgttgtttttgcgattgattttatttaaactcttttctgaaacaactaagggagtgcttctcaaacgacacggatgagacagtgcgtctcgtccggtcggagtatgtgcaatgtttcagtcttttgaattgatcaagattggcacccggccaacagctttcaaacagccagccgggcctggctgatcccatcagccgcagattttccaaacatcaaacccattccacaacagcaaatttcacaaggcagtagtcaaacaaaactacgctaggaattacctcacatccgcccatgaccgtgggcacggctgttcgaacagttttaataacctctgcagagggggtacactttacccacacgacattactaacccggatcatccagcccgtgcagaacggccacgactagagaccttaaggcttttatgacaaggcatttcgaaagccgacacaggttcaccatatgccaacgagaggggtcccagtccaacaccagattaggtcccagaccatactatgcccccgacaccaccccggcgaatccacatgtctcttagcatcatggctcccccgataagctagttactcagccaggggtgtcccattccacccatgtggtcgtacttgtcttatgttcggatgaaattccaaggaaacggtccttaagtgcaagagcgggaaaccgtacacccggtacgttccccggtccgcggttttggaaattcatttagttcgcaagcaccgacccaggtgtcgggttttccaagtcttttgtaaaacccaagttttacccaagatgtttctcagattttaagtttgaaggcgaccgtcgatacccgtgcagagtgcacgattaccgaggcgcaactaggtgggtacaagggaacatggtataacaattacaatggaagggtcaaatgcaacaaattaggtaggtccgccaatctgccttgcagacgggacaagcagattaagtgcgatcctatcaatgcataatatttttcaagcaacataattaagttcaaatataggctcaagatgttcaaaggtggcttgcctcgctcgagatcttgagcttgatcctcgaaatcctcgcactgcgggtcttcgggctccgaaactacacgcgaaacgggacaactcagcaaacggtgaaaaaaacggggaagattgggtggggaaaaggaagggagggcgcctgggtttatagggcggcgatgtcggtttggaaaccgaccttgggcggtcaagggagggagctcgcgctcggcggtcgcggccaaagcggcgacaggggaggggaaggatgacgccggcgggagggaaaagggaaaaagggggagagaaagggggcttgccccttgccactttgggaaaaggaggacgaagagagggtgacgcgggagagggaggaggagctcagcctccatcccttggagggacgcgcggggagaggcggggccgtgtcgatgacaacggcgatgacggcggaccggtttggagtggagcggcaacacgggcggtagacgcggggcaggcgcggcaggcgctgacggcggcggcgactggccggtcagccaccacggcacgcgcgcgcgcgggcggcgcggcgatttgggcggcatcggcgggaaaggcagcgagagcgggagggagggctcggcgcggctcacgacagagcggggagagagagagagagaaagagagagagagagagcaggggagggaaggggagatgggccgagagggattcggcccatcgaactcgatggaggctaaatagacttttgcggagggatttgatttgggaaggatttggattcgggattgaacttggcaatagatcggggatttgagatctgagatggcacggacactagacaacaagcaaagaaacggatttcgcaaatagggtttttaagagatagtttttccgctaggcgccacgacggaacgggcgctacaccacgatataaaagggacctctagggagaggtaaagggcatcgcatctcatcgccaacacacccaccaaagtttacgaagccggagtccacggagccaactcgtcgggagatctcgtcgaacccctcgactatgatctcatcggcattgtctgttcggttactctctttgtaatctgttctcatcatcattaatcccatataaactagactagggctattacctgataaggggcctgaaccagtataatccttgtcttttgtttgttttgatatcgtactacgtagatccctgttccaacatactctaataccctattcttccggtccgcgagtatcactcgtcgacactccactacgctacagtcgcacaagctctccttgggtatgctatcctcgctgccactcatcctcttctatcaccacgactttcatccgctgtcatggccacttcatagttcggaggatggaaaagatggattcctagaggtgggatgaatcgtgcaaagaggtttgagtacgtgaaggcgaatacgatgttggcttcaatgaggtcagaggcaaactgacgtcgatgctggccacacgacaacgaggtcctgtgtcgcctgggacatcggcgtcggtgaacccctactaggtggggatgatttcggtggggaagagaggagccgcacacgcgacatatgcatgttgtgtgaagcccagtgctggtgaacccctactaggtggggatgattttggtgggagagagaggagccacacacgcgacagatgcgtgttgtgtgaagccccaacgtgagacaccggcgtcggtgaacgcctactaggtggggatgctttcggtgggagagagaggagccacacacggggatgatttcggtgggagagagaggagccgcacacgcgatagatgcgtgttgtgcaaagcccagcgccagtgaacccctactaggtggggatgatttcggtgggagagaaaggagccgcgcacgtgacaaatgcgtgttgtgcgaagccccaacgtgagagatgatggttgtgggggcaagacaagttcggcgctgcgcagtgcttatacgacacgtggaggaaattcagccagcgacaagttgcaacaaagagccaagcctcatcctgcccatgatgacccaacggcccgattcaatttggtaccgcaagcactaatacagacaaggtttttgcatacggctagaatgatttatctcatgcgggttggcaattatcacgagcagacgctaggcctgtatacgaaaaaaatatttttagtagtgaaggtacatgtacctcaaagtaccatttgttgtaccagaacaaaccgaccaaaattaacaacatggaccaaaatatcaccaaatagaagataaatccattttgtaagccaagagtggtaataaaaaaaaatagaagaaaacatcttcaaatgttcagccaatatatagtagctctaggccagcctcaggggtaagtaaattattgagcataagacataccaaataaagcctccaatagggtaccacgagtgaccaatggtaacgccataattaggataatgaacaaatgattcttggtagatgagacaagcatcagtatggaccatgccatcacagttgctgggtgtcacaactcgttgacaatatctgcaaaactttgtagaattcttccctacaaaacgagtagaataaatgtttccattgacagacttgacatcgcttctgttatttactataatgctgacgtaaatatctttaccatcctgcgagatatagtcaacaacacaatgaaaggtcaacatgttacccttcatgacaccaaatcttctgatgttatttatgtactcgctttcttcatagttactaaaaaatggaccaagagttgtaatgaccctatctccaatccggtacaaggagttaccaaccggacaaattcgctggcaaaggaacttggacatttgattagccaatcttcctgatgatgatttggttggttctgctattccaacgtatagctgtataatatagaaaaaacattttcaattcatcggcatattattataagagcaattttactattattgaggaggtaccatgacgtacgtactattttttctattgtaaatttaatacctcttgatatctaagtagtatgagatactaaattttccactaaatttttgatacaccctcaaggattgtaaaattgctcttattataaacatgggttttcacatcaatgtgaaattgcacccattacttgtatgcaacttgattatagttacaggaaaaaatgaaaaaaaatgttagattgaatgggatattgggattctagaagtatatacacatacacacacaaatttgcatgcctcaaatgtgatctacacgtggaggtaaaaaaatgacacagtagaacgcagtgttactgctgttcttgaagtgtacaacgaatttgtagttgcatgcttgtgtacttccttatatcatcacagtatatttttccaatagtttttcaaaattttatttaactagttataccacatgcatttatacagtgagggatgaaaacagtagagcggaaacaatatatagtttatgtattaattttatggaaatggtttcgtcatggttgggaattttccatatttcagaatttaacaatctagtgacgactttaatatgacgccaacataaattagaaaaatgtgattagaaacggaagcggttggaaacgatgtcattatattatttgtatggaaacaatgtcatttttattatttgtatggaaaggatatcggtactatcaggaatttccgtatcattgtcacccccatatacatttaggtgcatagaatgcacatgcacctaggtgctaaaaatagtttctgacataataatcatatgattctacaagacactaaacatagtagctatgaacaacaagccattcccaacctaagacactagacatagtttccataaactccacatcatcaagaaactagtactagacactactcttccaatgcaaacaccactatttcattcttaaatttaatgctacttatctcacatgatgtcttgtatgttgtgtagaaactatatcttatgtaagatatggtttcctcctcttttctcatttagtcatttgccacatcatttttcatcctatgtggcagtttatttaatgctatggacaccatccttattgggttggcaatagcctaaggtgccaagctagtcaacttctgttaaaaagagagtagctttaacaggttactgctatatttgaaattaatggtatttgaacaaacgagggaacatgctttgagagtttaaaacacttccctgtgtattcgaaagttaaaaaaaagattaaaagcagcactgttaattaaactgtgaaactcctgaaaaaaatgcatgtaattgatgtgaatgagtttggtaaatgcagtcaaattgactgaaccaccaaaaccaaaccatatacgaagtcagagtggatgcgtgcacacgtcacggcagatatatagcagatttattactgcacggagtagtaattattgagtttgaaaactgctaataatcaggtagacagataccttctggccgttgacgacgtggttatggtcggcgagggcgagggcggcgttggcggggtgcatgaaccggcgaaggcgaaccggcggggaaggccggtgaggcgatcgcggcgcagccagatgtcggcgacatccccgtagcggccgaagtggtcgcggagctccgtgtcgcccatgtccggggagacgccgccgacggacagcctcgcgctctccggtatcctcatcggcgcgcgcgacgccggcggcgaacctaggtttttcttttcgctctcctttccgacgccactatacatatatgggcggggcggtccatgtgaaatacaagttcgggccatactagctagatgggccgaaccggaattgcttccaatcgaatgtgcagtccatgttctgttggctggattgtgtccatcgcggccaggacgcatcgaactgaactgttcttgcttaaagataagacagagtaaacgttttattttaaaaaaaaactagcaaaatacacggataaattatttgttaggctaagtattgattagaaattttaatgataattaggatggataaaatcaacattgcatattgatatactcttgttctcataatactcaagatgggtgtggatgctctgacgatcaaacggcggtgagaactgtggtaggatgtgtcccacaacatggtcttgatagagagaaaaatgacaacggcgaccttcggtggtgaacagatgagcgcggcaaaacatgttctcggacgaggggattccgttttctttggccgtgtaggaagatcaaaagatggagaaaaatgattagcactgttcatcgtcttccctaactgaaacaataaaataaataggagggacgatgggcgccgatgctctggtgaccaaacggcggcgaggaaggtggccgaacgtgctccagatgtgactcatccataaatggtggcgtttggcaacaaagacaaaacaacgggaacacgaccgacaagacatggtcccaacagatagagaaatgagaatgacgagctctggttatgaacacggtcatcaatggatgagtccaatcgtggaacacatcctaccacaatactcaccaccgtttgatcgtcagagcatccacacccatcatgattattatgagaacatgggtatatcatatatttaacagtggtttttatccagcctgattatcattaaaatttataatcaatacttagcctaacaaataaaaataatttatccgtagcgaagcacgggtattttgctagcagtagttattatatatttcttaaagataagacgcatcgatcagtttgatacgaatacggaacgtcccgtacgtacgcgtctacgtgtacgcacgagttgccgtcgacgagaaaatcagatcagcagatcgaggcggccggcaaagctcgctgcttcaagcttcgtgtcacctccatctccgaccacggcagcagcagccgccgcctcggagagctgccgtgcagcgcacgctacccgccgtctatataaagaggcacctctcgtgtcctctctcctctgaacccttcgttcccatcacaaaccacgcccgcctcgatcgatcgatcgaaagctcgagatggccggcgatgacgccgatcgcaaccgccccggccgtggtcgagagtctcagcccggcggcgccacctcgtcgtcgtccccgccgggctccaacttcgatggcctcgccgcgaccacgaccggcggcgcctccaccggcgacagcagcaggatcgcaagccacctcgtcgagttggaggacaccggccggaggcggagcgccgccttcgtccccagccgccacgaccccatctacgtccccatcggccgccccaatcccttgggccccatcggccatcgggaggactactactccggctccggcagcgccaccgccttcttccccagcagccgcgaccccgtccatgtccccatcggccgcgacaccgccttacccccaatcggccatccttcccagggccgcgtcaagtcgggatcgtcatccgcctccgccggcgacgacatgatcaactcctcctccgccgccgtcagccactcaaccggcgccggtggcggtttctcctcgcgacacgcccctgcttccgacgaggcgaagaagcagcagcgtgtgatggcaataaggcggcagcagcagctacagcttgcgatggaaatctggcggcagcagcagcagcagttagcggcggcaatgtggcagcagcagcagcaggaagatgagtgttctggcagcagctgcgtgcgatgacaccctccgccagcagcagcagcagcagctcgtcgtcctcatccgctgcggtcgccgccgccgacatagctctcgcgccatcggcagaggccgggtctccgtcgtctcctacgacgccgacgacaactggagccgatcagaagaatgtcggcgacgtcgtcaaacgtcggagtccttgatcgatgatcttagcatcagttagtcaggttagcacactcgcggaaggatcggaggaaacgccagtttcgtcaggttttgtttctgttatacgttgtggtaaaatcgatgaaccactgcgtgtttttgtttgttcgggtcgatatatccgtcttgaacccatttggtttgatttgactagtacggcttaaaagacttgatgcgttgatgatattgttgaatgttgattttgtgttcttgcattctggtatctagtatatctggagaaagattggttagtaagtattgctgcttaattgcttgcctgattgtggtcagattcagattctgatcagatgaacagtgtacatttgtctgatcaaagagtaggcagtaattaacatcttactctgctaatcaatcagtagttgatatgcagtttgacattccaattcatggttgcatgcacatgaatcttgttcagccttgatggaacattggaactgaagttgtgaactacggagtatatatgaaatgtcagatattttcagttatattttttatttgtacatctgaaatttctggatttcctgcatgcagccacaccggcaccatgcatgggtacaactaaacctatctcaacaaagctgacttgttcgggctagcaattaatcagttagcgcaaaattgaaatcagaaaagtaatgtttccactgcccgccgaccgacgaagacagagaaagagagataagaggaagagagaaagagggggtatgacacgtgggtctcaccattaaaaaaaaataaaataatgactggactgccacgcgtataccacgtagaacaaaaccaccacagattaggtcgaggggggtaattcggtcaaccgcgatagttaggggtgaagaatatccagttttgtggttcagggggtaatccggtcaaccgcgatagttcgggggtttaattcgtacttttttcttagctatttgctgaaacattgtttttatatagggtaaaacaacgttcgactttttggaaaccgttgtttcatacattgtagcaaaagtttcatgaggagatttgattgtgtttcagccttttacaagattaaaacattttttatttatttagtgaaatattttcgatctacttaattaaatagcgtttgatttttgaaaaaaagaaaaagaaaaggcgcctggagggattctggtcggtggctatacgggacaagattatatcggacacgatcgatctagctaggattactactctaggagtccctgactacatgtacttagattagatcgacgaccttaattaatttggcatcagttaacaattttttcgatcctccgctatcctcatcctcgccggccgcgcattgagacatgtcgaccaccaacgacgaagctacgacgtcgtcgtcgcctccttcagaattagatgctctcgacaccgtcgccaaggcagtcggcgacgccgttcgcttcgcgttaaagatggatcctaagaccaccttcctcgcccacggcctcgccgatttcgtcgcctccgccgccgcacgcgacgcgctctcccccatcttcgccaagttggcagccgccgagccgccgccgccgcccagtacaacggcgccgatcatcgcggcgccggcgtgggcgcccctcctgcagtttgcggcgacgcaacagataatcccgatcagtgcgaggctgttcgtgttcggcgtctccaagaagcgcaccaccgagctcgacctccgccgccacttcaagcgctacgggtatgtggccgacatctggctgcgccgtcgcggcggctacgccttcgtccagttgaggacaccctcccacgccgccctcgccctcgccgataaaaacccaggtcgtcaatggccggaaggtaacgtcatcgttgcatggaaaccgttctaaacactcgggcttttcttgcatatcattatgaaaaaatttaaaattttgacatgataggttaacatgtaatatatcacttcataaacatgcaagttcaaattagacttctacaagttgtaacaaaaataataaatttgactgtgattctgtgaatatatgtatactggttagagtttaatttgttatttttgttgttacaatttgtagaagactaatttgaacttgcatatttgtgaattgatatattacatattaatctatctgtatttttttttgaaaatttttcataatcaattagttgacatgcaagaaacgagtggacgttcacccgagagattagaatccatcatcgtcgttgcactgctacatgcatgcctacgtactaggggaataaccacccgggaaagcgttttcatcctttgagccaatattattctctagtttgttacatgtcatctaaaccgttatcaataaaattgtaaagaatttacaagatagattaacatgagatatatcatgtcacaacatgctagtttaaattcgttttttataagtcataacaaaaaataactctgaatttatatatattaactagttttagtttagtttatttttttattataacttctagaagtcgattttgaacttgcatgtttgtaagtgatatctaatattaatctaccttatcaaaaattgttaattttttttataactatttaggtgacatataagaaactaatggtatgaaaatccatctccatagtaacctgaccctatgagtatacttatacgagtatagagtgaattttgcaacatcattggtcagttaattagttattaacttcagctcgataaataatactccctccatcccaaaaagaaccaattcatgcttgtccagattcatagcccgggattggttctttttgggacggagggagtactcttttgttttatgtttgacgttgttgattttttacttacatttgactattcattttattaaaaatatacaaatatgtatttgtaatggtaaaaaaaataataataaatgatgattagatatttttttcctggaaagagaatgatgtctaaaaggcaaatgcgtcaaacataagaaaatggaggtagtagctaaacttcttttttatcaaaaaaaaagtagctaaacttctgaataaagtaacaaggtgattattgtgttgattggtcctctttgttttacagaattagtcggctactttggcccttagccccttatagacatgtttctttatatgattaattaatcacatgccttaattatatattatgcagctatacattgaaatagcgcaaccaaaattaccagtagaaagaccaatggccaagtacctctgccagcgggtttgtccagttgataactcgcttgttcggattggagacagggtcctctcaacacttgcattgcttggcaattactataaagcaagtgattacattactaacctcaaaagatacggtttcatggagggtaacatgctcatgtttgacagcgttgtcgactatatatcggaggattgccaacgttgttctgtgagttccgtagtaaagaaaagtgatgccaacaagcctgcagtccactacggaaacaacatttcttctactactccttctgtaggggatgatgctactgcaaaattttgccggtactgtctacaatttgtgactcccggtgatagcagcaactgtggcgaggttgatccataatgattcgagcctcatctaccaagaatcgtttcgtcgttttaattatggtcttaaaattaatgacaagtggtttcctgttggagcctttgttggagatatgtctagtgccgaggctgaagaacttgagaatttttaccgtccattgagtatctgcaggctcaaagatgatcaaattggtaataattttcaaacctataaaggtcttaggtaaggggatcctttatatctccaattttttttaatatagtggttgatatgcttactttactgattgagagggctaaagatgtggttctataaatggtgtaattcctcatttagtggatgatggtttatctatattacaatatgcagatgatactatcatttttctagagcattatttacatcaagcaaagaatctaaaattgattttattccgtatttgaaaagctttctggtttaaaaattaattttcacaaaagtgaattattttgcttcggtcaagcagaggatcattacgatcaatattctaatatctttggttgtaagttaggctctttttctgtcaaatatcttagtattccaatgtattttagaaagcttggtacgtaacaaagactggaaggttattgaacaaagaattgagaaaaaacttagtagttggaaaggtaagcatatgtctgttggtggtagattggtgttgactaattatgtactttcaagtttagctatgtttatgattttcttttttgagataccgaaaggggtgctttaaaaaattgattattatagatctcgcttttcttggcaaggagattttcataaggaaaggtacagacttactagatgggatatcatctaccagcccaaagatcagggtttaggggttcataatttggaaatagaaaataaatgttttttggacaaatggttttttaagttaattaatgaacaaggggtttggcaagacttattgaggaggaaatatcttcataataagtctattacccaagttgataagaagcaatgtgactcatttttggtcaggtttcatgaaagttaagggtactttcttaaacatgggttcctgtat

SEQ ID NO: 68864 - DNA, 14654 bp, Oryza sativa
tccgccgagtgctacagggattggctggaatggctgcacgacaccatggcagaagagcagcagccgctgctcccagttcaattcaaatcacaccgcctcgccccctccaccgacatggccgatcccaacggccaccaccgccgcctccccgccggtgccccaggccgcctcaacttgggctccgcctccgccgacttcgcccccagcagccgcgacaccatctacgtccccgccaaccgcgacaatcccttactccccatcggccagtttcctcaggaccacgtcaagtcgggctccgcctccgccgccgtcgacatgatcaactcctccgccggcgacgacaacgccagagatttctcctcctccccgcggctggatgtgattgcagaagcacagggtgctgcatggggttgggatgctctgtgggaagacacgggattcgctcactgccttcatgatcccaagatcgtgctctgctggcgatacatgtatggaggcgacgactactgtgatttgggatgcgattgctttgacgctcacagttacaatgatctgcaatcaaagatcaggacaggcgtcgccgccgccagcagaagctattcggttcctcaccctgacctagtgagttcactgtcgaattgatttgacgccggcattattattattgtgaattgattcgatgactaattcccaattgtttttctcttttcaggatctcgacttgtccgacgtcagccagttcgctggcgttttctcctcgcagcaacaaccccctgcttccgacgagtggaactttgcagtcgggaacatgcagcagcagcagcagcagcgttcgatgacgccctccgccagcagccgcgccgctgccgctaccgacgcggacggagaggatccaccgccgccgccgccacaccctccatctccatcggcagaggggtctgcgtctcctcctacgacgccggggacaccaactactggagccgatgagaagaacgtcggcgagctcaacgacgtcgactacccgctacttctccccgacgcccccgccccagcacccgcacctgcaccggcgccgccaccgagtcacaccccgatccggcactgccgtacaacggcacctgacaggagcgtgtcgtaggaaaaacggcgcgaaccgcttcctacgaaaccgcgatctcagtatcagtcccaggacatagcgctggtacccacggtgacaaatatgaatcattgcaatccttaaaataaatagaggacttatttaccttaacttaggttgcagctcagacagcccgagaatgcaaccgacgacacggacgaggcaaacaccaacaacagcagcagcagcggaaccaacggtctaacacccaataccacattcgacggctgggaaccaggacgaaaccctaatcttcacttcacttcatcttcacttcacgacggaggaactatatatacatatatagagcaagggtgagtactttcgtactcagcaagtcacgggaatttaggtgtttaatgcaagcttggaagagtggcaaggttgttttgcaaatcttttatttgaaatccattttgaaaccactaagtgatttattccttttcaggtttgggtcgaaaagagacttgcgtctcgattcaactttaagagatgcttttcaacaactcaattgataatgtaccgacctcccgggtcagatcattacttctcggctcccagagtcagttcacttgattaatcggctcccagagcctttttcattttctcggactcccagagtccagctgcccagcagcaaagcaatccgcttcctcttgggaagcctagtctatgatgcccgcaaacatcccgaatcacacagattcatttctgaccactcaggtcatccatctgccacataggctgatctggttacgattcccatcccacaacaacttttcacaaagcacaggcaaacaaatctacacaacggaaaccacctcacatccgcccatgaccgtgggcacggctgttcgaacagttagttaacctctgcagaggggtacactttacccacaagatacgaacttattccgaacacccgtcggtatcggaggttcgcaacaaagcctttcccaagccgacccagggttacctcatgccacatagaaggatcaaatcctcacataaatataggccattttagttttcacaaatcaaactccaaccacctcaattggaaatctggcaagcttcgcgttcttgccttaccaggaacccgggttggctccaaccgaccccgccccggcgttccccaactattggcatgcgaggtttccctgaaccgactagttacttagctagggtgtcccattccaccttgtggttgcactttgttatgcttgatgaatttcccacaggaatcggtccttatatgtgaatacgggacagtgccacgcaggcacaacccccgcatcgcgagttttcacaattcattttatttttaaacacaccgacaccacaggtcgggttttcaaggcttctcaaacccatttcccaatttttcgacaatcaacagtgtatgtgggatatttggtatacgcgctcaaagagcacggataccgaagtaccacaagggtggagcgacaaggaatcagggtagtacaacctataggaattagtgcgactactgggtaggtccgtcggtttggcacgcaaactgaggccaagcaagttaagtgtgtgactataataatgcaagttgcaaacaaaataataatggttttccaattataggagcaattggtcaaagggtgacttgccttgcttaaggtcttcacggagcttcatgaatcttcgagaaaacccgcgatcggcgaaaatccggtaaccgcaactatacgcaaacaaacaaaaacctaaacaaaagaccaagaaaaagaccctatttagagtaaataatagtgccattaaatagatctcaattttacggaattactggaagttgaacggagtcaatcggaagagcggttgggaagatatgaattttggaagtttaattggaatttctggaagacgagaaatggtttatggaatttatagaaataatattctcaagaatattattgacagtcactgacgtgcgggaccaaaggaaaatgattcatggaattttggaataaagaattttatttatggaacaaaggaaaaagatttattaaatcccttggaaaattaaagggatgagggatgtgatttggacttatctcgggtggcattggtgcggcccaaagggttgaaggaggctcggccgagccattgggccgggcgctgccacggggaggcggcccaacagagggggcgcgggggagagagagacggctcggtggaccgattccaccacgcggggtcccaggtggggccctcttgtcggtgatacggcccacggtgggatgggcgcacgcaagggcagcgctagggttcggggggaaagcggtccacgcgcggcgcgcgggtggacgcggtgtgcagcgggcccacgcgcagcctgtcggctctccgtggaccgcgcgcgagggtgggggacggagggaggcggctgaccgaggtcagctttgacccggtcgcgtcgaggtggcgccgacgtggcgcctacgtggcagccacgcgggccgggcgagaggaggaagaagaacaggagctccaaccaacggtggccgacggcggggtttcaccggagcacgacgcggcgatttgatcgagagggagttcaccggtacaaaggggagcacgagaggggttgagccaacggctcggatccttcgaagaggggctgacgacgacgaatcgcggcggcgcacgccggcggcgagaaaagggggaaatggcggaggggtgacagggattcaattcaaggcggtgggagcgtgtccggggttcaagaaatccgtttccggcatcggatggggcggaggagcaccgaggagggctagcgacggcggcggcctccggaagcgggcggcaatggcggcgaggccatgccgagcggcggcgaagctcggggcagtgtctacgcgcgttcgatgggctagtagagctaccacgcaagctagagagggcgagggagaacgaggaaggagaacggagggagtcactaccgagtcgggacggcacggtgacgagtggccgacggcgcgggagtgagttctccgttctcaggccggggaaggggaagaaggggggtgctcggagtcccgcgtcacgcgtcctcgcacgcaccggcctccccggtgcttggcgacgaacggcgacggcgagagcagagcgagcaacaataatagcgcggcggtgatggaagtgaaacgagaggaggattcgatgggaggggctcgggttttataggtggccgggtgaggagcttcgaggggaaggaaccgactcgggagaggcggtcaaggagaggagctggcggtcacgcccgtggtccaggcggcgacaggcggtcacgggcggtgtcgggcaaaatggaaaaaggagggggaaaagggaactctgttcttgccgaaacggggaatgggagagggagaggagagcgcgtgaggcagagagtcgcgctgcctccacgtcttggacgcacgcgcgtacagggtgggggcgagcggcagggcggcatgggcggccagggctgacgcggcggcgaccgggcggtctgccacgcgcgggcgagcgcgtgcgcgatgcgagggcgcggcggaattcagaggcggcggcgggaatcggcgccgggaggggagagagcagagagagagagcgaagacgggagagagaaagaacgagagagcgagagagctctctctcggctcggctcggcgcgtgcaacgcacgtgcgaggctgagagaggagaaacggctgagagagggaggtgggctaaggggggaaaacggcccacaacacccgagggaggtaaaatagacttttgcagggaaagctgatttggagagaattggagtttgtatttggattcaaattcgatattcgaactcgagggttcagggaggaatcaaggaagactcaaggtagggtttgatatttttcggaattgggagcgagtatttgccgaggattcaaaggatgcgattgaatttcggaatttgatttggagatttgagttgaaggaggaatttcgaggtggaggattttgatttcgatgagagggaacaacgggattgaattgagatcctggcacgacttagactctcacacaaagaacgaaaattttcgcaattaggattttgccgaattagtttttaacgtctcacgaaaagctgagcgttacacaccgccaccgccaccgccacggccacggccacggccacggccaccgacgatgagaagccgcaaggcgcggctgtgcgagcggtggatgcaggatggggaatgcccaaatgggaacggctgtcatgacccccacggcttggaggatcagataagggtggcagtgaagaagacgaccgaccgcggacatcggtgcacggactacttgttgggacagtgcaggaatggagtcaactgcactagactccatgatgttggtccttgatcgatcataggaatggaggatcaggatcggaggaaacgcccagtttcggagtctcgatgatgatgatcttactgaatgtctgaatcagatgttttgtttctgtttgtgggtggtcagatcgatgaaccactgcgtgttttctgttgttctcaggtcgatccgtcttgaacccatttggtttgattcgactagtagtgtccgtcctgagaaaaacttgatgcattgatcatattgttgatttgtgtgcttgaattctggtttttggattccgttatttccatcaagtattgttgcttgctttcctggttgtgttcggactcagatcaggtgagtgatatatttcaatatttgtgttcatactcagatcagatgaacagtgtgtgactggtgaaagagttggttgtagtaacagcttactcggctaataattgatatgcagtttgacattccaatatatgcacatggatcttactcagctagaaaggttcataaactgttctgagaatcgtcatcacatatatgaaactactagtgcaggaacaagagaaaccttgatggaacattagttggaactgaacttgtgaattacggagtatatctcagatattttcagttagatttataagtttgtacattttctgcatgcagccacaccatgcagggtacaattaaacctatctccacaaagcagtactcagactgaaccttttgtttaaaaaaaagtagtgcaactaaatttttgttttataaaaatcgtaaaatctaaaccgagaaacctctcggtttagacttaaccagctacgggcatgcactattcagtgtattagtagcaaccaaagtgaggtcgctggatatgcctaaccagcgacgatctcgttacagtcacgtccctttctaaaacttaaatgccatggaaaaaatttctttgcactccctggaaaaatttacaaatgaatggacatttcgatctcctacaaaattactatggaaatacggaatggcccatgtggcttctctgggagcccattcgtgttcctcaagtaaaaaagaccacatctgtgataaacttactttgggccgaaagcaaatatcttttggcccactaaaccttgcttcaccttcttccttcgcccagagcaaagcaagcgcgactcgaagcttctcaaccccgagctcgccagcaacttgcaccgtggacgctgtcgtacagcgcaagctacccctcgcctatataagacagcctctttctctctctctgacggtctgaccccaccacgcgtccacgcccccatttgaaatcacacgcctcgcctcgcctcgccctccatcgagatggccgatcccaacggccgccgccgcctccccaccggtgatccagatcaagccaacgcctccccgtcccggcgagtctccgccgtcgatggcgtcaccggcggcgagggcaggcccacctactcccacttcccccccggcgcgtacgagccgacggacgtggcctacggcatccgcgacgcggccaacgacgagcgggcgcgggcgcgggctcgggctcgccatgaccagggtggcggggctcatgaccaccaccacgaccggccccggcaagaccagcgcggcgaggctcacctccacgacctccccggcgagaagagcgaggtccccgacgtcggtccatctgaccaacaggggaaggaagcctccgacaccgacatggctccattggcggcgctggcaaagagatcctacgacgtcaacttcccgccgctgcacgagcaccgcgccgcccccttccccgccccggcacccgcattcgcacccgcaccggcgggcaccatgggatcctcttccgcacaggtgcagggtgacggggctcctgacaatcacgaccacgacccacgtcacctaccccggcaagaccagagcggcggagctcaccccgacgacctccacggcgagaagaccatcggttcaggctccgatatcctcgacgactccaagagaggaatgatcaacgccggtccccaacacggccgcatcaccacctccaatggcggcagcggcagcggcagcgacaagggcaagggggtctcctacgccggggacaagcccgcatctagctcgtcgtcctccagctctgctggccagcaggggagcgacaccgacaaaactccttcggcggcggcggcgagctcctacgccggcaacttcccgccgctgctgcccgcacccgctcccgtccccgcccccgcacccgcacccgcgggcgcggcgccatgggtgttaccaatgcccaccacaagattgcgctgtgcagcaagaggaggaaggggaggtgccacaacggggcagcgtgtcgctactctcatggcgaggaggagcaacgaattgtgccggagatgagagtcggcggcgggggacgtccgtgcccggagctcgccgccgccaagggatggtgcaggtacgggctcaactgcaagtattgccatggcggcgtataggatcgaggagcagcgccatgggaggggggagtccttcatcttacaacgctcgcggaggaaacacgtcaggttagagtctggatcatatgactgaatccatccgaatcatctggtcagctgttttgcttctgttgtggtcagatgaaccactgcgttttttgttgctagatcgagtctactctagtcatgcgtttgatttgattcgactcgtgaatccatccgaatctgaattcgaccaaggaccagtacactttttgtttcttttttggtcagatgaaccactgcgagttttcgttgtcagggtctaggggaaaaagattactagaacccatgaatttgattttgagtcctaataaacttgatgcagtgatgatattgtttactgttctgttatctgctcttcatctgggggaagattgcttatgaaaattgctttctggcagctgcttgggatttgggaccagtactgtttgtttctgttctggtcagatgaaccactgcgagttttcgttgtcagggactagaactcctgaatttgatttttgagtcctagtaaacttgatgcattgatgatattgttgagctctcgatccgggggggatattgcttactaacattgcttgtttgctgggatttgggaatgtggtgtactaatatggctctgcttcctctggaatccatttgagaatgttgatgcattgatatatttatttttttttaatctgcagttggtatagttattggttgttctgatttctggattcaatctagagtagaatgttgcttacttgggaacattctttcttgtttctggtcagatcagacactgcttatcagggggtctaggagaagaagacttattagaacacatatgattgattcttaaaattttgatgttattctcaattgtggtcatgaattctgaatccaatggttaacaaaattttgatcctattggaatgataacttctgatggtgatgagaccctggtctcaatgtgctgtcactctcacctgaatctgtgcttctccacttgagctgaatctgtgtttgttctgatatctggatttgatttgggggaagattgatcactattacaaagttgcttgatatgctggcacaggaggccttgatgttagcacgcgcaggagacatgttcacgtcaggatagagtctgaattcatcttaatctgaacgaaccactgtttgtttcaggtcagatcagatcagccactgtttgttaggtggtatagggagaagaagtctgtaattagaaagcatttgatcagagtcctaaaaaaccttgatgctgtttctgaattgcggtgtgaatcctgaaaatgcaacggttaaaatcgtgatcttattggaatgatcaggctgacgagaccctgatctcaatgtgttctcactgttcatcggcggcctcactgttctaataaaatcgtcaccttattagaaccccacagtagagctaagctacgaaatacaaatcactgtataactgaatcatgtaaagcgattattgatgacaagattctcaaagtacatgcagacagaatataggagtacttcctttcatacattcactttctagctatgatcaagcttgcctaagatcgagcgctactttctactaaagagaggaaaatatctccaaatatatgttcaaccaacagcagctctggaggttgagtatgttggataagtatagattattcagcattagacacatctccaataaagcatccaacagggaaccactcatcagcaacggcaacacagtaaggataatgaacaaattattcttggtagatgagacaagcatcggtatggaccaagccgtcgcagttgccaccgggtgtcacggctcgttgacagtatccgcaaaaccttgcagaggtggtctcgcttgcaagacgagtagaagaaatgtttccatggacagccttattagcttcgtcacttttgtcaactacaaagctgaagaaaaaaactcgaccatcctgtgagatatagtcgatgacaatatcgaagatcaacattttatccttgaggacaccaaatcttctgaggttttttatatactcgctttcttcacagttgtcaggcaatggaccaacggttgcaatgtgcctgtctccaatccggtagaaggatttaccaatccaacaaactcgctggcaaaggtacttggacatttcattagcaatcctcctgatgactttgttggttgtgctactctaatgtatacctgtataatacagaaaaaaaggttttccgattaattaattaaggttaaactgttaattaggcaatactgtagtaactaggtaggctaggtacttcctctgtttcatattataagtcgtttgacttttttttctagtaaaatttctttaagtttgatcaagtttatagaaaaatatcaaaaatatattctatttttaacacaaaacaaacatattatcaaaatatattcaatgttagttttaaaaaactaatttgatattttagattttgctagtttttttcataaacttaatcaaacttaacaaaatttaattaggaaaaaaagtcaaacgcttgtattaagaaacggaacgagtacgtaccttgcggccgttgatgaagtggtccttgtcggcgagagcgcgggcggcgtgggcgggttggatgaactggacgaaggcgaaggggcggtcatggcgcagccagatgtcggccacatccccatagaccttgaagtggcggcggagctccgctttgccggtgcccggagcgacgcggcccacgaacagcctcgcgctgatctccggtgatgtcctcatcgccgatcgatcgatgcgccggtgatctgcttagtatatattggtgttttgcttctgtctcttaattaatttccatatgcctaaccttgcctccatatatataactacagagagagatgatgcgagtcgccttccgattctgtaatggtgtcgtaatacgtcgtcggtggtgtggctgatcgagcgtgtgccggactggcagctcacgcagacgtacgttcgtgagttcgtcgacgaccgggactccaagatcttgttggcttcccctccctatgatcgatctcagacatgaatccacagtgcagatgccgttcacgcagtttgttgggccttgatcatcaagcaaataatcgccagaacacggatcgagcaggtggtgtgcactgtgcagtgcagcatgtacattttggttgagcactctgtaactgaagatcatatgcagagcgtttgttgatgacaaagattctcaaagtacgtgcagacatgatatactttctttcatacagtacagaaacagaattacactatgaaaggtacgttgcaatcatgcaatgtacagatacatccagtttctatctactaggatcaagctaggtacgttgtggccgttgatgaagtggttcttgtgggtgggcttgctttgaactgaaggtgggcccggaccaacgcttcgtttgtacatcgcaatttcggcccgctgggccggctacctcatcgcccaccgtcggatcgttcgatcaccgcctgtgaatgaagtactaataaaccctaagcagccgccgcctagccgccgccgtcttggtaaggctcgcctctccgcggatgctcgcaagagaaagtaatgccgatctcccactctttttcttcccgtgtttccattcggttcgaggcttcgagcagatgtgctgttgtcttgttgatcaggtgtcttcgatgagcgcgtgcttagatcgttttttattttattttggatgagttcatgtgtcatgttaataaaatataattcgagctcaacacaaattagaattgaatcagttatcattagaaataatctataatttatcgatgtgtcatgtcaatgaagaaaatcttagactcatagttggactgatgtacataggttgataggaacttgattagcaagggttagtatgtgttatgtatgcccttgataaatcttatcagattgcacaacttgaataaatgcttgtcccaagtgaataatgtatgttctgagaaactttcccacactaagttagtggcaaaaattgtaaatatagctattactatactttgagtttcttcagtggacaatcatacaatacaagtatggatacatttcaaaattatatctttcgaagcgttttctgttttttcccctggagtttgatatcggatggcagtgatttgacattacccgcgcttctgatataatccgtgaagcaaagggaaaataatggttgaattccttaatatgagccattcattcagctatcatatttcctctaaagtattagtgtttttgtctggttgatttacttcgactgctagatttggtggttggcagtgatgatacaaactttcagcttacaatgccagttctgcttctgagaatacatgacagataaagctgatatatatctgagccttttttttccattatgtgtttgtagtcatagcatccaaatatctaatctgcccatgatgagctgcccaatgattagagggtgtagttggctcaagttcctgtttatcaggaagaacctacttgcagctgctgcattcacatgttatcaacgggtttctgaggttatagacactccttattttgctcgtccatcaaattttggtgttgtactttcagggattcttttctccattgagaagttgcataatttttgccgagtttaactatccttccgcaagttaagtttctgttttgtgtgtaggctgaaaaagctcggagattgtgtgttgacatcagcttcgtctctttatgtctgtgagatgggagttaaatgacagcacgaaattccattctctttgggtgcactggtgcagtcctccccacctacaaggatcagccaccatcactgccgctgctgcaccattgcagctttcctttctggtctgtgttttcgtgttgccttctacatgttcaatttgatttcttttcatggatcaatggtatatgattttttttcctgtgtgttttgaatcgtcctctcttgctccttaaggttggggcaccaatatctccatggtgtcaccatctttgcaagaaggggatagatcgacgcgtcaagaaatcgtttctgttgccatggctccagtaggcaatacgattgttgcttgcgtacaattttttcttgacgcagactagtttcttttcttgtgctctgctgtaaaaattctgtttatatctgttctgttcatgcacggtgctaaccccgggcttgtcggattggaatcctctgaagaatgaagccccaatgcctgtgctagatccaccatgccattcagtgttgcaggtcatgatgcttcgagctcgtgattggtctgtgtcagcgtaatggatacatttcaaaactatatctttcttagtgttttctatttttttcccttggagtttgatggctgatggcagtgatttgacattacccgcacttctgatctaatccgtgaagcaaagggaaaaataatggttgaatttcttaatatgagccgttcattcagctatcatatttcctctaaagtatttctgtttgtgttcattagatttactttgttagatttggtggtttggcaatgatgatacaaactttcagcttaccatgccagttctgcttctgagaattcatgacagataaagctgatatagatctgagctgaatgtttttctttttctattatgagtttgtaatgtagcatccaaatatgaaatatctaatgtgcccatgatgagctgcccaatgattagagggtgtagttggctcaagttcctgttcatcaggaagaacctacttgcagctgctgcattcacatgttatcaacgggcttcctgaggtcatagatacacttcttgttctgctcgtccatcaaattccgtattgtagtatcagggattcttttctagttgatacacattgatttgctagtttttttttaaatggaaaattctgattgagcattgaattaattttcattgagcattatcgtgctgcttgctcttctgcaggaatctccatgatacaaaacaaaaccaaccctagatgtgttctattgctgacacagggagttgtaagtacatgttaaatggtggcatactatacagctgtacaatagacgcaagaaacaataaccacttacatgccatcctccaccctgaaatagaaaaccatttttagcatgttggtgcttcattttgtattccattgggatataaaaatggtagagaacaaccatttttaacccaattttgtattcctttgcggatataaatatggtatagattgtaacttgatatctggactcatttcgggtttggtgttcgctatttgttccacatggtacctggacgtgagtggttcatctgattcaatgccattttcattgatttgaaatcgcacttttctcacaattgcgctgattaacttatgaatcaacagatacttcggcaccaggatcttcgaaaaacttttccagtaaatcagattctacgcgcaattttcgagagtttgtcatt

SEQ ID NO: 68865 - DNA, 11267 bp, Oryza sativa
acacatgaggactcacatgtcatagacagcgagtggcaaataattaattgtcactttttaaaagtggccacacaagttaaatgtcccgcttttctaagtatcttttaataaatacagtaataataatagagctttatataagtttgggccccatactagtatgggccgcaatgggattgctatgcacatatagcccatgtcgcttgcggcacgttttgcttcgtccagttgagctagtttctgaatattattgctgcttctgtcgccgctgcaaactgtaattgttgccattgaattctttctttttggtgaggaatattgccatcgaattacagcctccgtcgtagaaaatttaacctctgtttatgaatctgaacttagactatgcacaattttctggtctaagatatcgcgtgttccaattaattaaaaataaaaggcatgcagtgaactgatgatccacgtcagagaattaatttgtcctgaataattacacatcagtgtggctgctgcactcaaaacaatacaaagaccaggtgcaacagaaagagacgtgcacaaaaatcaattggtctcttgcaatgttcagctatgcttgcttgaggtaagcaaggttggctggctctagcaaagctttcctgtcctctcacctaccatgaaagtgacaaaggaatgtgctcttcgctctgttcaatactttttttttctttagaacagctctgttcaatactccctccaccccattttaaatacagttgcggatttccgtatccaatatttaatcgtctatgtttgtttaatttttttattattagtatttttattgttattagatgataaaacataaatagtattttatatgtgatttatttttttaatttttttatattttttaagcaagacgaacggtcaaacgttggatacgggaatttataactgcacttaaaatagaacggagagaatacttctatgtttttttttcactccaaaagctttagacaaatcgccaaaatatagctgggggtgatgcatatatgcattcgtgatatcatttattattatttttttgttgccggtcggtggattagaccgatcaaatttcagtaagataatatatatatggggagagtgcataaaaaagtatcattcaattcgtccaattttttgttttaacactgttatctgacggcactagtttgtatgagaatcagaacagtctttgagtagttccatgttggctcaaaagtcagaacgtacgtgtacttatctggttcgtatttatacgccaaacagtacaaggctgctagtctgggtcaaattgtcaggtggctgcaagtatttcttttatagttccttacttattttttttctttctttctaagaagaagaaggtcagacggctgctatagtaaaacaacaatacaagagtacgatgttatgagctacgacaaaatacagataaaaaaagagacttattcttcagcttatgaattatatacatgatcttggtaaggctgtgctcagtgtactccagttttccatcctctgctttctccttttttaacacacttcctgaaccctttttttaaaacaaaattctacagaaaggttgtttcaagaaatcttattaattacttttaagattttatggctaatacttaatcaatcatgttaatgttttatggctaatacttagtcaatcacgtgctaatgagccaacctatttttcgtgccagagagaaaacttgtattccctccatccaaaagagttagacacattacttttgacactaagaccgagaaaaaaattaactcatttgtaacaaagatctatacatgcataaaatcaatgagtactacgtacgatactccttggatcgatcaaatatttaatttatctcttcatttaagtcttggatatataaaactacatatatgatcaatttaattgagaaccataatattaaataagtcaaacattttttggatggagggggtattgtctaacacaccctaataataatacttcctaacccagtcaactttgcgaccctacctacaactagctcctatcaccgtagctctagctagcaggggctcatccagtatgggtgttgggaaactcaagtcccatctacctcattggatcactattgagagaaaaggagagaggaggacgcaggaagaagagagagaagaaagtgtaggggagggaagggggagggggctggagaaggaagaaggaaataagcccctctctattctttttctagatccgcccctgctagctagtggtgtcagcaccccttgcgtcgcgctcctttcttcactataccaatatctatatctcttctaactatccttgtgtttctattgtccctactcctttttcccgcctagagtacccgccagtttgccatttctcgcccgctccattaccaaattttacctacatttgcgctaatgaagtggtcacattcacagagggagaagtagcatgggctgttggatttttatccaactacctggatcatgctaatgcttgcaaattcatgatgccaattaatatgatcaagctagacgttgtcggacgtttgattattctcccaaaagcgggcgttatttcatcagtttgagaaaattgttttagtacttggtccaatatttctaagagatgcaaagtccaagaaagattggttgtgacaccaacaacccgctatataaaacattgagtctcaatgactgcaatatcaaaaaaagaaattataaaatcaaacttaaaatgtgcaacgtagttggaattctagttgaaacattctcttcttatgtatgaaacatcaaattttacgactaaaacatgtgtatattttttcatcgtaatataataaaatgatcttgttgtaaacatttaattgtaacaaattcaacagtgtaaccggatcgacaattggataagtaatttagaagaaaaaatttttaatattagttgatagtcttcgtgcatgcatgtattcatagtttgagtacagagcatggcacatagagaaaagaaagagaggtgaatttgagggtgcccaaccatttgggttgtatctggcgtacgtccgaggctaggcatttttgttaaattaatatgtacttacaattataacactcaatcactcataatcccctataagatacacattgacaattattactgcctacaagaaaaataacaaaaaaaaatcaacaaagggcctctcggccatcaacatctatcctaatttcaccttcttcactcttcagaacttccctcatgtgggccctacatgccagtctcctgatttgtcgacagatttttttttgggtgctcattaattgtctctgctgcaaagcttaattctctgtaacaaattaaaaactgagctacaaactgtaaaaaaaaaatcaacctaattaagcatatatatgatcatagaacaagctcggatcggcgagctccatcaccatcctgtaaatgtcatcgttgcatccatccttgtagtagaaatcgctcggcgccggcgagctgagaacgctctgatcatggccgaatccggccatcgccgtcgccggcgaaggctccggcggtggcgccgccgccgcatgctgatgaaacactgtggtattatcattgctgctactgttccattgctcctggaagtagcgctggttgctgtagccaccgttcacgttgctcgccggcggcggctggagggtgttcatgtactcgacgacgtcgtcgccggcgctgtcggactcgaggctgccggtgatcgagctcgtcgcgtccggcaccggcgccggcaccgcggcggcggcgacggcgagctgcggctgcggctgcttcttgtgggtgatgttcctctggaagattcggcagatggtccaaacttcctgcatttttttcacgcacacaacaaaagttcagttcgtcgtcgtgctaacatttcggcacgttcgaggacacgtgtcagtgcgtcacgccactgtttccacgcacgtgtgaatggaaccaagccgggttcgcgggaaagtgcatgcaatggccgatcgacggcgacgtcgccggagatgaagaagatgcatgtaattaacaggttttaaatatcccgctatagctatttgagaagggttttaactaattatttactctcatatataatttagtcgctatagttctacttaacccgccgctatatctatctaagaagctactccctccgtccaataatataagggattttatgttgatgcgacacattctagtatctgtccagatttattgtattaggatgtgtcacatctactcaaaatcccttatattatggaacaaagagagtaaccgctagtaatgtcttagcacgctatttaaaatattggtaattaacttaccgcttcttggaggctcggaggaggggaggagcggccggcggcgaggtcgtcggcgggcggcggagggaggcggaactcgtgcatcatccagtcggtcttggtgcccttgccggcgctgccgcggtagtagacgagcgacttcttgaggccgatgcagtcgccgccgccgccgccggcggcagagcagattgggcggtcgattccggtggccttccagaagccggagccggtgacccggttgggtcggatgctgttcctgtacttcctccctcgaaggcagaagaagtaccattccttctcgctgcccaccgtgctcgtctctgcatgcatcaacatggttaattaattaatttgattaatccccacaagatttagcttttcatgatcgaatgatcgatctagcttatagtttgaaacaaaaaaaaatcacgtaaatatagatattattcatgttgttaattatatgtgttaattcttgaatttactcaaggcctggtcactaaatctgtcatgttattctattgcatgcaaatgaaactacccaatcttagctgataggaacatcatgctccaagcgcatgagcttgtagatcaccatgaactataagcatatatatatgcatgcatgctgtgattttttttctttaataagtatttggtgatcatgaacttttaattagttgaatgaacttactgaggaagtcggagggatcatgcttgtagatgtccatctccttgatgatctcgatgctcagccgcttctcggcgatcttccggcgaaggtagaacgtcactagctcctcgtcggtaggatggaaccggaatccggggagaaccaggtcatcatcatcttcctcttctacctcctccacccctcgtagaatcacatcaccagctccaagttcatcttcacaacccctcttcatctctgcagatggcaccattaattttatctttgatgatcagtgttcgccggccgttcgatcgaatcgtcgattcgatcgatcgcctcctcttctcaaacaatctaggagctagagaacgaaaattgttcttgtgttgttcttggaattaatatccctgtaaagatataggggagatcgatgaagttgttgagaggagatggccatggagccatgtatatttatatggctctgatggatgtgtatagtgagctaaactaagctgtctgttggtttgtgaaagctgcaagaggatggagtcatgaagtttcatggttgcttggtccaagtcacttgctttgacttctcttctctctagcaaccatgtccatatcgaaatatatcagcattggatgcatgtgtgtgtatatcctaatttttttttgacaattcttttcatttgaaataaatgcatatctcgtcatttatatagattatttgcccgtggtacggccaattgaatggcaaaaattaatatatgcaatgacgtagattaacagtgcctggtagtacggtgcgtgtttggtaaaagttgttgagtagagttttaatttaatttattcatgtctgttggctttattaactacagtatgttgttgttacggttgaaatttagacatgacaagacatgctcccaggcccgttcagccacgtcccgggagagacgtgccgccaaagtttactgagtcatcttgcagaagattaattaataatatcactacatggtttaatgtgactgccggcttcttaatggtgattatattgatcagtatatctttcttaaattcttactccctccgtcgtaaaatataatttctctatcaacattcttttcccaactaatcataatcctccaccattcaccttttccacttaccttcactgctcatccaatcacaacattccaccattcacttctatctactttcttaataactgtgttcaactttaaagcttcttatattatagtacagagggagtaattatttaggatagaagctgatgaacacattcgatcgatcttggccgtgggatagaacaacgacgatcgatattgcttagacagataaatacggaaaatatatagtgcaaaccacatattttcccagataaataagggccatatatggtagagagctaggtttgcaactaggtattgctctttttgataattcgtggagatgaaagctgatggatgatctgtttaattatagtggtaaattaaatattttatataataaattaaacaaagagcttatatacaaagtagtataatcaatgcgttagaagattaattttatattattagaaaacatatttttaagaatcatcaagcaaataatccgcgacaggatcgaaagtactcgatctgcataattggatcaactcttcttttttaataacagatagaatcgatcaagcctcaatgaaaattttcataggtggatatattcaccgccagtctagctagatcacgctatattatttacagtggttgatatgcataaataataatgaattaatcaatgatacggagtatccatagaccattgaattgaattaattgacattcttaggtggtatagcgcatctacttgttctttcttatttcatcaataatttactaaactaacacacaaagtgcaaagcatgcagtgtactgatcgagttgtgccttcgagaaaagtagaaagtaaatttgacgtaccaaccaactaccaagtcgatccgttcaccctgtcaatcaagaaacccaccaggccaacaagtctcaaatttttttactacaggatctttgcagaagagaacaatatattttctatagaagactgaatgcgatgttttccaatacaacgtatctagatagatttcttattcagatacattgtactaaaaaatattacattcgattcgattctatgttcttgtgtttgggatggaggtagtactttcaaagacaataagtgtatgcatggttattggtaaagaagaaagatcagaattagcatgtgtagaattctccttgcccgtatatgctatgtgaaactattttcttgcatggttgttggagacaaagacgaaagggaccagtataaacagtcgcaagaaggagtcaacttcatcaagatttgatggggtccatttgtgagaaaatgtttttcgacattcaattgagacacgtaacatagttttatgccttttggtgcaactttaagtattgttaattaggagaatatcaattttgggctttcttctacttacactcctatgatgttttctacttactgtgcatacaatctagctagaggctagtaagatcatttcagcatgaacaatggcgtgacgtcagcactgggtgtcaattaggattaatttgtgataatgtgaaggcaagattaacagaagagatcaatattttgtctgttgattaacaaatgttataatatgcagcttcataccatatatagcgtcatatactatctatatacttaaaattaaataattgaatgtacaaatttaatgtaaataattaattaactaagcatacaatacgctgtacaagttgtctgtgtatcatctggccggtatgacatgaaaagattacatagacgactaatctttaaaccgttattcatgcatgcatgatcttccatgtggaattaattatggttattaatacaatgagctatactttacacgatttctcaaacaatattttagttaatttgctatttttaatttatcattacaaatatatacccctatcgtccacaaatatatataagggactccaggttgtttagaagagtttaacgttaaggcaaaattgctttgttgcccctaggacttgattgagaaaaatcacataccagtgagcaataaatgcagcatagttggatgaattgaaaaagtagtactaagaaatgtcttatatttgtaaacagattttgaatttaaaatcctttatatttgtgaacagagaacactaaaatttaaaataaaagtattgtattttttatgtaataatgtagtctattcggttattttgtttatgaaagtaaaaatatgactacacatcaaattaaccaaaattggttatttccagtcgattaatttgtttaagttggtttttgcccacttagatcatacggtcaatgtcttagaatatcatactttactacttaattaacattctgaaaatgtttttttttcgcatcaagatcatatatatacactatatttcccatagtttgttttgtctaaatttttatatttaattaaaatattgttttgaaactaagccaacaatttctggtaccaactacagtatgtccatgacttccgaaatggagcttagcaacaaagtacaagccaagcggctgatgttggactaatgcattattatcctcgctagacttttggctccacagattttccataaattgatttcctccgtgatcttggatagtctcttagcctcacacatgctccctccgtcccgaaaaacaaatctaggactgaatgcaacatattctagtacaacgaatctggacaaatgtatgtctagattcgtagtactaggatgtgtcatatccggtactaggttggttttttaaggatggagggagtatccttgtttttgaatattcttctctttcactctttccaagcaatctacacaaaaccatcaccacacacacatatatgcatcacagacctattgatcttcaaagatatgagtttacaaaaagaggaatcagggtgataaaacaaagtatagaaagaagtttgggagtaggacaataagggactgtctactctacatttgatagaaaaccttcaaatacattgtaaattttagaccgttggatcactttaagatttttgcaaatcccccaaaccttgtcccttctccttttttccccctcttagctgccgcacgacgcgcaagagctcgacttcctgatgtctctttgacgacaccgcttgagctcgccggctggccagaaggccccaacgatgcctgcgagccccccccccctcccccgcgcgccctctatcttcctcatgaatgcggcagtggtgtggtgccctcatcctcaccgtcttctctgtctctaacaactccccaccacctaatccgtcccggctacaacctcttaatcacaaccttgctttgccccccccccccctccaccaccctcctccatcccaaatggcttcggctctgactccggcgccttgccgccgtccaaccccgggccatcgcctcccacaaatatcacactaagcctgactctcactagtcgagttcatcatcgttggtcgtcagtgtttatcaaggtcgttggagttggaggaaaagtccatttgagtacaaatcatgaagcggatttgaggttagaaatttgcaatattgtatctctatttttctgttggatgttgtttagcaatttcgaaaaaatatatatgaccggttgatgatgcatgagtcaatgtgcaatatatctttcaaggtacagcgagagattgtgaaccaaacaagtagtttatatggaatcttgtgtttctgctagttatggctcacgtgccaagcaatttgaagatctgaactttcgtctgatctctctcacaaatacctgtcaatagccatatagttggatcaaaaatatatatgtccaaagaccccacatatttttttctactttattttctctccaatgtaaatcacgcaagtggattgtgttcgattggtcaatggagcaatccgtgattatataattgcgatcttggttgatggatttttccatggatgaaaaagaaaagacaagctatataagaaatgtcgccatggtaggtaggaaacctgtcagtgtgttcaaggactaaatctattattatcgttcccacgtgtggctagagataagtcaggtaattaagcagcaaactagtcatttttagaaagcccgttatgaccaacaattgataaattatttataaacatgttgttgaaaaccagatagaaagctgatgacttgtatcgattttgagaggaatcgtttgtacgtacacaagcatcttttggttcccatatgctcttgtgggtctaatacgctaatgctacaagacagcaacattgcacttctagttgactaaactcaccttgccgtttgacaaaactttctttggaagcttatggaattcctgtagaagttagtgtgtttagtagtatatatgtacatattaatgtatttcaaattcttatattagatgtataaatatcatatgggaagacaatcattttgtctcaaatgtactttcgtaattagtattgaattttgtaaatgtattagataaaaattagtactagtttataaaattgtaatctggactgtaccgatgtgcaaatcaccccgactgtttgtttgacagttatttggtcaatgcatgcatgggctcaaagttgtagcatgtcaaatcacacttctagctacagtagcaaagccagtgaccttgtcgagcccggatgactaaaatcacttttcgatgatcaactaaattttaggatttatttgaaatgtaggaatgaaaaaacaaataactttaatagaaatataagtgtaaaatagagaattgtaaaatataggaaaaataaatgaatgattgtttgagtagaccaaaaccggaaaaaaacacatgaattgagtgagatcgaaatagacttaaaaagaaatttcgaaaaggttgaaacgtttgataacttttctctacaatctaaatagactgtccattccaaaataaaattaaaggatgggatatgatttttttcaaaggtattcttaattaggatttttttatgtaggattgaaatccttaaataggatctta

SEQ ID NO: 68866 - DNA, 1536 bp, Oryza sativa
gacataaaaatgtttatattttgggacggagggagtggcttccttgtacggtcgtagcatatgaaaaaaaaatgcacctagacaaaatatccctgtaatgtgaacatgagacacaatgacttccgagcacttaaattgattggttaattcatctttgactgatgttttttttgcgagttaatcttctagcacttttattgtcagaactcagaagccattgactgtcctcaattattcgttctgctattcccaaaccttatcttacacctaagttaatttgattaactccgttccaacaatatgcatgcatacacatgcaggtcgtaccgtacgtatatgatgaactcatctacaagaaattatgactctggttagtacaagataacttcaatattgggacggtgaccaagttttttaacacatgcgccgctatgacgactcaccttattaattatggacatatatatatgagttggtgagcttggtaaagaaaagtttactgaagttagaaattcaaacagtttataggtcatcactagtaaaaactatttaaatgaatgtttcctgatgtcttcttgtaaagcctgtgtaactcagctagtaaagtttgctcatccggtcagttttagacttgtggtacagggtgcccgcatttacatctaattattctttaagtggtaaacgatctttggacaacaaaataaaacatatgttgtgacttcgtcgattttaagatatgacagtttagctttttagtatgctcattgaggtagagtgtgcgtatgtgattattttgtcgattttaagatatgttggtctggtattttggagatacttataagagcatgatatacatgtgtatatataaggatgtgtatgcgcacccttgagcgtgatactgtgttttttttttaaaaaaaaaaagaaactccaccagaagacattgaccgtccaggtcgtacaaagtacgtacatgatgaactcagctacgaatatgagtataggggttagtacaggattacattattaatgggatggtgacagtttttttaaaacatgcattcgcggctatgacgactcaccttaattatggacgtgacgagtttggtgagcttgtttaaaaaaaaagtttactgacgttataaattcaaactgcttaaaggtcatctctagctaattaaaaactaattaaatgtatgcataaagggtaggatgttctatttcattattaaaaaaaattaaacgtatgtatgaccaaatcttaatcgagatccttttcaaaatactgtaatacacactcttaccacgtacggttaaaaattaaacttcaccaacatgtacataccgtcactgacacgtgtatatatcaaagtttctgtacagtcggcatgttgatatactcgtggttttgctatttacaaagtcgccatgatatcctaacctgctacaaattgagatgtcaagttgtcaacagcgttcacggccatataagtatccacgtatacttcgaacttacttatttcatgtgtcagttta

SEQ ID NO: 68867 - DNA, 1292 bp, Oryza sativa
tgattggaagagttaagaaggttttggaatatcttctctttgcagccaagacactagcacaaaacaagtctgcgaggagaggtcggagctgtgctccacgtcttcaaagcatgtagacatggaagatgataatgtggataaagcttgcttaagtgatacagatccaatacccattactgagaacatagttgatttggatgatgatggagtcgatatccctacaattggggtcacggagtggaataatcctcattcttctgaagtatctgatgtaagagaagtaaccactgaacctgaagataacagcttggatattcctgttgatagccaaccagtatctgagaatgctttccacggttaacctggcttgtttctattcttaaccccgttggcttgtattctatgttctcattttagttcattgcaaacattcatatattcaaattaaagctcgctatgagctcatggactttagttccacaacgtgttcactgtatccaagtggaataaaacagtgcaattgtgggtgtgtacatctgaaagtccatgtttgtcaacgtgattcagggtatcaggatagtgctctgaactaaattcacatgagctgcataatgcatcctgttcgagtattaattagtgacatctattactctttgcttgtatcatacggagtatatataaacaagtaatgaatgaacatcttgtcttcctagttttctttaataaaaaaggaagccgtcgttctcgtgcatttttgtggagataagtactcaaatgccctagctatttctctaatttgggggtagtgtctttcagacctatagtttcatttattcgaggaataagcgaaacggcatatttacaaatgaatagtaatttgtgaataaaacttttatatatgtgctcttaacgatctaaaagcaaagactgaaaaaataaacttatgaaaaaacctcaaaactaattctaaatttaaggttaaaaatttaaattttggcggatacgcatgagcgaaaacatgatgcctttctgtctgtaccttcaaatgaaaaaccaacgtagtgccttctagagaaaaatgaagttgtttagtgcctttctgtctttctgtctttctgtcttttttggggacaagttgtttagtgaaatttgtagctagtaaaatgaagcaatgaagcccatttttcatcacctgctcactaactatcaataatttactgtagacatcatcacaaaggaacagatcaaattaattgggaagacaagtaaaaggttggtcaaaaggaagagat

SEQ ID NO: 68868 - DNA, 6939 bp, Oryza sativa
ttaccatattggtacccagttttgtatgccattggggatatcaaaatggtgtactagattgtaacttgttatccggagagttggtaactcgtttccggttggtgtacagtacttgtcctacttggtacctggacgtgagtagttcatctgattctgaaacaatggcattttcattgatttgaaatcgcacatttctcataatatgaaaattaatggcattttcatttttttgagtcgcacttcttataattggataattaatttcgttggcatcagacctgtactgtacacccaacttatgtcagttgattaactttctggtcggttgatggtacccgtacgcacggaaatctttattaaatgacgaggcgaatttcttccgcctggcgcatgtgttttgttgttgctgtgctgtattgcatatagatatagtagtaaatagtttcatattattctactttctccgtttcacaatgtaagtcattctagcgtttttcatatttatattgctccgtttcacaatgtaagtcattttagtatttttcacattcatattgatattaatgaatctagatagatatatatgtctagattagatagatatatagatttattaacatcaatatgaatgtgggaaatgctagaatgatttacattgtgaaacaggggaagtaataataagatatatgttcaccaaaccagtataacttgacaataaacagattcttttgcaccagatcgtttgaaaaaaaaaaactctttaagagaaacaaaccaatctgcttctaattccattgtaaattgccgcatatttttttgtcggcacggtgaccacaaaacgtttttcggtttgatgactacaagagggtaagtactaagtacactgtacacacccttgcagttcggtgagaaaccaaccaggataacaattctgaggatagcttgttggatttttattgtatactgaatacatcaacaatattacaatcttctaaaatcctcccataatatgaatctcaagaattgaacgaatgaccataagcgctatattacatataacttctgtgagtgagcaattgaaagcccttgatgatgaacattcctaagaatatatccacctaagtttttaagttttcagccaatagatgctacagggtaaattctcttcacaaaaccatggcctgagggggtccgtagccgctccggtgcttcttctgccatgtccaggcaaccctgaggctctccaggagatcggtatgttgagcagtccagttcagctcgctgttgatctttgcgggatcgctgtacacttcggcatagtcaccgggtcgacgagggaagtagtcgaccttgatgtcaactcctgttgccttcttgcaagcttcgacaaattctttcactgacctacctgaacagccaagtggaatgaacatatgttagctaattaagatgctgaaaatgagtttgcattcatgttttcccttataatgaacttatgatcataatagaatacgatcttgacctttgcctgtgccaacattgtatatgccaactttgcccctttccgccttgttgagcgccttcacatgggcgtcaacgaggtcagtgacatcgatgtaatctcttacacaagtaccgtcaggtgtttcatagtcagtacctttaacctgtaatggaaaatgctattaatcagcaatccactaaaagctaagcaatccttataaatgtgaatctcaatgagtaagcaataggctatgctagcagcaatcagggcaccctgttcttgaatgtaataattgaaatactgggagtgaagatgtaccttcaaaccaggaattatccccagtgcagcatcaaagcatgcaccagatatacggccatgctcccgtaattcaggttttggagcctcgccaagccttccttcagggtcagaaccaatgacgttgaagtatctagaagtattaggttacatattcgtaagtcaggaatcaaatggtggtttaaatagtgggtttcatgcttttgttttgtaaacggtacataccttagaatcatcacagccatgtctgccttcttggatttggaaaaatccaagatgatgtcctctgccatcttcttggctttaccatatgggttgatcggaaactgtacagtaggatttggtgagcaaaagccttcagcattatctgaaagtaaagaggatgcagaagcaacagctgacctggggagttccttcggtgataggcatcttctcgggttctccataggtggcacatgtgctagagtagatcagggttctcacattgtgtgctgccatagcctctagcacaactaaagtgtttgaggtgatgttatgatagtacctgtttaaaatgttttcagtatctcgtgtgtcttgtggagaggtaatttgatggacaatagagactttagtacctcaaaggctcaagtgtgctctcaccaacataagcgacagcagcaaagtgcatgacagcatcaaaagcattttctgcaaatattctattaacctaagcatgtgctaaggaaaaaagatctttcaaaaaattccttcatcatattttgccgcattttgaatgaaagatatatctctacagaaaaattcgatttgagttattcagagaaataaatcaggatacagcttttggatcgcctaaatcagcatagatgaactgcaaccgcccaggctctgaaaacaagttctgaagaaccttgattgcccccatatttcctcttgaaagattatcctgcagaaaccatataggcacaagcattccataaattgcactacaacaacaccaaattcgaggaagaaatggcaacacaaagtcgcgaagaagtaccactatggtgactctgaaggaatctttcagcagccgaagcgcagcgtgcgaaccgatatatccagcgccgcccgtcactagaacatgcgtgactccgggttcatggatggagaactggacacatcacacaagtgaagagtgaagacaaatgttagctgcctgaccatgaattgttcatggcaacatacagagctgctgaaaaacatctgaaattgagttaccacactgggagtcctcctatggcagggcggctgtgtgagcatgacgacgcacatggcggtgaggagcgccaccatgaggatcttactgaggtaccgcggcttgcgcttcggatcggagaagtccatgtctggcacaacatgatgagctcaaattcagaggcatgtacaacaaggggaaaaaatatttctagcaaaggactaaaattacagagctcaaaccataaaaaaaccaaaattcctgttgcacaagcaacaactggacccaactatgagacaatcaaaaggcacttgcagataattttagagctatccaattacatgaaccaacaattatcaactaattcagaaaaaagagagaaagagacaaggttatcagtaagatagggtgagatggaaggaagcagacagacctgagatgaaataccaagatctggcaggcctctgctggggcctgttcctgttggtgggaagcatctggagcagcagcagcacaccaaatcccctcccagaaagaatcaaagttcctcggagacaagaacgccagagatgattcctcctgctcactgccggccacctacagcggcatcgaggaagaaaatctcgtcagaatcagcgagaggacagcacacacgacgcggccacgggtcgcaggagcagcagatccaacaaccacacacacgcaacttcaatctgatttaattacagctaattcaccagcgaaaagaaagcagcatcggcgctggcatggatggatggatggagcgatgaaattgcagcgaacacgcgtaaattaagccgccaagaaaaagggaaaagaaaagaaaaagaaagaaaagaaacagcaagaagaagaggaaggtagcttcgcacctagcttaccagaactcgttcaggatagcaatggcggcgaagcagatcagaggaaaagaaaggtgagctttaacacttacccggactagtagcctaccacctgctgggacgacttggctggctgcctcggcgacggcggaggagaggagggaaagcaggggagccacctacttcccgaggcagtggcggtggtcctagctctccctctccctctctcgttggccgcgagaagaggcgaggcgaggtgaggttgttgatgaagtgagaagaagaagaggctttgaagggaggaggcggcgctggctgctgctgctgctctgtccggtcgaggggggagtggggcccacgcggaggaaggggacacgtagcgtatgcgagagggggtgacgtcgtcgcgtatttgctgggccccacaacctcatcggtcggaacacgtctgggagcactacgaggaggttcaaaatattccgtgtctttcgctctttttttttgttttaataataataataataataataactggggaagaaaaatactgctgcactatgtatatatcgccgacacgcttccactgtatttgtcctgaggagtttatttttagagcttcttttatttatgctaaaataaatttgttgttcgtaattattatatagaagtttataaaaggcaaagataaatgtaataggaatagataaagtgaggaataattatattggatttaataaattaagttggaatattctagtcttttttttattggtatatgtgtgggatgggtgaaaaataaacttattttaaaaggatggagtatttctaatccgtgtgcttatttgaaaaactttctatatataattgtcttatatcgctagaatttaatttttaaaatttttaaaatttgaactatttatttacgcccttcaaaatctatcataaaatctgaatatagtacctagttcgaacggacctacgtactactacatatttgcatcttcgaggttcaattttctttttctttttcttatgggaaattcggtctcgattggtactagtagcatttttaccgagagtggatcacgagtagagtgtactgctgtgtttgttaaattttgagtgtatgacagtcggcttgttccaagaatccaaggacaagtttcactttttcttatgtactcctaaccaacaaaaaccggcaacacagtgtgtatagtggagtacataagaaacttctgcaaacacatataggttctatttagttcacaaacaaaaatctttcagcatgtcacattgaatatttagacacgtacatagagtattaaaaaaaactaattacattgatagcgtgtaaattacgagacaaatcttttaaacctaattgtaccatgatttgacaatgtggtgctacgcaaacatttgctaatgatgaaataattaggcttaataaattcgtctcgcagtttctatgcagaatatgtaatttattttgttattagcctacgtttaatgtttcaaatgtatgtccgtatattcgatgtgacatgccaaaagttttcgatcgcgaactaaacatgctcatatactactacgagcataggggcactgtagagtgttgacttggcacgacgaagaaatgaataatactaaagcgttggacgagcctaacaaaaccacttattatcatcgaattagtgggacaattttgttataaaaacatgattccaacatgtaaaccatgagcagctagcaggcatgacacaagatcaatgtcttacccggaaactacttaaatcaaccgtgtattccaacacaaaacgacagtcggccaaagactcgtggacataaagcccgagcagccacatatactatggattgagatcctctaacttacgtccttttaacttatgccatttttaacttataccattgacacgtgtgccatctactcagtagacccacatgttagtgactcaaagttagaagtaagtaagagaatcctcttcatatgtactatctaagagtaaaactcgcttggcagcccctaaaagtaatgttaaagaatgtacacgtgtgggtttgcttggtttgctttaaatctcaaaactaaggtagtacattttacgatcaagatatacacatcgagtcgatctatatcagttggaaaaggtaaagtcgtcatctatcgctatatattatgcgtgttatcttctagattattttttgtatttacatacttttatcctttatgtatgtcgctctctatttacttttgatttataaatgatagttcacgtagaaaattttaatatgcctgaatttgagtaaattacacaagcggtccttaaacttgtaatgaagtttcacttaggtccacgaacttgcaaagcgcgcatcgaaatccttaaacttccatgtcatcctggtccaaagtctggtttgacaccgtgatcttgcctatatgtcatgccacgtggtcgatgacatggctaatttttctttttccctttttttcttcccatcttttctctccttcctcacctcgcgtggagaaaaatgcggcagaagggagaggaaggaggcaaagtggagaaaaaaagggataagaagggagaaaaaaagaaggaagaaaggagaaaaaaaataaaaattccatgtcatcgtccacgtaggtaagaccacagtcaaacgagactttggacccggatgttacattaaaccaagtttaaggatctcgatgcgtgttttgcaagttcatggacctaagtgaaacttcgttataagtttaagaaccgctagtgtaatttactccctgaattttatcgtgtaatgcaattcaatgcacgaattaattcacaatgaacttgtgtagaaaaggctcttactacaacaataacaacaataagagctaacaccatatgatgtttaataaaatttaacattgttatttcaaacaacattaagatccgatcatttcttgcctgtttcaaagtgca

SEQ ID NO: 68869 - DNA, 8681 bp, Oryza sativa
  unsure (1)..(8681): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaggcgtgtaacgcccatagccccttacttcaatctaatgggaaacatcttatttctgcttttgtaatctacatttatattcttgttaatggaaatacgaatgagaaaagaacggcaccaggtacagcgtatcacaattcacaactgcacaagcgaagaagcatcctgtagttattaatgttttgtaataaataccttttgttttataaatcttcttttgcacgtctagaagcctggtaagctcttttccttgaggctccagacttcaacaaaagggggtgtttagatctagtggtgtaaaattttggcgtgtcacgtcggatattatataggtgtcacatgaggttttcgggtatttatgaaaaaaaactaattacaaaatccgtcagtaaaccgcaagacgaatttattaagtctaattaatccgccattagcaaatgtttactgtagcaccacattattaaatcatggagtaattaagctcaaaagattccacaaattagtcacaatctatgcaattagtattttttttaagcttatatttaatagttaatacaggtgttcaaacgttcaatgtgatagggtgtaaaatttttctgtgggatttaaacatgaccaaaatagaatgtgcaatctcgtccctccgtcgcgagcggatttggatcggcttaaacagtaacagtgtatgtcattggatgtaaattgggcgtgccagattgcatactgtactgtacaaagtactgtagcatgaagtactgtagccgttgttactgtagcattcgatctgagccgttgatcataaaaacggacaaccaaatttgcgtgcagttgttatctcgcggttgcaactttcatgtataactgcacctcatcccaattcgtcgcgagcagctccaggatcacggcgtaaacccaggagcggagccccaccggcacggcgatcaaagtgccgctgctgcatgggcctcccccctccccctcctctcccaccaggaacaacgacgccgcgtgccccttgatcgccacgacccagagctgtgcggtcgtgtggagtgtggacgaactggcctcgggctgattacgtagttccgtgccgtgcgctttcgtttttcatgactacgattatgcttctgcatccgcttgcgcgtggagccgtgcacgcgcgagtgagcgacacggcaaggcaacgaggcaaaggcatagagcacgcgaatgggggtgggtgagtggcgaggccgtgacgggagagagaggcaacgggaaatgaggtacgctgcgtacgcaacgcgcggggggcgtagtggttgggccgtgtcttcatccagcggttgggccaggtttcagctttgaatcctgcgcgcaaagggggagagcaaggaacaagtccatttcaactctgaaatataggttcaatctaatttgtatcactcaacatcaatatcaaatgttaactccctaaccaataaaatcagtccaatttaactccctcggctatttttgcgggcggtttttgttgatgtggctcattgacctagtctaaccagctgagtcagggggcccatatgttagtgactatttttcttcacctctttctttttctcttccttctcttttacccatcaatgcaattgggttgctggtgagcgagtcccctcgaccaatgcccccgacacggcactctgtggcaccgagctcgttagatctagcccgaggctcgtcagatctagatttgagaggcggcggcggcgacaacatgagtacttcctcgagcgtgcaaggccactccaacaagggtggctcgtcagatcaaactaaagatcgatggtggcaaagacggaggaagctcgacagcggcagtggagaaagttcaggaggggactggtgcttcacatcttaagggcacgacttccccgactcctcgacacgatttcgaccgttgcctcatgcatcatgggccttcatcctaataagacttatgtgttcttatagaggcgcaacccatactaacgtgaatgaagatcttcaaattagctatgtgaggccaaacttcacctcaccgtacactgtgaatggccttactgaaccttcggaatgaaaaagattataaggaagtggacctccaccattatatcagcaaggagaaacttttgatggtatttgtttataatgaagatgaatacgaagttaggatacacaaaacaagaaaatcattagcgcatgattagttgaattttaattattgtaaactttaaatgactttattaaaaaataaattcatttaatatttttaaaacaacacctatatagaaaatttttggcataaaatataccgattagcaatttaaaagatgggctaacgaaagtcgaataaaatatgtaattttaacagagatgaacaccgccaatgagggattttgtaccggtggaaaggaaaattcttcctttctctctctctctatctccgcgggaaaaatctctcgtgtgccttttcattattctaagtttgactagcatgatactagtagcaactaacgcttctcttttcaactccatggcatcacaagctggctagttgctgctggccagtgtatcgccgcgccgcgaaatagacgaacctacagggtgtgtttggttttgcttgcaccattctagcctggtccgtatgttccatccaggcttaccctagcctggataggtgggtgcaaatagggttgttaggttggttgtacgagttaagttggttgattgtacgcgcaaattaatcctgtatacaagagatattatttggtttggtgtatgaggttagaatatggttacctcctcttttgtatggtaagattaccccttgcaattttagtgtaccattcaattgtagttatagtactattcaatcagccaaattttgttaaaatctgttgcatatgtaatgggtgaattggtataaagaattataaaaaaaataaatggtgccaacgatcaataattcgccgctttatatacgctataacaggtgagggaaaaaaataaaaagaaagaaaagaaaaaaaatgtgcatctcgttctcgtcgatgtcatcctcccgccgccgcactaatcgttgctgcaccggtcgccgtcctccacccgctgcgctggtcatcgccgcagccctcctccgcaccggtcgttgtcgtcctccacccgctatgctggctgccaccgtcctccactcgctgcgctggtcatcgccgcaaccctcctcctccgcaccggtcgtcgtcgtcctccacccgctgcgccggtcactggtcgtcgctgtcctccacccgctctgctggctgccaccgtcctccactcgctgcgctggtcaccgctgcagccccctctctttccccactgctcgctaccggctaccctcccggatctggtggccggcggcggaagaaggtgcgggacggcgacgattgaagacggtggccagggattgaagagctcatcgtcgttctctccgtcgagctcgtcgccaaaccatcgcctctggcttcgctctctgtctaggtatgaggaggggggggagaaatgaggacggggcggtgactccatcgcaagctgttgcgtgctcggtcccgactccctattaggaatgcaagtgggtagtcccgctatccgtataaaaacccgtttgctagtttatttttcacgtggtagtataaaatttagaagaaaaaataaactagaagtgagataagcgggctaaaaaaacccgcttacccgctccacttacatccctactcctaacacgtcgccgtgtatagtttgtatacatacccgggacgaggcaggcaccgggcgtcggcaagcgcgtcctgcgtgaccgaccggaagaaactttttcagttgttgcaaccgctagctctcgcgcctttgcctgccttgttgcctcatgcgcgcgccgcaacgcaagagtgaaacacggaggccgccgcgcccgcgttatggcgtaaccgcgccgcagtataccgcattaaggtgctgagtcatccccgtactgtacctgtttctctctctctttttttgacgcatcaatgcgccctctgcatgcatgcatgcatgcctgcctgattggagcccctgtccttggctgcagtagtgacagtggccacagacgatgaccttgtggcttgtgctgattctgaccgtctcgattgaatgacgactactcaaagacacagacacccacaccatgagagaggcacaggaaagagaggcgtgtgcgtctccatatgcgcttcacgcctctctcacggcctccctcaacacgggtataaaaggcgaagcagtgggtagtgctaggttgggttggtgcttggctagccacggtattattgcgtgaaagagggggaggtgaggacgtgaggtgaggtgaggtgaggcagagtgaccacagcgacggcagcgtagccatggcgaccaggccgggccctttgaccgaatggccgtggcataggctggggaacttcaaggtacacgcccaaattctcaccttctgatttctgagcgaagaaaacatgttcatcctttttccttgctcccccgttcgttcctcttgatgaacttcaacagatgcagttgtttgcatacagtgaatggccagccaaatccaaaccttaaaattgcacatcccagtacatgcatgcagtttcctaaaaaagatgattatattctcggctagtagctttgtttgacatgcatggcatggggtggcatgcgcagtacgtggtgatggcccccgtggtggcgcacggcgcgcgccgggtgatgcgcaacgggtggggcgacctcgacatcgccttctccctcatcctgccgtcgctgctgctgcggatgatccacaaccagatctggatcagcctctcccgctaccagaccgcccgcagcaagcaccgcatcgtcgaccgcggcatcgagttcgaccaggtcgaccgcgagcgaggctggtcagtcacctcaacacgcacacgcacaacaacaacaacaacaacaacaagcagctaccaccactgtatatattcgtgctgatttgcgttgcgtgctgcagggatgaccagatcctgttcaatgggttggtgttctacgcggggtacctggcgatgccgagcgtgaggcggatgccggtgtggaggacggacggcgccgtggtgacggcgctggtgcacacgggccccgtcgagttcctctactactggttccaccgcgcgctgcaccaccacttcctctactcccgctaccactcccaccaccacgcctccatcgtcaccgagcccatcacctgtaagccacacgacttaaaggctgtgtttctttactcaatattctcaactccatcctacttgtttttccacgcgcacgcttctcaatctattaaacaatgcttttttataaaaagttttctatagaaaagctttttttaaaaaatcacattaatctgtttttttaaaaaaataattagccctaatttatcatttgctaataagtggctttgttttacatgcatcagtcatgagttcacacaactcatagcagctcatctcacttcgttagtttttgtttaatgccttatcatctcatgggtgttcatttaattaacttgttagtaccgtaccgtgtctcactgttcagtctaataattgttatatatagttgattgcgttcttagattaatgaagtgcgcagatcataaatagtaagcacaaagtggccgatattgactcctctcgtttgtttaatttcatgaaaaaactttttgtcacttgccggagatgccatgccctacattcctagtatgttctcgagttaaaatatgatgaagtagcagttgcactcctcggaataacacattcttagataattaaagaattcgtcgtagctaagaacaacacacatgaaagtaaagaatgaccagcaggatgcaggaatcgaattgaagacactgtacggagtattaatttcagaccaacagctcatcttctaccagaaaaaaaaaatcacaaatgttctgccaacatcatttatgttctctgatccatgaacagtaccacagtatcttttttttttttttgcaatgcaccttttcatgacaaaagaagaaaaagaacacctacgggacgggattgtgatatgtccagtctgaggctctgagcttcacactgtgtcactgtcgtagagtaaacggcataaattggctgtacctgctaggcagagagagagagaggcccgtccagcctgcaagaaatgagaaatgcatgtgactttctgaattgcagcgctgatgtgttcgattcagtttaggaccactcccggtgcaggccaatagtaggagtattacctttccttaccaatttgaccgataaatgctggaaagaacggccggtatactcctattgacatttcacatggcatttgcagagcttcagtgatgatgggtgaacagcctacagtttacagcacagagcctgtagtttacagtacagagagtacccaataaaacgagacataaatattgcggcttgcagaaaatgcagtttggaccacctccacaaccttctgatctagatatagctgttgctattactgatactgaatggaaaactgaaaacaaacataggttaagggttggtttagttcacgccaaaattagaagtttgattgacattggaacgatgtgacggaaaatttggaagtttatatgtgtagaaaagttttgatgtgatgtaaaagttggaagtttgaagaaaaagtttggaactaaactcggcctaaggccgtgtttagattcaaacttttttttttcaaacttgcaattttttcgtcacatcaaatgtttgtatatatacatagaacattaaatgtggacgaaaaaaaaccaattgcacagtttacatgtaaatcgcgagacgaatcttttgagcctaattacgccatgatttgacaatgtggtgctacagtcagcatttgctaatgatggattaattaggcttaatagtttcgtctcgtagtttaaggcggaatctgtaatttgttttgttattagtctacgtttaatacttcaaatgtgtgtccgtatacttcaaaaattttgtcacacgaactaaacacaacctaagtagaatacttcttccgtccttcaatgacttttttttaaacaaagttaacaaattagtaataagggtaaaagatcgaagtgctcctcattaataagaaagtagtattgttagtgatagttaggggtattgaagggatacaaaatcttaattcacggacggagggtaggtaagaaagttaaaataagtcttttatgggcaaggttgaaagactagaaatgaaatccctttaggacaaagggagtagtttttatcaaacgttggcaaatacaggtcctacaagtagaacaattcgaaagggattgatcgactattatagttgctttctaagtaaaagaaaagatcatatatctgggaggaggctattacctgaaattgaacgaggtgttttagctataaaacatcagtgtgatgttcatgcataggtcctgttgtttttttataaagcacatatataagagtatgtacctaccctgttaatgcacaattactattggcacttacaacgattttatacattgcagctgttattcatccttttgctgaacatgtggtctatttcatactgtttgcaatccccatactgtcaacaatttatttgggaaatgtttcggccatgggcattgtggggtacattgcttacattgacttcatgaacaacatgggacactgcaattttgagttggtgccagagtggattttccaaatctttccaccccttaagtatctgatctacaccccatcgtaagtgcaacactcttctctcatgtatctatcatagaaatgtattaccaacgtgatgacagattggatcactgaattcacataacttgaagttcagcctcgtgagttcataaacccaatgctaacaaacaaatgctatttccttctgcaggttccattctcttcatcatacgcagttccgcacaaactactcgctattcatgccattttatgactacatatataacaccatggacaagtcatctgacgagctgtatgaaagctcactgaaaggaacggaagaaacacctgaccttgttcatctcacgcatatgaccaacttgcaatcagcctatcatctaaggataggaattgcatccatagcctccaaaccgtacagtgactctgcgtggtacatgtggacgttatggcccttggcatggctgtcaatggtacttgcatggatttatgggtcctcagcatttgtcgttgagagaattaaactaaacaagatgaagatgcaaacatgggcattaccaagatacaacttccaagtaatcacttcccctcgcttatgcatttctaaattcaaaggtatggattatggaagat

SEQ ID NO: 68870 - DNA, 3262 bp, Oryza sativa
taagatagctcgtgccattgccattgcactatgtgacagaggtgtccaggtataatctatatatcaatttgcaaatcatcgttgtcttgaatatattttggttaatttttctcataatttttgccttaaattgcattacattaatctggatcaggtgatcatgaatgaaaaggaggtataccacatgctcaagtcacaaataccagagaacagggcaagctatttgaaactctcgagcgacaacgtacctcaggtaaaaaaattgttgcaagaaatggtgacaaactctcaagcaacatgatgcacctgtagactcttctactagtaatgttaaaatgtagcttatagactcttctacaagtaatgttaaaatgcagcttatattcatgctaatacttcatgttattgcagctttggatagtacacaatattgacgacaacgagcaaaagatggcgccaaaaggaacaatttttattcccatatcacagttcccccttaagaaacttcgcaaggactgcacttacatgagcaccccagcaatgaggatcccggaggaaatgaagaatatccactcctgcgaggtaatacagatatgttatctgctttgttaatctgaaaatatacgacatcaaagaacctcttcttaatagtgctactacctttgtggtcagaattggcttccaagaagggtgatgagtgcttggcacattgctggaatacttcatgctctggaaggatggaacatgcacgagtgtggggatgagatgatggatattgagaaatcatggtcagctgccattcggcatggattccttcctctcactaaagcttgacacctctggaagcatggatggtgtattccatgctagtagatgatgctatgatttccagcaacggcataatccattcattatctagcttgggaaccagatggattattcacttattatcttactatgtttgtaatactgagcttgggtactgataagtcatgaggaggcacagtgcaaacgaacttaattccaatagctcagtattttataatctatagtctatgtcagttctgtaacattacgtttatctcttatttgaatcttgtgggggaataattaaaataataggcaatgttttcttgtttagacttcgcaaagtaaaacctgactgatcgcacggtcagtgctcttgagacgagacaaacaagaccaggtaaagctaagcttactcgctggctcgctgctactatcgttttacccttcccttaaagtttgattcgacactgtaaaattcgcccatgacgctctgcacaaaatctttgaaactagtggcacacagcaaaatcagatgcatcactggcttcacacttctaaggctgtgttctttcctgggtgatctgggtgattgtgagtgagtttgtttcgttttccgcacgcacatttcccgaactatacggtgtgttttcttttgcaaaaaaaatttatagaaaagttgctttaaaaatcatattaatctatttttaaaatttaaaatagttaatagtcaattaatcatttgctaatggctcacctcgttttgcgtatattcccaatctcctcgatttcctctccactatcgtttggtttgaaatgcttcgttcaaaaaggaaaccatcgacccttcaagcacacagcaccagtggtctagtggtagaatagtaccctgccacggtacagacccgggttcgattccaggctggtgcacgttttgttcttctcttacctttttttttaaccgatccgatgactatgatctccaaaaagtaaacacgcagagtatcagagtgtactctctatttgagtaccagagtactaggcatatgtttgtgtcatggaagagttgcacagtgtattcttccgatgactatgctctccacgaagtaaacacgcagagtatccgactatcaactgcatgtattgattcagagtgtactctatatcagagtatcagactactaggcatatgtttcatgtttgtgtcatggaagagtggacagtgtactcttctttcttgcatgccgaaaatgaagggaaatagtgctggaagaaagcagaaatgctccacatacaaatgattccccaatataatgcattgagctagagctatatcatggcagagagttcacattccagaattctttacatcacttggtattggtaaaaggaacaaagaacgggcaaccaagcatactgctttgcgggcaaccaagcttggaaaaaaaggacagcagttcgtatgagctgttggaatatttaagtgctgaaccagcagtctgtaactctggaatctggattgtttatcctattccagagaaaaattactatatcatctttctggacgataccatcaatggctctgcattgacttccttgaatcacttgaatagcagagtagagaattcataggttaaacccgcgccctcgatttagatcctgtggcagtatataaacttttgtcagctaatgcaatttcattgatgaacgagacgagtgcagcagcatagaaccactcatctatacatatggagacacaaggtaaatgcctcacagaatcagcattaataaagccatattttaggggagaacctcaacttcctaaatgcacatatagatgccatcaggaacttactgcgcgttttgtctcggcaaaactcacttccgcaatgacatttgaatgccttcacaggatggtcgacatcatcaaaatcaatcccatagtcctgcaggtaaacacaagatcatggcaaacttcgaaaaatgacttacaacaggtagtgctccatatgctacatgattcaaccaaacaaaggggggatactatctatgggaaaagcactaatgagtatcaagtcacaaggtggccaccaaaaggtcaaaaagcccaaaacataagatgaaagcaaattcaactagaatgtctgaaaatggttatagtccacatgaaatggagcttaaatttaaattgtggagtacaacctacccatgtgagttcctcaaaaggctctattatccttgttgtgaagaacgccagctaaccaaaaaatggaagacacagaataagctcaatatggtttaacttggactaatatatatcagttacaagctaaagttgaaaaaatacatggtaataatggtggtcgggcgtctcgatctcaacaggtattcctataatattagcatcaaagcacctgaaaaccgtacaatgatatgccaggtcaagaaggaagaa

SEQ ID NO: 68871 - DNA, 1349 bp, Oryza sativa
tgtgtgctttgctttaccagtcttttgaattgtacggtcatacaactcaatgttcgttaatatttcaccaacatactcacaaacaaaagcacctcgaggaagtttctcagtactgcgcaatccccatccttttttttcaggggttaagaacacctgaaattttagaaagaacaagaaaaattattaaaacacgtagcaatgagatgtttactgtgacaagcacatgatcatacacatgatgcactatcacaacaaactgctgcagctaacatcataatttcaacaatatttggcagttgacaaattatcgtcaagctagcaaaaactttgatattattacttacctgtaaatggcgtgtgatgcctcgctgcaccacacggtttccacaatttctagtgcagccgcattttctccagcactccttgatgaatttccttgtaaggtgtcctttacaaggaccaggattcatttctgtgtttgatgaatcagaatttacttctatcttcattcgttcgtttgggcaaatcttgcagtagaaatggggatgtttaagtggttctcgaatcattgagatacagctatctagaaatgctcccttaagaaggccatctgttgtataagcaaactctcctcctgtttctgcagcacacgcacaaggaagtgattgtgccagacaatctctgaaacaatcagaacagcaattgtcatctccgattctagcaagggagatgtttacataggcttcttggagtgtgatattgtgtggtatgtagtgaaatggaggaggaagaatcccattgccatattcattaataattggaatccttaaacgttcttcaccttttgtgatatcattgacatcatgaggtggtctgttggcaccaatatgtagttgatgcggaacaaccggcatattactagaattctggctaactccagcaacagtgcaagaggaagaagtaccaccaaggctcatgacattattaggtggcataaaagcggaattagcttgatttgactgcaatatttgcggcactgaaggtttggacagaatgtccagggcaggaacagtttgtatgatgccttcatgtctaggtccactagattcaacaatacactggcaagtatctttaataagattcttaaaagagaaattgggttctaggctcttgtatttcctaaggcatctagcctccattttcttgcaaattaatttaatgtcaggcagatgaaaatcagaacggtttgccagggaagagttgtatgtgaatgatagtttcccagctccataatttgacaaaactacctcaatgttggatggagaatccttgctgcttacaatttcctg

SEQ ID NO: 68872 - DNA, 8946 bp, Oryza sativa
  unsure (1)..(8946): unsure at all n locations
attagagatcaaattctagaccaattctttgccaggagatatcaacatccagagctctagacctccctgccccatcccccaaaataacagacataagatcataatccctcagacatccacacataaaattctatatatccaaaaaacagccacatgtttttttttctttttgcaaaaagtgtatacgatatgtgaataaattccacaaaaacaacactacctttcacaaaactataaaaatcacacttctaagcaacaatttcagataactatgtgaacttactctctctctatatatataccattatagaggtatacgtccactctttgaccaaaattgacaacacaattcgaaataatctctggccaaatataaatggtctttaagttaatagtcacaatgcaagattttcacaacttctctgatcgcaatatattggcaacaacattatatcaatattagtttttttcgccgggaaggccgaaggaggccatctgaatatcaatattagttttacttttggatatattgacaaccctagttcaaaaggagtgaccacaaaatcccacagaaatattacttaaataacgggtctttttcaaatccaagtttgaggatcatgattcttattgtgaaagtagtagtaaaaaattctctttaaataataatgcactcatgtctagcaaaatgctttacaatacacgcttgctctcaaagcctcaacaccccattaactggaatttatataaagtattcctttcaactctaaaccataagtaattcatcttttttttaaaaaaaaaacgctacagtgatgtgtaggtaggaagctgattaacagaccaagactatattaacataatgttaacaaattgataaaatagcactgaagttgacaacaatacaacccaacaattaaacttactccatgaattcccaacaataagtagtcattaattttggatggtctatgaattaacagcattatgaaagtaaattgatgatggacacactaatattgcttttatgcagctgatttagatacatttgtcaaatttcaaaatgttgttaccgcaccacgcccaaaagatgttttggaacggatagagtggagagaagaatatttagattagcacactcaggtagacaacattaataggctgggcgacctgtatgttttagtttatacaataaaactagattaatttgtgggaatccatcaacaaagcattaaaaggttagcattttcatataaattattaacactatgtcgcctacaaagatattacctttgcgagtactgggggctacaacttgcggacaagtagttgctactgggacctcaaaagtttgaaggtcttgaccatggcataatacagcagaattattttcaacaattgttgtattctttgcaatgctagggcatgtatgtggttccttgatcagtaattgtgaagaaggcaactccaagtgggccctggtgactttcttcccattaacagttcgggcagacagtgtgcctcgtccctgctgtggtggagcttcaacaaactctctattgtcattgccatgcatcttggatgtaggattttgagaacgcttttttgtcttaagcttcttgttagattggtctgcatcaagatttgtctcattagcttgccttttctgtccttcctggtacatcaccaaaacttgaatcaaatcaaaatggcagattaatgaaataataagatatatggtgctcacataataaagaataaaactacactactgacttaaagaaccaaatatttaataatatgccagaacaaagcaaaaagattatactttgggatctgaatcacaaaatatagcatcagcaagagccagataattatcagcttctatatgcacccagttgtaatcgaataagtttagtagattattcaacacgggcgcagcagtttcctttaggataccaatatcagccatggctctgatagcagcatcaaatctatccttggaaatctttggaggagccatcctgcttgcagtggaacaaatcagcatggcacattaacacgtgatatcctttgagaaagcaagtgataagaaaaaccatatacacatactaagcatggtatcacaaacatcttacgaatgtacaatgaagttaagattgtgatacattacgagaagttgtggactaagcacactaggctacaggaccaaccacaagagtactccaggtacaagctaacttatttatccttggagaagggctgtgcttattgctgaattttcaatctattgtgcatgttaatattattctttcagtcagcatttgaaatagattactcaccggataattgccacataccatctacttgattataggaaaaaattaaatattttgaggaataaacttaacaaatagcactataaccagaatggttatatatgccaggggaagtgactagttttcatgacacagcagtgcaacaacaggaaaaacagaaaatgagtaattcatactacttgagcagctgacatccaatctgcattattatctctccatgtgcatgcaaagttagacaacttgagcagcattcagaaatgtataccttgttcagtgttacatgaggcagtaatgttctgtaagatgtgtctatggtttagtataagaattctgagtgtgcaagacatgtcatatattcgtgaattattttttttttgctgagtgagatagagtttggaatcggataatatcatcggatgcccataaaaacaattgtattaaaaaatgctgagtaaaagaataactcttacgacaatcccgtgtcacccgttttctctttgccattgggtttggccattccagtccttagctgagatgtggaaactgctgaccctgcaaatacaatagtgtccgtgaacagaagcagaatacatataacctttagctcaattgttcatgtttctctgccatcagaatgcagtagcaaaaacaaacatcataaggaaatcatgctataaaactgtgtcagaaattggcacttttaggttatttgaacagtactttctgttcagagaactgttcaagctacagtagtaataatctctttttgaattgcagtagtccataaataggtgtataatgatcatttactaaatatagttataatgtaagccatagtgtcgagttgataagactaataatatgggcaagtggtttaccttgttcacaatggacgaacaagttcaaaaacatataaatctggtttgtagaggataggatttcctcaaaaaagatataaattcccttcttaattaacatattgaatacaaacaaagtaaaatcaatttcagatcatattagtcactggaaacggggtcagtggcagcgaatcctagacccgggaacgccatccccgttaagggaacgcggggtcattttcgtgcccaccttgtaaaaacctctcacaagtagcataccacgtttctcgaccccgttcctcaatcccgtcgacccgggaactttgtgactaacaaacgcaggaaattgcagtactatccgatcggtattgaatattggttttgaaatccagtctaaaactttacatgggtgaatccacccatttgatactacaaatatcccattgcaattgtcatggaaggaagtcgcagtcctatctagatcactcacatcaccaagtctattgtggttctgaaacataagaatgccatttctgccctagctatattatatcctgctgcatttgactgagttaatccaaacagttgcttaaaaaggcttcagcaaaaaaaaagtgggaaaatcgtagctacaaacctatggaaatatatttcaatatttcccatgcaatcattttctttaataaaacatttgatatctggtcaaatttcccacccaaactatgcgcaactccattaaagcttatttgaatatataatttattatatatatatatatatatatatattctttcttctattttcaatctacatagctataatctagaccaaccatgactagtggcatatatctttctctttttttacctcattaacatggtaatttctaggccttgagagcaaatatgttggctccatttaaccttcactaacttatataatactccctctgtcaaaaaaaatataaacaggcgccccctcgctgtcgctacttcctttggttggtcacccttaaccgttgctggatagcggaccgcctcccgagtcgtggtttgtcacacccggatcgatgtgttctttgtgatcaatgcgaagagacgattgatcatctcttggtcgaatgcccggaatcgcggcaactatggtgggttgcattcaaagctatcgggcattcggagtgcttaccgctcattaacactctttcttttcatggttgtgtgactgtcataagaagatggtcaaggaacatcgccggggtttcgacaccatcgcaacattggttgcatggacgatctggaaggaaagaaacaatcgagtcttcaaccagaagagcagaacttgggtggaggttgcaagggttatgacgggtgaagcggagctgtggcggctagcaagagctgcaatccctgttttggtagcccatgttagtggagaagggtcgcaaaaatttagttggagattaggcttttagttttttgttctcctcctgtaccctgtccccttcgttttgtctttttggcccgctttatacatacatttattccttcttaatacaaagatacgctcctcgtgtattccaaaaaaaaaacacttttggagtttttcccggacattaagaagaggggttaaattacattagggatggttgtgattggttgagatgggaaagtagatgcagaaattaaatgagggatggttgagatgagggagtaagtggagaagtagctatattttctgacggaggaagtatatagaatctagccttttgaacaaatacccaaggctgcattctgatatattatgaccttttgaacaagtactcaatgttgcatgcatctaattcttcacatagaacgcctccaactcccgaacaggaagctcacaagtcggcacaatggtggatttgggggcaatagtgccaaaggcacgcccagatctcacaaattttcacacaagaaaactaagcaggagaagcagccttattgtgatcagagcaacaaacgagcaactcaaagcgactgaacaggcacccaaaatacaatacgagcaaagctcctcaacctcggagcgatcacattcgcacacccaagcaacgcgggaggacatcgaaacttcgcagaaataggccgaagaaaaaccctcatacgaggagccctcaccccgcatcacaacaggggcggacctaacgtggtgcatggtgcatgtcccacccggccaaaaccccaatttgcttcagagaaagaggtgcgtatagagagggatgaggaggatgaggatgtgcgcgtacgggagctcaccgcggcgagggtgcggcagaggaccgccggcaccgctgccgctcgcgggatggggatcgtcgcaggcggcggccggcgggcgaggagacgggaggggaaggcgaggggactagggcgcgaggaggaggaattagaggcgccacctgctgctgcgatgtttgggcggtacgcgcttcttgtaccctcggacctcggtcggtctccctgtaacctgtatgtgtgtgtgtggatccactgccatcggctgaaacaaacccggtgcttcgggttggtgacagcttcatacattccattttgcatccgtgttaatgtgttagtattacgtacatcaaccgggtgtgtctgtcaatataacttactttctttttttctcaccttataattaatgacgattgatcttcgttcgtggttgggaggatatcctgaataggagatgaccattttaatccctataaggctgtgttcgctctaacgtgcgcacagaaaacagaacggtccattagtatgtgattaattaagtattagctaattttttttcaaaaatagatcaatatgattttttaagcaactttcgtatagaaactttttttaaaaaaaatacaccgtttaacggtttgaaaaacgtgtgcgtggaaaacgagagagataagttaggaaacctgagtaagaacacagcctaagtgtttttgtttgttggcatgggtggatgagacgatcgaaagagaaaatattccacgtagatactggataaacatatccagccaaattgaccgagtgagagtatcatatttaaccttgaacatgaaccaaacgtgcactttattgtatccagccctacaacttccttaacttgtgattaatctccattcactgtattcttattccttccatagatacaacgttcactactagaaaaagcatttttgcatatggccaaaagcaattttttcagacggagaggaggatcgcctgcagaccaatgactgtgaaaatcatctattttcgcagttgggccatgggccgccctgcaaaattccaataaaaaaccaaaaaanatcccctcgtgccgtccatgggcatgcctcgccgccaccgccctccccggccctcctccggttggatctggaggggaggggatgggagccgccgccgctgcaacgggagccaccgaccacacgcgcgcctcgccgccgctgccgcaccgggagccatcatcgacgtcgccgaccacgcgcgcgcctcgccgccgccaccctcccccagcctccctccgtccggatcggggaggggaagggaggggaggggagccacccacgtcgccgtccacgccgccgctgccctcccccggcctccctccggccggatctgggaggggaggggaggggagctactgccgccgcaccgggagccaccgatgtcgccgtccacgccaccaccgcgtccgcgcactccgccgctgcgcgctctaccgccgccgcgtccgtgccgccggtggagggagggaggggaggggaggggagaagccggtggagggagagagagagttgagaagataagtttggggaaatgagtggtggggaggggttggaggagtagataagtatcatttttttttgaatgtacgatttttacaggcggaccacataaggtgcgtctgcgaaaatagattttcgcagacgccgcttaagtggtccgtctgtgaaaatacagcgaacttcaccctgatttattttttttaggcagttatttgactccaaggttcatgtctacctacgaaaaaaagaccccacgtcaggaaaaatgctttttctagtagtggttgtaagaaaaagtatgttttatctatattcccatgtacatcaacaatgtagtttaaatgaacttgtccatgtctgtttgtgcgcactgccaccggctgaaacaaacccgatactttgggttgtacgcagcttcttgtttcatatttacattcgtgttaccatgtatatcaacggtgtgtctgtcaatatgtcttactttcctattttcttaccatttaattaatgaagattaatctccgttcatggttgaaatgatatcgagatagtcatctaattgttgagcgtgtttagttagtggataagtatgtatgggacagtcagagagaggatattctacaagaattttgaatgagaatatccggccaaaatggctgaatgagaatatcctatctaaccatgaccatgaaccaaacgcatatttattgtatctagacatacgacgtatttcctttttcctcgacttctaattaatctctatcaatggctttcttgtttcttttcatatatatgttttatgggtgttcccgtgtacatcaatggtatagttttactgtgcttatcctacaacttactttttctttccttgagatataattaaggagtattgatatttgtccggcaacgcggctttcctgttttctatcatctttccatttgttctcctgtatgtagcaacggtttagtaatgttgtgtttggcctcacaactttgcttcctctttccttgatttaattaatactacatgtttgtgacttccctatttccatatccatgtttccatatatgctttcatgtgcgtctatgtttaagttttgttgtactagtcctcgcatcttattttctctttcctcaatttctaattaacaaatattgatctctatccagcaaccaacacaatttctcttatcccatgtccatgtgttacaatagtgatctccgtgtacatagttcaagtttgtgcttcatattttctcgacttctaattaacgagcatcaatccatttctagtaattgatacaccttctctctttccatatctatgtttccatctatatacatcaatggttcaattttagtgtgcctagcctcactttgatcttttgcaagcaacaatgatgtagcccccataaataacacatagcggcaagagcagccaggccatgcccattcactgacgtagcacaaatgcataacaatgttgcttctacacgattcatggttattgccttagtcctatattaggcttcattcggtttagaggatttttataggattattgtagaaattaaatccttaggattttttttctatatgcatcattcgtttcttataaatgtagcctaccaaattcctaaggattgtagtcttacaagctaattccataggatttttagcatgaggtaagacctcttgaaaaaaaatcctaaggaatggagtggatgtgaatcctaattaatcttttacttttcatattcttttgatttaaaaatcctatgaaccgaataagccctaagttctttgacgcggagcttgtgcgaaaaaaattaacagtatcgttgtgcaaataggggtgggtgtttgcttcacttggtcttatcatgaaagcactgtatcattcgttgtaattgctgat

SEQ ID NO: 68873 - DNA, 63579 bp, Oryza sativa
  unsure (1)..(63579): unsure at all n locations
ttattctattcttttcttcattgtttttcatatatagattcattatatcccatcccaaaatcccaaatcaatcaaccccgaatagtctccaaattctcaaatcaatctctaaatacataacaaaatctttaaaaaattacatcacaacttctacaaaattcattacaaatacatcacatattcacatcacacacaaatcaaatacatcacatattcacatcacacacaaatcaaatacatcacatattcacatcacacacaaatcgtctcagatccgaatcacatatttaaaaaaagaaagaaataaaggaagaagatgaacggcctgcagccgcggcggcgcgccgcctcgccggccgccgccgcaccgcccgccgcgtccccggatctgccgccagccgccagcgtgccagcgcgccgccgtgccgcctcgcccggccctctgtgtgccgcgccgccgcaccggccggcagccgccgcgcgctgcccgccgcgtccccggccgccgccgcgaggccgccagccgccagcgcgccgcctagcccggccctccgcgcgccacgccgccacgctggccgaccgggcctatgcgccccgccattgcagagggaggtggggaggagggagaggaggagaggaagggaggagggagagaaagagataagggtgactctgtgaggagatgagttaaaaaaggagaggaggagattgtattggtccaacccgcgtgcagccaccccgcttatgtcgacttttttcccggttggtgagatctttagtcccggttggtaacatcaaccgggagtaaagcttatattgatcttttttcccagttggtaacaccaaccgggattgtaaatagatcttggactaaagatcaaaaaattcatcagagctttcaaactgggactaaagatgtttttattcccggtttttaatataaccgggactattgtgaaatctggtggaccgaccaaagatggttcctccaccagtgatgatactgcagtttttatactttatttgtttctcgttttataaagaatgtttcgatatttttgtttgtttgatgtttggtcttttatcaattaaaacagtttaaccatatctttttttttctttcttggatcaagcatccgacgatcgaagctacgtttttttctctttttttttttaaaaaaaaagaggacgactagagacgacactgatagaattgttgcaagttagatgctacaaaagtggagatggtttttcgtttcttgagaggatattatctctcatttcttgcatgccacttaaataaaacaagttcaagtttaaatttgacttcgataagttataataaaaacaaattaattttttaggacaaaaacaaattaaattgaaactagttttttttgcggggaaaattgaaactagttaattaacgtgtgtatatttgttataacttgtaaaagttaagggtgtgtttagttctttgggtgtaaagttttttaagtatacggacacacatttgaagtattaaacgtatactaataacaaaacaaattactgattccgcatgtaaactgggagacgaatttattaagcctaattaatccgtcattagcaaatgtttattgtagcatcacattgtcaaatcattgcgtaattaggctaaaaagattcatctcgcaatttacatccaaactgtgcaattgatttttttcccacatttaatgccccatacatgtgttaaatatttgatgtgacgtttttagccaagattttttttatctaaacaaggcctaaattaattttaacttacatgtttgcatagtgatatactcactctgtttcacaatgtaagtcattctagcatttcctatatttatattgatgttaatgaatctagatatctacttacattgtgaaacggatgaagcatgtatcttttactaatctatcttaccagtttttttaaaaaatattttaattactatttagattacatgaaaaaagaggtgatatataaatctcaacagatgaaaacactactactgtcccacgaaagcaactgattaacccaaaaataagagaccggatcggagacggcgccgcgcggtgctacgtacgtgaccgagtccgagagtgactccactcatcgtaacgcctacatactatcctccgtgcttatatacttcgatgcacgtgcgcccgacctcttcggctcttcctcgtgttacccaactgacacgctcgtgaaaggcctcgctcactaatcactatggagccggaggaggaggaggaggaaccaaacatgtacaactcggaggccggggaggagaaccacgtcggcggcttctacgagtgcacgggcctccctcgcgacgcggatgggttcgtcgccgccgtccacgaggtgaacccggtgcagttcctcgccggcgtcttccgctacctgggcgaggacatggcgggcgagctgctccgctccgacgacgacgacgtgctgcactgcccgagcatcgccgcctcttcctcgccggaggagctcctcgcctgtgccgcccgcgcctacaccggccgcgaccgggagcgatgcggtggcagcgtcgtggagcacttgtacatgatctgctcctgcttctgcccgcacgcggcgacgacggcggctcatgtgtcggcgcccgtcgtcgccggcgctgatcacgtcccggccccgtgcgacgacaacggtgtcgacctggcttttacgcaggacgagttgaccgcggcggcggtgaccgtgggcgaagtggacgaggacgaggtggccgtggcggcggcggcggcgacagtggacgcggccgtagacgagatcgtcctgaatgcactgggattcaatgagtttgctcgcgacctgaaggagaccatcgaagcaaaggatcgtgaggacgcgttgcgcgcggagggctcgtcagtttctcccggcgttcgtccaccggtgtagccgcgtccgcgttcgtgttgtcgtgtgacatgtttccgcccttacgaatcggtgtcgtaatagctgtggattttttctggacgtccggagttggaggtgtatgctgtagtacgtaatacttcagttaacgttttgcacaaaagttttgcgctttggataattgaatagttatccaacctaggtctgcttataatccatcaccaatataggtctgcttgtagtccttcaccaacacagatatgatggttcgtgccctatcaaacattcttttccttgcaagctaactatactactctctttgattaaaacaatgatgtttaacccctattaaaactcttaaaacgttcactattaacttatctaaaaaatacttagctccaaaacataaaaaaaaagatgggtatatttattttgattttgtaagcttagtggatcttataaatttaacttttcaatagaaaattattgtcaaagtcacatataaaaataccttaaaagagttaaacgagctgtagtacctccattatgaaaattcacatttatgacaagtggtttgaaattccctaagaaaatattgttgtattggatgattacatatgtagaaaattgtttttgtttctcacgatgtgactttgtggctcatgttttacgagattcatctctctctctcttgtatgcacgagcaaatcaagtcgcgcacatggctggcccaccaaggcccacgtcacgctctacgcagtgaaacaattcagtcggccacgtgcccacatgtggaccccagactcatgtgattgcgtttctcccgtgcgatcgtgctagaatttttatgttttttcacctatttttattactgactttattttaatttcccctataaaaacatacaaataataaaatttattgttgttttaagcctttgttgaaaaaagtggcttcatgtttacttactacagtaatttgattgtaaagttttaaatttaagttgaaaattttattaagttggttgaaggttttcaaatttgagttaaaagttttgaattttaagttaaaagatttcaaatcttcagttgaaagttttcgaatccaagttgaaaattttaaatctgaatttaaaaatcttcaaatccaagctgaaaattttcaattctgagttgaaaaggttttaaatataagttggaagtttataaatcttcacttgaaaatttttaaatctaaattgaaagttttctaatataagtttaaacttttaaatatgaacttaatagttttcaaatctaagttgaaatgatttcaaaatttcaaaatttgattcagtaaaaaaaagaaaggataatagaaaaaagacgtgtgcggggaatttttttagaaaaaaaaataaaaagtaaaaaaccaagagacacacgcgggaggttagcgagaaacgcataacaaaagtgggtccaccactttctttcaccccgtgcaatatttccaaaaaatggtgcgtacgcagttacgcaccaattagccacaccctaggttctatcataaatcacgatacaatcttattcttctttgctcgagatttgtgatagagcacacatcacaataaaaattgacgctttcttaaaacaaaaaaacctcaggtttgactcccgctcaggcgcccgatgggaggaggttaaaatcgggcgctgacggcagcgttcgatttacgtgcaaaactactttaaactgatttttctcttaaattacttatccaaatcatgatccggttgcaccattaaattcgttgtaattaaatcttcgaaacaaggccactcctagatatattccaaaaaaaaattagcttattattgaattatttttaaaggttgcacgatattccattaggtatattggaattgtttcactaagtagatcgaaaatgtttcactcgtttaaattagatgttgtttcaccttatataaaaacaatgtttcagcaaatagcgaaagaatgtttcagttcattgcaacattagatctatacatagtgaaacattgtggtacactaggtgaaacatttttcagtggaacaaaaaaaataaaccaaattcccttaataaggagtttccaaaatatgtgggggtttttttgcaatggaaggtttcgttcactgcaacattagatctatgtcatagtaaaacattgtaagtacactaggtgaaacatcttttgtggaataaagatgatggataagtgggtgggccaaacaggtgctcacgtgggggagggcgagcgatcgattttcccacctccccggtagaccgatgctgggcattctccggttttatcacaaatcgcggtacaatttttctttgtgtttgcttgagatttgtaatagagcacatgtcacaagaaaaaaaatgacgctttcttagaacaacaacataacaaaaaaacaaaaacccatccaaagcttaagcccacggacgcggtgcgagtgtgcgacgagcccagagaggcaaaccaaacgtccaaacctccgcacggcgccgccgcacgatgcccccggcgccaccgttctcctcccacggcgacttcgtcgccgccctccaccgctgcgccaccctcgcgcacctcaagcagctccatgctcacgccgtcgtcaccggccgcgccgccgcgcagaccaccaccttccacctcctccggttcgcctccctccgcctctcctgcctcccctacgcccgccgcctcttcgacgccacgcccagccccaacgtcttcctctactccgccatgctctccgcctacgccgccgcctcctcccactcgcaggaacacgcccgggactccctcgcgctcttcctccgcatgctccgccgcggccgacccgcgcccaaccagttcgtctacccgctcgtcctccgcgccgcctgcgccattggggtccagctggtcaggtcgatccattgccacgcctgcaaggacgggttctacgggcacgattttataaggacctcgctcctcgatgggtactcgaggtacgggatgatgggcgacgcgcggaagctgttcgatggtttgactgataggaacgtggtctcctggaccgcgctggtgtccgggtatgcaagggcagggaaggttggggatgcgatagtgttgttcgaacggatgcctcagagggatgtgcctgcctggaatgcgatcattgccggatgcacacagaatgggttgtttgtggaggcagtggggattttcaggaggatggttgatgaggggttccggccaaatggcaccacagtatcttgtttgctgtctgcgtgcggacatttagggatgctgaagattggaaaggtgatccatggttatgcgtggaggagctgtgttggttttggctcatccgttgtgaatgggttgattgatatgtatggtaaatgtgggaatttgatggaggcaaaatggatctttgatgcgttttctgataggggtctgaccacatggaattctctgatcaattgccttgcactacatgggtgcagcgagagtgccattgcggtgtttaattcgatgaggaatgaaggggttcaacctgatgaggttacttttgttgggctgttgaatgcatgcacccatggagggtttgttgatgaaggtcttagatactttgaactgatgtgtgatgagcatggaattgagccagagattgagcattatggttgtgttgtagatcttctttgtcgagcaggacggtttcaggatgcgatgaattttatcaatgatatgaaagttcaaccagacgaagtcatttgggggtcattactcaatgcctgtagaatacacagacacctagaactggccgagcatgctataagaaacttgttggatttgaatccaagtaatgctaattatgtagtgatgcttgcaaacttatacagtgaaggtggcttctgggaagaggttaggaaagtaaggaagctcatgaaggaggatgttacaggcaagaagctgcctggttgtagctggattgaggttgatcgcaaaactcgccggttttattctggtgatgatggtcaccctgagtcagaggatatctatgacactcttgataagttagctaccacaatggaaatgcaggctacatttgcatagattaataattcatattcaaaaatcagcatcttctaattctgtacatgactgaaactgttgacctaggcagcattatgctggtagatagatggtcgtgttcccttaaacacttaccctgagctatttatggctgaggtactgcttatatgccactactggggtgtacttctacaggatttatccattgtaatgctgttatctttgcatatcatgaaggtatgtgtatattatggatggccgaatatgcttctgcttactcccattttgtatcccacacctggtgatcttttttcttaattctgtcttcagtgctgccactgtgtttcccttggttcggaagtaacaaactgtcctatctggcatgtaatacctgctgctgctcaaccattataggtatggataacacctctatgtcggtataccatgaccaacctttgttttatggtccagtcttcacaaaatctacgctcgctgataatttgttgtcaaatgtcaacagggcatattcttgttctttttccccctcttgtacaggagcaccaaagtaaaggagacataagctaaagatggagtgaagaacagatgataaagagttttctataaactaccatttttatctgttatgcaggtaattttatattaattcaatttgtggagaacccttgcaaaatgctttcattatcaagtactttggacttttgagcctggactaacgaaaagcattacattaacagctggaatagctggttgagacttgagacgagggatatacggaaagctgcaatcagttgcatattggcctctcattatcatgtatgattgtaggagcatggttcaaagaatatgttctgctccttatctgctttgcagtaagaccaatacacattttatcattttatcttccatatcttatctcggtttctcttgatttgctctcatgtccaccatttcctccctccaattcaaagcttcttcttgtttaaacttattatgtaattcgttctaaattggtgggttctcaatctatcatctttttatcctgtctctgcaaggtgcaaaaaggtgattctttgaaagaagattctgggtacggagggaattgcgactgacgagatgcttacagttcatctgctcatgtgatgtgtcacatggcagaaaacatggagaaatgagcgccatacgttgccatgctgcgattctagagatccagtcatccagacagtggaaaggggggtcgtaaaggatggcgcagattatagaataaccatacagagtacaattgaaatggaccaacgatgaaaggaaggaaatctgagaataaattccagtgcagtgccagtgtcagtttcccggtgccatgcctgaccatgtaaattgcgatccgtatgactatccaaaagaatggcaatggctgtagtcctccgaatttagtgagttgaaagtgacttgtgagactaaataaaatataagcgactggcaatggctttgatcctgtagccactagccagcgataactgataagtgcagtaatgtctcagacaatttttagggcgagaacttttatggtacaatgtactgctagtatatactataagtatatatgatctaacggtgtagattgatttgattttttagttaattagattgcagtataaagtttgaaagggtaattntgtcttttctttgttattctatcatcaaatcatgctatcgttacgtccttcgtcatccaggaccaggtactcccaattagattcaatctgaacagaagattactaaagagttattttattttctatcaaattcctaatatgcccttctatatactgtcagtatatactggtagtatattgtaccgtaaaagttctctcgacgagcgatgacagtggatcgaagattggccgaatatgccatgtttgcagtggatcgaagattggccgaatatgccatgtttttggaagatttactccttctgatgttccaaagaagggcgcccttggcatgcatgtcagtgctagggtatgcttagaagagcttccggcggctgtatcttataatcacaagtttcctcaaacaacctagtttttcatccaaatttggagaaattacggaatccaaaaaataaaagcaagtttttacagcctttttaggttcttaccaacttcttctaagaatcttagaacttgtttggcagagctctagctccagctccatctttcctatagctggagtccaaccaaacgatttcagctctacccaaaaagggatccatctttcttatagctggagtccaaccaaacgatttcagctctacccaaaaagggagtggagctgactagagtactctcgtaaaaatgaactagagaggtgaaactggatttacgcagctcgacaactccactacagacccaacttctaaagttaaatttagaagttgaagctctaccaaatgggaccttaaactcccataaacatgtcctaagcttagaatctaaaactccttcaaatgtccaaaaaaaatctaatcgtgggaatctaggattaagtttttttatgagacagaatgagtatgtgcctctaaaatctctttaggggaagaatttttttaaaaaataaaagaaccggaggactgccaataacattacaaagatagcttgcatgtactccttccgtatatgtgcatagctagaaataaggtcttttagggagttatgctttgagattatttggtgacctacgatttacaattttcattgcattttgtagaggtcatgcacgcttatatacagtggtgtgaatgtggcatgtgtgttaagtatatgcatccaattatactctcttgaaaaaagaatcatttttaggaagagtacaacctatgccctacaacaattgaagcttgaatcaatatattttgtctcctacattcttaattaatcggagcatgatcagggcatcagtagcaggtaatacctaaaagggtactagtgatgactgatgaggtccacatgaactagtaagttaaaattatcatgtactaacacaatgttaagtacaaggaccaccaagaggttgagacttaccagtgaggtttaaaagatcccatcatataactattaatttggagacgtttcacatatacttgaaagttgcctaagtgtgacaaatgattggcatttcctttttaagtctttaagtctaaatacctcaagtagctttcaagcgccataaaaaatcacgggtggaacgagttaagaactaacctagcctggagttcctccatgaccttatcactccaagacagaacgacaaggcgatcatttcaaattctaatatcatgagcctagcctccctccggtttcattttaattgacgttttgaacaatgacacggtctacaagatatatttttgaccttatttttctattataatatatataataaataaatacatatttatttttattatagtgctttaaaagacaaatctatatatgttgttctagttcctttaaactaaatatttttaaagttattgatggttaaagttataaaagtttgaccttaaccttgtccaaaacgttaattaatatggaaccaaaggagtatcaatactaatatctcctttggaaacatgaatttttctctcaattcacgcgatcattgatctaattcattaataaaatcacatacaacttcgataaatttgttcattctaagggtccctttgaaacataggaatttcaaataatttggaacgaaatgtatcaattcctataaaaatcctataaaattaaatagggggaaaaactttgcttccattatttgagagtgcaccaaactggcacatatctctgctcctgtaccggtccaaagtcaaacgttaatacgttatatgcattctcctagcagtcgcctatacattactgaacacgcattcgggaagtacaaaaaaaaatcatataagtggtgtacaaactacaaataccacagttgtcaaccttttatttattattacgtatggttttttttttcaacctgatagcaaacacgggctctctcctcatgtggtcacccgatcattgacaaagaaaggtagattatacccgtttccagtttttccacctgacaattatatcacacatgatactttgttgtacaaagcaaagctctacttgagagttgagataaagggatttttgctaagattttgtgtaaatttatatcaaatcttagtcaaatcccctgttccaaacagatgatctcagataaaaaatactactatctttttcttcctattatacaatcacgaaacctgcagcatcagatcaaccttgaaaaacgcttatatgcatttcgttcgatcgatgatgctgcatgtatgtactactagctcagctcctccggttccactagacatggcctcccatctcggcggcgacctgcgtgccgtgcgccgacttgagcatgaacccgccgacgctgcggtccggcttgccgctcgcgtcgtcgtcgtggtacgcgtacgcgaacccgccgtggcgcgtctggtccatgccggccatctcgtcctcggccgagatgcgcagcaagcccagcttgttgagcaccaggaacagcggcgccatggtgaagctcacccacgccgcgatgaccaggatgaccactatgtgcgccccgagcagccggccgccgccgcccatgaacagcccgtacgggcgcccgggctggccgaagatctggtccacgtactccttgcgcgcgaacagcgccgtgaagatgaccccccacgcgccgcacccgccgtgcagctgcgccgcctcgagcgggtcgtcgaacttgagcctcgccgccagcgcgttgaggccgatgagcacccacgccgagacgaacccgcagatgatcgcggcccacgggtcgacgacggagcaaccggcggtgatcgccgcgaagccgccgaggaggccgttgcagacgtcgatcacgttccagtgccccgtctggagcctcttcccgaagagcgtcgtgagcgccgccgtgctgccggcgagggtggtggtcacggcggtgcgtcccaccgccgaccactgcccgtggatgctaccgggcgggccgtaggatttgaggatggtgaggaacgagccggggttaaacccgtaccacccgaaccacagaaggaagctgccgagcacgacgagcgacgcgctgtggccgcgcagcgccaccgagcggccggcgtggtcgaaccgcccaatgcgggggccctcgatgagggcgccccagagtccggccacgccgcccaccatgtggacaacccctgacccggcgaagtcgatgacgccggacccgaagagcagcgaccccgacgtccgggaagccgaggcccacccgtcggcggaccagatccagtgggacaccaccgggtagacgaagccggtgaggaaggcggagtagatgaggtacgccacgaactgggtccgctcggcgatggagccggacgtgatgcccgcggcggcgatggcgaaggcccactggaagaggaagaagctgtagtcgaagccgacctgtgggacctgcttgaggccgaagaagtgcttcccgatgaagccgttggacggcgccccgaaggcgaaggcgaagccgaagaggtagtagaagagcgcgccggcggcggcgtcgagcacgttggtaagcatgatgttcatggtgttcttggcgcggacggacccggcgcagagcatggcgaagccgagctgcatggcgaacacgaggtacgccgagaagagcaggtacgtcgagtccacggccgacgtcgtgtccgcgaactggttgcacaggtagtccgtcgcgttcgccgccgccgtgcccagcagcgggccgagggtatccgcgcacgttgccatcctcgccgcctcgacgcgcgctcaacacagactgtagaggagaggggaggagcaatggaagtgtgggctgtgggtggagtggggagcggccgcgtcggatttataggcgacgtggagagggagcgagaaggaatccatgacttggggggtgtcgttgttgattccttcaaagtgtgaagggcccacctgccagtgaatctttggctacctctgaaatgtgggacccctatgatttgcttgttgatttgtccccctcctgttcgtggtcgtagttcatcgaatcccgtggaatctctctataggcctactgtaggctgcggcctggaggctgtgtttagttttttgatataaagtttttgaagtacacgcatacatattttgaagtattaaatatagactaataataaaataaattatagattctgcttataaattgcgagatgaatttattaagcctaatcaatatgtcattagtaaatgtttactatagcatcacatggtcaaatcatgacgtaattagactcaaaagatttgtctcgcaatcccatatttaatgccttatgcatgtgtccaaacatttgatgtgatatttttggctaaaattttctgggatctaaacaacgcctgagtcgcaatacagtggtttgtactttcttttaaaaagtaaaaacgactgtttgtacatttcgtcctcctctatatttgtctatagtgaagcacttgttatatttcctcctctgtttgtacttaaactttctttacttttttaacaatattatttttattatatttccacttgtaacacttggaaatattttataatttctaaatctaattggttcaccatgtttctaaagaaaattttggttgcacgaaaagacacacatgaatatgttaaccaaaacacatgaaatccttcaagctttctgagtggtactatctccatttcaaaacatatgaatttctaaggccctgtttgtttcagtttaagattattataatatatattattgagctagattactataaactgaattataataagattataataaaccgatatagaataagttgttagctgtttgtttatctggattattagctgtttgctagttattagctatccaataattaaaaaaagcacctttagagtggattaccagattatagtaatctggcttatagattataataatctatcataataagttatctgtttgtttcagcttactcctaataataatcagattataataattctaagtggaatcaaacaaggcctaaattgtttaacaaacattgaggttaggtcatagtctttttttactttagtatagttaattttttgaattttgaattgcttggattccctaaacccttccaagcatatgattagctatgaaatcattgagataatcggaatgatggaaactactacttatattgtgatgcaattgaattctaaaaatccttatattttggtattcatggagtacttttgaagctttcaccaaaacacagggctacgaattgaacccaatgattaatgttgtgtttttcctgtaactctaccatcatgtaatgattgtcgctctgcctttttaagcggctggtgctggttgaacgggaaagtattttctgaacctaggtgagctgcacctaggctcattaccgctagatgcgcctcaagattcggacgtacacgatacccacctgctatatgtgagaaacctgagaaatcatcacgaatcgcttaatcgatcgggcggcagacgccctaggtgcagctgcacctaggtgtagaaaaaccgcgtccctgttgaacatgtactccctctgttttttaatagatgacgctgttgactttttctcacatgtttgatcatttattttattcaaaaaaatttacgtaattataatttattttgttatgagttgttttatcacttataatactttaagtgtgacttatatcttatatatttgtataaaatttttgaataagacgaatgatcaaacacgtgagaaaaagtcaacggcgtcatatattaaaaaacggaggtagtattatcgttcatggtacttctctacccacctgaaattttcgttgtctatcatcgaagaagatcagccgttgcacctcatgctcaaagtgcaggtgctcgcgaaaaagtccagcacgagaattcctggaaatcttttataggagtacgtacttctctaactgtcaagctaacctgtacaagtgtgcaccacccaagtaaataagccatcgcagctatctcccattttgcaccggacttttggaaaccacagatcaacgtatctcctcattggcacaccacctgtcgataggcagctcacgcacgacgatgcgaccatcgtgccgaccgcgagaccacggcgagaggcataaaaacaaccgatcccgagatgggcaggcatatcggcgtacgcacgcagcccggtgagacccgccgcagttggagcgcgcatcgccatcgccgcgagcccgcgaagtccacggcgccctcgtcggcggaacaccccagttgctgacgagactgacaggtgacagccgagacagccagaaaagaaaaacgaagccggctgtactaacgacatcaaaaagaaatgggagccccgtctgtttcagacgtaatggcaatggtaatactaattagtaataagataagctcccagttgacgctccacaactagccaatttccatttcgcatgttcgattattccccctgacctccatgccatccagtgtgcatcttccgtgtcccgaagagctgctcccgagtaaactatgcctgaatccagagtccggaaacacatatgcggtgtctggatctgccgttgacttgtggattgtgattaaggaagtgttctcctctctgtttttcgtctgacatcaccgtcctgctgccgattatagtattttgagtttacagtggatttggcctctcccctcatttgctgaatcttatgaaaatgttttagctgtttgctcctgacagaatagtgtgacctatcatgtgaaacgcgagcgcaattgtactgtactatcatgtgaaacggagtatttccgatttcaaaccgtattacctgccaaccgtttcatggtgtcaggggtacgcgatccgaggaggtcgtatattgtactcattgagcactagtttggcgtatcgtaacgttgagcttcatttagaaatcagaatgtacagaaaaaaagagttcgctgcctgtgattcagttctgaatctgatcgagctcacctgcatctgtgctcgagcgttggttcgtttcgtaatttattgcagcttgaattttgatgacagctgttactgtttctggacccttcgagatggcgattgctcgagctcgctacgtcaacaggagggccgttgaatttacccattttccacgcttgcgtacgtacgttgcggcggaggaatcggcttgctcttgttttcttttttaaaaaaacgcagatatattgtttttttactccgtacctctgatccaactaaccgtatgctgtatagtgtatatacagttcttatcttaatcaggaacacggaaatgtcgccgtcgtgatagggggggccgagaaatcgaaatgctcgagaggtgggggtggtacgtcgtgtggtaccgtgctgtattgtttttagttttccacgttctcatgatcgcctcctgggcagccggcttctatctgtggaggaagcaccacggagaggagcggagagggagggcgcggatcatcaacggcgagccgcgagccgcacgggaagcgcggcacatgcagatgtaggcaatggcgcacggcggcgcggcctgaagccctgaaccgcgcggagaacgacgctctccgtctctccgagtcccttccgtgcgagaagccactaccgcacggtgcgcgcggggatgcagccatgcaggacgaacggggcgcgcgggggagtgcaggccgcagtccgcagtccgcagggcaagcggtcataataggccgttcgcagaagcgtaaggaaggcctttcatggctcatctgtcacttgggggttgggcggctgggcctactttgcgattgggcctcagccatacgttccttagcggaaaaagtacaccaaaggtccctcagcttgtcatcgggatagaaaaacgtcctcgaaccacaaaaccagatatgcggggtctcttaactatacaaaaccgatcacgcgaggtccttcggtgattttgattccgattttagtctatgtggcagctgagtcagcgtgggacccacgtgggtcccacatgtcagactgtccacgtcatctctctctttcccatcttctctccctttctcctctccatcactctcttgttagggactctggtcaggccgacagccgatcgatgggtgtggaggagggggctgaggcgcagctgttgcgacgtggtaaattgctcggctacctagcgacggcgggagcagggggtgcggagtggcgtcggcattgcgcggggaggctggtgcggcgcgtgaaggtgctatcggcgggccgacgcagtgcgtgaagacgtggtcgacagcgacaagaggccagcttggctaggaggtacagccggcgactgtgcggagagcgggtggacgcgggaggcacaactacagggggcgtcggtggagcagtgtccacgcgtcaatggaggatggttgatggtggagcaatagagcgttagctatggatctacaagggaagagcgacccagtgtaaacctagcccgatcttggccgggccaccaacgatggcgctttgggcgtcgtcttccctctcagaagtgttgtcgagccatcctcttcctctaactaggctgccgcgtgaaaaccctgtcttggttctctctaagaccttgatggagaggagcagcggtgctcatcgtcgctcttctccctagagatgtcgtctaggaaggtcccttgccaaaactcctcttaggcagctggtgcatgctcgctctagatgtcttgtgctcttgtgacgatgctctaggttatgcaagtcgaccacgttggcgggccctaggagggagagtagttccttcttctctctcaccctctccctctcaatctcaaatacatggctagaattgagatcggtggtcaaccgtagggcttggttttgggcggtcttagctgtagtttgcttgttggtctagtggcgaccaatcacgctttgcgatggtcggtccagtgcaagctttctcctgaactatgtgtatttgttgttagtgcgtggtggtgaaatttttttcttccctttcctggctactgtcttccaagatactagccttgtactactattcaacgaatcatcgtgttgtctggtggtgctgatcgttaaaaaaaaaacttgtagtactactatagcagtagtctagtacaagctagtttctccataggaggatactttggaccatctcgcagcgattctcccaaatggcatatgccgagctccacgttaacatcataatgacctaaatactgatacaaacaggacacgtctaaacatgtacaagaaagccacaaaaatccatacaggtgcaaatgcagagaagaaaggaagcaaatatcaaaagaaagccacaaccaccatgggctgaagtgccaccacgcccacacgactgcctcagcttatatatgcacacttcacaaaacactttccccaaacggacacgatcgatatgatcctactacacaaactggcccgccgcggcttgctccggcgactttctgggctccacgcgagccgtctccgccgccgacttggccctgacgcggcgctcgccttcgtcctcgtccacgtacccgaacccgccgtggcacgtcgggtccatgccttccatctctgtcgcgggcgagacgcggagcagcccgaacctgtgcagcacgtagaagagcgtccccatggtggcgctgacccacccgacgatcaccaggatctgcacgatgtgcgccgcgagaagcctcccgccgccgcccatgaacagcccgtacggcctccccggcaccccgtagatcagctcgacgtactccctgcgcgcgaacagcgcggtgaagatgatcccccacgcgccgcacccggcgtgcagctgcgtcgcctccagcgggtcgtcgaacttgagaatcagcgacagcttgttgcagccgatgaggacccacgccgacacgaacccgcagatcaccgacgcccacgggtcgaccacggagcagcccgcggtgatcgcggcgaagccgccgaggagaccgttgcagacgtcggtcacgttccagtgccccgtcagccatctcttgccgtagagcgtcgtcagcgcggcgacgctccccgccagcgacgtcgtcacggcggtgcggcccaccgccgaccactgcccgtcgatcgtgcccgactcgccgtagatcttggagatggtggtgaaggaccccgggttgaagccgaaccacccgaaccacagcaggaaggtgccgagcacgaccagtgaggcgctgtgccctttcatcgccaccgtgcggccggcggcgtcgaaccgcccgatgcgagggccctcgatgaaggcaccccacaggccagcaatgccaccgaccagatggacgacgccggagccggcgaagtcgatgacgcccgacttgaacagcaacggacccgtcaaccggccggccgaagcccacccgtcggtggaccagaaccagtgcgacaccaccgggtacacgaacccggtgaggaaggcggagtagatgagatacgcgctgaagcgcgtccgctcggcgatggaaccggacgtgatgccggcggcggcgatggcgaaggcccactggaagaggaagaagtcgtagtcgtaccctgtctgcggcatgtgcttcagcccgaagaactgcttcccgatgaagcccttggacggcgtcccgaacgcgaaggcgaagccgaagaggtagtagaagagcgcgccggcggcggcgtcgagcacgttggtgagcatgatgttcatggagttcttggcgcggacggagcccgcgcagagcatggcgaacccgagctgcatggcgaacacgaggtaggccgagaagagcaggtacgtcgcgtccaccgcggaggaggtgtccgtgaacctgttgcagatgtagttggccgcgtcggtggagttcgccgcgccgccgagcagcggcccgaggctgtccaagcacgtcgccatggtgtgtctcactagccaagtgtggcaaggttttgtgctgcttcttgctagggtttaggaactaatggaggttttggtgtgtgattctttgaagtagacgagagaatgagatgctggactatttataggggcagaacacattggaatccatggttgatggttgtttttaattggatgattcgtgatcacagacagcgggaaatgcaaaaccgaggtgcgcgtggatgcatgtatactgttttggattccttctaacatgggagtggattctaatacctcaaggggatatcccctcgtatacctttttcttccaaattcgatgtaaatagctatggaaaaaatctgaaaaaaattaacaatgtagagtataatgatacctactagtccaccaaaattcatattcaaattcgatctacacatcgagaaacaaaaaagacaaatttagatataaacagtacgctactattcatacgctgaatttgtcttttttatatctcgaagtgtgagttgattttggacttaagattttgtgaagttgtatatatgtgttgtatgaatgttgtcaatttttttcagaatttttcataaccgtttagatggtttttgagtaaacgagggaacatcccctcgagggattagaatagtttcccttctaacatcacatatactagtgcctgaaaacctttttttttcttttttgccaactgcaatgagttgattaatttttttagtggcagcaaccaatcttttcatccaacaggtgtgatgagtaaaagaacgagcagttcacctctattaatgaatgattgaatattactgagataattttatcatccttaagaatacattgcagataccattttttaatgtaaaatttggcacatacaattacttttttttagtgaattaaatttctcttgaaataaaggtacgctgcaattttatttttttgttttgaaatttcacaaaacaagatttttaactgatcttgatatcatatttagtttcatgtataggttggttcattcataaatttaagttcattgagaaagacatgtgattcacttatcttcaaaaattgtcagtgatgatttaatttgttacctagacgtctcggcgctggtgttgtaagactgttaaaattatcccaataggtttacactggttttgcgacagtgatatttgttttgtttttacttaagtattgtcttgacttttgatgatgagcgactcaactagcctgagttcccgctttgctcagaaagtttcagacatcagtaatttatgctgggttgggagtatccgacagatccaagcaaggtcgcatacgcaagatgccagattcaactaagatccaatgtcactatcagaaagtcgtgttgttgccatcacagctaagattcttttatgcattcaacattttttaaaggaagattcagaaatgttcttgttattatatcgtctgaagaatcgcattttgtcaacttcaagtattacaggttttaatctggtatctcctcgcatccttgcacgaggtagttgcttgtcgtcacgtccgactatacgcatactgttgtgtcatgaagttgcatatatacaaccatatacttgtatgcgtaatatccattgactttgttgattaactgtttaagttcttcaggcatgcatgtaaacccagcagcggataggtcgtacctagcagaacatggcgacaaaactcatcaatcgagatggtatatgatgtgtgcaatgcgtacttagcgaacgattagatattcgataaggttattggcacaaacggagataaacccatttgcttccataccataccggcggcttctgtcttggaagaaccttgtgattaatttgcctccctgaagaactcgtgtctgactgaaaccatgtaatcaacaggtagtccatgctaaacctgcttgctgactactgagtactctgtaattgtcaatcagatctctgtgttggtctggctacattaacctgtacgatattttcactgaaactatatgttttaactcactgcaaatttatgttgtttgtcttcagaaatgagggtgtcaacatagattaaccatgtattcttacttcttggcatagcagtaggtaatttcttccagtagaataaattcagatgatgaagcaattccttaggtcaaaactctgacaagactggataagatgtggtggatagggacgcaattgcttcttccttgcaagtatgacttgcagatgctgcgtatctaatttttacactctggagatagatcacgctgatgcgattaaatacctattgttttatacttttgtcgtgcctgctaccacacctgtatgcatatcagaaggttgaccttcagaagttcagagaatggacggatctctagtaaacgaatcgccattggacggaaacgagtgtttcttattagcaaattgcaaaccgggtgtcctcagcgagacgttgatgtctagtgacaaatagttttcacggatgagataaactagtcttctcggctccagggatcaaatgtcaataaacgccaccgtaaaagattttttttctcttcttacccaaatgctactcttgacttattgataaaccaatgtacagaaattgtactgctcgttaagtttatgagatatactagtcacggtttctgccttctgccgcagctgatttggggatctctctacgttactgttgtatgtgtatttcagtcacccctgaacttatctgaagctttgtaatgcttttctgaaacttttcacgggctttgtaattgatggaggcccaatttcaggcccatttgaactgcacttatctttggtcttggcgtcttgctcacagctgggccacatctgttcatatgtagtatattttttccacctcggatatctgcagcgcgcgcgagagaggaacagagcaactcgccaacaagccgatgacgacaacgcaaagcagcctctgttcgcatcggcgatgacgcgaagccacaaaccgcgaacgcgaccgatgcatcgccggatgcggccgcgcgcgcgagccgagggcccaacgcttacgtccacccgcgcgcacggagtcgtggccgtggtcactccaccacagctgcacggctgggcggttggccggttgcgcagcagctggttaaaattggctgcacggcggcatcattcaaggcgttggagtacgtagacaaacaggttcccggtcaagatccggtagctgagtggagctccctggtcaggtgtacaatcttgtgcggctatcctaaacagcgagataactttggatgatgtcaaacataatactgacattgaacaaaacagctggctacaaaaaaaaacaccttaattggctagacatggtaatttaaccctgcgcatcaaagcaaagaaccatggcaactactactccacagtccacacatgtctcaggcagaggcaggcgacgacaaagagtacagcagcgtattcaagctgggaagcgacagccgacaggcaagggtgctgcgaagaaacagtagctcctgcaaaccgtgaggaccggggtaatgcagggtctgcgggtggcacaaaagctaccagcagcacgaatgcgctgggaacggggagggcaccacagcaccattcgtgctcagcctcagcagcagcagcacaactcgcaacgatatccacacaaacagagtgcccggccaaaaccacagaaaaatcaggggaaaaaaaatctcatgctgatccagtgatcctcctgccggccggctgccagagatgagagatgcaaggtatggtattcatccattcgtcagtcaaaaggcactcactgaatgtgagtgaatgcacaccgagagagagagagagagagagaggcatgaacagccacaggacgagtcaaagtaaagcaagcaacttcactcgctcacatgctgcaacaaccacactttcggtggcttaagtgaataatagtaggccggaccacctgcttctagggcagcaagacgcccgggcggccggccatggctgcctgatcacaggttcagaaaccaccactgccacacgcacacacacacgcagctgctagctagagtcgccgaccgacccatccatggctagttgccatggaccatgcgtccaacgaaccatcaattccgagctctcaacctagtgctcgatccactagctcgggggaaccaaatagctgctactaccatccaaggattcggtatattctcttttgtaccatacccccattttccctcctgcctgaatgaaacggattgtgtggctagtaaggctgtgtttagtttacgctaaaattgaaagtttggttgaaattgaaacgatataatgaaaaagttggaagtttatgtctataggggagttttgatatgatagaaaaatttgaagtttgaagaaatattttaaaactaaacacggcgtaaatagtgttgctatcggtgcgagtaaagacgctgcagatagcgactgacaggcaaatcaatgaattggccatttttcatgcatcaccatctcataattttatttcgtgtgatccaatccacttatcactcactgatctatgtgcaatgaactaagtccagaaaatatctgggtagctgcactttggtttgtttgatttgtacctaacttctaattcatccattggaacaattataatgtttttaagcagcgataactgtgcgatagacttatggttacatgactccaacttatagaatctaaatcctactccctctgtcctattaaaaacgaatctagaaccggatgtaacatacatatgtccagattcataataataactaggatgtgtcacatccggtactagattagttttaatgtaacggagggagttggacgacatactcacatattagttcattttcaatgaaaatttagtgggaccaagtaattgttgttagttactccctccctcccaaaaaaaccaaactactccctccgtcccaaaaaaagacaaaccctggtttccgtgtccaacgtttgaccgtccgtcttatttgaaaaaattatgaaaaaaaattaaaaagacaagtcacacataaaatattaatcatatttttatcatctaacaacaatgaaaatacgaattataaaaaaaatttatataagacggacagttaaagttggacacggaaacctagggtttgtcttttttttgggacggagggagtagtactgaatgtgatatatttgtccagattcgttgtactataatatgtcacatccagttttagattcatttttttgtgggacatagtgagtatgtctctttatgcttgtgttatggacgcactagcttgtgtatatgtgcgttccaagtaatcgaagaaaacaattttgaatacttttgattcctcttaattggaatctcaccaatttttaagtaccatcataaaatgacacttccgctctaaagttatgacggcattatattttaagcattggcccaaaatacaccaaatgactaaccatgtgcactgaaaaaggtgtcatattaacattataatgctgtgaaatatctcctgaggcacttagccccattactcatttttaaataaaataattcaaatctttaagctgatgttgaaatagtttggctatgtttggcttttttggagactcaaggtgtgattggttagggatggtaaaactttacatagtaaaaacattattgcatattttagattttgttttcaaaaagaaaatagttcatattgcatcagggaaatttggcaaccaatgaaaacaaccaattccttcaaaacaggctagagtatcgcgtctatagctttgagattttgtattttattcaatatagaaatttggttgcaccaagaaaattataataaaaaacaaccaaagtattaatattttttattttatactttaaagattttggttcaaaagaatagcggaaaaccctgatggaaagctcaaagcgaagtcccgctaatatcgagtattcgagtctcacttctttattattctgaaaaacctattatccacaccactataattgacatggcataattaaccatgtaacaacgcttttatgttgatatactgaaatgccataatccttgtcgcaccaatttttttcacggcgtaaaagtattatcttacggtaccatttatagttgtgttgttgtaaatgttcccaatcgtacataacgtgtagaagggtttatttcaaaatttgtttagaataacgttcagaaaataaaattttccactgccttcgcccgagagcaggaaaatcaaatgcacctacaaagagaaacggcgcaggaaatgaaaacaaaagacaattaatggagtctagtggcgccggtcaaagagagcattcaaagtggattgcactcggaggaataaacaagaatactttgaacagcccctgcattgaccggtttttggggctcctgaataaccactagcctctcaggggctagatgcccctgccccctcgcacaccattttttttttacacgcagagaagaagagacattatcacattaggcacgggcttaattatctagcaacaaattagctacagaatgaggctaagcgcagtcaccgaactaatcaggaagcgaattagtcaccgaattcggcgagggagagagatcgatcgacgacgagacagacgtcaagatgaatcgaacttgtagtacttgtcgacggcggcgaggacgtcccaggtgcagcttagccccttggggaagacgacgaggtcgccggcgccgaactccacgcactccgacgagcccttgatgtgcgccctcaccttccccttcaccaggtagcacgtctcccgcgcgtcgaacttcaccgggaacttccccgtcgggcaaccccacctgcgcacgcacgcacccgcccacgcgctcaattaaacacgtacgccatgaaggagcaggaaatggacagcgatcgatcggcactgtggcgactcacttgggccaggacttgacgcctagctggagcaggcgcgactccggcgggttgcgctccacggcgatggagagggtgccgccgccgccgggagggtccgtgtccatggtgtccgggtttgagctcgaggccatgagctcgcgcgcgaggtcgaggaggagaggagggagaccgggagagggtgagcagtagcttgcagttaggagtaggaggaatgagttaaggagggttgtgtcagtttgggaggtgagatgatgagttcttctacttctagttctcgcgaggggggaaggctccaagagagggcagttggactgatggctttcctgtatcaaaacaagggcaagaggaatctccttccttcatgtttttaatatatacaagtgtgtgcaataatattatattatttttacccagcatgtgtatatcatttgggacaagtcaatattatacatatttttttctgaatggaaacaagtcaattttatcctcttcctatgaggccaaaatagctctatgttgcttactatctctgctctaaaatatactatatccgttttaaaatataagtatttttagtgataaatctgaagatgtagttatccaaattcatactctctttatcccaaaatataagaaccaatgattggatctaatatttcgtggtactacgaatctggacaggctgtccaaattcatcctatccaaattaatagtcctaaagaatatctcattcaatcctaacttcttatattttgagacggatgtaataactaaaagtttttatattttgggatggaagtagtaaaatattttgcctatgttattagatggacaaaatcccttatattttagaaaggcgatattaccttttatgagagaattttctcttatttgtactcttcatctaaaatataagtatttttagatatgtgtagagatacatagccagaaatatttatattctaaaccggagggagtagtagtattttgatatttgtatcaaaattagcattaaacacatatccatgacacgaacatatactttggtttttttttaataaaacttgtttggaaatgagatatattatgtttttctaacattttttgtgcctgcttgattgctcccgtacaactgtttgctacatgaaacagcaatgccatggcttgctgttgcagactaataagctgcggtcagacagccaagagccatggtgcattaactttgtgcaaataagatagtgaaaaattaagttattttggaaccaagggaatattattgaaaaggaaatattcacacaacaacttatgtatccacaacatttacctattgttgttttaaggcccaaccctacttgtcaatgtgatagcaaacataagtgtattctatactcctatattggtaatacttatcaaatttgattttttcacaaacatgtggcttttgactctttaagttttaagtttagagatataaatgcgaaccactctgaatgtataacttttgttaggtacattacaatgtaaaatgacacttttatgttgcataattagatattttaaatgctttacgttattattaaaagttgatcagtcaataagaggagtaatgcgacatcttatctacctgttctatccttgtcctatctaatctttttctctttacgtaaaactatgtacctctttgaacttgtggctctaaccacctccaaaccattcagttcttaaacgaattggcgagccgccaaattcaataaatagagcagaaaatattgaacaaggtaaaaagaaaataaaaactatgtacaactattcctggttgcccgggctaacgactaaggtagccattgaacttggtccttaaccatttagttggataaagttgaatttgattcctaacacattctattatgcaaccggtctagcaataatatattgtggcaatcagtctagcaagtatcgttgtttgaccgatgaaactttagacattatttcgtcgatcaatcattgcatatactacattacccctagcaacttagtacaatatatttatatctattgaaaatttggttgtggggcggataacaagtggtcaattctcatggaggccacaccgttcatcgcacatgaaaagaaaaaccgtcgtcatatgaaacacatgcttagacagcttagtgaacattacataaataaacagagacatacagtatcagagataattgttgagctcggggggcaaagaaacaactctcagccggctgcaaacttgaaagcaacctccaccgaatttgtcacgagaagaacgagacccaccgaccacacaccacacaatcacacaccacgccaccaccggagaagcggtcaaaacagctagagctcgcgatcaaccgcgagccgcgcgacgacgaaggggttaaaaccccgccgtccctatccgcttcgctgacgtggcgcctcgggcggggcccaccatacgaccaggccattgaccgccagcccccgccggcccgggatcccgtgcggcgacaggccacatggcctccttccttccttccccccgcccgtgcgggcgggacacgtgcggcggacgggaccgcgagatgcgatcggacggctggcttggctggcgcggcagcggggccctctgccgggcgaactggcctatgcgccgatggacggtggcgatgcgacggcttcgatggatgaggggatgatacacccatccttttcccctgttcgtacgccgtgctccccgaaacatgtggggccagtgggcgcgcgacgcgtggccggcgccggcgcagctgccggagggcgcggatcgtttgtgcttttctcgcggcggcagcgtgacacaagacgacagagagtcaaacagggcgtggatcgcgcttcagctttgagtttgcaaatgaaatcgtagaatctggtatgattcggtacaatacgacggaattcgagttaaaacaacgaaacacgaaatgcccgctttttgtaacaaactgttggtcgggtttaggaggggcctaatcaggaaaattgcagggtccattacaacaagccaacaatacgccagataatggcctacccgcggcaccatggcagttctcccctctgaagagaaactggttgaacaaccaattctttattacagtatcttttgtcaacatgctgttcaaccaattctttattacagtatcttttgtcaacatgctaatgcaatgctacattagggtgtgtttagttcctgaaaaaaattggaagttcgaagaaagttgggagttcagaaaaaaaaagttgaaagtttatgtgtagaaaattttttgatgtaatataatatgatggaaagttgataatagggggaaaactaaacacggccttagtatctggattccaaatctttcaggtaaaattgtttgttcacacagttgagggagtcagctactaggttgtagcagtaagaaacaagcaatcccgcagaagtgaagaatcgcgtcacagaactcagaagctaagtggtaacagaaacatagcacggatcaaacttcaagtttcaagcaggtactgtcaattagacgctacagtgacgttttggttgaaacttgaaagatttccagcattgcaagttcacaaaacaacagatcagcggcaaagctggagccaagaacgaggaccagctgctggcggataaacagttcacgcaagtggtagatctcggaaacaagaaatggaatgataccacaacttgacgtttctcccttggtagcagtctaacaatcaatcaggcaaccagcagtcaaatgcagcagccaagtgaacgtgaaaacagtctcgtctttcattttcacctcgtctagccaaatatcagaggacggaatatctgaaaatttattttcaccacttttctggatgacaaattcaactgatggacaaatcagaaataatattcaatagcacattcaatgtgataatcactttttcgcggggccaataggataatcaatatagataaattctaaattgcagatcttgttgacattgtttcagtcagttagaagcaaagacatgcaatctcatatggaaacaatcattgcttgaacactctcgcttcagaactctagatggcatagcctcatggtaaacaaaatgagggctgtttttaggctacttgcaagttagaactaatttcaagagaaattgatcaaatctaccataggatccccaaacttttttttgttgtgaagtggagatagccactaccagtactaccaaacagtttgtcaaatctattaaattggcatcaaatcatccccaactgtagcacaattcaacccaatagcagtttggtactcttgaaagcatttaatattactaatcaacaatcagaagcagcttgttgactcatgaacgcactttacacccaacatcaacaccttctagctagaactagcaatgtgacatgaggctggtcctttcccgactgactccaactagtgctcatgggttacaaacataaaagtatttcctctgcaatttcagacagaaatttgcgtggtagagacttttatttaggttaattcgccgtgctaatggagtttccactgcaacgccactactgattggatgaggctgctaattatcccattgcaacagtacgtctggaccctccagatattcctgttgtggaaaactctagcaggaaaaatcgaagccaatcgatcaatgtgacatcgacgttacacccacctgcttccaacatcgcgcacattgaagccaacatatataaacaaaaatctatcttgtgaatcaaagtactacgagaatttaagaaaacctcgcagagattggtaccaatcaagagccaaaagcactaaccaagcaaccaacaatgcaggcaaggcatagagattcaaaaacatcggcagcaaaaggtacccagattgatctcacgacgtctcgagatacatgaaaagaaatctaaccgacgaactaactagaagaatccatcaccatagagacagatcagcctctcaaacttccaggagagccccccacaagagcaccggcccccacacgttaccgtaagcgcctcaggcgaggtcggtgtcgtcgaagtcggcgccgtcgaaggagttgtagaagccggcgaaggggaggggcccgcgggcctcgttggcgcgggccgcgcggtggccggggaagacctccgcgtcctcctcgtcgtcgaggaagacggcgccggcgccgctgctgcggggggagtcgtcgatgtccatcagcgccgtgatggcgtcgtcgtccatgtcgtcgtcggcggcggaggcggcgggatggctagggtttttgcgggaccactgcggggaaggaaggggaggagcggggtggcgagggcggagagggggaggagggcccggtggtggggcgcgcccgctgcggtgccttggatgggggcgacgcgtcgtcctcgactccatataaagttgtgcttgtgccccccgagttctggagatttgtgcgtcgccttcgtcgtgtgccacgagtttttttgttttgtttttaattttatttatttattttcccttttctttttagagtgacggcatcaatgagcccctttgccttccgatctctgggcctatttgggctggccgcgtcgctaggccctctcccctgttctacatgatgctatttgtgaattcttcttttttttcatacggatttgctcgacattgttaaaaggtaattcatctcatcacctgccaaattttatttggaatgaataccgtcttccttttctcgttgcgttttgtgattgtctcgtgtgcgtttgggcctttggggatgtgttcaggccttttatgtgaaccataccaaaattcggtcgcactgagaaccagtacgtgaacaatacgatagtggttctatccggccatccggagaaataaccacgtataaaccaattatggaaagcccatgtactttacgtttacgtacaaattgttcggaaggaatcgcagttcaggattacattgaagatctgcattggcggtactcagttagcaagagtccaaacatataaccagcttatcccgtgctacgaaggatagcacatagcaggcgtcctgttatcgcacaggtcgcataaaagtgggagctactaatacttctttaagacattcacaacatcttgactgtcttctgttctggcagtgaaacctgcgaggcaaggtgctaaggtagtgagtaaagattacggcaaacgagcaaatgcacgcacaggaaatgtggcgagatagaggggaaaatggattacctgatgctaaccgcttgtggtgtccattgacgttccaatcaatttgatcgtcaatgttctcaacaatcttccttttcataccttccagtttccgctgaaatagtggtattacgttcacaagatctgcaggtatagcacagttagtcaggcatgttctgaaccagagttaaccaggctgcccaaaaatcatacttatgaagaatttactcctttgtagttagtatcgagatcctataaacaacattgaactgtatttgtacgtgacataaacaaattaacaaaagcagattaagaaatgtcatagaatttgggcggcgggcaagaatattttgctttctgaaactcaaaattgttgatgccagtggctgaagcttactagttttttaaccatgcgaagtaacccataaccaatatgcaccatacgttacaattactaacaatctgccatgtagcatgtcaattgtcaaacaaggtgacaaggaaggatataacatcagcatcatcacaattactcaaattatgtcaacaataattacccaaccataagtgaacaggttggagttctgatcacttgaaaaattcaaaattgtaagccttatttcatggaaaggcattggcctaaataaaataaaagtcttttaatgccagcaatatcgaagtgaaactgcagcttaagcatgccaaataactatttgtgaaaaacaaaagcagcgtgaaacttaattgatgtttaatcataatcaaatggcgtggatttctcttcctcctgttgtacacaactactgaatctaatgtcataccttgaaaattgtcttgaaaggccttgctttcaaacaccttcaataattcagccatagaggaatccaaatttctctggcactcagcttgtctttctaaggaagaaagctctttttgaagttcttcagattcattgttagcctgatgaaacaacatgtgtttgtcatataaatgcagatatagagaagctaattcatttaagtaagctgcttacatcttcaagttttttcctaagagaaacaagttcagcatcgagatccgaatcagaattcccatcattgagtgatttttttgcaggaatatcctgatgaagaaaacaactcatgtttaaccatcttcatgacaccattttttgaaatagaacattgaagtaaacataaaagtaaagcaaggtttcaggaaacagaattgtatgttctgcttcatcataagaacatatgaaaatgaagactgtacaactttgacacaatatgaattccaaaagaaacatgatgtagtataattaaatatcttgacttcactaaatcaatcacttcaacctcacaaaaaaattaaataaaccaatcacttcaatatgaggaacatacatcttcacgtgtcaggaatccttcaggtattgcgaaacaatgtcgaaggcagtatttctcccaattgctcattctcttatccaatacatccttcaccaagttgtgaatgctgattacaccctaaaaagaaaatcataagaagaactatacttttcagaacgttcaagctggactggtctattgggggaaacatgtgccaattgacaaacatatgaacgatatgcaatagcttccagaataaaatatactaaaaacattactgcaccatgataaaacaaagcaattgttattaaatatgatacatgataactcatagggctactaaatcattagaagtgttaaagtaatgtaatgcttccaaggagagctagcctgataggtccatagttgcttttgaccacaataagtggtatcttttttttaaaacaaaatgaacaatatccattccatagttctgaaaccaaatgaacaatatccattctatagcaaaaatatgaaaacagagaagctaacaatcgaaagaattgttatctggaaccatgctttgctttggtatttttctagctgtttcaatatttacactcagtaatccatttgtgttttaatttttctttttagaagataaatcattgattgacccagctttacaagaaagccacacttagtaattcatttggttttaaatttatgcgtagaaagtttccgcacaagtttgtttatcaagcatatatgcaaatagaaacatatgtgttttataggccattgcaaagtggtactgatggtctgatactacacactgtgcagcacggaaaagtcatctgaattgaaaaaagaaggacggcacgtcacatcctgtacaaaaggggctacaaaacaagtaatcatagttctgcagctgaactgctgaaaggcacatccacatagccgcataaattcctttgatataggatccaatagccagcttgagccttgaaatgaaccaaaattgatcaatgtctactagtcataaccgctggctgaccccgataaattggtgaacgctgagtctgagagtgctaaggctgataaattggtgaacatcacgagcgctaaggcaggtgaagctaccctaagactacgatcaagcattgttaagaacccgacgcacaaagatggaattcgtctaaaaacacaaccacaccatacaagacaccttctatcgaatcgtggaatgggaaatcgcgttccagaaccggattatttttttaaagggaaaaaaactgagggggccggcacgcttcatgaaatccagtggttggggggggaacttacccgctccagctcctcggccttctgggtcgccatggcggcgccgacggcctcgggggcgccttccctggagaagagagaagaacagcaagagggcaagttaacgaacaaccgagcagcgaaagagggggcgagcgagaaagggggggaggagaagtagagagggttcggtagccttactggaggcagtactcgaaggccccgtagcggacgtcgtcgaccgcgttgaggaccgagttgacgaagaacgaggcgctcagccccagcgccgcctccacggcggtctcgtcgctctcctccatgcctggtatgagggggtcctgagtggtggtggtgtgggtcggcggacggcgaggggagcggcggcggggggttgggcttgggcacccgcggtcgccgccgacgacgggtggggggaattcgaaattttccgcggccactttttgggaggaaaggaaacagatgcgcctctctcttttttccagagcccgagctgcacgacgccactgttcggcggccgcaggtgggcttaatccatgtgtatatgggcctagttcgacgtcagttgtgggactaaagccttattacgcatcggaagttcagaaatggaaaaagtacacccaaggtctctcaacttgttatcgagatacaaaatcgtcctcaaaccgcaaaaccagatattccgcgtcccataactaatcaaaaccggtcacaaaaggtccctcggcagttttgaccccagttttatcctacgtggctgctgagttagcgtgggacccacataggccccacatgtcagcgtaatccacgtcagcctcctctctcttctcttcccccgcttctctccctttactcatatctctctctcactaatctgcaagctagccagggcagcgagagaggaggagggcagcaccgcaacggcgacggcggtggccgtagtggggaagcatggcggaggcgcggggaggccggcgtcggcgtcgcccaggcggtggcggcgaggcgctgggaggccggcgtcggtctcgcccaggtggtggtggcgaggcgcggggaggccggcgtcggcgtcgcccaggcggtggcggcgaggcgctgggaggccggcgtcggtctcgccctgacggcgcagcggccgtagttgggaagcacggcggaggcgcggggaggccggcgtcggcgtcgcccagtcggtggcagcaaggcgcggggaggccggcgtcggcatcgccctgttggcggcggccgccgcagtggggaagcacggcggaagcgcagggaggccagcgtcggcgtcgcccaggcggtggcggcgaggcgcggggaggccggcgtcggcagcgccctgacggcgcggcggccgtagtgaggaagcacggccacggcggaggcgcggggaagccaacgtcggcgtcaccctgtcggcagcgcccgcagtgggaaagccgctggtcgtaaccggaggtggcgaggggggaggagttgtcggcggtgtcggctttggaggaggagcgcttgtggtcggggtcggggacggcgacggcaagggagcacgggaggcagagggtgaggatggtgtcctcgaagtcgagccccgatgccacggacgactccgtggagctccgctccgtctccttcgatgcggcggggaggagggccggcgtggccggcggctaacgaggaacgagcgtggtggagaggagggccgtgcggagccattgtcgtggccgcgctctcctccgtgtcctcactaccaccgctggcgagccgccccttatggcatcagcggccaagacctacctctgccgcaagcacgatcccaaccgtgccgtctccctcttcaaggccatcgacgacacctccctctcagcctcccaccgagccgcaccttgtcggtgtcttctgctcctacgccgccgtgtccctccccgagaaggctctcgccgccttccgctccgccgcgcagagctcggccggggccgtcctcaacgaccgccactccccatttggcgccgggtgcatcgagaagagagggaaagagaagaaataaaagaaaagataaaaaataagaagaaaataatgatgtggcatcctgacatgtgggacccacgcaactcagctgccacgtcagataaaaccggggtcaaaaccaccgagggacctcaaataaacggttttggaagttaaaggatctcatatatctggtattgtagttgagggatgattttgtaactggacaacaagttgagggaccttcggtgtactttatccttcagaaattttctaggaaaaagtgcaccgaaggtccctcaatttgttatcaggataaaaaaattctcgaaccgcagaatatacgcggggtcccttaactatacaaaactgattacccgaggtccttcggtggttttgaccccggtttttgtctacgtggcggctgagtcagcgtgggacccacgtgggccccacgtgtcagcgtgccacgtcatctctctctttccccattcttttttctttctttactccatccaggcggtgctccatggaggccaatggctggcgtcgctaggcggggctcgtacgcgaacacccagaaaccagcgccggcaccagcgccgccgtgatgcgcgacaacacatatatgtgggttgttgtgttcgtgtatgtgagttgggaactcattccctccacacgaaaaacggagcggtctattagtgcgtgattaattaagtattagctaatttttttccaaaattagattaatttgatttttttaagcatctttcgtatagaaacttgttgcaaaaaacacaccgtttagcagtttgaaaagcgtgcgcgcggaaaacgagaaagaagggttgggaaaagaggatgccgaacacagctgccactcctcataggtacacatggcttagttcactttgttgtccgaatcaatcatatcaaattttagtaattctatttttttataaattttagtgttgactttgttttgatgccttcgctaaattttattttgatagagtttttagagaggaagcttctgaaaataccaaaatttagtaagatagcaatggttgatatgtgtctagtttgtcacctactttaaaagcggcgacaaactgaatagtcccacaatttgccacaaacgtggccaatttgttatattaggtccaactcttttttaagagtatcaaagatggatcgagagatacgatccagctttctaagaaaacgaacagagtagggtgtattaggcaccccttttttcagccccttccccttatttttcacgcgcacatttttcaaactgttaaacggtgtgttttttgcaaaaagtttctatacaaaaattacttaaaaaatcaaaataatccatttttttaaaaatagctaatacttaattaattatgcattaatggattgctcagttttctatgcgggagggactagtttccatccctaaaaccaaacacaggctaaaactgtccgacacaacactcacaacataaacctaaaacacgctgctgtgaatttgagcttacattatcagcaccctaacaagcttaccaccaaaacaacaattccagaacccagctattgcgtgttttcaactcaggttatgttcggtaggaggggttgcaacattactgtggctacaactacagccagacatgacacaaacaactgatgttggcttacagttgcagccacatagctacagtaaaaaagagcagctgaacatactctacatgtctaatgaaagaacatctattgatccaaatttcttcatctttcagatttaatcttcagttagcttttatccaacttgcttgcaccttatccctttttcaaaccctttcacttttgtaagagagagatcattttatataccatctgtaaaggagatttcacaagtatatatgctttccaagacataatcatttcttccagtccatggaccctactccctccgtctcataatataggagtagtaatctagaacagacactttatagtacaacgaacctggaaaagaaagcatgttcggatctattgtactatgaagtatgaagtgtcacatcctatactaggttactatattatgggaccgagggagtaactaatatactccctccgtattttaatgtatgacgccgttgactttttgataaacgtttgacttttcgtcttattcaaaaaatttatgtaattataatttattttattgtgacttgatttatcatcaaattttctttaagcatgacataagtatgtttacatttgcacaaaaattttaaataagacgaatggttaaacattagtcaaaaagccaacggcgtgagggagtagttatcagtcatgtgataacaagctcaaccatgcattcttagggtttctttggagcgttctttttttaattcctatagaattatattattatgccatgcatagtcatgtaaaactcatttgtttcaaaagagaagccactgctggttataacttccatgttaaaagcaccacatgtgacaaagctcccacgaaattgacgtggaaacgtcaaacgtgaactccagcaaattagtgaaaaacccttttctccaccgtcgtgctagttgctacgctagaggtcagctcgctccttgcctccgctttaccaaaaagggcaaagacgagtcctttttccgctgccgggcgtgcgtggataagccgaagcgcctcccccccggccccaccccctcttctccccatcacccgcgttgtcctatcgtcgcagattcacaggaccccaacctttcatggcttattcggaatatagatagtaaaaacgaagaaatagaaaaattataggaatatggtaggattgtatgtgtaaaacagaggattgaaaaacataagaatttcttgttctccgtgcgcaggattcttacaacaaagaggctaaagtggattctttttttccttgtgaaaacatgggtagggaatagtattcctatggaattcaagatagctaaccctttcaaacgaatgcatctatagtacccagttcaaaggaatcatcaatcctccatttttttcttcacatttcctccattccgaatgagccctcttcctgtttctctcgcaagtggaatctccagccgtccagcgttaatgtggatagagatagagaaagagagtttagggcccctttaaatcgtaggaatgaaaaaacagaggaataggaaaaatacaatattctagcaggaatacacaggaaaaaaacaggaatggccgtttgattggaccacaggaaaaatgcaggaatcagatgagagagatggactcaaagtaaatgttccaagaggttagacctcttgctaactttcctccaaaatgtgcataggattgtccattctataggaattttaaaggattgtataggattcaatcctctgtttcaaaggtcttcataggatttttttttcatagaattgaaatcctctaaaatttctatatttttcctacaaatcaaaggggccattagagtttagagagagctgatgcactttctggcacacgactacacgaacaatcaatcactggctgagaaaacagggagctaattggctactagcatacgacgatcacaattgccggtggaccacgccggcagaggcagtgtgctgttgcggtggacaaaggcaaacgcagagggcggtactacgttcgtacgtgcgtcgcctgtgcacggaagtcagcacgtgaaacgtcgatccagcgcatcccacatgcgagcgtgtcagcgctcaggcaacacgaacaacccccggacggatgcacccccacggccccacacacgcacctcttctctgctggtaatcagagtgctttgtcagcagtacacggctacacgctaatattactactgttccaggccatagcaagcgttattgctgcagtgctgctgccagtaaaatgcatcctggtgtacgtacagtaataagctctacggtgtgttgtgtttgttttagcggcatcaagccaacaatggagacgagagatgtggcccggacggatggcgccgtccatgcatgcacccgtaaatcgtggtcccccgtctgcgtcgccgttttttgaggggatcccaggcttttcgagggtaaagtcaacacaaaagcgagcgccttttgcgctcgtaaaacgaatggcttttcgtgtagctaccggtggtggactcgtggggcgcgcgccctgcgcacacgctgaacgctgccctgtgcaacggcgacgcgcggcgcagtcgtctcccccgtcgtctgcgccggcgggcggaactccacgagagagccgagagccgcccggcgcccgcgcgtctcgacccaaactatctaccgtctccgtttctaaatatttaacgcttttaacttttttaaatatatttgaccgtttatcttattaaaaaaatttaagtaattattaattttttatcatttaattcattgttaaatatacttttatatatacatatagttctacatatttcacaaaagtttttaaataagataaacggttaaacatgtgctaaaacgtcaacggtgtgaaatatttagaaacggatggagtatttgtctaggggtgtgtttagttcacgctaaaattggaagtttgattaaaattgaaactatgtgacggaaaaattgaaagtttatgtgtgtaggaaagttttaatgtgatataaaagttagaagtttaaagaaaaagttgaaaactaaaccaggcctagaatttatttattttgttgaatggagagagtatatatgagtcacttcctcctagctcccagcttctgtaccgacttctcatggttagcgttggcatagtgcaggcacgcaggaacaatgatcagtcccagcttgagtaaccaaggcctgagtgcctgttaaacatcaagatgggctgggtcagactgtaccagatgggttgtgttgccgctggcctggatcgccaaatttgaacttcgtcaagagtggtttgatcgacaaaacgttatttatattttataacatgtttagcctgaggggtcatccgtatatcatttgataaagcttctactcttactttattggtgttttttttcgaacaagattttatgataaattttttacctatacaaattcgatttcttagtttacatccaaacacggatgaacgatgaacggatccacagtttgccttagtctctctaaaaaaccaccaccttcacaaaacccgctaaactcatatcttcgtagttgccggagatgaacattagagttggagaaagcattgcgaataatttaaccggatggttcaaaacatgtcaatattcttttgtaagaaaaaagtgtatctttcccattatttcccgtcaaatgacatttatcaaatttgaattcaaatctattatattattaaaggaatagaaaaaaaagccttcaagtttgctttaatggtctagaaatttccacattaataggagaaaaagaaaaaacagagtctatataagaatacaatttaataatagctgaaatttggaattaaaagtaaggaatataggaagctaagattagagtctaaatcggtatacaatagaactaatggaaattcagaattaaaaaaataaaaaaaattaaatgtaaaggttagagtccatctagaaatacaatttagaaataaaaaaaatcgaaattaaaaaaatatattggatgaagaatatagagtccatatagaaatagaatttaaaaataattaaaattcggaattaaaaaaatattgaaagataagtttagaatccatatataaaaatacaatttagaaataatagaaattaggaattaaaataaggaatatcggaataagagtacagaatacatataagattttaaaatttagaataaaactaataaaattaaagtagaatttagagtacaaatagaaatacaatttataaataactaaaattcaaaggaatattggaagtttgctctcataagagcatctccaacagcctctccaaatctaactctccaaacacccatatagccaactctccatttgatttggctagtcaaactagttgttcactccaatagcctctttatctacgctctctactttaactctatgggctagtttggtttgtagcctaaattggccttaccaatttttgtcaatgtcaaattttggcaacttttggcatggctaattttggcaaaagaaaaaattgtgtttggattgaagccaaaatagcctaaattaactgttgaaatggcctatttcttaggcatgccaaaatttggctccaaaccaaatagacaataaacactattgaaattgccaaatattggtaaggccaatataggcctcaaaccaaaccaaccctatgacaccgggacccatatgtcagcctctgccttcttctttctccccttccttcccctcttcctctttttttctcgcgttggctgggagcagacgacgccgacaagctgggaggggacggcggtggaccggtggtgggcgcggcggggagcttgtgccgcacgggtggccgcagcgagcggaggcggcagccgcggcgcgcgggggacagcggccccggcgagccgagacggcgggccgcgccgcgcgtgggacggcggtcgcggtgagcgggggcggcgcctcggcgcgtgggggtgttgacagaaaacacgaggcctaggagatctgcttaactccagtgcatgtccaaaactcgccttcggatgtatgagcgtgccagttgatttgatcctgcaatcaacaagaaataaaacaaaaaaaccgcaattaatcctataaatgatagccgatcagctaggtgccgatgacatatcatttatttcaagccgatgtcatgcgtacatcgatcggcaaatatcaataagcaaatcagaactaaatctactcgatcggctgtaaatattaatgatatataatccttatatcgatatatacttaaatcaagtgattgagatagatcggttgccttgccgagacagtataaatcacttagatcgaaatatatattaatagtgggattatatacatttatagcatagccgatcaaatggatctagcatgtatcggctaatactccgataccactctatattaagatgttaaagcaagtagaatatatcaaacagaagcctaatatatttagatgcgacaaaatcttaacataaagggcagatttaacatatagattaagcatatggaataaaagtagttaaatcagataagatcggctgaaactccgatactaccctgatcggcaaccagaaagcaggctagagattgcagttctaaacacgacttaatagatcaaactcaactgatgtagcattaagtatgaaaagaaaaaacaatatctagacaatcaagccgctggaagttttatagagtggtagatatatcacataatctaagttaacattgttgtctaacctaatcggctgccttccattaacagatgttagtcgattataggttagataaagatattatcgaagattatatgagatatatgataactcgacgaattacatagacaagattagagtatcataaagatggaagcactaatcctaagaacataaatcgtcgcgacaagttttacctcttgttgaagatcgaagccgatgcagctcaacccgaaagcacaaactcgtcgaaataaaagtaaagcaaaaagggtggcgatgcgccgagattgtattgaatgtcctttttttttacatagggctcgggtctatttatacccgagaattacaagatacgtccataacagacacgactattatctctaacaaactctaagataccataagtctctatagcagacttttgcccaaacatatctctaaggaaattacatagaatattctaattaataaatacaattgccttcccaggactctatccatgcgtggcaatcatcttgaagcacatcaacttaaacccgatgacgtacaccgggtcatattatcgaaattggctgtatcggctagccccgtctgactcgaactctgccgatcctgaccttagccgatttggactgcagccgattcttactttgtttccgcaacgatcttcatcttggattccacttcgatctgatcttcatctccgatgccaatagtgatagaatttaccaaatttggtcgttaacagggggacggcggccgcggcgagccgagacagcaggccacgccgcgcgtgggacggcggccgcggcgagcgggggcggcgcgccctacgccgagcgggggccggcggcggcggcgagcagaggcggcgggctacgccaagcggcggccagggctgcggcgcgcgggggccggtggttgcggcgagcggagaacggcgggccgcgccgcgcgggggacggcgaccacggcgagcggaggcggcgggccgcaccgcgtgggggacgacggcggcgagcggaggcctgcagccgcggcgagcggaggtggcgggctacgccgagcggaggatggcggtcgcggcgagcgcctcctcctcgtgcagtcgtgctccttccgtgcctggttgtcgtgtggggatggaggagatgggctgtgtggggcccaccattggccagccaaatggagtggctaaatttggctagtggagggagggttttggccagccggttggagaggctgttggagcacgatttttggctagaatggctaaattttgacttggagaatgggatggagagattgttggagatgctctaagacatgcaaaattatgttgtcattttaatatatttgaataatacattgagaaaatatatatgctattataagagagaaaatatagtaatactagccgtgcaatctacgcgggccactatgctagttactgtgaagtgaacttgcaaggaactgaccatgcatattcgcaaagtgaattattcaaccagatggttcaaaacatgtaaattttcttttgtaataaaaaagtgtaattttttcccatgatttactgtgaaatgatatatatcaaatttaaaattaaattactgtgaaatgcaaggaattgaccatattcctgtgaaattccgtattcactactgccactcggtacatgctcattgcccaggtaagcagataccatgtgatatacggtaaccggagtagatgggttatattgacgatggttcgtggtttattccttctggtgcaagtgcaatgctaaaaggcttcaaagtgcaaacatatcgcagtggtccattaatccttagtacacaaagtcggatccgttgacatggccccccaagaggacaggcttaaacagagtcatctttcttgagctgtggtaggtactaatcaatgaccttccttcatctctgaatagactgtcatatcgtagtttagcaaacgtaaacgacagctccttcaattccagcgataaaaaatgaaccaaacggcggtcaatacatgcggtttcgcatgtttatcgtttttgttgttgcaataatcaggtcaaatatattcacgcttcacttgagagcgactccttaaaaaaaaaactttggtcagtcaaactcacacgatcgtgccaaaggggtactcatctttttttagtgtcaaatcaactttagcaaaccacaacctccccaggggccagggggtggttaaaagggtgttaaacttcccgtgccatgcatgatgcaacctttttacagtcttgtaaacttaacaaagatgaatcaccccctgacatagtagataaagtccatgctactttatgggcagaaagcagcactactcctactatactgtcctactactaaaacctgggtatcaaaaaggacacctagctaaggtaagctaaccactactctcgcagcgttatcatggcagagattgcaccaacatgagaccacctgctctgctttgcatctcccagcaggagccttgctttgcatctcctagcaggagctcggctccagactccagtgcagcactgcagcggctagccgcttgcatatgcagtagacatgcagatcactttacgcgatcacgtcgcatcaaatccgtgctcgatatggcctaaatccgtaaagtaatctgccggcgctgattgctggagtgcgcgaacaagggtcaggtgatggccgaaaagttaaactgcaaatgggcaatttgggctcgaagttaaggagaatctcgcctgagttgagatcgcgctgcacgtgctcgcggtcgcggcctaaaataatttactagtagtaataaaactatacaagtaggagcatgtgcaagacggtcaaattgaaaaatcgatacaaataaccggtcgtagcgcgtgcgtgcgtgcactggcctgtctggtctatcagcttgattttcagtctctgaggtgtgctttaaccacagtataaacgtaaaaggtgtttaaatggtgctgtcaaacagagatggacgaacaataagttttttaaggagtaaagtgaacgcctgatctctaaatttgcatgtgttattaggttaacatattctcaaatataaatttaagatccagaacttatcaaagtgtgtcatcccggtttaaaattgtcacaaccatattggatcctaaatggtgccgaagcctgcaagctagctcgggaagctagcgtccgcaggtgtgtcagcccttcttcatcttctatgggttccacaagtgaaactttggatccgaccctatacttggttgtgtttagttcacactgaagtttggaaatttggttgaaattgaaatgatgtgactaaaaagttatgtgtgtatgaaaggtttgatgtgatggaaagttggaagtttagaaaaaaaaaactttggaactaaacagagccaaaagtcatggcctcacctcggtcaacccgtaggttgaaaaatcgcctcggacctggcttgtaggtggaaaccgcactgaacgaaaaaattgctatcctagtttagtatatgtaatctggcagtaattaaagttttaaatgtaggccgaaaatcaaagttttaaggcttcgttcgtttgttatggttgggaactctcccattggcagaaattacgaagcaattcattagcacgtgattaactaaatattagttagaaaaacttgaaaaatggattaatatgatttttttaaaacagcattcgtatatacatttttttaaaccacaccatttagtagtttgaaaagcgtgcacgcggaaaaagaggggcaggagttgggaacagtaagtaatgaactcagcctaagggcatctacaaccaaagccacccctagagtgtcctcactaactgagggtactctctatgaaactcatctctcaatggagaatacctctagatgggttcttcaaaatctgaggccacttgatggagaaacgccagctcataatgggtgtcccagcccaaggtaccctagtgaaaaaaataccaaccgtacccctcctcttttttctcatttcgcctgctcctctctccgccttgtctcctccgctggctcctctctctgtctcatctcctctgcgaagaaggcgacggcagtcgcgtcgagcgcaaggggtgccaccggcggttcccgtcgccgccacctccctcctcgccctctccagcaatcgtcgtcgactccctcctcttcatccgcaaccccatcttgccgccgtcaccggcctccagtcgaagtggttccggcactggcggtggccgaaggcgacagatcctgcgtcgtcataggcggatctgcgcccccctcccccccatggccagatccggatggagcggcaccggccgcgccacatcgagacattggacaaacacaacaactactactactccatatgcaagcacggggacaagagtagtacgctgctggtgcctggtgatgagcaaatggatcattgaatggagtgttggactgcctcctttaggtggtgattgaattcagtcacttaaagtcacttaactttagtctttatatttaaatactaattaagaatttttaagcctaattaatccacaattagagaatgtttactgtagcatcacataggctaatcatggattaattagactcaatagattcgtctcgcgaattagtccaagattatatctaagattatggatgtgctttattaatagtctacgtttaatatttatatttagtgtccaaacatccgatgtgatagggatttaaaagttttagtcccatctaaatagggtcttaggcctctttgggaaacatggacttgttccaagtccctgtcacatcgaatgtttggacactaatttggagtattaaacatacattaattacaaaacccattccataaccttggactaattcgcgagacgaatcttttgagtctaattacgccatgatttgacaatgtgatgctacagtaaacttttcataattatagattaattaggcttaaaaaattcatctcgcagattagctctcatttatgaaattaatttttttattagtctattaatactccaaattagcgtccaaacatccgatatgatatgtactgaaaaaattttagccccatctaaacacccccttagacaaatgccaatcctataaatgctgcttcaccagtaccaaggttgttaggatcgggataccaggcagtatcgttttgctcaaagtaatatcgcatcgtaggatcgtatcgtagtatcgggatactatgagattttctttttttaagtttaattaatatttatattaattatatatagacattctatataaaaaaatgtagtaatgatatatgtcatacaaatagagacctttatcaagagaaaccatgttggttttgatatatttaactgatttttatataattttgagtatatttatttacattattttcaaaccatgatattttaaataatattttgtagtatcgtagggatcgtagaatcgggataccacctaagattttataggatcgtgtagtaatgaatagtaggatcgagatactatgaaaattaggatactaggtgggatcggtatcgtttcagcttggtaagatcgtagtatcgtagtatcgtaagatactaggatatgaatcgggatactgacaaccttgactagtactagacatttctatgtcacctgcctatgcgatgcgcctcatctacaaaccgcaagggtaatagttcgatgtcaagaaaaaaaaaagagaaaatcccctgtgtactctcgaaagttcacctaatcccttctgtaccccttttgtacccctgaattttgctcaatcccttacatacccctgaattttagtttggatccctttcatgccctttccgctagttgaccgttagttgaccgttaaattcttatgaaaaagtccattttgccctttggtataaagaagcatataaattaatagagtatattgttagagcatataaatttgttatatgagactattatgtttatgagatagttatgcaccatattatttgtgataaatatacttagatatgacataaaaattaatacttatttattagttattaaaagattttttttagcatatgtattctgaagtaataaacaaatctgttgtattactatgaaaacacatatgctacataaaagaacttttaataactaataaataagtatcaactttttatgtcgtatgtaaaagtaaatttgttacaaataatatggtgcatcacatactcataaatataatagtctcatccaataaatttttacattccaacaatatacttcattaatttattatgtttcttcatagcaaaggggcaaaatggactttttcaaaagaatttaacggtcaactagcggaaagggcatggaagggatccaaactaaaattcagaggtgtgtaagtgattgagcaaaattcaggggtatagaagagattagatgaactttcatggatacttaagggattttcttaaaaaaaaggcgcgattattgcatgcgagaacttgacaaaatcgcattctttcttgattctttctctatgggcctaaagttgatagtatatactaatatttagagcgtgtaaatcaatgcattagctctctcacggaaaaaggaagatagtaggccaaaacaacggtctacatgctactagtacatgccttgaactggtactccaggaacattaaaaccatatttacctgatctatgctgcacatcgcaatgagcagcagagacacttccatcgttttgagcttggtgggcaaaatatgggccaatcctcccagccacaagttccgctgtgatttatgaccggagtcggcgcccaccaaccggggtgcgtgcgacctgaccagcaccgcacatcggcagcgaaaacccctccgttttttcttcatctcttcttccatttcgcttctcccaccaccataccaccacgggtcataaccccctcctcctcctctcatccacccaccgtcacctctctccctcctcaacctctgcttggctgtctgcctcctcgcctgtcatctgtccctctcatcagcagcggcgcacgggtcaaaccaagagccgcagcatcgccaccaccattcaccaccgccactcagactctccaatggcggctcctccccctcctcctcgtcaaaaccgcccctctcctctccttgtagcgggtagttgcttgtcgcgagtagggacgaatctgtgctaggggcgagaggtgtgtgcgcgctctagggggcaatggaggggatgtggaggaaggccaagaaggcgctgggcgccggcctctgcgttcgcctccccgccgtcgccggcgactgggaggacggcgtcagcgagcgccgcgcgtcggatgcgctctcccacgacgcgtcttcggcggcggcggcgcatgtgtcggcgccgaatacgccggccgcggcgttgccgggagcaggcccgctccggaggtccaagtccgggaccaagtccgccaaggttaggctcttctccttttctccctcttcttctcattgtgagttatataacctgtgccttggattgtatccgtggtagccttggttcggggtggctggatgtgaaatgcggagcagattggggtttcctccggggttaggcgcggatttggagcaatgtggcttcacccgtgaacgatttagattcagatgtgcttcccctggccgacagtttttggttgcagtaatgggcgtttcctttgtttgtgtctactgtctagcaatttttttttgtatgcatctgtttttttaatactgagttttgtcttgagcctcgcctctgctagtttggatttgtcattacctttgttactttgtctgcaattgaaatcatcctatgttgtttctgaggaaacatgggtcttgcccattttataataaaaaaaccattttgtgtgcagattttgatgattctgcaaactatttattctctaaattattcaaaggaatatccaaaaaagaaaagagatgcatccgtcattggcttcatcttgttgctccattcttcgtgtcatgttccagcaaactatcataccattttgttcttcaccattcagaaaggaatcaatttgtgttttatagcttctttttgggctctgttgtatttatttcatatcttccatagtacaaaaatttgctgcttgtttctttttctcaaatttatacgccaacagagattcttacgaatttctatcagctatcagtctgctggtatttttcccctcggtatcgcgcttcgttatgggttaattcaaataaaaaaacccagttgttttttttttctgtctaagatacattcatatcttaacgtaagcttcttttctactgttccacttgctcgttccggaatgggaaagttcgcttctttcctcagcaactccccatgtgttcacgtgtagtatcatcctgccgtctctctcttactccgttagtactactactacgtactccaactccaattaattttgtaaaggcgtgttttccaactgtagctgtcatccatcactgaaaatttgtatcaccagcctcttattagaattaccttatactgttctttttatatttatctttatttagttgtcatggcatgtgcgtgatctctttgaatggtcaatgtcaatttgtgatgttttctgatacaatactattttttcgtgtggtgttcattgatgccttttattgctgtgttcacaccttttgtttagtagcagttctgatttagcgagatattgtgtatggtagtgccctgtttgaccaactacttcacgaggatttcctcattactcattactcaattggttgacatttatctgccttggtcagaagtgaagacttgaaaagttctgataataagcatcgcacagttatttattgtgatttccgcattactgcctttgctaagcttgatttgtctatattatcaaatttgacaatttggtaaactggcatgaacgcttactgtgtttagttgaatatattgacacgcatgcaagtctgacaattctttgtggtttctctggtttaaaatgattttatttgtcaaggtaatgccgcgaaatgcaacatatattgggtgcccaaatgcaaaatatgtatttcttttaagttatcagtaaggaaaccgtaaaatcaggtgtgctgtttccattggtatttatgacgtgcatacgttatcataaaatataaaatacagttgtggttgctgacttggtgttagtcaaaagatgtatttgtttgaacatgctttggtttttatgttttagtcaaaatcaataacagtacctatcttaggtcctgtttagattccaacttttttcttcaaacttccaacttctccgtcacattgaacttttctacacacacaaacttccaacttttctgtcacatcgtttcaatttctccaaacttccaattttggcgtggaactaaacacagccttagcttatgatggcaccaatgaactaatagatccaacaccttgtatgtcacaaaaaaagatggaatggatgtgatatgacatcaattcatttagttctggtatgtgtttgtgatatatttttgtttagctttcatgtgaggccctattcgagttgccatattgatccaatgaaaataaatcaagaaagtagtaactttagtccatgaattgcagtttgtgtctatccgactatgtttcagaaataacaaacaaatatattgttcgacgtggatacactttgatgaagaattgggatgaaaaataagtctggataatggtaatttaaggtgggcctaagtaaatttgttgaacatgcagattagtggagatatctatgcagatcttggagttgattcagaatttgagatcggcttctgtcatagtatggcaaactctaggcagggcttaattctgtacagtggaattgatctgtgaagataaggacttaaataggggtgtacggggtgtggatatcaggacaaagggttgttgttatatgccagtctgttcactatgttggatgtaacatacaaaaagttttgttctcaataaagtatcattaatatcagttgaaccgtcttttcgcagcaaggctcatctttaagcccttatgtttcatgttttaaaacacatgtctccatgttgattgcacatttcaaatgtgaaggggtgagttctgatgttgcacaattaaattgatacatctttctttttttctctcaacagggaatgtgcgcaatatgtttcgatcccatgaagtcaggccatggacaagcacttttcactgctgaatgttctcacatgtttcacttccactgcatctcctccagtgtgaaacatggaaattatgtatgcccagtttgtcgagcgaagtggaaagagataccctttaaccgctcgttatcttctattgtacctcgtggtagaagtgggttgaatgtgaatcaagctcgattaccccaacaaggcacctacatggctcttctacgccaggttccaagtcaccatcgagaagcttctggttcccatacttctgagccagttgatttcaatgacgatgaacctttgcagctgatagagtctggtgacagtcgtgatgctagatgcagtagagctgtggagatcaagacatatcctgaattctcagccattccacagtcgtcatctgaagatgattttgctgttttgatccatctaaaagccccttgtgctaacccagaacaagtcacaggcagaccattcaatgccacctcaattggataccctacatctcgcgctcctgttgatctggttactgtgcttgatgttagtggcagtatggcaggcaccaaactagcactcctaaaacgagccatgggttttgttattcaacaccttgggccttcggatcgcctttcagttattgctttctcatctactgccagaaggttgtttcatctccgacggatgtctcactctggcaggcagcaagccttgcaggctgtcaacttgcttggtgctggtggtggtacgaacattgctgatgcattgaagaaagctgccaaggttattgaggatcgcaattataagaatccagtctgcagcattattctgttatcagatggtcaagacacatacaatatttcctcaaatgttaggggaacccgtccagattataggtcacttgttccatcttccattctgaatcatactatctgcacagtgcctgtccatggctttggttttggtgcagatcatgattcagatgctctgcactcaattgctgagtcctctggtggtacattttcctttatcgaggatgaaagtgtgattcaggatgcatttgctcagtgcattggtgggcttcttagtgttgttgttcaggatatgcgactaactgtggaatgcgtgcatcctagtgttcagcttcatactatcaaatctggtagttacttgagtaaggtggctggagatggacgaaatggatcaattgaagttggtcatctttatgctgatgaggagagggacttcttactatctttgagcttcccacaatctcgtgatcagaccatgcttttgaaggttgcatgtgcctatagagattcagtaacgaatgaagccatcaagattcatgcagatgaggtaaaaatcctaaggccaaagtcacctacgtctgagccagtttgcatggaggttgatcgtgagaggaaccgtgtccgtgctgctgatgctattgaggctgcaagggcagcagctgagaggggtgctctttctgatgcagtggctattcttgagcattgtcggaggatactctcggaatctttttcaagaaagagtggggatcgcctgtgcatttcccttgatgcagagctaaaggagatgcaggataggatggctagccggcaacgatatgaagcttcggggagggcatatctgctatctggattgagctcacattcttggcagagagctacaacgcgtggtgactctacagacagtaccacacttgtttactcctatcaaacaccatccatggttcagatgctgcagcgctcacagaaccaatgcccttcacctccgggcctgaggccgcagctccgacaaactaggtcactcttggagaaaccccatccaaggtagaaggcagtttgccattgtctcttgcgaagcaagtgcaaagatgatggtgtagaaatttcattggtgtcattgcttagtaggtcagtagtgcagtagcttagcattcatcctttgttcttctgttcaagtcaaggatggcggtataccggaaatggggaggtgagcttggaggtaaatatgtttttgggggtatactggagaaagtgaatgggggcttggtggtaaatacattgtgaagggggcctgggaagaaatagtagagaactggagcagtggtgtaattgctacaaggagtaagattgtgtaggttggtaatttagattgtcaggatgtttctaattgatgaacctcttttcattttgccttttggtgatgtaaagggtctggtatgggggaggtataccatagaatcttggggaattttgatttggggtggcaatgtaattccatggatttcttgtttttattcaccagttattaattgctggtgttctgctgtcgccttgccgtgaattgcaagtattatccactacatgcacgtccttacttttccgaattgtaagtattatccagttcattcatgcccttgtctttcagggtcatatatgctgatataatctttcttgtgccttattacacaaaccgcacatgagtacacacacctttaagatatgctcataagaagcaaaccccctaacctcacaaaatcaatattgactaaattcatattgaaagtgaatagactaaatttagggggtgtttagaactatgggtgtaaagttttggcgtgttacatcaaatattatatagggtatcgcatagggtatttgggcactaataaaaaaataaatacagaatccgtcagtaaatcacgagacgaatttattaagcctaattaatatgtcattagcaaatctttactgcatcaccatattgttaaatcatggagtaattaggcttaaaagattcgtctcataaattagtctcaatatgtaaaattagttatttttttggcctatatttaatacttcatgccagtattcaaacgttcgatgtgataggatgaaaaattttagggtgtgatataaatagggccttatattgaaaatgtataagcgatattgataggttgtgtgaagttatacttttatgattttaccgccagtgtaattacatgtgaaagtttttagagattttttatgtcgaaagttgtacttccaaacgaatttgctatactactatagtaatttagggaagaaactcgatatagatatttcggggaaccgtgggatacacttttaagggaaacatattcgctttttcgaccatgggatacactttaagggaaacatatcctctaactttgtgcagtctgtagttgtaacactgattatatgggccctactttgttatggcccacatgtcagtgatacaattgcacactacataaagttaggggagtcttttttacttttaagattcatgcacaggatagagagcaaaaattaaacactccatgcaaggtgctagagtcaaacccacaacatgccaacgacatgctcgcgctatccaccaccaagctacgtggttttagttataatgcaattacatagtacttatactttagttacacatttgttacaatgtacctatattagttttatattgtaattatatcttaataaagtttttaggaacttctcaatggaaagttacatgggtagttcctttataaaatctctctcatgaatccactattacgaatgattacttgaattttgagagatcacttgatcattaacaccaggatgccagatgcgtcaagaaaaaaaaacactttcaatcgtcaacatcaataaaaactgaatgcatatggatcactgactcattgtcattgtcaaataaaaacagatgaaattcattaaaaaacgaaatccttatgatgctgttacaattgatttcctcccaaaaaaaaaaaaacaacctagattagcaacctgactaccacctgaggagcctcctccctggctgcaatacctgatacagcggatacggcacgtctgggctgtcgggaaaggtcgggaaatccgtcgtcacgccgcaccgcggcgagaactccccgctgcccacgcgatgcttgcactcgatcaccgtctgcatgcacgacctgcagtacctcgccggcgtcgtcagggtcacgtccaccgccgcgtccccgcggcggagctcctcggcgaggcgctcccgcgcgaactctgggacggcgttcgcgtggccccacgccatcacggacctcgcctccgtggtgttctcgttcctcccgcagagctccggcgcgggcccgctcgccagctggacgccgcggtaggacacggccgccgtcgtgccgcgctcgacgcacgccacgctgtacctgcgcggctccttgatgcggacggtgaggtcgaacgtggggtccagcgtgggccgcccgaggtcgcggtccgggtcgagcccgctgacgccggcgacggcgacgctgaactccgcggacttgccgtcgtcgaaggaccacttgtagggatagtagagcaacgctgacatgagcaccagcgccgtgagggcgccgaggatcccctgaaggatattccagcagaaccccttcatcatcacgccgcagtcttccatcgtaagaatcaacgagccgctcgcataagtactcccgcgagcgccccatgtcgacgatttcgtaggtttctctccgtacgcgatctaagcaacagtagaagaaaggcggttttgctaaatatttatcgggtgatttttttcatagtatttgacgtttttctcgccgcacgatgttttccaagatttgtgcaaaaccacggtcagttgattccatgaccgagtcaacctgactttgtatcgatggattcctatacatcacgcatgttagtagccatttatttcttctctctatttctttctttctttttctagttacaaaaaagtttacagtgcacttatactaaaattacagtctacttacatgccatatctactatttttccaaatataattttaattataaagcactgtaattttagttataaatgtaacatttaacacttcagatatctgcatggtttctcaaacaatgtatttgtactaaaacgacaaatattccagttaccaaaatttatagcgcacttgtactaaaacaatgcacttacatgccatatctactatttttacaaatgtaattttagttataaagcactgtaattttagttataaatgcaacatttaacacttcagatatctgcacggtttctcaagcaatgtatttatactaaaacgacaaatattctagttaccaaaatttacagtgcacttgtactaaaacaatgcacttacatgccatatctattgtttttacaaatgtaattttagttataaatgcaacatttaacacttcagatatctgcatggtttctcaagcaatgtatttatactaaaacgacaaatattctagttaccaaaatttacagtgcacttgtactaaaattatagtgcacttacatgccatatctactgtttttacaaatgtaattttagttataaaacaccgtaattttagttataaatgcaactactctactaacgagcacaatcacaggctacatggacggtttctctgtactgttaatttttttttaccgttagatgcagatttgaggggaggaaaaatttgagtgattttttctcaaaaatcacacgacagatgcctagacagtcccgaagaaaggcgttatgacttagcgtccgccgtatcaaggcgtcagttatatacaggtcgcagttggaagattaatccaaggagtaatcagattgggagtttgatttacagatgagttcggcaatgatacgggagataatttgatttctattcgaatgtttcgcgttgatgcgttgtagaattctgcgtttgccgcggccgattacaattgcaaactccatggatgtccacgagtacgtgctggtaacaattgacacgacgtcacgtcaagcgtagaagcccaaatctggagaggaggccatgggtgcgttcccggagcaagaacagccacctctccttggtcgacgcagctcctttcgaccggaggaagaagaagaagacgatgagtacacggatgccttcggtgtatgcttcggcctgtttctggccatcttcgcgatcatgctggtcgtcctctgcatccgccggcccgacacggacgggatggcggcgagcccgcccgactacttcgtcgcgatcaacgccgtctcgggcgtcgacccgtccacggacctcggccggccggcgctcgacccggtgttcagcctgaccgtccgcgtcgcctcgcggagctccacccgcggggcgtgcgtcagggccggcacgtcggtgctggtgtcctaccgcggcgtcccgctggccggcgggcgcgcgccggcggacccggagctctgcgcggggccgatgggcgcggcggaggacggctccgtcgtcgcgcgggggagcggggcgcgcgtgccggggacacagctggacgccctcgcggaggacatgcggcgcggcgaggcgctgttcgaggtgacgctcgcgatgccgtactacgggcagcggaaggtggcgtcgtgctgggacagggtcggcgacgccgcggcgctccgggtgccgtgcgacgtgtccctggtggacccgcgccgccttgccggaatcactggcttcagcgatctacctagtgccgtgtaaaacgacatattcgctgggaactctaaccacttttgagtctctcgtggtttacatgtaatttaaataatttttaaaaattattaaaatatcaataatatatatgataaatcactccattttagtctgtctttttattttttaaaactttttttcaaccattttaattataagcaaaaaatacaaacaatgagaagatggttccttcagagtttataatccaatcacgagatcaacacaacagcaaccactcccacatgtgttgagttgtaactttccgtagtttctagagtagtgatcactcgtgtcctcaggatgtatctgatttggtactttcttggttttctttaaaatctctatgtgtaaggactttgggggactgattttcccccaattattttttcacactttatctaacgttcgtatagagatttggttttatggacgcattctccgtagattgtatttgaattatgttgtgcatatttgtcaagctcccaaggatatatctgttctaaaatatactcatcacctaatagggttcaacatttgtactaaaatataataacctttacacctattctcatcttgaaaaaactaatcggcacatatgcgcttgataagttataagttgctggcgtacgctcagcccaagccggcccacatgcttctcttttctccatacacggtcgcacttccattaattttgacaatttgaccctttgcaaaaaaactaattttacaaatgaaccgtcgccaaaactaatttaaaaaataaccttttgttcagcgccaaatcgtgtggcgctgaaattagacacttcagcgccaaatagcgtggcgctgaatgtacgttggcacgttgactcagccttccatctacggtggcacggcattcagcgccaggtgatgtggcgctga

SEQ ID NO: 68874 - DNA, 29641 bp, Oryza sativa
cacgatttggcgctgaaaaaagggtcacttttgaaataagttttggcggacggttcatttgtaaaattagtttttgcaaaggttcacattgtcaaaattaatggtcgcacttctttctttctctccgttgctcgccttctttctacatgaaaggttttcattttcctccggttgactcaggcagtcaccatgaaaaggcattttctttcataccttttcattttattttgagtaaatttcacaaaattagatatactttcatcaaactatcacaatactacaggtttaaggcaatatatctcaaaactataaattaacactaaaattaccacaaaactataaatttaaggccaagtatcacaaaactacagatttagtaacaaaattatcccaaaactaaaagtttagtaccaattcaatcgcaaaattgtaatgcttatacctccaacgtaatagtagtgctagagatctaaacttgtcgacgttttagcacgactacgatatttgcatggtatgaagatcgttggtacaaaggcatatgccagattgaggtaaaagaaacagtgacaaagatttttatacaggttcaggcctcttattcatcagaatcaggttatagctctactcatgttggccgaagccggtgttgctcttattcatcagaatcacaaaagtacaatatttgagataatctatctagctatcgtcgatatggcggcatgaacaccaacacatagtcgatgatagggtagtcttcctcctcaaatatgaactcagcgagatcagagatagcgctagatccctcttgtcggcctctacatgcactagattgggtatgtctaagctgatatctgatgtcgatgtttggcggcgtgtattagtgtctattctgactgttccgtggcccctctcctcctatggggtcttgtatttatacccatagatgtccccttttgtctaagtaaaactagggagacacgtatggatacaattagagtagtcattatagtttccatgtagaactctacttgttcttctttatccgaaactccttctgtatacaaggtatgattccgtataagatttggaatatggtgggccccgccgaacttaatcgattactattggatatgtgttatccataaccctgacaaaacttgataatttgcagttttgtgatacttagtttcaaatctgtagttttgtgatataacgccttgaatcttagctttttgatagtttgattaaaattctgtagttttttaaaatttactcttttatttttataccatatttcaaattattaaaacttaacaaattcaagtaaagtttgacactaaatttgaaattttcaattcaaaacctgaaactttcaactcaaatttaaaacttccaactcaaaatttgaaaactttcgactcaaagtttgaaaactttaaagtcaaaataaaatatttcaactcattttttaaaactttcgacctaaagttaaaatatgaaagctttaaatgtcaagttgaaagttttcaaatttgatttgaaacttctaaatttttaattaaagtttcaaaaagtgggttgattttttttcaaaagttaagttgaaaagttttaaaatccatgttaaaattttcaaattctagtaaaaagtttactagattttttgaatttgaatttgttgatgaatattttaaaattaattttgttgatgaagttggcctacaatttgagcttgtggtcctagaggcccagtagatcagaggacgagagaagtgagcgcatgccacatgggagaaaattgaagatgcgtgaatgagaaaaatccatgtgggcctggaattatgcgccattttattctcctagcgcacctgcgctaattagacattccctcctcatctaaactaatcacaacatctcgcattttatttccccttctatttcatctaaactattttttgtttaatttttttgcgtatttctttatcttaatctagtcacaacctatactcattcaatttcacacctcatttttctaaaagtatttatgaagtgattattttgggacgtacaaagtactctctccgtccacgtcccataatataatttggagggatgtgacaaaatatagtacgacgagtttggacagattcgtctgttgacagaaaacacgaggcctgggagatctgtttaactccagtgcaggtccaaaactcgcattcggatgtgtgagcgtgccagttgatttgatcatgtaatcaacaagaaacaaagacaaagaaaccgtggttaaatccataaatgatagccgatcggctaagtgccgatgacatatcatttattttaggccgatgtcatatgtacatcgatcggtaagtattagtaagcaaatcagaactaaatctactcgatcggctgtagatattaatgatatataatcctcatatcgatatatacttaaatcaagtgattggaatagatcggtcaccttgccaagacagtataaatcacttagatcgaaacatatattaatagtgggattatatatattcatagcatagccgatcagatagatctagcatgtatcggctaatattccgataccactctatattaaaatattaaagcaagtaaaatataccaaacaaaagcctaatatacttaaatgcaacaagatcttaacataaagggcagatttaacatatcaatcaagcatataggataaaagtagttaaatcaggtaagatcggttgaaactccgatactaccctaatcggcaaccagaaagcaggctagagattgaagttctaagcacgacttaatagatcaaactgaactgatgcagcattaagtatgaagagaagaataatatctagacaatcaagccgctggatgtttcatagagtggtagatatatcacataatccaagttaacattgttatctaacctaatcggctgccttctattgacaggtgctagtcggttataggttagatgacgatattatcaaagattatgtgagatatatgataactcgacgaattatataaacaagattagagtatcataaagatggaagcactaatctcgagaacacaagtcgtcataacaagttttacctcttattgaagatcgaaaccgatgcagctcaacccgaaagcaagaactcgtcgaaataaaactaaatcaaaagggtggcgatgcgccgagattgtattgaacgtgtgttaataattacatagggttcggggtctatttatacccgagaattacaagatatgtccataccggacacgactattatctctaacaaactctaagataccgtaagtctttgcagcagacttttgtccacatttatctctaaggaatttacataaaatatcctaattaatagatacaattgcctttctcaggactctatccatgtacggcaatcatcttgaagcacatcaactcaatcccgattgtcggatacgagccatattgtcagaattggctgtatcacttaacccagtctgactcagacttagccgtagccgatccggactccagccgattcttactctgcctccgcgataacatcgtcgtactagattgtgtcacatccctctaaaatcccttatattatgggacggagggagtgcgatttttttttttgaaaatcttttcttcattagtaatctatataaagttttcaaaatcaacttaccaacttttgtcataatcaatttgtgttctagaataataatcagtttcagtttcatccgtcatccatcctaacaaagaattcatctaggagtacgacggagagagagtaggagttagcgtaagatatatctaggagtattttttatttcgaatatagaataacgatatacggtactataacagattagtatttgtttgatacgtaatgtagcatagttggcccgtaaaccaggactcggatctctttccgggcacccgaagaactccacgtccgatcaacttacgacgtgtttcgatccacggacatatagaccagccttccggccgctccgtccgttccccctcctctctctccgcccccacccccaaaaaaaaaaaaatccatctagtctctcaatctcgatcaccaaccatgggcgcgctcgtcgaggaagaacagccctttttgcccctcagccgcggcggcggcggcgcctctggtccgagagcagcaagggagcgcggacgctcacagacgagcgacccgtgcctggaatgctgcggcatgatcgtcgggattgccttatttggggtcctcttcggtgccttgggctggttggccatcaatcatcatgggggagtactacgtcccagcgatgccgcagtactccgtcgagatcgcctccgtctccggcctcgacccggcgacggacctccacgccggggcggcgctcgacccggtgttcaacctgaccgtcggcatcgcctcgaagggcgagtatcgcggggtgtgcatcgagccgcgcaccgccgtcaaggtgtcctactcgtacctcggcctcccgctggccgggggccgcgtgccggaggtgtgcgcggggccgaaggagccggccgagaagcggaccgtcgtcgcgcggggcgtcggggtgagcgtgccggggtacatgctggacagcctcgccgaggacatgaggagcggggaggcggtgttcgaggtcaagctgatcaagggagacggcgacaggtacagcaggacggtggcgacgtgctgggccagggtcggcggcggcttggacgataggtgcatctgaatacaaacttccaatcgcgaaaaatcatcacggcttcgtagtgtcagtttatctgaggttttttttcttccttggatggaaattcatggaattttgtcggtcagcatatatgcatttcttttctttgatggattctaccaattggtttatacgtacataatattgtttacaaaatatgcatatgttggaattttcaaatgttgactaaatattatcctaagtgtcaaatatttatgacttaaccaaagaaaggaaaatatttgcatggtatgatcggtctaaaacattgttgatcgatcgagatatataccaaatacaatcggatctatggaagcaaaaagggtgaatagcttatcgaaacccaagtctatttctaatatcaattgcatacaaattgcaaattgcatgtatgtaaacaaaaactaagagttgtggtatattaaatctatttctattttaaaatttaactccacgtaaaattatacggaatattattatttagggattatgaaaaccaccccaaatatcacattgagtttgagattcctccctataggatgatttcaaataccgcccccctataagatgatttcaaatactttcttatttaccagtttgatatttctccccaattgttgttcatgcttttattttttcatctttctgaatgtgttatataatttaaaacatggccctagacacatattctttctcagcgacacaatatcgtatcatatgctcatctttatcgtcctgtatgtaccgaagaaccgtgtactttcagacctcatgaggcaagcacaatagctcatcttttatcgatctcgatgttcaggagcaaagactcatgaccaacattgcccaacgacgtgctaagctccatgaggaaggttgccacggtcatgtcaatattcatataatcgcctgtggggtttgtggccacaagaattagtgagcaacgataatcggagaaatctcaaaacaaactgaatagaggggatatttgcaacaaatcttcttatgtttataggaggagttttaaactcaggtaggcatttagggtagccttttcaattcttttcttgttttaaggaaaattttaaaatccaaaaggaagagagatgatcatatctctaccatatagttcaacaaatagtttcactcatcactcattctttcatctccactatagtacgttcaacaaatggtttcactatcactcattctttcatctaccctatagttcaacaaatggtttcactcttcacccattctttcattcctcattgaacaaatggtttcacttatcactcattctttcattcctcatggaacgatctagatcatctctctaagatccaacgtccctatagttcaacaatggtttcgcttatcacccattctttcattcctcatggaacggttcaactgattcctctcatcttgcgcgtgcatgcccctcccacctgtgcgcataccgccgatctctcctaaaatcatgcactcatggtgatttcagaaaagaaaaaaaaatcatgcactgactatactgtgctaccccccctcaacccccaatctggtgttcatcaagcccgctgcctaagggagccatcgtttcgcttattcgtggaataagcgaaacaacatatttgcaaacgaaaagtaatttgtgaataaaacttttatatacgtgtttttagcgatctaaaagcaaaggttgaaaaataaacttggatgaaaaaaacctcaaaatcaactccaaatttaaggttgaaaattcaaattttggctgataagcataagcgaaaagatgagactgtacgtcagcgtgtcctatgcctaccaagaccccccgctggtcaccgggctggtgccggacttctgcatcgggccgcgggaatcgcggggcgagcttgccgtcgcacgggtgccaatgtgagcgcgctagggtactggctgccaagcctcgccgatagcatgagggcagtagcaatgcgtcacgcctcattgaggaaccaaaatgtccatgttggaaaaaaagcagtcgaagctcacctcagctcccctctccacattgcacttgagctttaggtaggtccaccaccttttcttttcaggccggccccaccaccttttcttctccttccccctctctctcttcctaaagctgacgacgctgacacaaagcggatgaagaacacgtgtctcagtttggtcacacgttcttggtttagtcacgtgaaatgcacacgtggctgagaatctcctatgtgtaagcttgaggctgaatgccacatcactacactgtgaaagcccttaggagcgctcaagtgatgtttgacgtcaatctgcagaagcggaacaggtgggatgagtgcaggacgagagtcggcgagaaggcttcatgccatttagattttgccgaatagttattaggagacattataattccttctgttaatatgtgatacatttattataagaaaatattatgttttcgtttcgttttttaagtgatgtttgacacatttattttgttcaaagattatgtacaaatgcataagatataaattatacataaaatatttttatgataaaacaactcataacaaaataaatgatagtttcgtaaattttttaaataagataaatggtcaaacgtgtatctaaaattcaaaaatgtcatctattaaaatacctaggtaacactaatggtattttctctcattaaatcacaacattctagttatttctaacatttggatgattcacctatatgatgcatatcatgttaatatttttaagagtggctatatttatgatgttatattttgcactaaaagacaatcaaattttcggatatcgaagtttaaactctcccgtatatccacggtggatagaacaaatcaatcgattcaggcgcataaatacataccagacacccgctctgtttggcaagataagattaaaactctaaagtagattccaaagcacaacgtgtgctgagaaagcgatgtccgccgtgatcgcgccgccggcagagcatgagctgcctgtccattgggccgtcgctgagccggacaacactcaacgccgaggtgtactaggaggtgtaagattgcgtatagacaccgtatgcctcgtcatggtttgcatgatcctcatagcagtagccttcttggctatgatgattgttgccatcgtcaaagactggacgcaaccggcctcctactccgtcgcgatcgattccgtcgccggcctcgacccggagacggacctgccccgcgacacgctcaacccggagttcaacctcacgctccgcctcgcgtcgcaacgtgccgacatgggggtctgcttcgaggccggcaccaccgtggcggtgtactacggaggagtcctgctcgccggcgccgccgtgccggcgctctgcgcggggccgcggccgtcggccgaggaggagagcgtcgtcgcgtgggggagaggggtgcccgtgccacgcctggctcgggaccgcctcgccggggacctgcggggcggcggcgcggcggagttcgacgtcacgctcacggtccaaaggtacacctacgccgagtcgtgggatgtcgtgttgtgcagcggtaaggtaggggatgccgccgcgttgataactccgtgcagcctgtacgacgaaaatgtgcaggagccgtcgctggaaccgggttacggcgggtattcttcgcagccggagtcaccaccagagaccggcgatgacggttaaggtgaaggttttgctttgtgatctgtgagccatctgaattttcagatgttgcaaatattgggtttttgttgttgcaatcggtgtgttgcattcaattgaaacatctttgataaagcggctaaatgttctttagtgaaagatgaaacatcaagaaacaatttatgttgaaatatttttttcgagcaatggaacattacgcgcaacattgtccggagacgtctgatgcataggtctatccaaaaagaagcagtcggatgcggacgtttagtcgtcaactcctaacaagaaccggtttcgaaaaaagtgccccaagcacgcacgtcgacatggccgatcaaactatattaatcggagtcgtgcactcccaatcccaactccacaccccatcgtccgtgaggccggcatccccctcccggccacgccacgccaccgtccaagccactaagccagttcatacatacgaaacaggtagcgccgcgtcgtcgacgacgacgatgcccgcggacttcggggcagaccaagatcggattcgacgtctcctccgctgtttcagtggcatcgcaatagcggtgttggtcgtagtggccgtgctcgtcttgtgcgcattggaggcctccaaggccccgcggctgtccgtcgcggtcgccatcgtctcgggcctcgacccggcgacggacctcgcccggccagcggtggacccgcagttcaacctcaccctccgcgtcgcctcgcggagcctcctgagccgcgcgtgcgtcggggtgagcagcacggccgtggccgtgtcgtaccacggcgtccggctcgccagcgcgcccgttgcgccgcgcgtctgcgcggcgcggaggaagtcggcggacgcggggccgttcgtggcgtggggctcctcggtgcgcctgccggggttcgcgcgggacagcctcgccgcggacatgaggaacggcgcggcggcgttcgacgtcgcgctcatggacgggcacctggtggtgtgcaggggcaggcgggtcggggacgcggacgccttgcaggctccgtgcgtcttgacccacgtggaaacgggtgcggcggtgccgcacacgggaacgtaaagaggctcgccgtaagagtatatctttgctcggccggccgtgatcatcttggcacagttttttcttagcccagatcttagcgcaattgtcttagtatttcgaactgatgcgatttttgggttacttttgtatttcctgcaagattattagtccaaattcaggttattttcttattctttaataatgtaaaatcctaaaccaaaatttctatacacacatcctttacttgtaagaaactcaaatggttatgaacaaattatacattttgactaacctagcctatgatgatttaagtcaatatataaatgtgtggtttcttcatctatatataccgttaaatttaaattttgacgtacatgcttatgaaagaatccttatattatcataatctaccgtagcaacttctattaaatgttcccctcaaaaatatttctattaaatttatctataacacgagcacgtacgtatgtgtgcaacatactctctccatctaacaaaactagcctagtattaggatgggacacatcctagctagtaaatctggacttatattttatattagtgaggttgtctttagttccacgcctaaattggaagtttaattaaaattggaagtttgaagaaaaaagttagaagtttatgtgtgtaggaaaattttgatgtgatgaaaaaattggaagtttgaagaaaaagttgggaactaaactcagcctgatacttactcctcctgtcaaaaaaaataacctagtacattttctattgtaaatttgatacctcttaatacttagatattatatagtattaaattttacattaaattaaatttaatacctcattatacctcaataataacagtaaaattgctcattatataaacaacagtttcttaaccactccctccatccggtcttaggaaacgtaacgtcggtgcgacaccagttactataccttcgttgaaaccaaacgctatattaggtaaaaaagaatacattaacatatataatttccgggatatggaaggctcaaactacgggaactatccgtgtgtattcgatttcagactgcaacatataccatttttaaggcttcagaagctaccaatatgtcagatcaacgtgtataaaaacccaggccgccgtacccctgctttatccatcaaaaacgcgaggacgaagcgaatcgaatacaaacagaggctaaaaatcaacgtacaacaatgctgcgcgcggcgccgatccaagtgcagccggcagagccagggccacctcctcgtcgctgcagcgcctgcgtggctgtctttatcacattcgtcatattgtccgggttgttgttcgtgttagtgctctcagccgctctatttggtgagcagaagtactacgtcgccatagacaccgcctccggcctcgacccggcgacggatcttccctggccagtgctgacccctgagttcaacctcaccctccgcgtcacgtcgtggagcgtcgttggagccgcgtgcctggatcccgccatggacgtggcggtggcctaccggggcctcgccctcgcgcgcgcgtcgccgccgccgcgtgtctgcgcgcgggggtggggccggacggagcaggtgccggtcgtcgcctcgtcggggaacggagtgcgcctgcccggtttcgcgctgcacggcctcgaggcggacgcgtggggcggggctgtggcgttcgacgtcgcgctgactatgccgccgaagggcagagacaaccggcatcagctgtggtgcagagctgtgccggtcggcgatgacggcggcttggggatcccgtgcaatgcaaattcggagtactaaaggtattagcggtgcgaattaacttgtgtcaacagtgatgtgcgtgcatgcacgcgtgtgtctgtgcgaacataatactatgtgtctttgtgtttttctcccgtgatatagacttgattatcttggatggtgaaatactgtaacgttactacagggtataactatttatagatacatgtgccataatttaaaatagggtctaaacctcggacttgctggtgatccgggtctagcaaaacaacggcgtttgtctactatatcggcacacagatgaaacctctcgttgcttgttcatagactgcagatacacaaggaaaagctaagacaccattgccaactagatagcctataaccccatcaaaccaacaaactgggtgcatgtgacccagtctatgattggtgggagtcacttgcaacacgtcagagcgcacccaagcgtagtacttgatccataattctcctagtctcatgggaaatatgaaaggaacggaatcactgaattttccgaaataaggagttatccacggcggccctcattgtgaacataaaggaagagtcaaaatctcgggctttggcgggagccaaacacctaacggagatgttgccatagttccccaatcttttttttttgtaaatattaccttactccttacttaaatattacttccttctacataatgagtgagacatggggaaaaggctagcttctcctctctttctcaatcggttttgtgattaaaagtaattaataattaaaaatagttttattactctgattggtattcgggctaaaattctagaaccaaatctggctcgggtaaggtaacaggcttagtcgaaattaatactacaatattgtgatgtccgattgacgaatttgttttttttcttataactcaaggttaccgagattaggatccatccaaacctgcgacgcgtagtgatcatcaatgaactcgccggaagaacgaggcatgtcagcggcagcggctacggaggtggaagcgcacgcagcagacagccctcctcgccgtcgcctgtcgggtcgcaaccatggcgataactgcctgacggttttgttggtagtgctcctcttgctcatcgtcggcggggtagttttcttcgtagtcgattccaacacgagaccgcggtactccgtcgcgatcgacgccgtctccggcctcgacccggccgcgacgggtgatgacgggcggggtcccacgctggacccggtgttcgacctcaccgtcagcatctcgccgcggagccgggtaagaggcacggactgctacgagcccggcaccaccgtggaggtgaactaccacggcgtcctcctcgccagcgggcccgtcgagcagctgtgcgcccgggcgacgaagacggggcgggggcgcgccgtcgcgtggggcaccggcgtgcgcttgccggggttcgtcctggacgcgctcgtgtccgacgtgcggcgcggcggggtggaggccacagggttcgacgtcacggtgaagatcccgtccaccggcggtggcgaccgctccagcccggccgggatgctcgtgtcgtgcagggcgaggcgggccggggacgacgccgccgctgtgttgaggactccgtgcgacgcgctgagcgcgaacatcgtcgtgccattgccgaacacggggaggacgcagacgggcggtgccagttaacattgtgtgaataacggcgacgtcgtcgtagcacgctgcagcctgcacgcagccatcgctacaagtctacaactcacaggtcgcgagtcgcgaccagttaattcgacggaaagtctgtaccgtaccgtccggcaacgaagcagaggattcaagaaaagcgactaaacagactttcactgtatactatttatatgtttttttttgcttcacttttgttgaagctattgatcaatgaacatagtgttcattgcaggattatatttgtaaattttttaaacagaattactaaaacaaggccggaaagtattccttcttctacgggaacatgcatctatatgtgggcatgttcacttcttttgttgctgaatagtaaaatatgaattgtaataatcattcgagggcataaacgaatttaattaaatattataaagttaaaaaggatttaaaacagcattgtaacatattcatatgtagaatttttttttgccaaaatctcttcatttagaagctcgggaagcatgcacaattatccaacattctactgcacagagagaaagtactccaggtagttaggtacctcgagttaccaaaacctttgatacttaccgtaaaatttctccttttctaatttgtgttttcttttgatattgtatgttaaaatgttcttagaattttaactggcaaacttttaagggcttattcagttaataggttttcaaaatcgaaggaatacgaaaagcaaaagattagcaagttatacgtactccactccttaggatttttatcaaaagttctcaccccatgataagaatcgtatgaaatagggttataagattacaattcttagaaatttgataggatccaatcctataaaacaaatgatgcatatagaaaaaaaaaactaagattttaattactacaataatcttacgaaaattctttaaactaaatgagcccttaaggcgtggatctttcggtgcttgataatcaattttgctagctgatcctggctcagctcgtagctatgtctcataccggtggttcatgctagcagagttataatcttgatggataattttatcatccatgagaaggtatcaggaggtaccatattttgtaatgtaaaaaaaataaggacaattttaccatacttaaaaagctatctagtgttaaacttggtacttctaggtactaagtatctcaatatatcaaaaattttattgcaaaatttagatacctcaaggtacattctcaaatactataaaattcctcaaaacttaatactttcagataataggtactttgagatataaagtttttattgtaaaattttgatactatagatactttctcaaaaactctagaattcctaatgtcaattggccgatgagtttcaagccgcggcgagatgtcgatttttcgttagtttcatctcttttggtaaatttctaactagtaaaattcaacgagttttgagccggctcgatatgctcgaaattcactaaattcatcgattgtgaatccgggcaccaatttgctccagcgggaagaaggaaagagaggagaagaaagaggagggaagtagggaacggaggaatacatattcggatccgacttgtactgggagacctagctagcttcggagtctccagttgtttccaaacaagagtcgacggaactccaaaaaaaactggcccgccttgctgatcgtgaacacaaaaatccctcgacatcgcccctggtcttcaagccaaaagcagcgacgcgatttgaagttatcgacgaagtccgctctagaaggaagagatgccaagggagcgagcgatgcagatggaagcgtcgccggaagaacttccctggggctgctgcgtctgcgcgtgcgtactcatccccgccgtcgtgctgttcgctggcttgatcttcttcgcaatcgacgacaatgacgcgctgtactccgccgctgtcgacgccgtctccggcctcgaccccgtttcggagcttggccgggatcccacgctggacccgactttcgacctcaccgtccgcatcaggtcgcggagctggttgcgcggggacgagtgcctcgagcctggcactgccgtggaggtgacctaccgcggcgtcctgctcgccagcgggcccgtcgagaagttctgctcgggagggaagaaggcgaaggaccagcacgtcgtggcgtggggcaccggggtgcgcttgccggggttcgctctggacgcgctggtggcggacgcgcggcgcggggcggaggcgttcgacgtcgcggtgaagatgccgtccaaacacaggggtcacgtgacggtcgacgggacgctgatatcgtgcaaggcgaggcgggtcggggacgccgccgcgctggggacgccgtgcgacgtgtccagtatggacatccccgtgccatccccgaacacggggaggacgcagaagactggcggtgccaattagcacgtgtatgaataacgtcgctctcggcttgtggtagtagctacagtacacatccgtctgctgtgcggagtttcatgttaagtttagagttggggctcttttttctttgtttaatctgtttcttttggaagagattggcagttgatcaattgatggcctcaatgtgtttttccgatatagaagatgcatacgtgcccacgccaatatacacataaacttatcacatatgcaacagcaaataagtcccttgcgcacgttataggggcaaagactagcggaaaattccagtcttaataaaatcctactcacccgttccatattactttttcctattaactcaaattttaccaaaattatttaaaaaaaatactcactccgttttaatacatgtcgcccttggctttttaatatacgtttaaccatttattttatttaaaaaattatgtagttattactccatccgttccaaaatataaaggattttggacggatggacactagtactacgaatctagactgtccaaaatctcatatattttgggatggagggagtatttatgttgttgtagcttgatttatcatttaagattcttgaagcacaacttatttttatgtttgtacaaacatcttcaacccaaaatataaatactaacaaaatgtagttaattgtagatttaataaagctattttaatattgtagatattgttacctttcttctaaaagggagtattaataaatatccgtatatgtgtaatatttgcagacatcgaaattttgatagaatcatgtactagctacttcacgaagatatgattccaagaaacaaaggaagtccaaattataacagtaagaaaaacaatcccgtacgggcctgggaatttttttagaaaaaaaaaagaaagagatcgaccaactaagatgtctgttgaagcctctaagaattgcaatagttctataaggtgacaattttagaattgtttctctacaaatccaaaagatcatgcatacccttatttgttccatcctattaaccgacggtccttattcagaaagtagtagccggccgccgactcaattttatcatatattttctggacgtgactacacagctagtggtagctggtttgtctaaaccaactaccactctatatatgaaagacactatccacctataattttaatacaattttctcttaaactactcatccgatctacgatccgattataccgttgtgttcgtaacaattaaatctttataacaagatcccacatgattatattttgatgaaaaattataaattaattttataatatatataaattacttttagatttcactaaattacttcttagacatatgaaagtaaattcaataaagcctaaaagtaatttacatactccctctggttctatattaattgatgttttggacaagattgaggttaaacttttataactttgaccatcaataactttaaaaatatttagtttaaagaaactagaaaaacatatatatatatttgtctttcaaaacactataataaaagtaaacatgcatttatttattgtatatattataatagaaaaataaggtcaaagatatatcttgtagagcgtgtcattgtccaaagcgtcaattaaaatgaaaccggagggagtatattatagaaataacttataacaaaaagaaagtaactttattgaatgccttttttctcattggacatgactacacagctaaaaatgaaaggaaaaaaaacaatcgatgattaaacagatttatagagagttacttttgaaccatgcaaaagttacttccaattaacattgaagttaggtggtgtttggatccagggactaaactttagtccctaacatatcggatgaatttggagtattaaacatagactacttataaaactaattacataaatgagagttaaatcgtgtgacaaaatttttaagcctaattaatccataattagcgcatgtttactgtagcatcacataggctaatcatagattaattaggctcaatagattcgtcttgcgaattagtccaagattatggatgggttttattaatagtctacgtttaatatttataattagtgtccaaacatccgatgtgatagggatttaaaagttttagtgccatctaaacatggtcttacttttaaaaattgttaaacttacgtgtgttgatctgtgttgattaaattttatttctagataaagtcatatttttatccctacaacgaatttacttctaatgtcgtgacaaagttacttccgttttgttttaagttacttttataatatatgtaacttacttttagactctattaaatttacttttatatgactaagaagtaatttagtcaaatataaaagtaacttatatatatgataaaagtaacttacatatatagtaaaagtaatttataaatataaatattttttcatcgtaatataatcatgtgaaatcttgttgtgaagatttaattgtaacgaacacaatggtgtaatctgattgtagatcggataaataatttaagagaaaactttgtttggagaggaaaaggacatacatgtgctgtagtagacttctcaaaaaaaaaaaatgcatgcatgcagtacgctatagtagacttctccacacgttgaggcgtcgctggttaaagcaaaaacagaggcctctccaaatagattttaccatattttctctaagccaaaataaaatgaattttaatagatgggacccattttaattttattccaattttaaatgaaaacctagtgctagatggatcatacccaaccaaaatctcttatattttcaaacaaagaggatatatttgcaatgcgtgcgactacagaaataaattctaatccttcgagagtcatgtccctcgatcttacatattatctaaatggttataaaaaaatgtaagaaaacttggtaagatagccacacaaacatgcaagttctgccgaatgttattccattattaaaaaaaggtacagtgtaaatttgatctacataagttgtaacaaaaatagaaaatttaactcttaactactctacgtgtgttcatagtattcctttttttacaatttgtataagtcaattttacgtatagtgacatattacatactgtattaatttatcttatcaaattttatcactatttatatactcccttcatttcatattataagttgttttgaatgttttttattaaacatttttaagttcgactatatttataaaaagtataacaaaattactatcacaaaacaacaatttttttttaaaaaatatattcaatgcttcttttaatgaagctaatttggtattatagatgttgctaaatatttcaataaactttgtcaaatataaaagagttttactagaaaaaaaatcaaaatctctatctcttctctactattataaaattttaagatgattttaccggtactttggtaagtcattcgtgtatgagtcgggttttaatttcctttgcttttgcaaatacgtatccgtatttgatattacatattaaattatcttatcaaattttatcactatttatatactcccttcatttcatattataagttgttttgaatgttttttattaaactttttttaagtttgactatatttataaaaagtataacaaaatttctatcacaaaacaacaattttttttaaaaaatatattcaatgcttcttttaatgaagctaatttggtattatagatgttgctaaatatttcaataaactttgtcaaatataaaagagtttttgtcacgccccgaactagtcccgaccggaactagcccgtgacgctccaaattaacctgttaatcgataccagtcccaggaaacagtcctggtatcacaggaagacagaatatcacagcaacagaggtctctttattatagagtagaggtacagtcatgttaggctgcggacagatcccgagctcacaactgcattacaaaagggaagcggaagccaagactcggaccaaacaacacaggcgcgacttgggaactaggccgaaaccctaaaactcatcgtagccggcttgctcctagaagaactcgtcatcagagggatccgcttcatcttcttcagcaactgggggggattatttatatagaggaagggtgagtacgggagtactcagcaagccatgggaaataagtgtttaatgcagacttcaaggaaaggctgttgtttttgcaattgattttatttgatatcttttctgaaaacaactaagtgagtgcttgtcgcgtcccaaaacgactctaaaatacatcctcgaatttatgcctagaataattaaaatccgtgtgaaagcctccacaattaaaatgtgcaaagttaaaagtcaaataaggcttggaggatttttgtatatttcctaaaagcctaaaatgcgtaaataaattttagtggaattttcacagcacaaataataattattaagaaataaacaaagttaaaatgattttataaaaagaaaaaccctaaaaagttccctttccctccccctctctctcttgggccggtccggcccagctctctatccctccctctcctctccccgcggcccattcggcctcctccccgcgcgcgcgccgctgacgggcgggcccgcccgccactctcgctgacgggtggggcccacccgtcatccccttcctcccgccgctcccgccgccgccgcgaatcccgccgcccccgtctgccccgcgtgcaatcaagaggggggaaatattccccgtgattccctccctctttccccccatttttccctccctctctccctcggattcgtttggaaatctctcccctaacctcgccggcgccatcaatggcagccggatcttccgcgcccgtttcctcctcgtccggccgctctctctcactcccgaccctatataaacactccccgtgcctccctccaccgtttccgccactcgccgccctctctccccgtcggaatcgagctcgcgccatcgctctctctctctgccgtcaccgccgagctccggtccgccgccgtcgtcgccccggaccacctcccgcctcggcgtcgccaccttcggcttcaccgcatccccggcgacctcgtccacccctccgtttcattcgccgaccgccggaacgccgtcgaccccgtccacccgagccgcgccgccgtcttcctccgctccggtcgccgtttccgtcgtcgccgtcgacccggggtgagccgtggaccgccgcttcttttccccctccccttcccctctctcggccgccgctccgccgtgcctatggccgccgccggcgaccataggggcgcgggcgcgccgcctcccgccgctgcgccggcgtggccgccttcgggcgcaccgtgcggctgccgcgtggggcccggctgtcagccgcccgcgccctcgggtgcggctgacgcgtggggcccacggcgccgcccggtgcgagcccgggtgcgcccggtccaccgtggaccgtgaggctgccgcgtgggccccactcccgtggacccggtccgcgcgcccctcccctcggctgacgcaataaatccatttttaaattaaattttaaatgaagaaattcgcaaatattcatttaaagagcatataaacttcaaatggccataacttggccatttgaactcggaattggaccgttcaagtctctaatttttccttaagaagtcaagaacctatttttgtgctttgttcctgcttgttatatggagtttattagagtgaaagccttttcttttccgttggtcgtgtagacgctgcagcttcggaagatccgctcttcgtggaagttgaagccggcgtttgggaaagcgagcaaggcaagtcacatcatccttgaacatattgaatcccagtttataaaattatgttgatttaaattattgcattatcgctttatttaaattcccgcgtaatcactgttttatttagccatgcctatttacctttgttatgaccttattattgttattgttattatttccttgttcaccctagaataaacaaaaccccaactagtggacactctactcatggtaccactagtatgattttaggtagatgcttcgctatttaattaggtaacattaggcggttttacaactctagactttgggatattcatatcacctggacactttggaattgttggagtattgtggaattggattcacacctccccctctattcaaaatccccaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctctagggcaaatgaaggctacacgagctgcggcccggtagtcgagatgtcatggcacagggccggtgtcctgctgctaggggctcagtcctgcctacctgtcccggagattccggccgtaggtgggattgggtcggtactcttgtctatggctaggatgggttggaaactatgtcacgtcttccgtctgtataccgtggtggtatgtggcacgtggttgcacgtgaggaagatgtgtcttgtgggtaaagatgtacacctctgatcagagtataacctattcgaatagccgcgccctcggttatgggcaagccgagcaatgtacccaagttagtgttttaattcttaaaacctgcttaacaactaaaatgtggaatggttggcctggattggcttgggacgagctgggacccagggtcgggttgccagttcggtctgaatcatcgtaggccttgggttaagacaggttcgtgtgggttcgccgccttgataaataataatgtatagttctagaatcgtgtctacaaaatagctttgagcaactaaatatctttaaatgccgtttactgcaaccctaaccctttatattctaattcccttgtactcccttgcatttattctgcacttgtgggtgtgtcttgttgagtacggtggttgtactcagtcttgctcaatttttcccaaacccagaagaggagcctctggaagatgaaggctttagtgtctagctcgtgcctgccgtcaagcgcctgtggtcgtcgccctagtcttccgctgtttcccgtttgtctttgtgtgtgctgggccttcgtcgcccatgtaataaattaactatttacgcttccgcttgatatactctgaaatgtatcaactcttggtgtaccttgcctcctgggacaaggaataatacacgcacgtaaggaacgcccgttgggttaattccggtcgtgacaagttggtatcagagccacccttgaccctaggacgagccgtagatcccaagccttagcaatattttcaaaaataaaaatcctgtcttatttgtgaaaatcctctagtctctctctgtcttgccgcttcatttatcgccaaaatctgatctttaaaatgttgcttttctttttgtttttgtttgtagatggccggcagcatcaaccgtcgtggtctggacctgactggctttgttttggagctgcggggcatgtgtgttgtcctggggtatccgcatggagtggactaccagggcaggcagctcccggagcaggagggtgacgatgcagagccccacgctgcttgggaggttactgcagtgatcctcactggctctcccgagaggacttcgttggcagtcaccgcgggtggagattctttctccgccgcttgccagaacgccgctctcctcgccatcggcactcttcaccagcgctacccggacgagttgcagcactcgccctaccgctaccaccctcgccgcggaggagcccgcgaccacgccacctttcgggatgctagctcggaggatgacgctaccatcatgcatctggcgcgcatggtggaggcgtacgacgcggcccgtatcgacttccatcagatggtgcgccgtgggatggtcgagaacagcatgaagatcctggagctgcgtcaggagaatctgcagctgaagaaggacctagacgcagtggaggcgcagctgcatcagctcaagatcgcccagggagaggtctgtcgccccaagcgtcgccgcgtctgccgcagccagaagatcaccgcccgcaagagtacctccaggcccgagcttgttcgccagtccttggcatggacctgcttcgtcgagacccctcgtgccgagcccgcgcccgtggttcctcaggagggggaagcctcaggcgttggtagcacggaggatgcgctgttgctcaccttccgtcctggcccgtcgcagcggtagacgagcagttagtaggcttgcgcgtgtgttctttctcgtttgtcttcttgttggagccgtgtggggcatggttatgccggtgtgtggtataactgtgtcagagcctgtctttattttatttgcctaagcaacttgaactttaatgaaccaatttaatagcagtaataaattcaagaattatggtagtcgtgggtggttagctttaattgtcagctctctctgtttgctggatctgtgtggggttgtcagatggtgacgaccaggagaagtgctaacaccggtgatggcaaccaacctgaaggcagcaaccacaacaaccatggcagcccacctccacctcctcctccgcctccaccaccaccactagacaccaatgccatcctcacccaaatcctagcccagcaggccaacatgatggctgctttcctccaccacatccaaaatccgccacaacataatgctccaccaccacccccacaacactctaaactcgccgagttcctccgcatccgtccacctaccttctctagctccaataaccccgtggatgcattggattggttgcatgccgtggggaaaaagttagacaccgtgcagtgcagcgatgaggagaaagtcgtcttcgccgcccaccagctgcaggggcccgcatctctatggtgggaccatttccaggctacgcagccagaggggcagcctattacttgggcccgcttcaccgccgccttccggaggacccatgtgcccgccggagtcatggcccttaagaaaagggaattccgagagttgaagcaaggcaaccgctccgtgatggagtatttgcatgagtttaacaacctggcccggtacgccccggaggatgtacgggaagatgaggaaaagcaggagaagttcttggcaggaatggaccctgagctgtccgtgcgtctagtctccggtgactatccggatttccaacgtctggtggacaagagcatccgcttggaagccaagcacaaggaactggagtcgcacaagcgccgcttggcgaatttccgcaatcaacagggagctaactaaaggatccgctacaccaatccctatccagggggatcgtcctcgcagcagcaacagcagcaacaacctcgctccgcgccccgacctcaattcgtggtgcgcatcccacagccgcaacaacagcagagtcagcaagggacccgtgcgccccgtcctcctacgacagccgcgcagtctggtcaaggccgcagggacgttcaaggtccgcagcgtctgtgcttcaattgcttcgagcctgggcactttgcggataaatgcccaaagccgaggcgccagcaaggccaagcgcctccccgctccaacaacggtggtaaggatgtcattcggggtcgtgtgaaccacgtgacggccgaggacgtgctgacaactccagacgtcatcgttggtacgttcctcattcattccatccctgctaccattttgttcgactctggagcttcccactcgtttatatctgtgccattcgtggggagaaatcagttgggggtagaaaggcttaggaaccctccgctcatcaccacccctggaggggttatgacagcaaagtattatagccctgctgttcctatagaaattcagggaattccttttccttcggatctgattcttctagacaccaagaacttggatgtgatccttgggatgaattggttggctcaattccaaggagtagtggattgcgcgagacgcactgtcactctgtaccgagggccggaacaaccggttgttttctttgcacccccaacctctgtcagtagtttagaacttcatcagataggactgtcagaaatccccatcgtcaaagagttcggagacgtgtttccggaagaactacccggtatgccgcccaagcgagagattgagttccggatagatcttgctccaggaaccactcctctgtacaagcgaccctaccgtatggcagcaaatgaactggccgaagttaagaaacagttggaagagttgaaagaaaaggggtatatacgtccgagtacttccccctggggtgctcctgtgatttttgtggagaagaaagacaagacgaagaggatgtgcgttgactacagagctctcaatgaagtcaccatcaaaaacaagtaccctcttccccggatcgatgatctgttcaatcagcttaaaggtgccacggtattctccaagattgatcttcgttccggatatcaccagttgcgcatccgtgaagaagatattccgaagaccgcattcaccacgcgatacggactgtatgaattcacggtgatgtcgttcggtttaaccaatgctcctgccttcttcatgaacttaatgaacaaagtgttcatggaatacttggataagtttgttgtagttttcattgatgacattatggtatactcacaatcagaggaagaccatcagcaccatctccgtctggtgttgggaaagttgcgggaacatcaattgtatgccaaacttagcaagtgcgagttctggttgtccgaagtcaaattcttagggcacgtgatatctgctaaaggagttgctgtggaccccgaaacagtgaccgccgtcaccgattggaagcaacccaagacagtcactcaaattcgcagtttcttaggtttggctggatactaccggaggttcatcgagaacttctccaaaatcgctcgacccatgacacagttgttgaagaaagaagagaaatttgtgtggagcccgcaatgcgagaaggcgttccaaactctcaaagaaaagctggtttcctcgccagtgttagtcttaaccggatactcgcaaggacttcatggtgtattgtgacgcttcgcgccaaggattggggtgcgtgctcatgcaggaaggtcatgtggtggcctatgcctcacgccagctacggccccatgaaggcaattaccctacccatgatttggagttagccgctgtggttcatgctctaaagatctggcggcactacctcattgggaatcgctgtgaaatatatactgatcataagagtttgaaatacatcttcacccagtcggatctgaatcttcggcagaggagatggttagaactcatcaaggattatgatgtgggaattcactatcatcctggtaaggccaacgtggtagccgacgctctaagtcgaaaaagccattgcaacactcttgtcgtccgtggcattccacccgaacttaatcaacagatggaagccctgaatctaagcatagttagtcgtggattcttggctacgctggaagccaagccttccttgctcgatcaaatccgcgaggctcagaagaacgatccggacatgcgtggactcctcaagaatatgaaacagggtaaagccgctggtttcacagaggatgaacacggaaccctatggaacggaaatcgggtatgcgttccagatgtcagagaacttaaacagctgatacttcaggaagctcacgagagtccttattccatccaccctggcagcacgaagatgtacttagacttgaaagagaaatactggtgggttagtatgaagcgggaaattgcagagttcgtggccctttgtgacgtgtgccagcgtgtcaaggcagagcaccaacgaccggccggacttctccaacctctccaagtaccagaatggaaatgggatgaaattgggatggatttcatcaccggacttccaaaaacccaaggtggatatgattctatatgggtagttgtggaccgattaaccaaggtagctcggtttattcctgtgaaaaccacctatggagggaacaaactagccgagctctacttcgctaggatcgtgagtctccatggcgttcctaagaaaattgtatctgataggggaagccaattcacctctcacttttggaagaagctccaagaagagctgggtacccgattaaatttcagcaccgcgtatcacccgcagacagatggacagaccgagcgtctaaatcagatcctagaagatatgcttcgcgcatgtgtcctagatttcgggaagacctgggataagagtctcacctatgccgagttctcctacaataacagctatcaagccagcatacaaatggcaccctatgaagcgttgtatggacgcaaatgccggacaccgctattgtgggaccaagttggggaaagccaagtgttcgggactgatatcctgagagaagctgaagctaaagtcagaaccattcgggataatctaaaggtggcccagtctcggcagaagagttatgcagacaaccgacgccgtgacctggaattcgcagtggatgactttgtgtatcttcgggtcacgccattgcgaggtgtacacaggtttcagacgaaagggaagctcgcacctcggttcgtgggtcctttccgcatcattgctcgacgcggagaagttgcttaccagttggagctgcccgcctccttgggcaacgtgcatgatgtgttccatgtgtcgcaactcaagaaatgtcttcgagtgccatccgagcaggccgactcagagtaaattgaagttcgccaagacttgacctacgtggagaggccagtgaaaatcctggacaccatggagcgcaggaccaggaaccgggtaatccgtttttgcaaggtccaatggagcaaccacgccgaggaagaagctacctgggagcgtgaagacgagctgaaggcagcccatccggatctcttcgccagttcttccgaatctcggggtcgagattccgtttaaggggggtaggtttgtcgcgtcccaaaacgactctaaaatacatcctcgaatttatgcctagaataattaaaatccatgtgaaagcctccacaattaaaatgtgcaaagttaaaagtcaaataaggcttggaggatttttgtatatttcctaatagcctaaaatgcgtaaataaattttagtggaattttcagagcacaaataataattattaagaaataaacaaagttaaaatgattttataaaaggaaaaaccctaaaaagttccctttccctccccctctccctcttcggccggtccggcccagctctctatccctccctctcctctccccgcggcccattcggcctcctccccgcgcgcgcgccgctgacgggcgggcccgcccgccaccctcgctgacgggtggggcccacccgtcatccccttcctcccgccgctcccgccgccccgcccgcgccctagcgccgccgccgccgccgcgaatcccgccgcccccgtccaccccgcgtgcaatcaagaggggggaaatattccccgttattccctccctctttccccctatttttccctccctctctccctcggattcgtttggaaatctctcccctaacctcgccggcgccatcaatggcggccggatcttccgcgcccgtttcctcctcgtccggccgctctctctcactcccgaccctatataaacactccccgtgcctccctccaccgtttccgccactcgccgccctctctccccgtcggaatcgagctcgcgccatcgctctctctctccgccgtcaccgccgagcaccggtccgccgccgtcgtcgccccggaccacctcccacctcagcgtc

SEQ ID NO: 68875 - DNA, 1858 bp, Oryza sativa
gcaaccctaaccctttatattctaattcccttgtactcccttgcatttattctgcacttgtgggtgtgtcttgttgagtacggtggttgtactcagtcttgctcaatttttcccaaacccagaagaggagcctctggaagatgaaggctttagtgtctagctcgtgcctaccgtcaagcgcctgtggtcgtcgccctagtcttccgctgtttcccgtttgtctttgtgtgtgctgggccttcgtcgcccatgtaataaattaactatttacgcttccgcttgatatactctgaaatgtatcaactcttggtgtaccttgcctcctgggacaaggaataatacacgcacgtaaggaacgcccgttgggttaattccggtcgtgacagtgcttgcctcctgtctgaacgcagagtgcacgatttccgaggcgcaactgggtggttacaagggaacatggtataacaattaacgaaggaaggatcaaatgcaacaaattaggtaggctgccattctgccttgcagacgggacaagcagattaagtgcgatcctatcaatgcataatatttttcaagcaacataattaagttcaaatataggctcgagatgttcaaaggtggcttgccttgctcgagatcttgagcttgatcctcgaaatcctcgcactgcgggtcttcgggctccgaaactatacgcaaaacaggacaactcaataaacggcgaaaataaagctctattaattacctctaagcgtgccattagatagatctcgagattaggaattttggaagttgaacggagtcaaacggacctacggttgggaagatattgaatttctaagattattggatttttggtctaaaggaaaaggatttatttaaatcctttttgaaaaagaaaagaaaagaaaagaaggagggggaaaaattagacttccctcgggcggctagggcgcggcccgagagaaaagggacggctctgccgagctaaatgggccggccggcccaacaaggcgacccagagcgcgcgcgcgggcggggaggagagagggagccggtggaccgggctcacctcgcgtggtcccgagtgggacccgcttgtcggtgacacggttcaccgtgcggaacgcgcacccggcgcgcgctagggtttgggggagggacgcggtgcacgcgcgcagttcgcgggggacacggatgcggcgggcccacgcgcagcctcaccgctcgcggtggaccgcgcccgcgagcggggccgaggggagcggctgaccggggtcggctcgacccggtcttggccgagctggggccgacgtggcgcctacgtggctgccacgcgggccggcgggaggtagacgacgacgccggccggaacggacggcggacaacagcggcgagcggcggagcgaaccacggcgatacaggagaaagcgagcacaccgggtggttgcacgggacgaggggagtcgagccaacggctcggattcgccggagggagctcgacggcggcggattgcggcggcggcaaccggcggagggaaaaggggaaaacggcgacgaggtcacggggggccgattcccggcggcgagagcatctacgcggctacgggaatccgtcccttgcgccggattaggaggaaacgcatcgagtgaggccggcgacgagaggcgcttccgagctcgggcggcgacggcggcgagcacacggcgagcggcggcaacggtcggggcggcgccggctagctacggggaggctactcgtgctactacccgagtctaaggggaggagatggaacgaggaggaagaacggagggaggcactaccgtgcgggcgggcgcagttacgagagccgacggcgcg

SEQ ID NO: 68876 - DNA, 2068 bp, Oryza sativa
  unsure (1)..(2068): unsure at all n locations
agagcggagaagagggagagagagatagccagagagagagagagagagccggggagggagggggagatgggccgaganagattcggcccatcgaacccgagggaggcaaaatagacttttgcggagggattgatttgggaaagatttggattcgggattgaactcgatgatagatcggggatttgagatctgagatggcacgaacactagacaacaagcaaagaaacagatttcgcaaatagggtttttaagagataatttttcccgctaggcgccacgacggaacgggcgctacagaccaacccccctaacaagaatctcgaccccgagattcagcacctaagggagcagctccgggaactcggcgcggagaagatcttcttgctcccaggttgcctcatcttcagaatggttgctccattggactttgtagaacttgatggtcttccttcgagtctgacgttctgcctcttcaaaaatcttgatcagtctttccttgtaggtcagattcttttccagctcgatattacccagggggacttgctcttctggaactcgaagacatttctttaactgggatacgtggaacacgttgtgcacatatgcgagaccttcaggtaactcaagctgataagccacttcgccacgtctggcggttatgaggtaggggccgatgtagcggggtgctaacttgccggacatcccaaacctccttataccacggagaggcgatacccgcaggtacacatgatctcctttttcgaactcaaggtcacgccttcgattgtccgcgtaattcttctgacggttctgcgctgtctttaaacgttctcggatcagtttaacttgttcttctgctgccttgagtacgtcaggaccgaataccagtgcttcgcccacctcattccagcacaagggagtgcggcactttcttccgaacattgcctcattcggcgacatctgaatgctggcctgataactgttgttgtatgagaactcagcatacggcaaacaacgatcccaagtgccttcgaaatccagggcacacgcacgtagcatgtcctctaggacttggtttaccctttctgtctgaccatcggtctgcggatggtaggctgtaataaatttagatcggttccgagggcttcatgcaactgcttccagaactttgaggtgaactgagtgcctcggtctgacacaattttcttgggacagccaaatctacacacgacatgggtcatgtagagttctgctagtttctttccatcaaaggtggttttcactagcacgaaatgagctgatttcgtgagtcggtccacgattacccagatggagttgtacccgctaggggttcttggcaaaccggtgatgaaatccattccgatctcttcccatttccactcgggaatcggtaggggttgcagcagaccagctggcctctgatgttctgccttgactctttggcaaatgtcacacaaggctacgcattctgcgacatctcgcttcattccagcccaccagaagtatgccttgatatcttggtacatcttcgtacttcctggatgaatggagtaggcggactcatgagcttcctttaggatgagatctcttaactccttcttggccggtacacagatgcgtggaccgcaccaaactgtgccttgatcgtctatggagaaattggtgtcattcttctcctgtattctttttattaattcttttatcccttcgtcatctttctgagcctcccggatttgcgattctagggtaggctgcactgtcaagctggcagggacacctgactgtaccacggtcagccttaacttctccaattctctgcacaggcgatcttggtaagaccgtatttgagctacattgcaataggccttgcgacttagcgcatcagtgaccacgttagctttactggggtggtaatgaattccaagatcgtaatccttgattagttccaaccattttctctgcctcatatttaactcggtctgagtgaagatgtacttgagacttttgtgattggtgtatacttcacatctgttcccgattaaatagt

SEQ ID NO: 68877 - DNA, 4609 bp, Oryza sativa
  unsure (1)..(4609): unsure at all n locations
agcttcaaccttgctgggatctacttcgacaccattgggggagatcacgtgtccaagaaatgctactcggtctaaccaaaattcgcatttcgagaatttagcgaatagttgatgatccctgagcttttccattatcagcctcaggtgttcagcatgttcttcctcattcttggagtatatcaggatgtcatcgatgaacaccacgacaaactggtccaggtattccatgaagattttgttcattatgttcatgaagaatgctggagcattggtgagtccgaaggacatcactgtgaactcatatagaccataacgcgttgagaaagcggtcttcgggatatcttcagatctgattttcaattggtggtaacctgatctcaagtcaattttagagaaaactcttgctcctttaagttgatcgaacaaatcgtcaatccgtggcaacgggtacttgttctttatagttacttcatttagggctctatagtcgattaccattctctcacagccatcctttttcttgaccaggagcactggggctccccaaggggatgagctaggtcgcacataacctttactctccaattcttcgatttgtcttttaacttctgctaactcattagctgccattcggtagggtctttttgcaattggtgcggtgcctggtgccagttctatggcgaactcaatctctcggtctggtggcatacttgttaattcttctggaaatacgtcgggatattcacagactatgggcaccgactccaaggaggtgacttgtaaacaggttaggatagaccgactcgcggtaggggtgttagaggtaaagcggacttgctttcctccaggtccttgcaaggtgatggacttttcggcacaatctatctgccctttgtgcttagccaaccaatccatccctaggatgatgtccaagctttgcgagtctaggactatcggtttggctaggaagtcaacttcctcaattctaaggttaacttccgggcatatttgagttgcccttatattcctcccaggggaatgtactatcattggtacacgtaaattttgggttttccaaccatttcttttcacaaaagcttgtgatatgaaagaatgggaagcttctgaatcaaacagaactattgcgggtacggagttgacagagaacatacccatcacaacgtctggagcatcctgagcggtctcagcttgaatgtggttcacccggcctcgaccaaagttgttggaagcacgagagccttgtccacttgcctgagagctaggacgagactgagctgccgctggagtaggagttctggcagtgctgccattagcatgccctgagttggtgttggtaggattctgagggcactgtcgggcatagtgacccatctggttgcaccggaaacactgaactgctgacggtcctagcggtgacttgaaagaggtaacactgtttggtgcagtattgccactaggggcacgctgctgtggctgaggtgccggacggttcatctgaggacgaggggcgtagcctggctggcggttagcctgagtgaccgactggtggtattgcatgggttgaccatagcgagggcgaggtgcgcctcgggaagaatttccctgatggttagacttgcgtttcttgtattcttcggtagcctcttttctggcatcctcaagtagaagtgccttgttgatcatatgttgaaaagtggggaagtcatgagcaagcaactggagtctcattcctactgcgattcccttcaagaacttcctgatcttcttcttgtctgtgtccacttcctcaggggcgtaccgagccaacttgttgaacatacttaggtactcattgacactgttgttgccttgcttaagtctgttgaattcctctttcttcatatcaatggtgctttcaggcacatgagctgcacggaaagccgtagcaaactcatcccaagcaatgttagtgggttcagggtgtgcattgcagtaattctcccaccaatctgcagcaggtccttttagctggtgagaggcgtagagcgtcttctcaacaggagtacactgcactaagttgagttttctatcaacatctttcagccaatcgtcagcctcgacgggctcgacggtctgagagaactctggcggacgagacctcagaaagtctgttagattggatctattgttgcccatgtgagggtggccatttccatgcgcattgtgctgataaccggctacggctgcggctaatccttgcaagatttgtgtctgaactgccattaagtgttgcatgttgttttccacatgaggtggggaagggaggcgttcttctccagaattgtgactggcagtgcggtgagagcggtgagactgttccatctctgcattacgggaagctgtgtgatgcgagcggttgctgcggcggggttgctcaacttctgcgttgcgggaagtagtacggtgcgaacggttgctgtggtgagactgctcattagctgactcatgatttgcttctggctcaactctaccttcctcaaaaccaaagcgggctggtgcacgagcagcacggcgggggcggctagccatctaaactcccagatgagggcgaggtaagaatcagataagcacttaggagggcaaggagcaaagtaaatagcaactcagatagcacacactaggcataaactggatttttcaaatcataaaaacacctaatacaacgggtgtggacaagtcacagagctacgccgagcttgactgtgcgcacaccacctaggagaaccggactaccaaacaacacccacatcaaacacacgcacgcactacctcgccacgactccaaaagagttggcggcggaacaaaagggcctaacacacggacggctgctgaagactgcctcctctactcctcgtctgcctggctgcctcctgtagtcggctcctcagtcgaagaaacgtcgatcggctgacgcgaagggaccggcggaacctgtcgagggccgacagcagcacgggccgctggcggtgtgggagctgggtagtcgaaacggaacacggtggaagaaccaacaacacgcttccgcgcagtgcggataaagcgtgggccacggtgggaggaagcaactggggtgtgtccaggggtgtaggaggggctaactgggtgagggtagggggagtacactggtgagtacggcgcacgcgagctgggggagcgcaggccactgggagtgcgagcagagccgcgggagctgtgggaggacaggtggctggcgtggtagaggcgacctgagtcccaagagacagtgtcaactgaggtgacaccctcctcggccagacgggcctccagagcggcgtagcggcgggcaagggagcggtaagcctcaaggagtaggtcgtgctgagtggcctgagcctccgaaagctcaaccatgcgagtcagcactggctgaaactcactgtaaggacaagggtacctggcgtttgcgtggccagaaggaaggcgtggaagctgccggaaggcagagcccccgagacggtggctgtagtcgtaggccaagcgacgaagcgcagtccaggagaggtcctggcacgcgatctggagagtgggcctggccacagtgaagtggtgtgggcgaaggccagctccgtgtatacctccacgagggtaaaggtacacagagagctcacagcgagggggaacacggtccacggagtaccccgtgtactcgggacacgagaagccaaggaagcgggcgaggtctcgaagctgagcgacatggtgaccctcaccaaaaccgtgggaactgaagctggcgttcactgccatctacaattttgaaagagggagaaaagatcagtaaccattttagaaacaaactattgaaaataaggaaaccaaaaaaagccttagcttttcgcaagtagttttgaacttagtacccttagggtcgtcctaaacgtcgggtttcgccctaggggcaagcctgtgctctgataccatctcttgtcacgcccctaactagtcccgaccggaactagcccgtgacgctccaaattaacctgttaatctataccagtcctaggaaacagtgctggtatcacaggaagacagaatatcacagcaacagaggtctctttattatagagtagaggtacagtcatgttgggctgcggacagatcccgagctcacaactgcatttcaaaagggaagcggaagccaagactcggaccaaacaacacaggcgcgacttgggaactaggccgaaaccctaaaactcatcgtagcgggatccgcttcatcttcttcagcaactgggggggattatttatatagagcaagggtgagtacgggagtactcagcaagccataggaaataagtgtttaatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 68878 - DNA, 6427 bp, Oryza sativa
attcctgcagcccttctaggccatgacatacaatttgctgtgtgtttgtgtgcgcgctttcaagcttctactcgtgcttcacatcgtcaagcggtcaagcgaataatgaggtatttgaatcatacacttgagtttgtaatttggtattctacttcatcttctatatgcttaagtggatattcagatgctgattttggaggttgtagaattgataggaaaagtactagtggaacatgtcattttcttggtacatcattgattgcatggtcttctaggaaacaatctagtgttgctcaatcaactgctgaatctgaatatgttgctgctgctagttgttgttcacagattctttggcttttatctactttgaaagattatggtcttacttttgaaaaagtacctctcttttgtgataatactagtgctatcaatattgctaagaatcctgttcaacactcacgcacaaagcacattgatattcgttttcactttttgagggatcatgttgagaaaggagatgttgagttgcagtttttggacaccaagttgcaaattgctgatattttcactaaacctttggattctaatctctttgcttttcttcgtggtgaattgggcataattcatccttttggcatggtttgagggggagtttgcacctcatggttttatcaagcaataatatgacaatgaaaaaaattgagaaaagagagctttgtttatgtatatggtattttcttgtgcatgctagcaatactttgaaggtttatttgtctctagcatagcttgtatgtattctagtcttttcatgagatttagattttgcttttaagggagatgatgcatgacacttaaattctatacttgaattaagaaaatatgcaatgttgatgctagcatatggtttgatttataaatgctctatatatatgctttattgacttgttattcctcaaatacctttaattgctcattgtgaaaaagagaataaaaaatataaaaaaatgaataccgaattcttgaaaatagtcttgacgacaaggacgtattcgatgtgagcaaaataatgggtgccgaatccctggaaacagtcttgacgatagggacgtacccggaataaaagagaaaaatatgagcaaaaaggctcaagataagaaaaagtacaaaaaattctcttggttattttgtgctaaaggttatttgagaaagagtgataaatgcaataggtctatgtgtttagtgtttattcttcaacctatgtgcttgttaagatgttgcattataaatcgtatgaaatcatgaattttgattcttgattcaagcttcattgtaaaatctttggttcatggttatactttaatgcatgcttgttttgttatagatgggtttattttctttttattgcaacgcatgacttgatatgctatatgtatgctcagctcttgaacattaatgaacataattcctatgcttgatgaaatcattgtcaaaagggggagaagtaatgtgaaaatttttggatttttggagaagcaaggtgaatttttgaagagttgttgaaaagagcatgttgttggttcaattgggaatttctttcttttaaaaagggggagaagttttcttttggattttgaccacgatgtgtacatttgttttcttttggatttttgagcatgatgtgtacatttgtacgaagtgtgctttttaccaccaaataccaaaagatttttatggatttgccaatgtgtccatcaaggggagattgtaaaatcaaaggtgtttttgattattattctgtgatgaacgattgggcattggagattattggttttgttatttgaaatttattcacgaagtggttttggagatgattggatttcacaggtgaatttacaggatactgctgtgattttatgtggacatgttataccgggctctggtagccggtcagaccggcgtgtaatgcgcggtcagaccggcgcagcccacggtctgaccggccgacactgtgtcaatttcggtttcgggttgtttatttggatatccgagtttattccatgattatgacttctagatggatactatacatatgtaataatattgtttgctgctaatgagtcaagttggagatagcttggtctcggaatatggtttctttgtttgttccatgtgtaggtgactcgatgtctcgggagagtatttgcggtgatggaccgggagtcggcttggggataagacgacgtccgtggtggtcagagatcatgcggaatacttaggctagagttgatgcacgtggtaaatggagattccatatggcatacgatggaggaattgtgtgcgtatgggatgcggagtcgaatttggaaggagtccaaatttggtacgtttgattatctaaagtttctttcttgtactagtgggcttcctaaggtgtttaggactcctagtatgagtttagttcgtggctttaggctgcctacctcatgtataaatagagggggagcgtgaggcttcccggtatcgctatagagagcaattgagttgagttttgagttagggtttcgagtttagttgaaatttttgtaaggagtgctgttggtgcactttgtaaacacagagagaagaaataaagtcgtcatccactttaagagttctttgatttgtgtttcaccaggtttcggcggtctaaccggcggcgcaccggcggtcagaccggcggcatcgcggcggtcagaccggtgggcacacggcggtcagaccggcggctacaggagttggcaacaggcgttttcggcggttcgactgatcgatctacatcggtcagaccgacgttcatcaggtggtcagaccggcacaactactacggtcagactgcgatccatcgatttcgagggtaacttttatttccgctaaaagtttttggtttttgggtataccaaccattcaccccccctctgattggcttagttcttgtgattcgatcctaaaagtggtaaggccctttacgatcctacaattggtatcagagccaggctaggttaacatctctggcccgatggacacgtgtgaaggcctgatggacagtgggtgcctgcggggcccgtatacctgatggaccgtgggtcggtgggggcccggatcatattaatggtcgctgttcaagttttctcttatcattataaagaaactcgatcctgatcaaatccatggaaagcatggatgtagatatttaataccaaatgatccatctaattttgggcctatctgggcgttgtattcgaccattaatattttcattgatattgcatctctcttaagacatcaatcagtgagagaataactaagtgcttattattgttcagacaaatccttgttattgaatctatgcatatcgttatctattaaactactaaatgatcttccctgttgtgatttccaaacctgtgtgcagtctactggtttcgatcattatttgccgtgattattctatttctctcttgggacgttggtttaaattaaggaactcaaccctgagccgttccgtggaaaagtttgcatatgcaaggtattaaattactaagtgatctttctaattttgaatcaatgtgcaacctactgttttcgattattacttgtcaatgatattgattttattcacaaacctgcctttgttttctatcattatttgtcattcagtcattgacattcagtttttattttaagacgtcaatgagagaggaacttaatcctgatctatcccatgagtagtttaggtgattgggactcaaaacattatgggagggtccacacccacatgcctagcctatttgaacgcaggacaacttttagatctacacgacacagaaagtcttgacatacagaggctcttctctagctttgatgtcttacactagaaatggttccatgccaactgcaattagcaaccactgtacatacttcttctgattgaaggaatgccataaactccatggagatcattggcatcaagtgctgtggtgttgtcctgactcccttgataagcctcgcaaaacagcatgctgcctatttcttcaaagcccagaagttcgtgcgtgctctcaaaactgccaccgagcgtttaagggagagggttagcgatgttgagaccaaggtggagggtgctgcacgaaaaggtatgcagccaaggcatgaagttgaacgatggctgaagcgtgctgagcatgtatgtgtggagactgagacaatccaagcaaagtatgataagaggaccaagtgcatggggagtctgtccccttgtatctgtgtaaactacatgatagccaagagtgcagcagcaaattgtcaggctgtagagaagatatacagtgagggcatatttgaagaatatggtgtcatggtgccacaggcctgcactgaagtgcccataactgacataagcctaactggtacagatcggtatcgcaacctcgctgtcaagttcatcaaggatgaggctgtaagcaaggttgggttgtggggccctggaggtgtgggaaagacacatctgctctatcagatcaataacttgtttcacaaaaaccctgcttttgatgttgttattcgagttactgcttccaaaggttgctctgttgcaaaggtatgttgtgctccctttaacgagggagtgatcaaagtttgtatttaactaattagatgaaactaatcgttgtcccttgatgtacatgtttctgtatcttgctaaagtatatttgttgcaaagatgaatgcatccagcttgcccaaaagacaaaaattacaaaccatctagggtaagcggcctaatgagcaattcacagagactaaaagctccagctaaaattatagtttgttttataggagctacgatttctaggatactatattgactgtcatcaggtactactatcatgtaatatactccctccggatggaaatatttgttgtttcggaccagcgaaatgacttacacataacatattttggctgtcggaaacagcatataaaactgatcggagggagtaataactagcgttacataagggttcctggcagccaactaacattttgatatttcaaaaaactgcatatacttctaattttaaatactttacaacattatttagttaagctctctgccagtttgctccaaatgacaaaagtacttttttacttgttgcccttgaaggttcaagactcaattgttggggaacagatgctgcagaagaagaatgacacagaatctcaggcagttatcatatatgaatttctcaaaagtaaaaattttcttatattattggatgatttgtgggaacatgttgatcttgataaggttgggattccaaacaaagttagctcaattggcaattacaaacaaaaattgttgctaacaacacgctctgaaagtgtttgtggccaaatgggtgtcaagaatgggcaaaggattaaagtagattgcctggatgaaacagatgcatggcatcttttcaaggaaaatgttggtactgaaattattaaaaatcacccccttgtacttccactggcaaaagaggttgcaaatgaacttgccggactgccgttagctcttattgtagttggcagggccatgtctaccaagaggcatccacgagaatggcagaattgcatcgactttcttcagcaatcacggcttaatgagattgaagggccagtttgcaacgaagaaagtgtgtttgctcgactgaaactcagttatgaatatctaagtgatactaatctgaaagattgtttcacatcatgcgccttatggcctgatgattatctgttagatagaaacaaactatctgagtactggatgggactgggtctagtagaggaggaggatattcaaagatgttacaaggcaggatatgcacgaattcgtgagttggtagacaagtgccttctggaggaaactgatgatgacagactagttaaaatgcatgatgtgatacgtgacatggcactatggattgtaagcaacgaaggaagggacaagaataagtgggttgtacaaacagtatctcactggcatgctgcagaacaaatattatcagtggggactgaaatagcagagctgcctgctatttctggggagcagaccaagcttaccgtgctgatacttcaggataatcatttaagtcaaagttcagtaactggcttgtgttcttttatctcccttcaataccttgatctttcacggaactggctcaaaacatttcctactgaagtttgcaaccttatgaacttgtactatctgaatttatcggataacaaaatcaagtacttacctgaagagctcggatccctttttaagctggagtacttgcttcttaggtcaaatcctatcagagaaatgcctgaaactattctttcaaagctctccagactgcag

SEQ ID NO: 68879 - DNA, 723 bp, Oryza sativa
aaacaggaagaaacaattcgatgtacataaaacgggaaagtattaaacaaggaagtaaatgcgatgaattacctatgggagcactgcaacacaagacaggagaggaatcacagtatagctaactaagggttgctaattttaaaacagctgtacgactccaaaaatgtgaacaggacaatgatatctgtacagaacagctatagtataggcaaaaacatatattattactatctaacagcagaaaatatctcgcggtacacgatgttccaagtgcgagtagtgcaattgccattgtcatcttcaattaacacctttaagcctgcgcgagaagtgactcgggaaagagcaacgtataactggccatgacaaaaaacagggtttttcaagtaaataccaactgaacgtaacctttgtccttgacttttatttatagtcatagcgtagcagacacggacagggaactgccgacgttctaatgtgaagggccattttttgctggtcgcagataaggttattcttgggatataaacagtttcccccgcattagaaccagttataatacgcgcttcgatcaccctatcacccaagtttgtaacaatatccttgtcccattgcaaagcccagcggtctgatctaaatttctcaaaagcattatgggaacacctatttttaggcacaattgatgttcaggataattgttaactttgatggggctgcaggaat

SEQ ID NO: 68880 - DNA, 710 bp, Oryza sativa
gaattctgcaatttgtaagtacagattagatcaaactcaatggtatattcgcgttgtaacttgtacaaataattcaaatgaggcgatgcattgataaatggagtgcaaacatagatgcaatagcttgtctgattgtagattatggttttggggaagctaaagcaaaggcagagataagcagatcaataaaaattcagctacttcagtttgttcagtactgagaagcagcttgcctcacactcacatgcatactactggtaagagattgttttggcatttggggcaaggcatgagcaatctggcagattgatagtacacaaaaacatgtgcaggaactttcaacaaacttctctatcaacctttattccattaaattaaatgcatgggacccatgacaaccctttccaaagatcaaattgcctgcatcatgtgtcatcactggcaattgcatctccatgtccatggagagcttgcaattgcgtagtagctgaggaaacatgtgattaaggcttatactgggtcttatttaatgctagatttatgagcacacagctgttcttgagtcttggccccttgttcagctattcattcagaagcagtcactgaagaatgttgttgagcttagactcactgatttataagcttcctgtttagcaagcagactcatcggtgttacattcagaaaataccggcacattccaacttggggg

SEQ ID NO: 68881 - DNA, 12035 bp, Oryza sativa
aaaaatctattaaactttttagaaacattctcaagccaccacatggcactccttaaaacgctctcaaattgccacgtggcaattaaaaaatctaaccattgattttcatttaaatcggtaggcccactattatcaaccatctgatcaatctttaaaacccattattttacaccattagattggatctattattggaaaataataatttcaacacaatttagttgtgtttttcaagtagttatgattaaattataatttgtttgagattaaaattctcaaagtatttttatatttttagaattatttgactatacatatttgtcaaaatataaataataaaatgatgctatggatatacatatttgtcaaaatataaataataaaatgatgctatggatattatcgtggtggtatgtctcatgagttataattttttaaaatatcatcgaacgattaccctcggtcattttcatccctgtacgtatgtcagtacataccgctgcctgcgtcccgtacgtacccaactctgtccaagcaatcacgcatagatttttatgctagctagatagccacacagttatggatgatctatatgcatacatatgcacaccaaaaatctataaaagatcttcgaattagaagagaaaaataagccactcataaacaaacaagcaattttttggtttttttaaagccataagccactctttatatactactattaaataaaaaaactaggttggaaaaaaaattggcttatgtaagacagatgtatgactccaccggcatataagctaaaaatctaacttaaaaatcgaaaccgataagcataagcctatatttagaggccctaagcaggttgatggtctgattgatgatagaaaatgtttagtaatctagctagggcacttggctctatttttcctttgctagacttaatttgaatggttgtagtctagctttacaattaaatcaatagtttaaacccatatatttattagggttaaatggatcatgtcactataaatgtggctagataaatgtcactactatttatgatattggctacgtgccactaaaatttgaagaaactgagactgtgcaattccatcatgttttccgtcagacccccagacgtgggacccatatatgagttccatcttcccctatcctccctcttctttcttccccatctcttcctccatccccgctactgctatgaggataacgacgatgatggcggtggcaacagcttccgagccctcccgcgcagatggggttgaggatggcggctcccttgcctcccgccgcggttggcgtcgaggatggtggcggcggctcccgagccctcccaccatggatggggtcgaagacaacagtggcaacggtagtggctctcgaggcctcccaccacggaggtggtcgatgatggcggctgcaacggtggttgtcaacgacggtggtggagagagaggaaggggaaagagaagagaggggagggaggtgaagttggaactgacagttaggtcccacgtgcagttgagggtaacagagattttttacggaaaacgtgatggagtggcactggtctaatttccccaaattccagtagcacatagccgatattgtaaatagtagtggtatttatctaaaatattatatttgtagttgcatggatccaactatatgttcttacatgtaaaataataagcactaacatttatctcaatagttcaaatatccacaacatttacatgctatccaaacaaccttagaaatttctaaaaatcttagtatatattatgaaatcaaatatactattttacaaatattcaaagctaaattattccacatatatgcaaacaaatcataaaaaccgaataaatcaatatataaatggcactcttcataaatatactctctcataacattaatttgtggttcataacacgaatagtcaaagatatctaaaatgtccatggtgttatatattaaaaaacagagggagcactatacaaaaaaagaaaaggtatttaaagtttagaaactccattgttgccatacaatatattctcataaattcaagactgtatggtttgaagtatttctactttacaatttatatgttacaagggtaattagaagaaaatcataaccactgtcaaaaaaatcctaaataaattattgacaaaaacaggtttagtatagaatcaaagaatatttcaagaaaaaaattacctgcgtgcaaatattcgtaaaaaaaattcaaacaacattatattaaaagcccgcgcacatgcgcgggctatcttcctagttaggtttaaaaatgaaattatcatatcagaaataatattatcacttaattttctttactgccgactggcaaccatctgataaatatgcgtttaatctatacaacttggttggtctggctacattattggagaaattcagtatctggtgcattgtagtcttataaggaaaatggtagttctgtttccttcacaagaagtcttttaccatctggaataaatagaaaacaatgccaatcctcgtctgcgtgaagaagacaccgtgaacaacgggaacgccgtcctcgtcctcagctgcagccaccgatatatcgacatcgccgttcccgctaactcgagccacctccagctagccaaactgcaacaccaccaagcttgcatccctcccaggagtagaaaaccccaagatgagtcccaagcgaggagaacgcccattgtacgtcttcctccgctcggccgtcaagcttagccgtggatttctccgcaaccggtgagcaatagatcgatcacttgcgcatgtttttctaaccttcttcctagccgatggccctaactcgccaacgccgtccgtgcgaaaccaccgccgccgtacgttgagccgttcccggagtagacttcactgtccaagcttcgtcaatccccggttaaccatcggtgagtctcattgtgcacatcagcaacccatgcattgatgcatgcactgatttggctcgattaatttgagccggagatcgattaatccacggtatgtaccgacgtaccgtacgccgtcggctagggcaaaacacggccactagggctgaggtgaaaattttataaacaatattactattggatgaagaaatgatcaaaataaaagttacagatattttgttgttgatgactttttcacttgaaatcatttagtatttgaaaatgttgtttgaagttgtcataatttgaaattcaaattgaaattattgaaacagagtcatatagcaaaatgaccaaaacaaaagttgtagatcttgatattcataattttgaagtatttaatattatatttgtaaatcgcgacgaaattgatataacgtcacagtttttgggccggtttacgatgaaatcgataaactgtcacggtattatgggccttgtatcaatagttgcatatccatgacgatttctgaaaatatcacggaaattttgtgacagattaaatatattcttgtagtataagccgccacgtggcattcctataaacactcctaagtcgccacataggcactatataatctcaccgttgattttcattaaaatttgttgatctattattttacaccattagattgcatctattattgaaagtaataacttcattctgtttagatacaaacgctactatggtactaccgttctccagtacttacgacgtacgagtagtacatgcgattttaacgggaaaaaaccatacgtacgaacatagatagaaaagacaaccaataaacatagatatataaaaatggacggttttttctacaatataaatatgaaatatattacttcagaaatataatataaatatatatagttaaactaatatctataataaaatataaaatacccaataaatattctttaaaccatcttctaaattattttgaaattatatatatccaatttgcgatcatgttgtatttctttaattaaattataaaagttatattatggtcctaaatacaccacggcacatgaggccaacatatgtatgataacttttcaaaaaaatcacaacatattttagggagggcaatatcacttcacaatttaaatcaacatatgtaaaaattctattatatactaaaagtccattaaacctcctatggatgctcttaagtcgctacgtggcactcacttctaagccaccacatgggcactatataatctcaccgttgattttcacttaaattggtggactcattattttacactattagattggatctattattagaaaataataacttcaacacttgtgtttttcaagtagttctgattaaattataatttgtttgagattaagattctcaaaatgtttttatatttttagaactatttcactatacatatttgccaaaatataaataataaaatgatgatatggatattatcgtggtggtatgtctcatgagctataattttttaaaatatcatcgaacgattaccctcggtcattttcaaaagagagtattctatctatatcataaaaaatttagtagtaatgatcaacaccataaacaaattgtatctacactactgcaccacaaatctactcaaaacactttaaaaaactactttggtcacctccatctctttgttcttccctgaaggacaccaaacttgaacaacaaagtttattatggtgtcgtaagtatagcatggaatatatggctaagttaggacagtcccagtggaggccaccatcgctaatagtgctcaactttctacttaccaatgcaatactccatgaacatgtttgcactcccgtcgtcgccttcggtcgccgccgcctccattagattcgcagctgcaaggagaacaccgtccaccatctcgtcttcgccaaagatcgctggaacgccgctgtcatcgttgaccagtatctcgccgcccttcggagcttgtcgtcggccatctccttcgctgttcatcgctgcgtaagtgttggtaaggatcgtcgcgtcctcctcttcctctccgtgctctcggttttcaccgttgtaccgccatttgccgtcctcaccgccgaatagagccgccggcgttgatcccgcgtggttaccatgtcattgccttgtcagctgccgtcgctgccacctaagtgccacgccgtctctcagatcccacgtggcagccatctaaaaccttagatcagatcaatccgagccatccaattttggtcaactaggtcaaagttgatctcagctgtccaaaatcaatataaatcatgttattccttttcaatggcatattagttgtttttactatatgtcgtctactaagttcattccaataatttccggaggatgctttagtcttatatttcagttataaattatttgtaaattgtttaattaatttggaatagtcttttctttaataggtttaattggaattaatcttgtaaaattcataactaattcatatgaagtcagaatgaggccgttcaagtctcataattcatttaaaattatgatctacatgtttgtttacttttatgtactgtttatttggtttttattagtcttttttctcgttttgcgtgttagcttgtttccgtcgttgcgaaggttcgtgagtgcgtcggaagttgttcagaagactaattgaagaccgattattgcaaggcaagtcatacagatcccaaacacaattcctttgagcatgttgatcctatatttaaattctctatttatttcaactgtacatttattctcgaatgtcaccgggtggtgtgaatctattcctttgttatggccaatttgcattgattacccttttccttgataccttgggttattataatttgactagttgagctttatatattggttccgctagatgttagacataattacttagccatgcttagaaatattagcacatgattgggataactaatgttacactatcacttattgttatatttaatggtagctcacgatggtcaatcgtgattgattaattaattacttgccaactaaaacttgataatggtgggttgtgagcacatggttttgaaggccgtgctcatgacaattaaggaccggttcgcgagctactgatgtgagacattaaccgtaccaaccacaagccagcgtgggcaacggctttacctttttatatagcatggttcattgcggggcaccagactgagaagcggcgagaagtccgtgggggtcgctagggagtccatgcctctggttgtagagggagtgattatgatccaggaatgatgcgctgtggtgggttgtgttgtgcgaagggtactgtcacagtcccgttccgaggtaccgtggtggtactgagagcatggtgacatgttttggggctgtgtcttgtgggtacagtggtacacctctggccagagtaaaactattcgaatagccgtgcccgcggtcatgggcgggttgagcaatgtttttcatgattagagtcacacctctcacaataattattgatgctataactggtaatagtttgcttagctcctggtttggagttagatctgtacagccgggtatggttgttcaggagggttgggcctgaccagcatgggtgtgctgttcagtgttgattaaaattgatgattaattactccactgttttattactcttaaatgtttgctaaatgctgcttttgcaaatgagcctatattatgccatcatttgatatccttgtgcacttgcatatttgctgtgtggcttgcggagtatgtcatatgctcaccttgcaataatcaattaaacctcagttgaagaaaaaggatccagagggaaaagacgtttagcttataccccagttgagctgcctgtgggagtggagccggagcttcgctagattttattttccgctgcagttttctttgttgtgtggactaagtgcctcttcagtaagtgttaatctctttagttattttgatgaatatgtatattaaattgtcagtttgtgtacctcagctaattcctggacgaggattttatgcacaaataagttcggaaaatatcagtgaatttctgggcgtgacaaatcaacacaaagatcaccttagcacaaagagtcacgccgcctcctcctcagcatcacaagcatgctagcgcatgcatcgcatcacagcttttccattgcatgcgcttgccgatgaggagggcagtgcctaggaggggcttgtacctctcgactccccttattcccaagttacggtgccgagatgggacttagagtgacggctgtgggccaagtgtgcacggggcggcgaatgatgttagaggtggaacaatggcggtggttggtggtggcaacatcacagcgatggatccacccatcgcagagcaaactcgatctctcgacaatgaaccaagttcggatccacaccacctcctcttggttggcttgggcttcggaggcaattcgcctccacggacctcagtgagtgggcttaagcactggtgcggtctagatcgacggagccactctgatcgagaccaccggctccacctcctcctctggccatcgaatgtgcctctcctggacctccttctgctccctccttagccttctgttcgaggcgccgccccatcaaattgatagccggcagtgccgaattgaggagaggccagtaggcatcaagctcatcgttgtcgctgccgaggagctcattcctgcacggagctggtggatctgcgtcgacctcttcgctgagggagtcgggtggatggcatgcagcggtgagcatctaaagcccaagcatgctcggaagaggggaagaaatgaagaggaaggcaagtaggttatggtgtcccaccaccctctatcggtgggttcctcctctaggtgttcatcgtatagaggagaaggagatatttgtcggtggagcacgggcggcggatagctggtcgattccgagttgttggtggagagcgaggcattgagggtgaggaaaaaaagcatcaccgacaataggccccgccagatttttacggagtatttgtttttctgacagatgccatgtgtgtgccacgtaagctgaaaactacacatgattaaattaggggtaatttgtctagatttaagaactcgggtgtaaaatgcctagtatttgaattcaaaggggataattcgaactagcgccatattttagggggtattcgaactttttgtttaaataattgtactccatgctagaaatattccttgggtagcaggcatggctggtgcaattattttgtgacaatttcgtaagcattgaaataactatctgcaactaataattaagggtagtttggttatttttacctaaagctaatttgtctcctgcctttactactccacgttagaacgattagtataggagagagggacttggtcatgtcaagtaacatcaatcccaataaaaactattgtacctctagtgaccgtaggaggatgtcctttgctcatctgctttggcagcatcccataggaatggggtgaagttcttgggatttggcccatggagcatatggaactcggtagcatcgttgttgcctgcacaatacaatatgtgtgagcaaattaattaacaaagtaaacaaggtcagatggaaatatggtactccctccgtccctaaacgtttgacgcctttgacttttttaaatatatttgactgttcgtcttattaaaaacttttacgaaatatttaaactatatatatacataaaaatatatttaacaataaaccaaatgataggaaaataattaataattatttaattttttaataagacgaacggtcaaacatatttaaaaaagttaacggcgttaaacatttatggacggaggaagtatatggatgcgagtctatctacctgtacatacgtactcgatccatccacatcccaatttaatcatctcctaagaatattcttttagatcttttcaaattgatcatcatctaaccggtatctactcgtttattcgttgaaaattaaatgacaacattgcatgtctattatagttacatctctattcgtttatctatgtagccctccatatcaaaatattggtttttatagcgtttaaattgtgggcctgtttagttggtgaaataaaaattttttggtgtcacattggacgtttgatcagatgtcggaaggggtttttgacacgaatgaaaaaactaattttataactcgcatggaaaccgcgagacaaatcttttgagcctaattaatccgtcattagcacatgtgggttactatgtagcacctatggctaataatggcctaattaggctcaaaagattcgtcttgcgatttacatgcaaattgtcaattagtttttctttttatctatatttaatgctccatatatgttatatgttcaaagattcgatgtgatatttttggaaaagtttttttttaactaaacaggccctgtatccgaaatatactagtactgtattcttactaatcacctctgatttaattttcacactacctaccttcactcacccttgctccaaccaccctgaattaagccctccagtacacaattttattgcgtgactttataggttagtcatggcatttaatagcgatatatgggattaattagatgtagttggatgaaatgagatcaatctagcccctaatgttactatcaaccaaggttgtcagtatcccgatccgtattatattattttacgatactataatcgtaccaagctgaaatgatattgatcctacctagtatcctaatttttatggtattctaatcttagtattcatttacacacgatcatatgaaatcttagtttgtatcctgattctacgatccctacgatcctataaaatattatttaaaataaggtggattgaaaataatatgaaaaaatatgcttaagtttacataaaaaccaattaaatttattgaaatcaatttattagaactactgttaggagcgcagcgccaaacatgcatcagcccaggcccaccccaccccacgtttcgtcatcccacttctaccgttgtcggagtaaacgatttactcctatcgcgcgcctcaaccacccacctttattcgagtaaacgatttactttgataataaaaaaaactcccctgcttccgatcccaccccacgtcccgcatcgtgctcccaccattatcggagtaaatgatttactttgataaaaaacaacttctctgcttccggtatatattctatttatcccgtacccaaccaaccactctcgccccactatgtttttttcctttttttgggatctgaatcgatcccagcccagcccacagatcggcgacacaccatgcaggaggacgacgacaccgtggcaattgatggtggtggccagcgagcggtggctggcagcggttgaggcgaaggcactacttcggacctcactgccaaacgctaggcatcaccttaaccagcaaggaggtgttcacctgggccaatagcagcaaccagcggctgctccacatcggcgatattgatataacaaacaagtaaggaaataacactctgatttgcatctgcatactctccttcaacttcacgcatgaagctctaatttttttttcaaatcaaattaacgtgcaatctccagtattacctgatctcaattgatgggctgcacaggtcctacatttgcacatcgtgctccatgtggctggccgcagaggatagggtggagtccaccggtgatggaggttgttcgctttttttcatttgcttgtcattcgtattgacgtgaaagagaatgtttttgcattttttttcgtgcttgctagatgatggatggctgctactgagctacgtcgagctcatctctataccacactactatatccttccatgattccatcgtcgactactgctcgcatccttccatgattccatcatcgactactgctcgccacccggttgccctctccactaccagtcacaaggcacagaccgtgctcttcatcctcatagcaagatccagcaaagccatcggatggattttttggctgaatcattttttggcgtaattttatcgcttgtgtgtgattgagcctgtaattttttcattcatacgactattttgtgatacagatcaacaatactcttagtatcagtttttactcttatattgtgtattgaacatatcagtaaacatattactacacggtggctatgaaatcatggctatatcgagaggaaggtgataattgttttactcgtagaccatgaaatttcagtttttactcttatactgtgtattgaacacatcagtaaacatattacaacacggtggctacaagatcatgtaaacatattacaacacggtggttacaagatcatgggctatatcaagaggaagatagtaattgttttactcatggaccacaaaatctaaacaatatttatattggtaaaagaattaccagcgttgtaagctggtaataattcttttacgaccatctaggtatggcagcatacgatgtggaggcattcatgtgagtaaatttgttacttttgaatgagcagatgtgggaggctgggagtaaattcgttacttttgaaacgtgcggagatactagaaaaaggaaaacttggaaagaaaaactaaacggacgtgataacagaaaaactacagagaaggaaagaaaaacagaaaaaactacagagaaggaaagaaaaacaaaaaaatctggttaatatttttacaagaaggaaagaaaaacagaaaacagaaaaaactacagagaaggaaagaaaaacagaaaaatcacggatgagatgaaaagagaaaaaagaaacacggaaggtggagtggtaaaaaacaaaaaaatgaactgagaaaaggtgggatgcggaggaaaggtgagggagtaaaaaaggggaaaactgaaaggagagggcgttatgcggcgcttgaactaatattccgcgttgtagagcatagaatagcgctaccg

SEQ ID NO: 68882 - DNA, 43787 bp, Oryza sativa
acggtacaacaacttagtaggtgggtgggatacagtgcaagaacttaagaattgaacgtccgaatacgataacttgagaatgaaacgttaaataaaacttttattaggatattggtcatatatactccagagattaaacttctgtattttttgactgatggtagatcggggagtagaaatttaagaattaacctttttaggaaggagggagtatacactacaatataaaaatgtaccttgcacctcttacaggcagggagatgaagcaaaactagcaatggaagagcaagagagctccgcgtggtggccttccgccttcttgtaaaagctctcccctgtatacgtgctgcgttgcagagctatatatttataaataaaacggtgcatgcatgtggtccaacccacatgtattaattaattattaaacaatgcatctggtccaacccattcataaaagagagaatcccttatatgccactgaaaatttgtctgatcccttggatgccactgaaaattggctcttcccttatatgccattgattcaaattttcgctccctctcatgccactgccgtccgttgactggtagttgactgttaactgtagagtgaaatgacgtatttgcccttcttgagttgataggcatgcagtaggtgttagtatatcagttatatactaccttttagctaggcatcacatatatttggaataaatgaatatatgaatgtatagcattaatctatatattgaatatatgaatatttttcagtcacataattttgaggcacatatttctctgtttttcatagtagaacaaagcaatctgttatggcattaatgtattttccacatacattgaccatgtgcttctcgaacaaaagcttcaacaatatttactagggagcacaacatttctctgtttttcacagtatgacaaaacattcaagcaatataatagattgcttctgacagacatttaagataatgtgtaattgcacattgtttgtaatgcacggctaaatagctaaaataaccaacagattgtttgctagagcatggagatatacacagtagcacagaatatgcaacaaatattatagggagctgtttaaatgaccacatagtaccaaaatgcatactaacacagtaccaaaatacatgttcaggcttactgacatggtgcatcagagggatgttgggcttggcccacttggacgattgggccatattctcatgtttgggccaaagggtatttttgtcatttctgtaaaaaaatgacaagtgattacatcctatcaacagtcaactaccagtcaacggacggcaatggcatgagagggagcgaaaatttgaaccaatgtcatataagggaagtgccaattttcaatggcatccaagggatcaaacaaattttcagtggcatataagagattctctctttataaaaagtcatgcgcatctctattaataatgactctaatacctctcatccacatatacaagaaaaataaattgtaagatgggacttctgtatacctaactttaatttggacatatatccaacaattatatgatatttttttaaaaaaaattacgcacaacgaattttcttagacgtaatgcatagcaatttaagtacaataaaaaaatttatgtataccgtagccattaaataatggaaagtacctgcacaatcctatttattcttttcttctgtcctatttattcttttcttgtgtaattttctaatctatgcagattaggagcaaaagggacatttcctaattcaaatgttgattaggattatccatgaggcatattaagttggtccaaagatgattttaagttaaaatgaatacttaagaggacttatgtggacttatgtgcataaaattaaatctcagggtttaaattgtgcctttagtgaactttgagagactagattacctattcacccataaatcatcgataattcttacatagaaaaaaataagcaaattatcaagacaaacatcggcagactcggcataaaaataattaaacgacacacgaaaacgtacacgtcgtcagagctcttttttgttttcttactattattattattactagaaaaaatacccgtgtgttgcaacgggtaaaaatatttttggatcgttatatattttactctttggttttagaccaaaagctcatttcgttccttccttgtcaagtggagctgtgtaggtccggctcgcatatccgactgtagtcttcaacctccgaaagacaatgtcgtgtctgtacatgccaaaatcgatcctcccatcaaatttggtcgaatctttctcgatctttcaaaattggtcgagggtttttgatacactcgatcttctctttccgtttttattaaaatcagagcgacaaacatcgggataaaaacagtgatttttaaataaagattaaattcagtgaattaaagcagcgttaaaaggaaaatcataggaaaatgataagggagtagcggggaattgatttttggcaatcgattggaagagggaacgcatgggaaggcagatcgaccggcgacgctagtgttcagccgggcgtagaaaatatggcacataaaaaaacaaatgcttaccacgtgcgagaaaatacaactaaaaaaacagcaacaaacatatgaaaaaacccggtaaaaaggcatagaaaaaaattaagaaaaaacagcagagggaaaaaatgaaaaaaggcgaagagaaaaaagcagatggaaaaaaaggcgaaaaatacagacggaaaaactgggaaaaaagaaaaaagaaaaagagtgaaaaggacggaaagaaggaaaaaaacagacggataaaaaaagaaaaagaatcggagagaaagaaggaaaagaaacagactgagaaaaaaaaaaggaaaacggacagaaaaaaaaagaaaaaagggcgaaaaataaaaaaagacggacgaaatttttttttagggaaaccttgcttatttttaattaggtactagaaaatatgcccgtgcgttgcaacgggttgagccaatttaatttgtatatatgtgtcggtggataaataatcacttattcatgtgcttatatgaataacttattaccaaataaaagactaaccatgtacaaatctttaatataatgttcttagcgactgataagcatgttgtaaaataaagtacgataaaaaaacaaagagtagaattcaaaattaagttttaaaatttaaaatttgacttataggaataagcataagccaaaacaacgaggccttcaagcatgagctcgatttgttgtctatccttatcttaagtcatgcaggaattgacgacggacggaaccagcaacttccattatcctttatttcagttggcatgttcttttttttaaaaaaaactgattcttatggattattgtaatggtaatattgagtatgcacactgcacccaagtctaaaattaagtatttaatttatacgcactgctatccagctatacgatgcctgcagccagatgtattatagttagctgtctagtttagaattaaccaacgtgtgagttcaatcatcgtttgtcatttatattaattttttcttgtagactcagtcagtaagaaaggaattcctgcataaattgcactgaatgcatgcatcatcatccatcagatgttaaactaataacatctgaaagcacgttaattagtcatcaataccatgaactatcaacaaaacaataggcttcacatatgtcgaaaagtttgaagctatgtgcggcctatcgcttttgataactattcagttttcttcttagttaacaccagaaaggaactcatcaattcagattgattccatagaatacatctgttaggtgttaaatgatcgaatgaaccatctaattttggacctatgtgaatcttctattcatgtaataatatttgccatcgctattgcattaatttttctcttaagatgtcagttagataggaacccaatccttattattgaacacaggacaactttttggtcttcttggttcttgcactcttaataaacacagacaaaattctcctggttgaaggaataccacaaactccatggagatcatcggcatcaagtgctctggtgctatcctgatctccttgatacgcctctcgaaacagtacgccgcctacttcttcaaagcccgcaagcgtgtgcgcgctctcgaagctgccaccgagcgtttaagagagaggctcagcgatgttgagactaggggtgtaaacggtatggaaatttcccgaccgtaccgataccgtttccgcaaaactaatataataataatatttttaccgatgttaccgttttcaaattttagtttttttaatttctgtcagcgtagcattgaagttgacactaaatagatgaattcataaatatagaaatttcctgaccgtttgcgctcgttttcgaaaaaagtaataaaataatgtactgtttccgaccattcccgaccgttttcatccctagttgagaccaagttggacagccctatgcgaaaaggtatgcagcggaggaatgaagttgaaggatggctgaagcgcgctgagcatgtatgtgtggagactgaaaaaatccaggcaaagtatggtaagaggaccaagtgcatggggagcctgtccccttgtatctgtgtaaactactacatgatagccaagagtgcagcagcaaactgtcaggctgcagagaagatatacagtgagggcatgtttgaagaatatggtgtcatggtgccacaggcttcctctgaagtgcccataactgacgtaagcctaactggtacagatcggtatcgcagcctcgctgtcaagttcatcagggatgaggctgtaagcaaggttgggttatggggccctggaggtgtgggaaagacacatctgctccatcagatcaacaacttgtttcacaaaaaccctgcttttgatgttgttattcgagttactgcttccaaaggttgctctgttgcaaaggtatgttgtgctccctttaacgagggagtgatcaaagtttgtctttaactaattagatgaagctaactgttgacccttgatgtacatgtttctgtatcttgctaaagtatatttgttgcaaagatgaatgcatccagcttgcccaaaagacaaaaattacaaaccatctagggtaagcgacctaatgagcaattcatggagcctcaaagctccagctaaaattatagtttgttttataggagcaacgatttctaggatactaacagtcttcatattgactgccatcaggtactactatcatgtaatactccctccggacggaaatatttgttgtttcagaccaacgaaatgacttacacataacatattttggctgtcggaaacagcatataaaactgaccggagggagtaataactagcgttaaataagggctcctggcagccagctaacattttgatatttcaaaaaactgcatatacttctaattttaaatactttacaacattatttaattaagctctctgtcaatttgctccaaatgacaaaagtacttttttacttgaaggttcaagacgcaattgttggggaacagatgctggtgaagaaggatgacacagaatctcaggcagttatcatatatgaatttctcaaaagtaaaaattttcttatattattggatgatttgtgggaacatgttgatcttgataaggttgggattccaaacgaagttatctcaattggcaattacaaacaaaaattgttgctaacaacacgctctgaaagtgtttgtggccaaatgggtgtcaagaatgggcaaaggattaaaatagattgcctggatgaaacagatgcatggcatcttttcaaggaaaatgttggtactgaaattattgaaaatcacccccttgtacttaaactggcaaaagatgttgcaaatgaactcgctggactgccgttagctcttattgtagttggcagggccatgtctaccaagaggcatccaagagaatggcagaattgcatcgactttcttcagcaatcacgccttaatgagattgaagggccagtttgcaatgaagaaagtgtgtttgctcgactgaaactcagttatgaatatctaagtgatactaatttgaaagattgtttcacatcatgcgccttatggcctgatgattatctgttagatagaaacaaactatctgagtactggatgggactgggtctagtagaggaggaggatattcatagatgttacaacgcaggatatgcacgaattcgtgagttggtagacaagtgccttttggaggaaactgatgatgacaggcttgtaaaaatgcacgatgtgatacgtgacatggcactttggattgttggtgacgaaggaagagagaagaataaatgggttgtacaaacagtatcacattggtgtaatgcggagcggatattatcagtgggcactgaaatggcacaactgcctgccatttctgaggaccagaccaagcttactgtgctgatactccagaataatgatttacatggaagttcagtgagtagcttatgtttttttatatctcttcaaatctagacctctcaaggaactggctcaaaaccattcccagtgaagtgtgcaaacttgtgaacttatattacctgaatttatcagataataaaatcaaagacttgcctcaagagcttggactcctttttaagttgcagtacttgcttctcaggtcaaatcctatcagagagattcccgaagttattctgtcaaagctctccagactgcaggttgcagatttttgctcgttgcagttggaacaacctgcttcttttgaaccaccatttggtgctcttgaatgcatgacagacttgaaagctcttggaattactgtaggcaagataaaatacttgaatatgctctgcaaaaccagcttacctgtcagatccctctgtgtaatcattaaatcaaagtctctagacgaatggaaaaggtttgcattttcagacagtttgttcggaaatgatctgatacagaggaatctgttggagttatacatctacacacatgaggaacaaattgtatttgaaagcaacaggccacatcgaagttctaatcttgagaagctctacatatgtggccattacttcacagatgtattatgggaaggagttgaaagccaggatctctttcagaacctgagacgattggaccttatatcatgcattagcttgacaaacatatcgtgggttcaacattttccttatctggaagacctgatagtatataattgcgaaaaactacagcaaataattggaagcacttctaacaatgataatctgccaaatacagatgaaaaagaaagaatatctctttcgcagccttgcctaaaaaggtttactttaatttatttaaagagtttgactactatctgcgactcatcctttcactttccttcattggagtgcttgcaaatcttgggttgtccccagctgacaacactgcctttcacaaccgtcccatgtaatatgaaggttattcattgtgaggaagaattgttggagcacttgcagtgggacaatgctaatatcaagcactccttccagcctttcttcaaagtgatttccatgaacaacaattctgcaccacagaacttccttgatggcttatacgctgagtggatctaccatcggtttgaggtgcgttgacataccagttgcgattctattcataatggctttcaaagtgatttcatgttctttctttatgcatcagtgacacactaaagaaattccactgagcacatgaactatatatattttgcaaacgtaaataaatatgctttctaaattgtaattgtatttgttcacttgattctaaaacgtccttttaactcaggatagagaaatcacttgttctggaatgaaagcataggattgactaaataacatgatttcttcaatgacaggatgacgaactggaagaaattaaagctcgatggaacaaagatcgagggcttgatagttgatataggccataacacaatatattgataatgtcgactcgcttaccatcttgaatttcggtctccatgttttaagctttcactgtactattccaatatgtgttgtatctgcccgaataccgtagcgtcaaaactatgtggttcgatttactggtgtgcttggtctgtacgaatacaaacggcattttccttttattagtgcttgattatgtagtatacagagtcgagggctttagtaaactcatccgaatatcgttcatatatttttgtaaagaattcgcttggtgggtgctattgacatgctctgtttctacagatggtaacataactcagaagctgttgttaatcacattctcttaggcacacttttcctgattatgcaaattgtgcatttgaaaacattcttgaaaactcatgtatgtaaaaacatattggaacatgcatgtggtttcataaactttgttgcaaaatcatgagaatattccaaaagaaaaatgtgagataaccaaacttaaattccaaaagtttcttttgaacttgtggcaaaaattcaatgtgtacatcttctgttctatatacattagttttgagtttattgttgttgtattagttcaaataatcaaaatacatgttaacaagcaccaaggtgcaggctttcatcggcaacataaaatgtcaacaggaggtccaaggtgaaactttggtagaaagaagtccaaaacaaaatttactttttttaaaaaaaagaattgtgcaggtgtgtaattaagtatgccatttctatctggcatgacgaagagtgctgtgacagcttggttcatgctaacattgcctatgtttaggttaccattttgttagccagactttgttgtttagaaaagagatatgccacgtaaagttaataatcatgaaccaaacaagcctagggagttcttaaacttaaaatgaccatatttttcttcaggctcaatgtagtaacatatgatcccttctttgttcttgctaaagctctcccatcatctattcaaacccagaatattaaaaaaaatcgttggcaattacgtgttacacatgtaaccattgcggttgtcttcaacgaagtgactgtagcctatttgaaaacttattttacaaataaacccagaaattttattccgagaataaacccttttcacggtactaacatcattggcacaccgtggtttaacatgatagcaccaatgccattggcattgtcatatgtaaatgggcatgtagcctaatggttgcagtgacctaagtagcatctcaaggtcctgagttcaaatctaaataggagtgaatttcagattggattatttgagcgctaagttccttatttgataggctaagtttataatttctaaaaaaaaagggtgcatatatccgattgaatatagatgccggtgtcggtgatacgggtccgggggtatcaagactagagagaggagactgcccccagcaccacgtggccttacccacgaggggggttaggcccgagactaggtggcggccgccctctcgtgtgaccaaggggtcgggctcccccgaacccctccaccgggaaccatgtgcaacgggttaggtggttgccttcgagcgcccacctacccgcatttatggtgacctgagcaggcatgaccggttgattgactgatgggaccgaggcgtcaggcgcactaccacgcgtgccaggcggcgtgcgcctggccccgtcccatcgatcatgatgagagattttagcctcccgtcacaatcgagggtggcacgtctgccttaatataattaaggcggatatcgccgcctcccggtgcaagtggggggtctctgaccggtgggtccttcactgtttcacgtttgtggcctccaagcgcaacgacgacgagcagtgtgaacatggacccagaagtctttgccccttgacggccgctgacagggatgtcccccgtgtcaggcggcatgatttgacgggccccatcacggggcaatattcgtgttgttctccaagacacgcatttaatgcagagattgtaatacttctccactaagttatggtaaggttaatcatgaatgaaacaagcctagggagtgcttaacatgacctcctctgttcttgctaaagcagttgggatatgcaaataataagcccaaaatatttccatgagaacaacttattctgccattaagacttggaaaaattttacaaccttgtacaaccaccaggacgtccaaaatggaatacaccatctaaatatggactaacttaattggtagcagttcttattagttgacaagcaatggatgccgacaggccatggtgcaggatcatagccctgaacattagcatcaacaaacttgagatctctgaatgatgctgaattttctccaggccattgcccattgcccattgcaggactaggattcctaatactccctccatccctaaatgtttgacgccgttgacttttttaaacatatttgaccgtttgtcttattcaaaaaatttaagtaattattaattctttttctatcatttgattcattgttaaatatatttttatgtatgcatatagttttacatatttgttaacaaccaaatttggtaatatcggcatcgggaaagaagattagatcgaagcgaagtcggaggcggagatcgggttcggaaacagagcaggaatcggctggagtctagatcggctacgattaggatcggctaggtctgagtcgggctaggtaagccgatgcagccgattccggcaatgcgacttcatgtatgatatcgggttgagttgaggcacttcaaggtgattactgcacaaggatagagtcctgagaaggcaattttatctattaattaggatgttttatataatttctttagagatacgcttgggcaaaagtctgccgtaaagacttattgtatcttagagtttgttaaagatattagtcgtgtccgttatagacatatcttgtaattctcgggtataaatagacccgagccctatgtaactttgaacacacacgttcaatacaatttcggctcatcaccaccctttttgctttagttttatttcgacgagttcttactttcgggttgagctgcatcggtttcgatcttcaacaagaggtaaaacttgttatgacaacttgtgttctcgggattagtgcttccatctttatgatactctgatctcgtttatgtaattcgtcgagctatcatatatcttacataatctccggcaatgcagctatctaatctacaatcggctaacatctgtcggtagagagcagccgattaggttagatttcaacgttgatttagattatataagatatctaccactctataaaacttccagcagcttgattgtctagatattgttcttcttttcatacttaatgccgtatcagttaagtttgatatattaagtcgtgcttagaaaatcaatctctagcctgccttctggttgccgattagggtagcatcggagtttcagctgatcttatctaatttaactatatttaccctatatactttattgacatgttaaatctgccctttattttaagatcttattgcatttaagtatattaggcctttgtttgatatattctacctactttaacatcttagtatagagtggtatcggagtattagccgatacatcctagatctatatgatcggctatgctatgaacatatatagtcccattattaatatatatttcgatttaagtgatttatactgtctcggcatggcgaccgatctatcccaatcacttgatttaagtatatatcgatataaggagtatatattgttaatatctacagccgatcgaatagatttagttccttcttatttattcatgtctgccgatcgatacatatatgacatcggctcaaagataaatgatatgtcatcggcctctagccgatcgactatcatttatagatttaaccgcgggttctttgcttctatttcttgttgattacaggatcaaatcaactggcacgcttatacattcgaaggcgagctttggacctgcactggagttaagcagatctcccaggcctcgtgttttctgtcaacacgcttttggcacgcccgatgggacctttaagtagtcagctaacaattcttcctcatggccgagaaacaaccaccaccaccatctagcccaggctctgttaaggaaaagatgctgaaattgggattgactgatgtcaatgaaggaaacgtcgtgccgatcgatccagaaaaattcacacctgaacagaagaaagagtttgaagcaatgttgcagcaagcacgggatcagttcttgaactcattcatgcagacccgcaaggggacacttgttcagaagtacaaaataaaagtggttgctgatgatcctgggaccagttcttctaaggatggagatgggaaacaagctccagacggctcggctcagccgagtatcaaaggtgctaccgacggctctctaggaaatcaaggcgacaattctcaaggagtccatggagtacaaggtgacggggtgcatggagttcaaggtgatggtgctcaggggctgcagggaggaaatcttaatcagaatagtgatgtggcacaggattttttcaataacttccaagatcgggttgattacgcggtgcatcatgctttgatcaattagtctggggtgttagtcaataccttatcaaacatgatgaagtcaatagccgatggttcaatagctgagcatcaggctgcaggcccggtttatttgcaaggtgtcttcccaaattatcggtatttgattaccgatgttcagccatctattcagccggttccctccgttgcaccaacaactcagccaacggcgccggcatcaactgccctacctgctctatcagtgatggcgccaggccagccggcgaaccctcggttgttaatgagagagcatccatagcatagtgggcaggttgcgaatcggctaacccaagatcaggttgctgccatgtttctgccacctcaacctgttgttgatccaatacagcagcaaccgattcagtagcagccgattcagcagacacccccaattcagcaggttgtacaaccaatccagcaacaggtcatgcaaccagttccgcaaacaccaccaaggcaacagcctctgcagccgattcagcgaacgccattaagacagcaaatcgttcagccgatccagcaccagggttcagtaagcacatcggccgggtttgcaacgcctggtggtcagcctgtacaacaatttttaaatcaagttgtcccagaacacttggttcaccacgtacagccagatggcacagtaatgcctcaagttgttcctgagcacttggtacgtaatatccagccgaaccttcataattaccaagggggtaacttgaattatcaatatcagcctccttccccgcaagcccaatatcacccagggggattggctcaacctcagtttgcatctcaatacggtcagttcggacccatgcaacaacagtcacaaggggcagctcagcaacgaccatgggccgatgtgattgctgacgtaatgagggaacagtttgggcttaaaccaaaagagactgggagcttgtatcggcagccttaccctgagtggtttgagagagagttcctcttcccaatcggttcaaagttccggacttctctaaatttttgggacaagatggtgtatcgacttatgagcacattggccgattcttagctcagtgtggtgaagcatcggctgtagacgctctgaaggttaggttattccggttatctttgtctggatcagcttttacttggttttcttctttgccatatgggtcgatcaatagttgggccgatttggagaagcaatatcacagttatttctacagtggggttcatgagatgaaattatctgacttgacagcgattaagcagcggcatgatgaacctgtgcactagtatattcagagattcagggagatgaggaacaaatgcttcagcttgagtttaaccgatgcccagttagccgatctggcctttcagggtatgattgctccgattagggagaagttctcgtctgaagactttgatagcttgtcacatatgatacagaaagtaaccttgcatgagcataggtctgcggaagttaggaaaagctctaagaatgttaatcatgtttgtccgtacatgtatgggtcggatgatgatgacgatgattctgaaatagctgcagccgaatgggtgaggagtaaaaaggtcataccatgccaatgggtaaaaagttctggaaaagaggagaagtatgactttgatattactaaagctgacaagatctttgatctgctactccgagagaagcaaattcaacttcctgctggtcatacaatcccatcggctgaggaattaggcaaaaagaggtattgcaagtggcataattctgggtctcattctattaacgattgcaaggtttttagacagcaaattcaggtggccattgagggaggcaagattaggtttgatgattccaaaaagccgatgaaggtcgatggtaacccttttcctgttaatatggtgcatacagctggccaaacagccaatagggtccgtgcaacgggttttcaggcgaattcggctatgattatcgataaatatcagaggaagtatgacaagcagcaggagaagcatcatgaagaatacgatgatggttttgatactcattgggattgtgaattctttagattctgctggaatgagagcatgaggttgccatctattgaaaactgccctgggtgcagtgatatcattgagagatcaagccgatcatataataggagtaatcggctaaggcagacaagaatttctgttcatcaaagatttggtccagtgaatcaagatcatggccaagaggacaatgtaatcaggaagaatcaatggtgtcattctggtattttcatgaagaatcagaagagaagggttcaaagattgagaaacagggagcgccttcaggaggttgaacaagaaattaatcatcggctgaagaaagcaaagccaaggcaggagtggcgtgttaagaatcaggttactctagccgatgatgttgcagccgatgaggcaaagaggttggcaaaagggaagagtgttgtgatggcaccggttaacatggtctttcccctgccagccgaattcgggatcgatcaagccgatgtcgacgaggtggaagaggaatcagctaagttggttctgtcaccagaacaggcagtgttcgagaaacctgaggggacagagaatcggcatcttaaaccattgtatataaacggctatgtcaatgggaagccgatgtctaaaatgatggttgatggtggggccgcggtaaatttgatgccctatgctacgttcagaaagttgggtagaaatgccgaggatctcatcaagacaaatatggtgctcaaagactttggtggtaatccatcggaaaccaaaggtgttctgaatgtggagctgacagtcggcagtaaaactattcctactactttttttgtcatcgatgggaagggttcttacagcttattgcttggaagggattggattcatgctagttgttgcatcccttcaactatgcatcaatgtttgattcaatggcaaggcgacaagatagagatcgtgccagctgacaggtcagttaatgttgccagtgccgatttagctctttgggagatggatggccttgattgtttatctggaaaagtctgggatggagattttctgaaagtgtccgattctaatatacagccaattgaagatggagaacccaagctattattttgaggacatcgtggagggttcaaatgtctacactaaggatacagtagatgatctcgatgacaagcaaggtcaaggtttcatgtcggccgatgatttggaagaaatagacataggtccagacgatcggccaaggccgacatttattagtaagaacttatctccagagtttagaaccaagctaatagagctgttaagagagtttagagattgcttcgcttgggagtattatgagatgcctggactcagccgattgattgttgaacatcggctacctatcaaactaggggttagaccacgccagcaacctccgaggagatgtaaagccgatatgcttgaacctgtcaaagctgagattaaacgattgtatgatgctggttttattcgtccttgccgatatgctgaatgggtttctagtatagttccagttattaagaagaatggcaaggtcagggtgtgcattgatttccgagatctgaataaggctacaacgaaggatgaatacccaatgccaatagctgatcagctggttgatgctacatcagggaacaaaattttgagttttatggatggaaacgctggatataatcaaatctttatggctgaagaagatatccataagacagcttttagatgccctggtgcaatcggcttatttgaatgggttgtcatgactttcggcttgaagagtgctggagctacatatcaaagagccatgaattacatatatcatgatttaatcggctggttggttgaagtctacatcgatgatgtggttgttaagtctaaagaaatagaggaccatatagccgatttgaggaaggttttcaagagaaccaaaaaatatggcctgaagatgaacccgacaaaatgtgcttttggtgtatcggctggccagtttttgggatttcttgttcatgaaagggggattgtcacgaccggaaataacccaacgggcgttccttacgtgcgtgcattattccttgtcccaggaggcaaggtacaccaaaagttgatacaattcagagtttaacaagcggaagcgtaattaattaatctattacatgggcggcgaaggcccagcacacaagaagacaaacgaaaaacagcggaagactagggcgacgaccataggcgcttgacggcaggcacgagctagacaccaaagccttcatcttccaggaactcctcttctgagtttgggaaaaattgagtaaggctgagtacaaccatcgtactcaacaagacacacccacaagtgcagaataaatgcaagggagtacaagggggttatagtataaagggttagagtttgcagtaaacagcattaaaagacacttagttgctcaaagctattttgtaaacacgattctagagctatataatattattaatcaaggccgtgaacccacacgagcctgccttaacccaaggcctacgatgattcagaccgaactggcaacccgaccccgggtcccagctcgtcccaagccaacccaggccaaccattccacattttagttgttaagcaggttttaagaattaaaaacactaacttgggtacattgctcggcttgcccataaccgagggtgcggctattcgaataggttatactctgatcagaggtgtacatctttacccacaagacacatcttcctcacgtgtaaccacgtgccacataccaccacggtatacggacggaagacgtgacatagtttccgacccatcctagccatagacaagagtaccgacccaaccccacctacggccggaacccccggatcaggtaggcaggactgagcccctagcagcaggacaccggccctgtgccatgacatctcgactaccaggccgcagctcgtgtagccttcatttgtcctagagatgtccatcgacccccgacttcgtccatctccatccgtgtactttttttataaccagactgagccacaaactaagccttatccactagacatgtggaagtacggtagtgctttgcaacagaggcccgaagaccggtccttatatggccgatgtgctactatcaaaaccatgcaccccgagcccagcctaaaaccattttgaggattttgaatagagggggaggtgtgaatccaattccacaataatccaaccattccgtagtgtccaggtgatatgaatatcccaaagtctagagttgtaaaaccacataatgttgcctaattaaccagcgaagcatctgcctaaaatcatactagtggtaccatgagtagagtgtccactagttggggttttgtttattctagggtgaacaaggaaataataacaatagcaataataaggtcataacaaaggtaaataggcatggctagataaaacagtgataacgcgggaatttaaataaagcgataatgcaataatttaaatcaaaataattttataaactgggattcaatatgttcaaggatgatgtgacttgccttgctcgctttcccaaacgtcggcttcaacctccacgaagagcggatcttccgaagctgcagcgtctacacgaccaatggaaaagaaaaggcttttactctaataaactccatataaccagcaagaacaaagcacaaaaatgggttcttgacttcttaaggaaaaattagagacttgaatggtccaattctgagttcaaatggccaagttatggccatttgaagtttatatgctctttaaatgaatatttacgaatttctttatttaaattttaattttaaaagggtttattgcgtcagccgagggggaggggcgcgcggaccgggtccacgggagtggggcccacgcggcagcctcacggtccacggtggaccgggtgcacccgggctcacaccggccggcgccgtgggccccacacgtcagccgcacccgagggcgcgggcagctgacggccgggccccacgcggcagccactcggcgcgcccgagggcggccacgccggcgcggtcggcgggaggcagcgcgcccgcgccccgatggttgccgccggcgaccgccggcgcggcggagcggcggccgagagaggggagggaagggggaaaggaggcgacggtccacggctcaccccggggcgacggcggcgacggaggaggcggccggagcggagggaggcggcggcgcggctcgggtcaacggggtcgacggcgttccggcggtcggcgatcgaaacagagaggtggacgaggtcggcgaggatgcagcgaacccgaaggaggcggcaccaaggtgggaggcggtccggggcgacgacggcggcggaccggagcttggcggcgacggcggagagagagagagcgacgtcgcgagctcgaatccggtgaggaggaagggcggcgagaggcggaaacggacggaggaggtgcggggagggtttaaatagggttggaagggggagagagcggccggaggggaaggagaccggcgcaggaggtccggccgccatcaatggcgccgacgagatttgcgggggcaaatccgcccgtttgaatacgagagagagagggaaaaatggggggaaagggagaggggatcacggggagtgatttcccccactttattgcacgcggggacggcgggaggcggcgggattcacggcggcggcggcgctagggcgtggaggaggcagcgggagcggcgggagaaaggggatgacgggtgggccccacccgtcagcgagggtggcgggcgggcccgcccgtcagcggcgcgcgcgcgaggagaggccgagtgggccgcggggagaggagagagagagggggagggagatgggccgggccagcccaagggatcttggagggaagggggacttttagggtttttctttttataaaatcattttaactttgttcatttcttaataattattatttgtgctctgaaaattccactaaaatttatttacacattttaggctttttaggaaatttacaaaaatcctctaagccttatttgacttttaactttgcacattttaattgttgaaggctttcacatggtttttaattattctaggcataatttagagggtgtattttagagtcgttttgggacgcgacagctctggcagtgggaattcagcttctgtcacagagggccgatggacaaccttcatgactatcaggtttaaccaagtttgcagcagccaccatggtccacctgctccaactattgagccgacggctattttagccgatgcattgttcaacatttggtacagatagccgagaaggattttgcccaaaggaaattctttctttgattctaaggctttgttgtcgaaatgacaactgcatacgtcgaaggacgtggttactcaacagaggttggaaggaaacgaagtgtattgaattttgaatttcttttttcgggatccccctcactacatggccctaggggactatttatagccccattacaggttcttactactagggtttatgttgtacaggggaatttacatgattacccttacgaaagggacatttacaggggtacataatgttataggggctcatgggcccctgatgggccgtctggcgattgccggccctgtagcccttaggcttgatgggccggaaaggcttcctcgaccctcgcgggggcgaacttgccatggcgaagtcgtcttccttcggcaaatagtcttcgccttgcacccttcgcctgagacgcctctggcctggcagggcactcgtacgactcttcgcctcacgccgttcttgctccatagccttcgccacaggtttcggcagatttagtcgaagggcatcatgccatctgccaacaagcccctcacgggcaagggtgagattggagcttcggccgagaccgtgcaaaccatgtggtatggtatgcggcgccccctttcgactgatgctcctgccgaaacctacattattcctgcgaatgaagtttgttacttgtgcggctggtattattttgccgcgcttcgcctcgtgcgattggtggttatatattttcttttcccgggccgaacggaacagtattgggccttcccatcgtgggctttttactgtgccgctcagacggtgggaatttaccgtttcgcctacccttgcgacacgtggcgctttattactggtgagtaggcacggtcgcccgagtgagctatatattcccacccctctttccttttcaccggtacacttgccatttttaccgcttgcgctctcttcttccattcctctcttccacaacatttcttgacccctcaggtgtttcgcccattctcttccttcgccaccgcatacacgccgttcgccatggcccctcgcaagccaaacccagcttcggcaaaaggaccggatcccggccgggtcgatgatgacagcaccgcctttttgggggtttctctcgtggacgacgttgaactggcaaagttggttagctctggggcgttggttgaggggcaggctttcgccccggggaaagccgtggtgccgaagcctgtcgacaatcggacggtggtgttcgccgtctttgttgaggcggggctacggtttccgtgcaacgtgttgttgccggagatctttcgccttttccaggtggagcttccgcagctgagcccgtcggcactagttcggatctccatctttgactgggcgtgtcggacttccgggtttgagcccagcgccgagctcttcggcgccatatttttcgccaccttgaactcgaagacggtgattaccccggctggaacgaagaagacagtgttcgggagcgtgaactttaacgttcgccccgagcggtccaatctctggccggtgaacgctgccatgtcgaagtgggaccgccattggatggcgaggtggttctatcacaccatccccttcgcagctggttctgactcggcaaaagccctccggtgccggcatagggcgattgcaccgaaccggaaacccaagatcgccatggacggcgctatggaggcgcggttcatcctactgcgcaaggtttgctcccgccttagctgccgtgacttggtggaggagttctgtatgctttgcatctttcccctctcccagtcatggcaagtcacggtcgagcaatgcgaagaggctaacggtttgccgaacttggttcttcctgaggggacgaacagtaaggccgttcttttgctatacactcctgtgctttgttattttgccttgtctgacctttaacgcagctacaccctttacttttgcaatgtcaaccctcgaccaggctgaagccgaagcccgcaggatgatcggcgatgtttcggtcgtcgagtatagccagctgctaacacgacaagcggctgggcggacgaaccgggtttacaacggcgaactgcctccccggcgaatccccaaaaagctgacgacgatgcagggccttcgcgaaagcggatgcgtggacaagtgaagcttgcccccaggaagcgaagggttcctgcttcgtcggactccgacgccgacgacgaggatgatgccgaagaatgtgacggcgagggggaaggagaggaagaagaggaggtggaagctgtggctgataaggccgcgaacgaagcgatcgaagaccgcgtcgacacccccggctacactcctaccccaagtccaggtcacaacgagaccagggtggagtcgaacagctccccccttcaacgaaaggatttggaaggggcgaaggccctagttgcgttctcgtcgggcaaggcggcaaaaggaggtctggtcaagaagatctcaaaaaagaagggactcgtcgacatcgctcgcgtttttagcgacgatgaatcttctgacgagactccgacttcacctgctggccgcagtttggacctttcaactgctcaccttgctccgctcggcgttgctagggcaggcggtagcgccgccgccggggcttccgcctccgccgaacggatcgtgtcggctgcggcgagagttttcgggagccctgtgcgcgagccagctatttcaccgctggtcaaggcgaaggggaagtgtgtggccgccgaagcatctgcctcggagtattcccttgcggcgccccacttcgtccctggtgacttcgtgacccaggcggaccttattccctttgtggagggagtaagcaatcttgtcttgcccgccggcaccccgagcctgttcaccgaacttaacgagttcgacgaggggtgttccaccattaaaagtttggcggttcgggtatgcctttttttccttctttgttttcctcttccctctttttttttacgtttggcaattaaccttttattcttttcgcccgctcctatctttcatctagattcttgcgactcactgctcgacggagcgaaccgtgcgggcccgttttgacggttttaagagccgtcttcgggccaaggatgatgaaataagccgcaagaacttggaggtggagtccctggcccacaccctcaaggagccgaaaactgaagtcaaacgccttcagtccgaactggacaaggggaaagatgcctgggccgaggttgatcgcctcaaggccgaactggagaaggagaaggcccattcggcggtgctcatcgattactacaaccttactgagccgaagatggaggctcttcgccagaaggctagcagggtcgaagcgggcgccgcggaggagtcgcagcggtttttgcgggagatggcgaagaccaccgaatccgcgagaacggcttgccaaacgctccgcctcgcccttaccgacatgggcgcgaaggtgcggggggtccttgccgaggatgcctcagcctttgacttctccgagtggacccagcaagctggcggatcggtttcggactgtgccaccgcgtacggcaattgctgtgcgcgcgtatcggcggcctttaccttagaccttttgcaatagtttggctgcgagcacgttgccgaattccctacctatgcgaagggggactaggagattagtgcgcagaacatttcgcccgctcttcgcgcgtggcgaaaacagttctggcagaatgatggccggtccgctgccaaagcgcgccttctggagcaactggcgaaggcggaggcggcagatcggggcgaaggagagggtgccgcaggcgaagaggttggaggcgatgcccaggatcacccagaggtgtgaggccctccgccctttccttagatttttgtagttttcctcccacttttgcatttgcctggagaggcgaatgatgtacgttcggcaggctgccgccgaaccttaaaaaacgcctttttgtacatttggaatatatgacacaatcttaattgctttttgatggtcgaggtctttggcatattattatttcgctcatctcgcattatgccatacctccccctccttccgcctattcttactatgtaagctgtgttttgctttctctgcgctgtctatcagggcgttcaccggaagttgtgcattcggtccccttccgggagctggcgaagtcaaaacgagaaatttgtggcattgaaggacctgccgaaggtgcgatgtccatttcgtcctgtttatcgcgaaatggagataaacggtcatagctataaggttttcaaggttgccgactggctgcgggcgcaccccgggcgaatcttagaagattacgaccttgttcattcaagacgtttggaggatatggctcgcttttggcgaaatcatcagaagacgaaacgtcaggaaatgatctttcagcgtcgcaacagtttggtctgtgtttcgccccctactcctcttaaggttgtgtatgatattagtagtgatgacgaacctagttcgtctgaccattccttagggagggataatgattacaggggcgaagatgtaatttacttgtaaagtgagttgtatcgtgttgtgaaccttctattcttcaattatttttttcgaagttaataaagaaacgtgctttatttccttttcgctatttttcgcatcgtcacattttgtgctttttgttaggtcggaacatgccggcccctttgcgcatattagcaaaataggtgtactgactttttagcttttcgtcgttcgttttcgacctgtagcattctgtgtcgaaagagacacttttgcttttatgttgatcgaatcgtaacgtcgtttggctagttattttccgagacaagctgttgcggtttcaacgttcggcgagcgatgcttcgaccgattcgtttctccccctggcctttttcgctgatcaggcgtttgccttggggtttttccacaaattatcaatcacacgaaaaatgaaaagaaggcggaggacatagagattttatactggttcgggcctccatggtggataatagccctacatctagtttttttttcttttttctctttttcccctttttttttctttgccaaaaggcttacatagtgccgaagggcttacatggtgccgaagggcttacatgactgtatgtacatttttacaagctagcgatttgggtgccacccattctaggcatagaagcgcttgaaagaggcggcgttccaggaatggtcgaactcctcaccttctagtgtcgctaggcgaaaagatcccgtcctggacttgtgtttgatgaggtacggtccttcccactttgattcaagcttgccaacagctactggattcgccttcttccttaagacaagatgaccaggcatcagctctgtgggtcgaacttttttgttgtaagttgccgaagtgcttgtggcgtacttgtgcatgtgctcgagcgcttcgactcttaccccttccaagagttcgagcgatacttcgcgcccctcttcgcccccagagaacatcacccttggtgagttagcccctagctctgctggggtcattgcctcatcgccataaagaagcataaacgggctaaacttggttggtcttgtgggggtcgtccgaagggcccagagaaccgatagcaattcttctggccatttgcctttctttagtgcttctaggatcttgccatttgtacgttcggccgccccatttgactgcgggtgggcgaccgacacgaacctgatttccaggttaagccctttgaacatttctctgaacttatcagagtcaaactgcttgccgttgtcactaatgaactcttttggcactccgaaacggcaaacgatgtttttccatacaaacttctgtactgctgccgaagtgattgccccaaggggttcggcttcgatccatcgagagaaatattccacagctacaattgcgaatttatacccgtttcgtgccaccgggaacggcccgatgatgtccagtccccatctggcgaagggccatattggcgcaatgggctgcagatcatactggggcgtggcttggcttcggccatggcgctggcaactttcgcacttcttgatttactcaacacagactttcaacacagtgggccaatagactccttgtctaaatactttggaggccacttttcttgcagcctggtgcgcgccacatagcccctggtgtatctcctttgccatttctttgccttcggcaaaagagatgcaacgaagtaagggttgaagtaccccggagcggtaaagttgacccgagaccatcttatacttcgtggctctgagttgcaaacgcttcgctcctgcttcgtctaccggaagccagccagtttcaaggtgtttcacaaatggggttcgccagtcatatgtgtcttcgcccaatttctcctggtcgattgccatgacttccgagctgtccatgggcacacttggagcatgtaggacttcgaaaaagatgctaggcgaatgtgggccaccacaaacagtggatttcgccaaggtgtctgcttcctcgttttggcctctaggcaagtgttcgaccgttatgccggtgaagcatttttccatggaccgaacagcctccagatacctcttcattccctcttcttttgcctcgaaggatttgtcaacatggcctgctaccaacttggagttaattcgaattagcaggcgccggactcctagtgctttcgcctttcttaggcccaggagaacggcttcgtattctgctgcattgttggttgtgtcgaactgcagtcttgctgcgtaccgaatcggcacaccattcggcgaaaataggactgccgcaatgcctactcccttgtgcgaccacgagccgtcagagcacatcacccagaattgttcggcgggctcggggtcgggggcaagtaccggtgtccattcagctacgaagtcggctagcacttgagacttgataccagagcatgcaacaaaatgtaagtcgaacggggatagctctgccgcccacttgctgagccggccagtaacttccttgcctcggagtatttcgcccaaggggtactgtgatggcactatgactttgtgggcctggaagtagtgcttaagcttgcgcgaagccaccggcgaagtataatagcagttcgcttcctggggggtgggcttatcagagctggcgggctttgcaagtattgctttagctcgtcgaatgctgcttggcactctggtgtccaattaaactttcctacgccccggaaggtcttgaagaagggcaaacctcttttggctgcctttgagaggaatcgactgagtgccgcaatttggcctgcaagctttcgtacttcatgtacgcttgacggaggcttcatttgctggatggcatcgattttcttgagattctcctcgatgcctctttcggaaacaaggaaacccaacaacttgcccgcgcggacaccgaaaaagcacttctccggattcagccttatgcctgctatgcgcaagctgttgaatgtctcctgcaggtcgatcgcatggtcgaaagccttgcagctttttacgacgatgtcgtcgacgtaagcttccacattctgccccaactgcttgccaaggaccttgtacaccaacctggcgaaagttgctcctgcgttccttaagccgaaaggcattctgaggtgacaaaatgtgccgaatagagtgatgaaggatgttttggggatgtcgagcgggttcatgtggatctggtggtaaccggaatatgcatctaggaaactcatgagctcgcatccagctgttgaatccatgagctggtcgattcgtggcaaggggaagtcgtcttttggacatgctttgttcaggtctgtgaaatcgacacacatgcgccatttgccgtttgacttccgcaccagcactggattcgccaaccaatccggatggtcaatctcttggataacccctgccctgagcaatttttgtacttcggctttcgccgcttcttggcgatcggcagacatcttgcgcaacttttgttttcttggcttaatgtccggcttgactgctaggtgatgcatgatgagatccgccgggacaccccccacctcgtcagggctccaggcgaagatatcgatgttctttttaagcacctctagtatactctcaacttcttcttcgcctatgtcgccccccagtgatacgggctttgtggggtcggcgtcatcaattttgtcacgcctagaaattcacgaaccagaatttctaagctgaatgtgtattaaacccctgtccaggaccagccagggtacacaaacgacaattgttgacatacagatccacgtcttacaaaaatataaaagattacaaatgcagcggaaaaggtaaagcgagctaagcctgaagccttgactcctgcagcgggcgattccattccacaggcaacccttgacggcagcgacgaaaccaacctcttcaagacctctccaaatgagaagaacttcaactctggtgtgggggaaaagagcaagactgagtactacccactgtactcagcaagtcataccggtagaggaggtatgatgcaggatataaccaaaggaggctacggggttcatttgcataaagcaggcatttaaaactagtagttgaaaacagtaaaacagttgtagtaattaagcaatattaaccagtcactgtccaacgctacgccacgttgcaacaggcccaaccaaccacctgaactacaccagttcattaagctaaactaggggtgaaactaatcacggtgaatctggtcgaccgcccataaccgcgggcacggctattcgaatagttttactctgatcagaggtgtacaactgtacccacaagacacagccccacgacacgttcccgtgcgccgacatgccaccacgacataccagaaagaggccgtgacaggacccttcgcataaccctctctaaccgatcgcaccacaccttagggttcgcccccgtccccagcaggcaacgggcagcccccctttcgtgccgcggtgaatccggaagccgatcaaccggacaccccggccgacccaactccatcatgcccaccctcgcctgggtacgtcggctagagaaaagctacactacaagcccagccgttgcccacgctggcttgtggtaagtacgataagttcttccagggcatcccgcgaaccggtccttaatcgccatgggcacgtctagcaaaaccatgcacccacagcccaccatgaagtgtattttaattaaccaacaccattgcggtggcactaatccaaaactattgccaataatcaaagtctatgctttaatgtgatccccttttgtgcactagttgaactaagcatggctaagcatctcctaaaccaacatctagtcattttaatacccaagttatcaatggcgtaagggaaacaacatatagctgagtaataggacccatcccacatgatattgtaaaacaatgcaatatttaatagaaatgcgggacatttgtaaattgggtacaatatgatcaattgcaatgtatgacttgccttgctctcgcactgatggaaccacagcaacgtcttcgagaaaccacgaatcgacgaaacgggcgaaatctacgcgacaaacaaagcacacaagcaagacatgctataagactactgaaacaggaaacaaaaccatttttaatggattctatacatttttatgaatttactgagacttgaatggacttaatcggagctcggatgaattagttatgatttttagaagattctctgtatttttactattaaagaaaagccttaatcaatttattgcgcaatattgccccagggctgacgtcagcaaggggtggggcggcgccggcatgcgggccccatgagtcagcggctcaagagagagagggaggggcgccggcacgtgggccccactggcagtggcacaaggcgggaggggcgcggctcacggggaaaggaggaaggcggcctggctcagctcggcttcaagccggccggccggttatggcgagggcggcggcgcgcgcgcacggtcgccggcgacggcaaccggaggcgcgggaagcggcggcggatgacggcggcgcacaggcggcggcacacagccgaagcggcggctcggcccggcacggcgctaggagggagaggaaggggaaaagagggggaggggcgcctcaccgcgagttggccggcgtgggggggggggaagacgacggcgaacggcgacggcgagcgaccggggaacggcgatgataggcggacgagctccgagacctcctagggaacaagatgggagggattagagggagaggggtggttaacagcgagcggattcgccggtcgaaggcggcggccatgggggtactcaccggcgcgcgaggagaagcaagctccggcggcgggattgaccggggaaacggcggacggggtggcgcacaagcttgtgaacccggcggcgtcgacggcgcggtgcggcgacggctctagcggtggcggagtgcggccggagcttggcggcgagcggcggatggcgggatgagaggcgcgggagcgatggagagctcgggagggctcggccgagaaaggaaaaagagaggggaaggtgcgggcgtgcttaaataggagggggggcggcgagtcgtggccgggaacggcgcaatttcgccggagtagtggagggggtggaggaggaaagagagagtgggggaaatttcaaatcccccgccgtttgcgggcgcgcgagctggcgggaggtgcggggaaggtgggcggcgacgtgggcgtgcggtacgggcggagtgggcgcgggaaacggggaaaccggcggcgtgggcggtggtttcgacggcggttggcgcgggcgtgggcggccggaggttagggaaagggctgacaggtgggccccacctgtcagcgcccgagagggagagggaggccgggtggacttccggagtgggagggaggagcgggccggcgcgggaggaaatgggccgggcccaagaaaaagaaaaaaggagggaaaagaaaagataaaaaggaaaaaggatttttccagggatttaatattgcactttgcttattttaattgattaaaattatttccaaggctctgaaaattccactaaaaatcctgttagcatattttgacatgtagaatccaagaaaaattccacatgtcgattccgattattatttgcatttattaattagggattcatctctaggttaaattaaacaatttcttcggacgatttattttatgaatttagagcaagggaggggaacttcagggcgtgacaaatttgcacttttgttatcttgccgtgaggggtgggctttggcgtgtgcttcggccgttcatacggtctggtctcaacactgtgcactgctctgttgatcatggctagatcgccttttgaagcggccaaaggctgaagccccttgactactatcacccctgtcgggccgggcatcttgagcttgagataattgtggtgggaaatggcttcgaacttgttcagggttgcacggccgaagatggcgttgtagttgtacgggatgtcgacgacgtcgaacagtatttgctcttcgcgtctgttctctcccgagccaaaggctatcagcaaaagtgcttggccgagaacttgaactgcttctccgccgaaaccacggagtgatgctggtgctggggtaagggcttgggtaggcaaccccatcttggcatatgcttcggcgaagataacatcggttgaactccctccgtcgaccaggattcatcggacttcgaaaccagctatctcagctgagattaccaggggatcttgatgcgggaacataactccttctgcgtcttccggcccaaaagaaattagctggttccgatactgcggcgccccttcacccgccaaagtgatgctgtggaccatacggatctgcatcttcttctgccgtttggacaactggcttggcggatcagcccttgtaatcacttggattacccttcgctgtacatcttggcgttgttcggctgggggtgtttgctcctgaattgcttcgcaggatgcttcgacagttgttccctgctgcggccttgggtcttgcacgttgccatgttgcctaatttttcggcattgctccgtggtgtgcgaagagcgtccgtgaaaggcgcagcagaggtcttttcggaccttcttgtgggctggctgctgatggttgctcgcttgctgggcatcgaactccttgcggagggcttgcacttcttcgaccgccatcacagctttgcccgcacggtctgttctgaactttctccaagttatgggggcctggccttgccttggcggctgtccttggatcgccgactgagactggcgaacagagaggggaggtggttcggcaacttgaacttgtgcttgagcttgagcggtggcgacggaggctttgtcgtactcagcttgtatagcttgtcgtcgcttggaatcctcctcgccccttgcgaacccgtcaatgatgcgaagtaggtgctcgagcgtctgtggctccttgttggcgatttttcttgtgagttcgccctcgagcagaccggccgaagcggcgtttataaccgatgcctcggttatgtcttgaacttggcaccgggcttgcgagaagcaacgcatgtactcccttatcgactcccccggcctttggcgaatgccgaggaggtgttgctgcgtcttcggctcctcataggtgcctcgaaagttaaggacaaaaacatcgcgcaattgctcccatgagtaaatgctattggctggtaaattgaaataccaaaaacgggcgatgccgtctagagcgagatgtattaccttcgctttggtattttcgtcaccatgagccgcttcgatcgctgactcgtagatagagagaaactccttcgggtcagtttcgcctgaatagcgcgggacgggtgggaacttgaactgcggtgggattggacgagtcctgattcccccactcagcggtagccccttttcgcctcccgccctgtttactgcactttgctgcgggtacggtgtggcgaagggcaaaatcgcagcttgtgcgtgaggttgcgccatggcattcgactgtctggctccaattggaggtacttgctgagtcgccatggatgggtcaaaaattggctgcgaccacgtcgtggcagcttggattggtgcttggtttgttccgaagcctggagttggagcttgctgccgaacggttggtgcctgagcatgttgacgaagtcgaactgcagtccttgattccatggcaaaactgtcacgcccagaaatttaacccaaatttccagactattttgcgtattaaatccctgtccaggaccagccagggtacacaaaacgacaagtaatatacagttccaaacgtaaataaagcgtaaaatacttacggaagaggcacttagtcctcacaccgaaacaaaagcagcagcagcggaaaaaggcgatcctagcggggcttcagctccattccacaggcaaaactcaactggggtctgagccttggtcttctaacttcgtcttcagctcagaagcactacacttctgaaaagggggaataatagcaagactgagtacaaccaccgtactcagcaagccacaccaacgatgcagacgtgcaaggggatacaagcaggggtttgtggctatttgcataaaggcagttgtaaaacattttattgagcaaaacagtaaaactgttgagtaattaaagtaatattgaatctccactgatcaacgctacaccacgttgaacaggcccaaccaacccacctgaactacagtgtattgagtcgatttattaagatgggactaatcacggtgaatctggtcgaccgcccataaccgcgggcacggctattcgaatagttttactctgatcagaggtgtacaactgtacccacaagacacagccccacgacacgtttccgtgcgccgacatgccaccacgacataccggaaagaggccgtgacaggacccttcgcataaccccctctaaccaagcacaccacacctcaggtttcacccccactcctcgcaaggcagcgggcagtcccctctcgtgcctaggtgaatccggaagccgcataggccgtcgcagggcccatccaaactccatcacgcccacccttgcctggatgcgtcggctagaggaaagctacactacaagcccagccgttgcccacgctggcttgtggtaagtacgataagttcttccagggcatcccgcgaaccggtccttaattgccatgggtgcgactagcaaaaccatgcacccacagcccaccattcagtcgcattttagttggataattacgaccatgaagcatggccagatgtctcgagcacgcagctcatactgatactaaaaggtctaaaactgtaattaccccatcaactgagctagtggtaatgaagcatggttaagcatatagttctagctaggtcatcaaagtaacacaagctaggcgatttattacccaaggttgacaaagaacagatatcaagtaaacatggcacaagcgagcagataggtaaaaccctgaccccatgtaattagcaaaacatgcatatttatttgcaaacagtaaaacatttgtaaattgggatcaacatgctcaaggggaatgtgtgacttgccttgcttcttcactttgatcttccgaactcttttcctcgcgaccgcggacttccgaaacgacggattctacacgctggcacgcaaaacgaggaaaaactctaataaaaaccaaagaaacagtacataaaaactaaacaaacatgtagatctcaattttagatgaattttgcaagttgaacggctcaattcggagttcgaatgaattagatatgaattttagaagttttgagccatttaaatgaatttctagaattattaacgaattatgacgcaattattatttatttttccaaaggaaaagagggttgctgacgtcatcaaaggggaggggtggcgccggcaagcgggccccaccggtcagtggcacaagggcaccggtccaccgtggaccgggaccaccgaggcggtccaccgccggtccacgggaaccgacggcccggattggcccaagccgatcggacggccacggggcgcgcggctggggcacggtcacggctcaaagcctcctatggaggtgagaactggtgcgaggtaaatggaaacgactgccgaccacgacaatacgaggaggagctcaccggcgacgagggaggtggagctcgggtggatttccggcgaagagggccagtggccgaggatctccccgtccctgcggagccgaggaaggcgacgacgcgggtcggcgaggaccgaagcggcgttgcgacgcggctggaggtggccatggtgagggagagaggtggtgcgtgtggcggcggcgttccggaggcgaaatgggaaaatggagtagggaccagggtggagctcgacggggcgatgccggcggtggcggcggcacggcgcggtggtggctgcagcggcgaggagcggcggctggagctcgtcgttgagtggtggagagagggagcgcggtggggagggggttccaacgatggaatggggaaaacggagcggggccgaggtgcggcaaggcacggcgaagccgcaggtggcggcggaacagtacggcgacggctgtagcagcggtggcgagcggatggagagtcgccggtgagcggcggcgatgggagcagcgaggggagagcagtacagggcgcgagaagctcgggaaaattgggggaaatggaaaggggaggccggggatgctttttatgggcttggagcgatgggatcgtgctcgagagaggtggcaaccggccgacgagataggcggggcatcttgggggtggtggagaggttaaccggcggcgattttcgtggggagagtggggaaaagggtggaggacgtggggcgacggggtcccacgaccggcgggctcgcgcgcggggtggaggaggtcggaaacggcggcgtcgtggggtggctcgggcggccctggcggttgcagccggccagccagaggtaggaggaggagctgacaggtggggcctcgggtcccacctgtcggggagagagagtggggaaaacgggcgagggaggtaaagcagacttgagggagagagagagccgagcgggccgtgggagaaggccagcccgagagggagagaaggggggggaattgggccgaaaggggcccaaagagaggagggaggattttatttgttttctttttattttaattggttaaatgatctttgtgactttaaaactatttctcgagctccgaaaattcacggaaaattccggagagtacattagggcaccaagaatattacaaaatattcccggccaatgatttttaaaggaaattttaatttcctctataatttcacttgattaaattgatttaacttttatttaatttctagaagatgtattattaattgatttttattcccgaacgaaaatcggggcgttacaaaaactcctaggcccggctgaatcggtggcaaccaattaggcacaccttgacttgtattcccctccgggtgggccgatggggttgtacttgaaatgcagtgaggttggttgagttgctgaaggaaagcttggagttgcgcctgcagagccgaagccccttccgccactgtttgtggcgcttggccaggtggttgatggtgtgcttgggcagcgactggttgagcttccagttgcacgtgaggggctgaatgcactgctgcggccgattgctgcccggcaaagtacaccggcgcctgtgcggcttgtggcggaatgggctgggtcgtcacatgcggatggacttgagatgggacataacctgccgaatactgaaggattggagccgacgtggccttggtccgccttgccacctcgtatgcttgttgttgttcttgcatttggcgaagcatgtcttggagccgtgtcatgttctgccgcatggtttccatgtcggcttcggcttgtgcttcggggtcagggctgacttgggcctgcacaacggcaggcgcggttggggccgctgccggctgcgatggagcggcttggggcaccaccagttggattgttgaaaggatctccgccctggtctggagtgcccttgccgccgcagccgccttcgccacgtcggccgcgttcggcacttgcacggaggttgcaggggccgaaggcagttgtgatgtcgcttgtcctcctccatcttcggcagtgggcgccgaaggctctgctccttcctcggcggccatgtctagtccggcgtcgctttccttccacctggcaaccttctccttcacgaccctcttcggtggcattcgctctcagtggtttcgctcggaggtccccacggtcggcgccagctgttgtcgaaatgacaactgcatacgtcgaaggacgtggtaactcaacagtggttggaaggaaacgaagtgtattgaattttgaatttctttttttgggatccccctcattacatggccctaggggactatttatagccccattacaggttcttactactagggtttaggttgtacaggggaatttacatgattacctttacgaaagggacatttacaggggtacataatgttataggggctcatgggcccctgatgggccgtctggcgatcgccggccctgtagcccttaggcttgataggccggaaaggcttcctcggccctcgccttgcacccttcgcctgagatagtcttcgccttacacccttcgcctgagacgcctctggcctggcagggcactcgtacgactcttcgcctcatgccgttcttgctccatagccttcgccacgggtttcggcagatttagtcgaagggcctcatgccatctgccaacaggcttcgactacaaattgccagttggttgtatggccacaactagatccacagaagaggaacttttccagccacatgagcaagaaagctacatgctctcgaggagtaacagacccttggcccatatatgccgccacatagccagaccagccacctatgcttttggtcttgaagtcaaattggttcttggtgttcatactcatagggttagccgatgaagttacatcaaatccagtaatcatggtgatgtcgattaaagttggagtcatcggcccttggttgaataagaaagcattgatggtgttggaccagaagtaggtggcggcagccatcagaggctcatccttagcagaattggctatggtgagagcaagcgcttggccgattccaatctcatcccagtgaactttcttactagccaatacgcgttggtaccaggtggtccagctcttatcaggagtaggtttttcgagagatggccaagacttgaaggtattcttccagtgacccaggttagggttggctagtctaaaggggatttggttggtttcaccgatgatgaaatcagtggggtcgagattgccgattgggccaagaaaatagtggttttcgtgtgataggcttggaatcgcaactaggttggagagatgctgcaaatccgaaacaaccgagaaaaagagagcgatataagataagagaaaatcgatctgctgctaagaaaggggatctagccgacgaggacttacctcagcgtactcggctgatggcacatcagataggttggtggaggatgacatcgctgcgggcggaaatctcgccgaagatgaagtcgcctgggagtcgcttttgcatcggaggaatcgtcggagagagagagaacaaagtttcgcttgagcggtgaaaacggaagtcacggtgtgagatttctcgagggtgacggttagtatttaaagcacggcagtaacggtcggaaaacggcaaagtgcgaaacttgctcggggtcgatttacagcaaatccgaaacattaccaaatattccggacttggggggcatgtgttaacaaccaaatttggtaatatcagcatcgagaaagaagattagatcgaaacgaagtcggaggcggagatcgggttcggaaacagagcaggaatcggctggagtccatatcggctacgattaggatcggctgggtctgagtcggactaggtaagccgatgcagccgattccggcaatgcgacttgatgtatgatatcgggttgagttgaggcacctcaaggtgattgccgcacatggatagagtcctaagaaggcaattttatctattaattaggatgttttatgtaatttctttagagatacgcttgggcaaaagtctgccataaagacttatggtatcttagagtttgttagagatattagtcgtgtccgttatggacatatcttgtaattctcgggtataaatagacccgagccctatgtaactttgaacacacacgttcaatacaatttcggcgcatcgccaccctttttgctttagttttatttcgacgagttcttactttcgggttgagctgcatcggtttcgatcttcaacaagaggtaaaacttgttatgacaacttgtgttctcgggattagtgcttccatctttatgatactctgatctcgtttatgtaattcgtcgagctatcatatatcttacataatctccggcaatgccgctatctaatctacaatcggctaacatctgtcggtagagggcagccaattaggttagatttcgatgttgatttagattatataagatatctaccactctatgaagcttccagcagcttgattgtctagatattgttgttcttttcatacttaatgttgtatcagttgagtttgatctattaagtcgtgcttagaaaatcaatctctagcctgccttctggttgccgattagggtagcatcagagtttcagccgatcttatctgatttaactatatttaccctatatactttattgacatgttaaatctaccctttattttaagatcttattgcatttaagtatattaggcctttgtttaatatattctacctgctttaacatcttagtatagagtggtatcgaagtattagccgatacatgctagatctatatgatcggctatgctatgaacatatatagtcccattattaatatatattttgatctatcccaatcacttgatttaagtatatatcgatataaggagtatatattgttaatatctatagccgatcgagtagatttagttccttcttatttattcatgactgccgatcgatacatatatgacatcggctcaaagataaatgatatgtcatcggcctctagccgatcgactatcatttatagatttaaccgcggtttctttgcttctatttcttgttgattataggatcaaatcaactgacacgctcatacattctaaggcgagctttggacctgcactggagttaagcagatctttcaggcctcgtgttttctgtcaacaatatttcataaaagtttttgaataaaacgaatggtcgaacatgtttaaaaaagtcaacggtgtcaaacatttagggaaggagggagtagtagattgtgtgtaggtgtagccaccccatgctatgacgtttgcatggtcagccaaattggttaaaacactgctcaaccaaaatcctacagggctaagattgttattatcatgtccaaagtacaaccaccagtcaccatcatcttttttctgcatgtcaataaaagcaaataaagttaattgaaatatccaccaatgatgtcagttgatataaaaaaaatgtaaactaataaacactgtgaacaaaatgaaaacctagtgtcactaaaccatgtatttacatttcatacaccttattaatttgacacccaattcagtatccactaattcgcttttagatttatgatgtttcaaaaaaagattaagacaaaaaagcatcaatacattcaactacaaaccttaaatatcttgattgtgatactcagagtgccattagttggctctaaaatatctccaggagttataggggaattgtttacaggtacaaaaccatcacggtccagattatagcatcctgtcgagacaccattatcaacctatatatgtaaaaaaataaacaaaagatcctaagttatacacgatagtataagcatgcggtaattaaataatacgaagaggcaacaaactacataccgtccacgctgtataaaaatgtgttttgctgtcaccatgaagagatgaccgggttgacctacatatgaaataaaacaatcacataaatggtatttatacttataaatatgttatacttgtgaaaatgttgagaaaactaacataccatccatccggcaaataaagcatttccgtcagtaagatcatggcgttgctcatttagtaccgctaaatctgctgagcttacttggtccttgttcaaatttgggaacccatatacatcaaatgttgccatggcaccaagaagctcatctgagggtgatgtgttcgaataacattgagcttgctgtggaaaaactcacacataaataacaatctgagacaatttatatctttctgggaaatgtgccaacgcattgcgacagatgccaagtaaatatgctttaagatctacagtaagaaatgtaataaaatatttgactctacaaaattatactaccatgtttttataagatcattgcaaacagcctttttttttgcaaaaaaatgtatatatacaaatatctatccatagaagatattgataggggattgaccaaaatcatatacccaacatctcattgaggtaaatatgtattagggatttgcagttgcagcaattaaggctgataccattaaaaatcatgtctaatttcccaaaaaacaattatgtctaacaagtaaagaaacaaatcttataaatttcatttgaagtatgtaactatctttataaaatattaacatagtttttgtaatattaagatttcctcgcattatcagatcattactaggttctaccctctttggaaaacaatattttgctgttttcacccttttcattcattctattcctttatctctctgtaattacccttttgcccctccacccttttttctatgggacaatttcgtttctgcccctactctgatgtctaatattgattttacccctactttttagggttttcgtttttaccctcacttttttaaactgaacgcttgttttgcccctactttggatggtgaagttaacggtattaagtaattgacaaaatgacatttataccctctcatatatgctcattaattgtgtttttgtccccattttatgcatgtagctttagaactttatttttgtgagtatatttaaaattacatgaagcacattgactaatatctaaaggaacagataattacattttacaaaatgttgtcaaaattttgtttaagttctatcaaaatgctgaaattttatcaaaattccatcaaattcagaatttgtccaaattgttatattagtcaatgtgcgtcatctaattttaaatatactcccaaaaataaagttccaaagctacatgtataaaatggggacaaaaacacaattaatgaacatacatgagagggtataaacgtcattttatcaattacttaacaccgttaacttcaccatccaaagtagaggcaaaacaagcattcagttcaaaaaagtaagggtaaaaacgaaaacaataaaaaataggggtaaaatcaatattagacatcaaagtaggggtagaaacgaaattgcccctttttctatatactatattttctttccatatccaaagtatgggttagtcctaccgcagccatgttgatgtcctactcattgatctttccactccgcaacggtcacggaatgggcatgtgagaacatgaaaggagtatgggaattccacgagcaaggaagtagggacaaaattaagcgatattattctagaggggtcaaaacacttaactgaagaaggaaggaaaaactagtccattagcaatttttagatctttgggggcaatcaaggagaaaatcaaggattgcaacaaaatatgaagatatctaatgccccaatgaaaattctacgcggagtagttttaactcacataggatgtttcttgaccgggaggcttcactaaatcctttttgagtagcgagctgcttgcagaggataaacgattccccatgtgtaactccctaggatcttgatcatattcccatgatgatatcaaacttgcttgctccgaacaaatgatcagaagacacagtagtagtaaaacacgcattacttgactcattctacaactagaatttctcactcctctatgagtaagataagaactactcaaataagttgcggaaattttttttctagataaaaggtttttgtgtgcttttatttcctacaatgaacacggctttatatagatgggcagaggttgttctctcagtaagagtttatacatctataaaggtaggtggcaatttattgttctagatatgcatacactggaaataataaatgtcagattgagaaaaatcaaaacaatttcctagaatta

SEQ ID NO: 68883 - DNA, 6669 bp, Oryza sativa
  unsure (1)..(6669): unsure at all n locations
agtagactctttttcctaacacattttacaaaattctttgtcattttctttttactagctgaacatgacttggccagcctctctctcccagccatgtatataaagtgtttatttttggaggaattttactcttctagacctccatcacgcccgtctctcacccatcgaaactttagcgatttgtacatttatagtgtttgttttataagccccttcttctaatgtggacaaattagctgatctggttcatctattaataagacattcctcagcttatctgtcgactcaactaaatctctctggtcactttaatttagattccttcttaactctaaaacccactatcctccattcttggtgctgattaatgtagtatagttgagaaacaggatttataaacggattttgtcataccactcattccctaaatttaatttgaacataattgcctcttttagctttcttttcagagaacaattgcacccattttgtgactcatgtaaacccttctagaactgggatcctctctggggatgaacttctgtaaaactagttcattgccccgcgcgttgcatagcaggtcattttgtcattttagaaccacaaaacatacttgcgcatatatatagtacgttagagatcatatcttatatttgataatggttaaggcataagaaatagtcaacaaatgaatatatttttgcaatcattgttcagtatattaaaacgtccgatcattgaatctttggacgtcaatttaacaataaaaaacaacagtaacaatatttagtaacgccatgagacttacggttccatctaagtatataaacagtctatgagattagccggatagcatacaccagttcaaaagaccaagaccaaagtattgcaaaatactccctccgtattttaatgtatgacgccgttgacttttcgaccaacgtttgaccattcgttttatttaaaattttcgtgcaaatatgaaagtatttatatcacactggtggagaaaccctttgtagtcccggttcgtaacccccctttagtcccggtttccaaaccgggagtaccaatccgggactaaagatcgagctgaccatttttttttttgcatggccctgttgctgcatggtttatatatatatatagtttatatatatatatatatataaaccatgcatatatatgtttcaatacatatatatgcatacatatatatatatatgtatatatatatatatattatattatattatatgtatatacatgcataatatatatgtatttatacacatatatatgttatgcaaattaatgcatatgtatatagatatatatatatgaccaaaatatatttacattatagaaaatgtgtacacatgcatatagaaacatatgtagtcatgtattaattacaatccattatatgtcctagctagctagctatcatttcgacgtagtagtactcgctgctagctcagaagctaaggaccggtgaattgtgtttccgtcgtagtagaattcacccttgggattaaggatttcttcgttgatgaatcccatgagttgttcttgaaccgccgtgataaattccttgtgtgtggtcaggttatccctcatgcgaataaactatatgaatgtatgaaattgattagtaattaaacaagaaatcgctacgtaatgaaattttgaatttatttgtacgtacatcgagctctcttgtggtgatgatttggtttgcaaggcagtggcaatactcgcacacgtaatagccgcacaagttatttccctgcttttgctttgcgcactacaaataaatgacaaacaacgagagatctaattaatatacacttgtatgtatttgaatcggagaaatataaatatagagcatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacaaaggaacttatgacggtacctgtctataagttcgaaaaccttgtcgaacgtagactcttttttatccattgagtcatatacgttgacggtgcaggcctccaggtcgaagagtaaaagcacccagtggaatctgcaatgtgcgtgggatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggacgagattgtcctctgtttcttgtggatattggtcgagcattgcgacgtttactctccgagggtcgatgaatccagtatcgaaaaccctccgccgtcgggccctttgaatctccattctacaacgataaaagggagtatattattttctatagtctacttatatacaaggacctaattaattaaaggagacgtatagtaagaaatctaactgaacgatatacttacaaaatccagcaactcataatagagacgtcgacggcgtccagctggtatagttcgtagatatgtgtgaaattgatccagagaatgtcatctccttgcaagaagtccgtatccctaatcctcgctccgatcatctctctaccggtggcgctcatctccatgtacagctgatggaacttgtacatttgtgtgggtagggactgcagcagctcaggcttgacaagcggtttaccgagttcgtacatgtatttcacttccgccttttcgattggtgcgactcctagcaattgatccgtagttagaccggtgtcagtaataaattgttctatcgtcatttctttaccggtaaccaacggctcgatctcctgttttggttgctctccaagctgagggactggtttggactttccagaagatgctttcttcagcgttcgctcatagtccgatagcttgatggcctccttgacagatgcagacatacccctgaagaagttcctgacactggggtctataggaatcttcttttctggacttcgaggcttgaattgtctcttgacttctgatgcaacgtaagcgtcaagctcctcttgcgtgcaatcgtaccccgggtccttgttcttgtcggcgtcaactttcgccttcttcgttgcccttgtgtgggcaggcggtgcagctgggggggcccttgactttgaaggtgccggaagaggagcttgcgggggagtaggtgtaggagcacgaggaggagtcggtgcaggatcctgaggaggagtcgatgctggagcctgaggtggagacggtgctggcggagcatgaggaggagacggtgcaggatcatgaggaggagatggcggagccggaggagatggtgcacgagacgccgcttgtcgcccagggaggatgatgtaccgcctgcgccatagaataatggcatggcttgtgtctcgtagatgcgtctcaccgtctcctccagggtaatccagctcgaggtcctcgtacgcgccttcgaccaactcaacttcgaccttcgagtatcctgctggaatcggcctgcagtggtaagtacctgaagggtccgttgggatggccatgcccgacgccaccttcatgttgtgagagattatttattagtaatcaacatatataagcaggaactagcggaatggctaaatcttacctttattgataagttcttgaaaggaatatgcagctcacatggtgtccgctgagtgatgtcatcaacgggacaggtcgattcgtcctgtgtttgcatggcgtccatgctctgcgatcctacctgccccgttgaggcgcagctgctacggtttcctgacgggctcaccattgcaggaggaatggtcggctggggatcatgggaccgatgtgcggccatgcgttcatcaaccttccttgccacctcctcttgcatgttgagttcgtagctcgatacccggaactctaggtctgcaatcttcgcctcggtatctctcttgctcctcatccgactcctgtacgtgtggatgtcctccttgaaaccaatcttccaaggaatcacccctttccctcgtgttcgtcctggatgctctggagtctgcagggcgagtgtcagctcgtccctatctctgtcgggtcggaacgtgccctgagaggaggcttccactgcatctgttagtcgttgcgcagcctctcgtatctgaacgccgaagaccagtgagccatcagctgggttgagcgttccaccgtaagcatagtactagaacttcgatcgttccggccaattagcggtggccggttcngnaatnnanncncccccttnctnncaaagcaaaagctagcctccatctcctcccacttcggcatcgcgacgctatagcctcctgaccccaagtggtgatggtacttcttcttggcggcattttctttgtttctttccatcatcgcctgcccttgttcacctgtcttatatgcaacgaactcgtcccagtgatcccttagctttgggaatgtgtcgaagttcggtgtctgccccttcagtatatacttcttgtacagatctcccttgaagctctgaaactgttctgccattttcttcagagtccaccttttcactttgtcctctgtacccgcaggaagggtgaatgtctcgagcattgtggtccacagcatctctttctccgaatctgggacaaagctctcatgatctcctcgtgcccttgttcttcgccagtacaccgtactgacaggcacgttatcccgcacaacccaaccgctgtgacgtacatagttcttggcggcttcggccggggcactaggacgtccatcttcttccacttccgttatgatgtgccgaccctcaagcttcttcgctgcacctcgttgcccgcgtgccctcttctgtccaacggagggttgactaccactagcctcctcctcctggttcccctccacatccctttccacgtgcccctgctggttcccctccgcatccctctccacgttcccttcctcgttcaagtactggtttggatcctcgttcccctcttcttcattccagtactggctgcttccctccgcgattgtatcgtacaatatctgttcctcatcgcggtcagccatctgttgatacaagaaacatctgctaagtcacgacacatttatgttttaacaatctaagtcatgtatgctaagtgtaaatgtcgtacattagaaccctacacaaacttacgtgctaagtctaattacaaatcgtgatataagctaagtctaggtgacgtatattatacaaccctagctagtaaataattatatactaagtctaattacaaataaagtaatcttatattaaaactcaaataatattacatgctaagactaaaatagtcatgtatgctaagtgtttcgtgcatatatgctaagtctaattaagacaacaatagtcaattgctacttgtcgcaccatttccgtagtaaataattatatactaagtctaatctcaaataaagtaatcttatattaaaactcaaataatattacatgctaagactaaaatagtcatgtctgctaagtgtttcgtgcgtatatgctaagtgtaattaagactacaatagtcaattgctacttgtcgcaccacttccgtagtaaataattatatactaagtctaatctcaaataaagtaatcttatattaaaactcaaataatattacatgctaagactaaaatagtcatgtctgctaagtgtttcgtgcgtatatgctaagtgtaattaagactacaatagtcaattgctacttgtcgcaccacttccgtagtcaataattatatactaagtctaattacaaataaagtaatcttatatatatattcaaataatattacatgctaagactaaaatagtcatgtatgctaagtgtttcgtgcgtatatgctaagtctaattaagactacaatagtcaattgctacttgtcgcaccacttccgtagtcaataattacatactaagtctaattacaaataaagtaatcttatattaaaactcaaataatattagaacactacacaatcttatatgataagtctaattacagggctaataatcttaattaattgcattacaaatataacaatcatttatattattacgtcacttgcctgctccaattccttctagggctagctcttccactcaggcttgacggacgactccgacaacacgtcttttctgcaagatacaaaaagatgtatatagtcaaatgcgaagtaacatatacatatatatatatatatacatatatatatatatacatatatatatatatatacatatatatatatatacatatatatatatatatatattgcatttcacgttaacgttcgttcgatcgttctcgttctcgttcacgttctcgcggcaacatacattgacgtgttcgttctcgctctcgttcgttcgatcgttctcgttctcgttcacgttctcacggcaacgtacgttgacgtgttcgttctcgcttctcgttcgttcgatcgttctcgttctcgttcgttaatggcggtgtggcggcatcggggcggcggttggcgccgtggagacagcggcggcgtggcgacggcgtggcgac

SEQ ID NO: 68884 - DNA, 3850 bp, Oryza sativa
aagggtgtcttcatttgataggaggatgctagggttaatcgtcaccgtgaaagggggttgcccatccaactgatcgtaatcctcgtcagtcttgtcctcaactccgatgatttttcttttgcctgggagaaccacgtgacgcttaggctcgtcaggccctctacccttctttcctttgctagacatgtccttcatgaaaaagacttgcgttacatcattggcaaggacaaaaggttagtcgagtatccaaccttgttaaggtcaacagttgtcatcccactgtcatcaatcattacgcctccaccagtcaacctaacccattggcaccggaacagaggaaccttgagaggaccatagtcaagttcccatatgtcctcgatggcaccgtaatacgtggcagttgttccatcgtgtcccatggcatcgacacgaacagcgctgttttggttcgtgctcttcatgtcttgggctctcgtgtagaatgtgtacccattgatctcatatccctggaatgtcgcgatcgacccagacggtcccctcgccaggaaggcaagttgttggttgatcgactcgttacccatgagatgttgtcgtagccacgcggggaaagtatcaatgtgatgccgtgtaatccatacatcggacttaccgatgttcctggcgcgaactagagccaagtgctcctcgatgtaaggagctaccaatgaagagtgttgcagaacagtgaaatgggctttacggaataaattgttgtcccccgtcataattgctttccttccgagagttccctttccccgtagtctcccttcatggcgtgattccggtaccccgattgggcgaaggtcttcgataaattttacgcaaaattcgatgacctcctctgttccataacccttggcgatgcttgcctctggacgagcacggttacgaacatacttcttcagaacgcccatgtacctctcgaaaggaaacatgttgtgtaggtacataggcccgagaatacggatctctttcacaaggtgacaaagcagatgtgtcattatattgaaaaatgaaggtggaaatatcaactcaaaactgacgagacattgcaccacttcattctgaagggcatctaatctatccggatcgatgaccttctgcgaaattgcgttcatgaatgcacatagctttgttattgttgcccggacattgtctggaaggataccccttattacaactggtagcagttgtgtcatcaacacgtgacagtcatgagactttaggtttgtgaacttcttctccttcgtgcttattattcgcttgatattcgtggagtatccagacggtacctttatgctctccaagcattcaaacatactttccttctctgccttgctaagagtgtagctggctggactcaagtaatggcttcctttctcctttggttccgggtgaaggtcgccgcgttgttccatatgcttcagatcattacgtgcttccagtgtatctttcgactttccgtatacacctaggaagccaagaaggtttacgcaaaggttcttagtgaggtgcatcacgtcgattgcgtggcgtacgtccaagaattcccaatatggtaactcccaaaatatagagttctttttccacatcgccgcgtgaccatcttcgctctctatatgctggcttccagggccctttccgaacactactttaagatctttaaccatagcaaacactgttttcccgctgcgatgtttaggcttcgtacggtggtcggccttatgttcgaagtgcttgcctttcttccgtaccgggtggtttgctgcaaggaatcgacgatgacccatgtatacaaccttcctacagtgcttaagatacgtactttctgtttcatccatacagtgagtgcaagccttgtaccccttgttggactgtccggataggttgctaagtgcaggccaatcgttgatggttacgaacagcagcgctcgtaggttaaactcctcctgtttgtcctcgtcccacacggggacaccttccttcttccacaactgtttaagatcctcgaccagtggtcttaggtacacgtcgatgtcgttaccaggttgcttggggccttgaataataatcggcatcattatgtacttcctcttcatgcatagccagggggggaggttgtagatacacatcgtaacgggccaagtgctatggccgctgctcatctctccaaaaggattcatgccatccgtactcaaaccaaaccgtatgtttcgtgcgtcctttccaaattctttaaattttctgtcgatgtttcgccactgcgaaccatcggcggggtgtctcagcatcccgtcctgttgacgctcttcagcgtgccatcgcaacattctagcattccccttgttcctgaacaaacgccttagccgtggtattatagggaaataccacatcaccttagcaggaattctcttctttgttagctgcccgtcaacttctcctggatcgtcccgtctaatcttgtatcgtagtgctttgcaaacagggcatgcttctaggttctcgtactcctcaccgcgatataggatacaatcgttcggacatgcgtgaatcttatgaacttccagtcctaacgggcagactatcttcttagcctcgtacgttgtctcgggcaatttgtttccccccggaagaatgttcttgacgagtttcaataaatcgccaaatgccttgtcactaaccccattttttgccttccattgcaacaactccagagtggtatccaactttttgtgcccctgctcgcaacctgggtacaacgaagttctgtggtcctccaacatcttgtccaatttatgggcctccttttcactttcgcagtcctccctggcgtcctgcaacatttgaccaagatcatccgcaacgtcgttaccatcagcagctatttcctcctcgcccgtttgatttccttcaaatccaacaaattgagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaaccccttttcctgttagcttcggccactctcaaaaaatagtgcacgccgtcaataaactctttggaccgccggtcagcgtacatccattgccgatccatctacatgagtcaaaaaaaccgtacacaaataattattcttacaataatgacagtcatacaataattataagatatctttattcatacaaaaatcataaaatattacaccaaataattcttaaaaactatttgttaagtaataaactaattttaatgtgttttacttcttttaattttcattttagtttgttttctattatttaagattaactttcactagagttttccttctcaactattttataaaaccttatttagcaaatgaactaaatttctatatattctttcttccccacacacattttctctctcatcaacttacaactacattttggagacaaaaaaagtgtgcaaaacataggtgcaaatgtagtatgacaaaaaaaacattggaggatgaagttgcaaaccttttaggcacctccgatttgtatgtaatcaccaaaataaattcaatagaaattttggcatgacctcccctcttttttgaagaaattttgaagcttgctcgggcagctggaggaggaagaagacatatatataggggtgggactttagtcccggttggtagcaccaaccggggctaaagatcaccgggatct

SEQ ID NO: 68885 - DNA, 2079 bp, Oryza sativa
atctttagtcccggttggtaacacaacccgggactaaagatcaaatatgcccgttaccctctttgaaccgggactaaagaacatctttagccccggtttttattgcatccgggactactgtggaaatcggccgaccgacgaaagatggtttctccaccagtgtcatgcttaaagaacatttgatgatgaatcgagtcacaataaaataaatgttaattgtataaattttttgaataagacgaatggtcaaacgttggataaaaagtcaaccgcgtcatacattaaaatatggaggtagtagcatgtacattacataggtgaactgatgagccataaatattaatttcagcaattccagacaattgcaaaaataaaagccaattctaggcaacttcacaaataaaaacatatagcttggttacttacatctaatcctatatatgcaggtggaaaaataaagtgagcacaaaccttagcatattccatgtgtgattttgtaataaatgcttgcatgaaactataccaactctatggaatgaatccaggaagcaaaaagtgcagagaagcgtagttggaagttcatgaaacatttttgtctgatatatatatggaggcaattgcaggttgttggttaaaaagaaaaagaaatcgaataacacaccaaagaaatcttgcaaagttattttacgttagtatagtgaattatttggattgatcagagatggtaaagaaagaagcacttggggacttggagagatatatatgtatagagagactgggaaaagaggctagatatattgccgcgctgttcttaaatcacatggcagctcggtaggtgaggctctattcggtgccaagggtggatttagagtgtaacaagtgagggccttggcccccacttaaatttgcagtgagtggggacaaatatcccttgacactttttacttccttaattagtctacctgagcggtagatccttggcccctactcatgctactttctgactccgcccctgttcggtgcctgcttgcatggatcgaccttgtcagatgtagatggagacagtggtcgcatcgttcactacctgtgattatggatgagatgatcttcacaaaatatgggaaaattcctaatggagtattgacgaagatcgatgccgctcacctgcaagcgaggcaaataatttctgccgccggtgccttttgtgctcgttggaacggacgcaaatggacgctacggcctaggagaaaggtgagagtagaaattacggagtacgtcgataggtgatggctgggcttctattctatatatgagagctgcactgttcttgggcttgatctgtcagtgttcagaacttcagatagcttagaaaaccagatcgctgttggatggaggtgtcaattaatcgaattttgtttgatgacgcggcttcacctggaactgtgcacaaggtatgcacgtcgccgtcctcgtacgttgccccctccggtggataagaaacaacagcaaaccgcagacacagtacacggatatagcgtgaaaggcaccgaagaaagaagaaggctgcaaagatcagtacagaacccactacgatacccataatgcaaacgaacacaatccatgcaggccgctgaagaagtccgaatggtaaaagcgactcatatcctgcaacaatgatttttaaagtatatattaaattttattttgcacaactgttgagcagaaacgaagtagaactgatgataataataaatgagtaaattttgaaataataataaattagtgaattttagaaaactcatatattttgcggccagtgtaacacgtaaccacagctccttacttattttatcacataactgctgtttttttcttctggtcgaacagggcatggcggcggttcatcggcgccggtggcggagcaggccatggaatggagagagaggccagttccggcagcacagtggcgtgcggcgactccggtagtaatcttgcgtggcggcgggctcgggcaagggatgcgcgaggcagcgctgccaaaccagggatgcggcggcggtggggggggggggggggggg

SEQ ID NO: 68886 - DNA, 15038 bp, Oryza sativa
cactcgcacggcgaggttccagcggcaatcgatcatggcgatcgaggaagttgtgtgggttttgtagaacgtggcatggtgaactcgaaggtataattaacttcagttttgaatgaggagaagctacgctacgtacggcggccggtgaacttggcgatttctctccggcggccgagctaattaacgtttcatgtccggccggcgacggcgagagaaccgaggaggaagaggagggttaaggcggtctcattagttacctttttggctagctgcagtcgacgaggctgctcgagctcgaagacgatgaagatatggaggtcgatcagggtcgagcaggagtgatcgatccgcggcggtggcagctggcaacaagcttggttgagcgcgcgcgcgagctcgatctcaggtgtgggggtttgctgctgcggtggcggcagctcgatcgcgcgtgcgtcagcgtgcaaggacgaagctagcagctgcgtggtgcgcgcttgcggcaacggcggtgacaatcgaccggcgttcacgcgcgcgcgccgctcccccgtcactcccgcctcccggatcactctcactcccagctagctaggccaggctaggccccagcgcacgtgggcccaaaccatctccgtgggtttctaggaatgaatttatttataaaacataaatttgagaaaagaaaaggtgaatttcacaaaactactacatatgagatacgctgaccaaactatcacaaacctatgtatttaatattgaatttatcacagagctacagattttatagtttaaatcactatcaccactattatgtttgtatagttttattacaaaattggttctccgaagaagcaaaaacagattttgcgaaaaaatatatacacaagttgttattgtataaactttaaatgtataaattttcgatatataaactttgcataaataaattttataattttaaaaaaataaagaaacatttcgcaataaaaaatgaagaaacaaaacattgatatggcctgtgaagcttatatataatctctagatgctctctacccagattcaccgtgcatctatctagaaaaggaaaggaacgaaaagtactaagcccaaaagaaaaacaacgagatcggaggcccaaatagagcaatctttgtctctatgacataactttttttttcagaatttcagttccaatgataaatttattcaacacgtcacgagaaatgccaactattcctagcggaaaatatagtggcttgcgaagcgcgttaagtaatagtaagaaaactatgctagacaaaacttgttaggcacctctatttgtatcaagttaattactaaaactatgctagacaaaacttgttaggcacctctatttgtatcaagttaattacttgaagtaattctacttctattttcagataggagctcttgtttatgtcatgaacaaaatcaactatagagagtgttctagaaagatatactaccatacgccaactatacaatttccatgaaaactaatattaacatgtttcatagggaatgtgtgcaaagctatttagctgcagactaaacgatctggaagaagtattaatgtttgatgcccaatgtatagaatgtgtgcaatgtttcatagtgaatgtgtgcaatgctatttgatgcccctctcgccatggcccaggaacggtggcttcttgttttggtagtcactactcactagaagaagcaaactagtcaatgatcttactattatatagttgcgttatttagaaagttatgtgtgtactaaaatttaaagtatatgtgtatttctctgatgtttatttccggacatcctgccgctcaggcgaccgccggagccggggggcgctcccccccccccccccaaaaaaaaaaaaaaagacgtgtgcacgtgctcctggccccaccacatgtccctgcccccacctgctacatgtctccaccacatactccgttgcaacaaatcacccgcatattttggaaaccctacattaagagaatttgtttctttttttttccaaaaaaatgtttcactatgtatagatctaatgttccagtgagttgaaacattctttttaacaaatcacccgcatattatggaaaccctctattaaagaaattcgtttcattttttgtttcacaaaaaatgttttgtaattataatgtttcactatatatagatcaaatgttgcagtgaactgaaacattttttcactatttgttgaaacattatttttatataagatgaaacaacgcctgatttaaatgattgaaacattttcgatctacttagtgaaacaattccgatatacttggtgaaacaacgtgcaacatttaaaaataattcaataataagctaattttttttcgtcggaatatatccatgtgtggtcttgtttttaaagatttaattgcaacgaatttaatggtgcaatcggatcatgatttggataaataatttaagagaaaaaatagtttaaagtgtttttgcacgtatgcatcttgctgacgtcagcatgacgtggacgcccgatttttcaccctggatcaggcgcccgatgtgtaattgcctttgtttatttctctatgaatatctatatacttacccatggagctgatgactttgtcagaatgcatcatgcatgtcagacagtggtatataataaactgagtataaaacacattctacataataagttcgttttatgatctgggcaaagggcagcgtaaacgtaggtcttgattctgcattacacatgaagcttgccgtctctaaatgccgattcttacaagaacaaaagaaggaacaaaacaaaatttcatctcccttcaattatttataagaaaaagaaacacctagctctcacaaattctacctctaggtgatttacccataatagaagaagagatgaacaactcaaagagggtccaaatacagagccaagtgataagcatgcatttaatttgcataagattagtttttttccgtattgtggcctaagaaccatttttggagggaatgaggaaatttatcactggattcggtaaaacaatgtgaagggaatggatttattgcacccataagtgaccaaaaaaaatcaagcataccttgaaataagatttgatattctcatttgaagtccaatgtgacaatcttacagcaagaacaagagctgatagtaataagactattgaatatcctgccatcacataccattctggaactatcaagcaatgactcacagtcacaagtcacaaccccttcccttccaaatgtagcaatgatgatacttccaaaggctcttttcggtgtaaagatgtttccaaattgatggattatttcagagggattgcaaggtgctcaattggacatggtattaccaaattctaaatgggaggatgtctggttggatggacccccaatctattttcagttcctaagactcttcgatcatttgctgttgatggaaatgtttctgtgaaaagctttatactatctaatcttgaagacaattttcaactgtctctatcacaacaacctcatgcagatttcttaaatttgagggaattgataaatgaggtgaatgtgggacatgattgtgatcaatggaactacatatggggcaatactagatatacttctaaaaatttctatgcactaaacttcagagcaatacaacctcaccacttttgttgtactccctcagtttcaggttacaagacgttttgactttggtcaaagtcaaactactttaaatttgactaagtttatagacaaatataataatatttataataataaattagttttattaaatcaataattgaatatattttcataataaatttgtcttgggatgaaaatgttattattttttctacaaacttagttaaacttaaagcagtttgactttaactaaagtcaaaacgtcttatagcctgaaacgggggtagtaattattttctattattcttatcaataagtttccctaccgtggggacctcccctgatgtgttctattaaagaaaaatatagcaatgatgaaaccatgcacccctaaaggcctgaacatccacagcactgggagtccgtattgtgcatggaacactaaaccctaaaacccttctgaaacaaggaaaattttcaaaaagaaaaaaaataaagaagtggagtatttgaaattttaaatccataagaatattccactgaagtccaaaagaacatatacaattaaatccctgtggaacagcttgtttcgtatgaatttttacaaaaaagcaaacgtaaggtaagacctcatgctttctccttctgtcttgattttcgatatttttcctatcatccaaataattcaaaatattcccaaaatttttatttgcttggtgcctatctgccaaagttaccaaacacaccttgttctcgactacattgaggagtgcctcggatgaaatgcctgagctgcagaataagtaatgatcattatctgttagacacaatgcacacaatgtttgggtgtaattatccaggtaacataccgatatttagatggcacttaccctacatcgaagatgggtatccaaaacgtgtcgcatgtctgtgtgaacaagtcaaaggaaccaaagtcgtccagtccagaagcagaatagttggagaggctggcttggtgacccaggaaagcggcagagcagaggctcaaccccaagcatatcatatttcataatccatatgcagcaagaagcctgtgttcttagtattcagcaccaactgtgtggtgatggcccccttgagtgcaggggtctctccagcctctgggaaatatggcagtaacttcctcagtttaagctgtgaaccatttttggagtgaatgaggaaatttatcacttagatttgataaaacaatgcaaaggaaatggatttgacacccataagtgccataaaaatcaaacataccttgaaagcagatttgatattcttttgacatccaatgtgacaatctgacagcaacagctgttagtaacaagaatatcatcacaccattctggaactatcaagtaatgcctttccttccaaatgtagcaatgaggaaaccgggcacccctgaacatcctcagcacacaatccgttaagatgcaaatgactggaagtctgcattgtgcatggagtggacaaacaatttgttactatacttctctgcttgtcaataagtctgcaatttgcattacctctacgtctctgatagtatcgttataatattttgtgcaggtataatttctcgttacaatgcacagatcctcttcatccagatatgtatcttccatatcataaaccttatgtcagttccatatacaggtgctccaggatagtataaatctcatcaaatttgggatggtagaagtctcctgctaagaactcatgaacaacactatccacttcaacccagctgcaccctgctgttttgtcaataacctttctcctcatcgatagctgcacatcctcaacagcatcccattgctggcctcgagctagggtgtttctgaggagaacatagttgccaggattcttgggttcaatcctgatgagttccttcgctgcaatctcaccgacatcaacatggcaatgcttcctgcaggcattgagcaatgctccccacacacctgcatgtggtttcactggcattgtcttcacgaaacagtgcgcttcttcaatgagcccagctcgaccatatagatcaaccacacaagcgtagtggtctggggattgctgaactgcatatgtggttttcatcaattcaaagtagttctttccgtattccactagcccggcatgagcacaagctgatagtacgccaagaaatgtgacggcatcaggttgcaacccagagtcaaccatcgcattgaaaagatccaatgcatctcttgcatgtccatgttgcgcaaaagcaatgatcatcacattataagacactgtatcctttggatatgtctcagtaaacaagaattgagcttggctgatgcaaccgcacttggcatacatgtcaatcaacgaattctggacatggcaattcatctcaacacaactcttctgtaaaagtccatgcacttgccctgcaattgtcaaagaaccaagctgtgcgcacgcagacatcaaaacagccatcgtcgcagcatcaggctcgaaccctgtcgcacgcatcctattgaaaaccttgactgtatcagccaacgatccttcctccgaacatgcggcaatcatcgtgttccagctattcacattcctcactgtcatctcatcaaacaattccctcacagtggcagtatcccccaaatgcagataaccggacatgagtgtattccacgagattgggtccctctctgccatcccatcaaacacctctcgcgcggctcccatatcaccggcccttacattgcacgccaccatagtgttcccgaccaccacgttcttcacgggcatttcgtcgaacaccctccttgcatctcccaccaggccaatattcccgtacagatcgagcaacgcagcgcccacgtgcacggaggagcagcccagcccggccttcgccaagaacgcgtgcacctggagaccctcatggacggctcgcaccttcgagcagcacttgatcacggaggtcacggtgaaggcgttcggccgcgggcccgaccagagcatgagcgcgaacagcgcgaccgcctctcccgcgacctcgagggcgtgcgaggaggacgacgaggcgtgcctcgcgtaggcggagatggtggccgtccataggtacacgttggccgaggcggcgggtacgctgtcgaagacggcgcgggcgtggcgcggcgaggacgacgacgcgacgagcgcgacggcggcgcgggcgggcagcgggaggccgcggatgaggaggtgcgcgtgcagctgcctcgccgccgccgccgccggggacgtcgcgccgcggcgggcgaggccggtcaggagcgcagggagcgggggcggcgccggcatcgaggacggagttcgcgcccgcgtctcgccgccgccgccgccaaatggctttgcggcatggaggtggagcgcgtgtgcgcgcgaggggattttgctcttctacactgtaaaatttgatacggtctcaaaaataatctttggcttatgatttctcaaaggtttatagcaaaaaaaaatattaatttcaaatatcaattcaatgataatatcttcagcaaataaaatttaatttatattgtactaattatgggtcaaatattttagtcaaatcttataatgcgtgcacgtcttatattatggattggaggaagtataaatatttaaatatatttaaatatcaattttcctcgagcaaaaacaataaggcatattgttattgaatacatccagtaggtggattattcaatctgttggatatgatgacaaatgttaaaattgtgtaaaatagtatgaaaaataaaatatggctttctttttctgaaattgacacttcaaaaagttattgtgtatttgtgtatctccaaaaaaaaaaagaatcttatttcgtaatggtttcatgaaggcttaaataaaattatgattctcatagatctcgtttaacatgtcaaggagaaatgagtattacaacagcacacattagattccaagattacaaacatcagcaagcccttttttttttgtgcatgcttgataatttatccagcactcatagacccaaaaaaaaaaaattgcacccttgtttattattactcacgtcagattgatgtctatacaagttagggagtactcccaaattattttcgatctataaatggcattatggcactacaaccttggcagtatggcactcttcctttgtcatctcagtcatctgttcaagttttcttatgcttttccatgcaagaacatgtgaactggagactggagactggagagactggcaaattataacgttgatcacaaatccattgttcagctgtttgtcccttcatctattgccctcagagtgtggcgaatggcggttgtttgcaccagaaccagggtaatcattgagctcaaaccccatacttccactacgggtgaattccgattcttcaaaatcgatagcctgaacgttttcaaaagatcatcaattcagcagtgttgtcagattcagataaacagactgaacaaaaaccagggcggtttttccatgtatatatagctgatcagatagtctccaagatcttatacattatatatagcatcacataaaaggttttcgaatctacttcaaactgctgtataaactataaattatctcagaaatcaaataaataggacccatgaatcaaaattgaaacatgagggagaatagcatctatatatagactggtttacacaacttaaaagctgcagcgagaacaagcagctagcatctctttgaataaactgagcaaaaacgaggatagatagcacatctaatgcatgatctgagttctgaaaacaaaaaacctgtattacctcagtcgttgcatcagaggttggagttgctttgctttcctgtagcactcttagacctatgaatggcaaaacaaaccaccagaattaagaagagattaagatccatattcactatgacatgggatagagtttgagaatattgccatggggaggttcactacttgatacatgaatgaaacaacacgaaaccaaaagcaccatgactatatatggcaaagataaattcctcatcctcctacgatgtcctgtgcatatatagttgcttctctaatttctgtgatgtttgcataggacagtgaattcattggtcttatatagcagcttatcatggattaaaattctttgctcaaaagttgtccacgatgatgtgtagcccatcaatcaaagtccaactattccctttactttttccatgatccactttcttgcaagtgaagtgaaggaaacatttttcaactgagactaagaattgtgtgcacacatgacatgcctctggcagttcaaagggagctctctttcgtagcaaaatagcaggtatgctttctcttaataaattaaatatagagaataaagacaccgaatcttggtgattaaaattcttatatgccttgagtatgagtacatgtgccacagtgttacagccccactacagcgcctcagtgcaacagtataccacaaaatcactggtttatgacatggtgactactgtggtggaacttcttttgttattgactattctactacaacactttggttgatcagacaaaccatttccattatttgtacctttgagggaaaaaaaagggtatttcttatcctgaagctgctgcatcatgcatgtaaagttagtactagtcattttcagtacctaccaacttattttcttcattgaatatgctagtggtgggttcagcaccaagcattcagaaaatgaatgtcttatggaaaaagtaaaactgcacctaaatcaaaatctccacaacaatagggcattgacaatgcaaaaggcctaccggcatattagtaatagctaaacatctttctcacttcttaaatcaaagaaaaattaacttctagatgtaacctgaaaatattctcaaggacctaaaaggcaccaaataatattgtgttgatattaggggaaaagatagatgaactgtatcactgatgtaggtaaatctgatttctcttgctccaaaaaagataccgaaaggtaaatgaccaaaattgtactgtcaagattttttctctgtgtgctgtcatcttttgccagatccgagtcatattccaccgaagcatatgcaattaggtaagacaatttctaactgcgctcccatagtgtgcgatgtatcggtattgcactatggttaattggtaattttgttaattacttccgtatagaggtacagaaatttagatatactgtgcataactcagttggatacaacggaagaagatgaatgaaaaagcagctcttgcaaacaatgatgaactagtatacacaaatttgtataaagttcacattaaccttaaacaagaagctaattcacataaaaaaacagtcaaatttactattaagtgtaaaactaaccaagcatacgcaagagaacattgtggaatactctgtaggaaatgtaatgcacaaacccttgcagtggaattggttcacaaataactactgttagctctatattattgacagattgagataatcctttcataaggtgccagctctcataagcatgtcatttattttttgtctccagttaaagcaacatgatagagacatagattaaattgcagctcttcagaaaggtttgggtggggggagggagcgggtgggggatgttttgcaaacccatgtttaagagaaccagcttcatgtcttttcagcacaactgcaattttgttctcacacaacatctcaattgaacatgtcacttccacaataccccttaatcaagagcaaaccaattcaaaattggtccaaattggtttcatccaggccagccaggcgagaactaatgaagtgatttcatcaccattttcatattattgacatcctcctccgtactctcatacttcaccggcttaaacagcttccacagcccaacaggatgccgccaccgcctcacctccttccccttctccctaacaattcccccgaaaatcctctcgcactccggatacggcttcacaaacatattgtagaacctctggcgactgaacctcacataatgcttcatctcaattgggtcaccgagcccgccgattgaccgcaggtgctccaccacattgtgccgcgggacgatccgccgctcgaggttcacccccaagaactccgggaactccaccagccacccaatctcgaaccccatcctgctcaccaagaaatccaccttcctctccacatcctccaggccgtacaggatcgcccgcggctcggcggcgaggacgcgcagcgcgtcgcgccgtgtcagcccgcgcgcgtgcaggagctccacccgccgccgcgccgccacggcggcggcgagcgcgccgcccgcgaggacccggtccctgacggcggcccggcaccggagctcgtcgcggacgagccccacgaggcgggtcggctccccgggggacatggagaggaggaggccctccgcgtcggacgcgagggcggccctgatctcgcgctccccgaggcgcaggccgcggagctcgtcgcggagttggcggtggcggtggtggtggtggtggtgcggcagcttcgagctggtggggaggccgcggcggaggagggaggcggactccgcggcggtggggccggcggtctcgtggaggctggaggtggcggcgggtcgtgggccttcttggcgttgcgggggtggggtggaggaggaggtgggggtggagaggatgcgctcgatgcggaggagctcgcgggggtcgggaggcgaggaggagaggggcatggagtggaggagaggatggcgaaggaggcggcgggggagagctcggagagcgagagccatggcggcggcggcggcggcggcgccggagataaaccaccgtttgagatttctccgttctgatggtgatggaggggttttcgtgttctcaaatgccactctctcggatgacttcgctattttgccattagagagagaagatttcttactcgtgtgctatttttgagcccgcaaggcgccaagtcacccaatctaaggataaaatgaccatcttgcccttcttcttcatttctcctcccgtctctttcatccccttcctttcccaaggcgccgaggttattgggctccggtgagctccttgccttgcactcttccctccttcgctccgctctttcttttgtggcatcatcggtgtcttgctccatcgtcatcgtcgttgcctgcctcctcctctcggctcttctccactctcccacgacgtcaagtcgttcgccacctagcgctaggaggttggtccggcggcggtggtggcggtgtcaccagctcacacgtagggaggaaggttggaggagagagaccccgagctagaggaagaagaagggcaaaacggtcattttaccctcggattaggtgacattacgctttgcgggctcaaaaatggcacacgagcaagaaatcttctctctccgatggcaaaatagcgaagttatctgggagagtggcaaatagtcctaaaaacccggtgatggatgcctgaaacggtgtgggtatgaactggccccactggtcagtgactcatctatgaggcaaaactcatcttggctataattaagggtggtaatgagcccaacatcttgacaaacaaaatgtgagggttgggtaaaaatggttgagctgaaatttaaaactccctccgttccaaaatatagcaattttatactggatgggacacatactaatacaataaatctggataggggtactatgatgtgtcctatcccgtacaatgttatcatattttaggacggagggagtactattttttttctataaatattaaagagttgaggtgagttgtgaaaggatccatgagccttgacccattaccacccctagtgggccgtagcaatgtggacctcacatctaaagcaagcaagcaccatgtgagccatgcaatcaaaacgagttactccctcaggaaaaggtcatttggttcacgttttttaaccataaaaccatatatgaagactttcctaactattaaaaccggcccaattgacctccctatccttgtgttacgtggcagctacgtggtgcatgcttacgtggtattccgatggtcgggacgacgtcgcgaggagcgtcaccgaggggatggggggtggtgggtacgtgcagatggtggctccctcaggcctcaggcttggtgaccgaaagggcaacaacggtgttgggacagtggccattgatggtagtgccgagctgatccctacatccatgcacacgctcgatgagtggaagtgattcgatctagttggagagatcggagggagagagagaggaccagctatacagatatagagaggagggatatggagcaggtggttaccattacctctctgcaccggtcactgggttccatccaccacggccatctagaccacctcagccaccagtccattggccccattaggtgtgagcccgtgtgacaagctcaagctcctagtgcccgccttgtcaagcttgagtattgcggcgacgaagcaatactcaacgcaaaaacctcaccggcacctacagcgatgaagcaaccttcttctcccggctcgtcaccaaccacgtgtcaacagtccactccatcgatccatagcattgacgttagttaggatcgatccatgccttcgtagagcccgatgccaccatgaaggagtagagttcgaccctaccagtggggatagcaagctccggcgtggagcaggcaaagatgaaaaagaggagacatgtgatgggggaaagaggagaaaaagtcccattgacatgtggggccaacaactctttttttattattgtaataacatatcgcttgaggtaaaatgaaccccacatacgacaaaatcatcgtcgaaaccgcttgaggaggaaaaataaactggttttaatacctaaggaagcttctatatgtggtgatgaatcgaactgcggctatagttgaggaagttaaaatggactttttcctactccctctcgtgaaatcgtgtttttgcgataatacttttgaagccagatttataaatataacttccacgtgagcaacaacttttgtgtattcatctcaagaaaagaaaacgagtacgtgttgatacgaactttgcattatccagacagagtcacagaaatcgctgaaaacaaacatccacgaaacaaactaccacatgaaacaaagtgattttgacagtttgtgggaggccagcttgacagttgacaccatgaaggaacaccatacagcagtcctaaaatcggaaagaaagtaaataaacaggtagtaaaaaaggaagctgcaagacatcagtagcttctcatcaatacctggtagtaaaaaagaagtcgaaaatgaaatctccatggatgtgcaaagcaaatcacatacccaacctaatcataaatgtagaccgcatcagattaactttctgtaaatccacatagaaattgtgctaaaataaatctgactttcataatgaacttatgaacacaagcagttccactgggtcatgtgaaatcagttgagacttccacagtgaacactgaacagttgaccagatttagggggtaataattttctagtaataaacaatgcatatttttccttgtagatgatttgttggcaagcaaatcaaacttcatcattttatgaatcgttatagaggaatatatgcatgaccaagtagagtgtattctttttttgtcattcggagagtgaaaataagcattattctcatgcttttcaggggaaattatcaaagggtgagagctcaaattgtcatgaaagagatgccaatatggtagaggaagagcttcatcttttctatgaattttagtccggaatgtttcggttcttgatatgctgtaacttgctagaattttaaataatggaattcatcctggccttgacttcagactcagagaagctacggccaacaaggaacttgctagaccacaaggtgataataataaatccttcaatccttcttgaaaaaggttgtttctgttagttagcatgaaaggttcggatcatgtgatcacgacctgacagcttgcatgcatgtagttgttgaggttagtttggattaggttagtctatccatgcggatcaggttagcctttcctccacatgcgataacagatgtttgttagagtttgttttctgttttctgttactacatgcagtcgtttcatcaatctcggcttcggttgttctcagctgcgccgaactctgtatcgccacgatgggggctgttcccatcacatatatattaacacgaaggcgacgcaca

SEQ ID NO: 68887 - DNA, 17439 bp, Oryza sativa
  unsure (1)..(17439): unsure at all n locations
tcaacctttcccattgtaaaacctttcgcaagcaaaaagttcttaagcctatcataccatgccctaggagcttgtttcaaaccatacaaagctttagacaatttaaaaacatggttgggaaaatcaagattttcaaaacctggtggttgtttgacataaacttcctcctatacaaaaccatttagaaaagcatttttcacatccatttgatacaatttaaaaccttttgaagcagcaaaagccaacaaaagtctaattgcctcaattctagcaacaagagcaaaagtttcatcaaaatccaaaccctcaacttgtgtaaaaccttgagcaacaagtctagctttatttctcacaatcaaaccatcctcattttgtttatttttgaaaacccacttggttccaataacattatgtccagaatgtggttcaactaaagtccaaactttgtttctctcaaaattttcaagttcttcatgcatggcgttaatccacgattcatcagttaatgcatgtgacacatctttgggttcaaaagaagcaacaaatgcggaatttgcacaaacatcatgagtcgttaccttagaccttgtagtccgctcacttatattaccaatgatttgttccggcggatgtcgtcgttgaatgtgcaaaggagcagcaacttctgaagttgatccacgttctgtttcagtactgatcgaagttgaattctctggaggaccatctcgatcagcaccaacagtacccgaacccgacgaccctggccggtctgaccgctcctcatgtgtcggtctgaccggaggtgtgccggcggtctgaccggcctggcgcccggtctgaccggccgagccgacctcgtcgtcgtcgtcgtagtcgctctcgtcttcaaaaatatgaccatcctccccctgaacctgtgacagtgtacctgcaatttcaggtctagtaccaggactagcctcatcaaaagaaacttcacaactctcaacaattttgttagtccctaagataagtacacgataggcacgagtgtgtgcggggtaaccaagaaacaatccatcggtagggcgtgcctcaaacttatccaaatttccagatttcaagacaaagcacttgcaaccaaaaacacgcaaatgtgaaactttgggttgatgaccaaatcaaagttcataagaagtttttcctagtttagatcgcaagaaaactcgatttgaaatatagcaagcagtgttaatcgcctcagcccaaaattttctaggagttttgtatttatctaacatcgttctagccatctcaaccaaaacacgatttttcctttcaacaacaccgttttgttgaggaacacgaggagaagaaaattcatgttcaagacctctttcattgcaaaattgttcaaatgaagcatttttaaactctccaccattatcacttcgaattcttttcaaagaaccaggaaattcaagctccaatcgaagaaacaaaccacgaaagtgttgaaaagcttcatccttagttgccataaagaaaacccaagaatatcgagaaaaatcgtcaactataaccaacgcataccactttcctccaacagattgcactctagctggaccaacagtatccatatgtaatagctgtcccggtgcatccgtcatcacagaaacaataggagcatgtgaagtagaaaccatcttagcatgacgacacggtgtacaaaccaaatcaagatctttcttaagtttaggcaaaccacgaacaagatccaaaccacttaacctagtgagatgatcaaaaccaacatgtccaagtctacgatgccaaaacatcacatctttatcaaacttagcaaccaaacaagttatcacaggtgaaacagaattttcaaaatcagctttaaacactcttccataacgagaaatattcagcacagaatcaccacaagaatcaaaaattttacttctagttttcttaaagtgaacttcaaactcttcatcaacaatttgtgaaaccgaaagcaaattgtactttaaatccttaaccaaagctacattcttcaattcaaaattttcatttaccataaccaaacctgtagcgacaacggcactagtagaagcatcagcaaagacaattgattcagtcttggatgcctttttgagggaggagaaccaatctttatcaccggtcatgtgccgcgaacaaccggaatccacaatccatacgttctccttccttgccaccaaagcctacactgtcacagcctgaatttttgtttcaggatttaaaaattatttaataaattattaatagaatatatattaaatgttcattaatttacaagtgaagttaaatgtgggaaataaaatttcctaaatataaagcatggatggatttaatttgtattaaattctccatgattaattatactctttggaattttctcgaatttctcagagctcaattattaattttaataatacaaagaatagtttagcaattatttaattaacaaattaatcattaaatggtctggttttaatattgttaaatactttgagtgtccaagtatgttcaagatttttcttggaattatttgagcattgaaagtatttttaacaattgaaagatcatctcattggttaatttatttggaaaagtaataaaaatcctcctcctcagcttgggccgaattcagcccattctctcccttcctctcagcccagccaaagtctgatttacctccctatcgctacagtactccatcttcctcctccagacagagccgagccagccgtgctcgtgcacagtgccgccgcctcctcccaccaatccggcctccccgttgctcctttttccaaattagttgcgggaatggaatcctctcaatctcctcttccttttccccaagaaatccccaaaagtttatatggaaattctttccaatttcgcggatcaaatcctttcctttttcttttttttttgaacggaaaacagcactagagtgccttttcatcgaatagagcaggagaaaatacaaacccctaggggtaaaagaaaaacggagaaccactatagctgtacactatacagagtgtgggattaactcacgcaaccgcttagctcctgctaaagcccaaaggctcgcctcctctttgattttcattagtaggaagttcgttgccacctctttgtgatcaaaaatccgccgattcctctctttccaaatttcccagacgactaacagaatgagcgatcgaagtccttttttcgggacactaggcgtgtttgcaatgttctcccaccactgtttgactgactgggcttcctcccattccgttgggtccatctgctgatagcccacccatgcagagacgaggtgccagatcctcttggtgtatctacaagtggcaacgtggtgcaatgccgtctcagtctcgcggcggcaaagagggcaacaaccattgttctgccatcccctggtcgcaagccggtctaaagtccagactctgttctgaatgatgagccaagcatgaaatttgcatttccccggcgcccagggtttccaaatcaaggaattgaagtttgtactcggcgccccgcagcactgcgcatggtaagccgaggaggccgtgtagtgcccgttgtttgtgaacttccaagtaatctgatccggttctccaacatctaagtgcacatttcggaccgcttcccacagtgcgactagctgttcgacgaggtcgactgcgatagatgattgtgaatcaagcttaaaatcttgcacctaggcgtcctcctcctttccttgccgaagggattttcctctgttttttgagatcgcaaagacaagcggcatgaggtctttgggtctttgcccaccaatccatgcggactcccaaaatcgcaccgtgtttccgtcccctattgttatgtttgttgaggcggcgaagatcctttcctttttccggcaaatataaactttcccgagtttttcccgtcgatgtgggctcgatcccggcctcccatggctatataaaggaccccctagtcgtcctctacccatcccctcaagtcccgtccgccgccatcgccggaaacgctctccccgcgagctccctctctctccacctccggcagccgctccagctgccgtgcgccgtcgccccggccgtcgccggtcagcgccgccacttccctcggctccgcaaagtcgagctctaccccggccacccgttcttttgcgctgaaccccgccggaagtcgccgtcaccgtgaaggccgaaccgttgccatgttttgatctccaacgaagctttgccgtcgactccgtggtcgccggacctcgccgtatccactgtcggcatcgcagcagtgaggagaagcctggcagccacctccgcgaagacgcaagccatcggagcaccgtcgtccccgtgaagccgatctgttccatcttcagtcgcgccgttcgttgtcgtccgtcgtcgccctcggtcgccgtcgaatccattgggttcgcaggagcaaggtgaagcccggccaccggtttttcttcaccgaagatcgctgaaacgtcgccgccatcgctgacccgaccccgtcgccgcctctacctcgctgccggccgtctgccgtcatcatccatcgtcacgccgtccctcagtgagctttcctctctccgatgtcgttcatcggtgtagtttatccatcgggtcttgatccaatttaatctaatcttgtttggccctagcgtcgttgtcgtctccatgtgttgctatcggaacgttgtcatcatccctccctctccgatcattttggatcggtgagacgtctatccttgtctccttggtttagatttcaacccatcggccgcgcttgccaagccgcttcgtcgcagccgcagccgtgcccgttgcgttgttgttcgccgcgctgctgccctagcctgtgcaccgtcgctaccggttgtgccgttgttgcttgccgtcgccgctgcgctagtcgcctagccaccgttgtgccctccctgccacagtcgtgttgctcctgctgtgcgttaccgcttgaccgctagctgctgtttggccgctgctcgtgtgtgccaagttgttgccgtcccgctactgcaaccaccgagccactggtcgccgtgctgtgttgtgccgtgccgtgccgttgctgctataccatgtcgcagccgtgcgtcgcttaaacctagccgccgctttagccgttgctcggtaatcaagttgtctagccgtaggtgcatccctaggttcctaccggcctatcgtttgccataccggggctttaccatgaatcgtgtctagcccaccggtttagtcgcagccgttgttgagttgttcgctcgttcgttcgtccgtctagagtcgtcctttagttcagagccgttcagagccgccggttccgttcgccggtttcggttgatcattaggctgatcccgggtcatgtagaattgactcgttgagtcggtatctcgtgaggctcacttgccagatcaatcgaagccatccaatcttggtcaactctatgtcaagattaatcttagccatccaaaatcaatataaatcatttcctctcttttcagtggcatattattcctttttaatatatgtcatctaccaattataatctaatctttttccggaggttgttttaatcttttctctcagttataaatcatttgtaaatggtttaattaatttggaatagtcttttctttaataggtttaattggaattaaatcttgtaaaattcataactaattcatatgaaatcaaaatgaggccgttcaagtctctaaaatcatctaaaatcatgatctacatgtttgtttactttttatgtattgtttatttggtttttattagtctttttcctcgttttgcgtgttagcttgtcgtttccatcgtttcgaaggttcgtgagtgcgccggaagtattcaagaagattaattgaagatcgattattgcaaggcaagtcagacagatcccaaacacagttcctttgagcatgttgatcctatatttaaattctctatttatttcaactgtgcatttatttttgaatgtcaccgggtggtgtgaacctattcctttgttatggccagtttgcattgattaccctatttcttgattacctctggttataatttgactagttggatttatatattggttcaactagatgtattagatataattgcttagccatgcttagaaacattagcacacaattgggataactaatgtttcactactacttaaagatggacatgataatggtagctcacgatggctaatcgtgattggttaattaattaatgtgccaactaaaacttgataatggtgggttgtgagcacatggttttgatggtcgtgctcatgacaattaaggaccggttcacgagtttcggttgtgaaacattaaccgtgccaaccacaagccagaattggcaagggctggacactttgtatagcaaggctcattgtggagcaccagactgagaagtggcggagataagcccacgggggttgctggggagtccatgcctctggtttttgagggggtgactacgatccaggaacggtgcactgctttgggttgagttatgcgagggtcttgtcacaatcactcgtcatggtgacgtgtctgcgcggacacggtgacatgacggtgggttgtgtcttgtgggtacagtggtacacctctggccagagtaaaactattcgaatagccgtgcccgcggtcatgggcgggtctaacaatgtctttcgtgattagtcccacactactcattaataataatgtggtaattgatggtaattaatttagctcctagtttggaatggtacattcctagtttggagatagatctgtacagccgggtatggttgttcaggatggttgggcctgagcagcatgggtgtgctgttcagtgtttgatttaaattgatgattaattactctattgttttacaattctcaaatgtttgctaaatgctgcttttgcaaatgagccctgtattatgccattctttggtatccttgtgcacttgcatatttgctgtgtggcttgctgagtatgtcatatgctcaccttgcaataatcaatcaaacctcagttgaagacaagttgcgaaggagaagacgtttggcttatactccagttgagctgcctgtgggagtggagccggagcttcgctagattttattttccgctgcagttttcttcttggtgaggactaagtgcctcttaagtaagtatttattgttctagttaatttgatgaatctgtatattaaattgtcagtttgtgtacctcagctgattcctggacgaggattttatgcacaaataagttcggaaattactagtaaatttctgggcatgacatacacacaagcagaagttgaagcctcagtactggggttagatgataataaaaatttaggaatccagtactgcgacacacgaccagaagatccaataggcatatatccacgtgcaaaatcaattttagaattttcagaaaaattccttcgaggccggtctgaccgagatacagtggtcggtctgaccgggggccggtctgaccgcctctgtactgccggtctggctggtgtccggtctgaccgaggctctgcagccggtctgaccgcgggacccactgcggtctgaccggttgcctcgagggaaaaccagatttttgccactttgattttgcaacagcaatctctctctcctttttctgtttatgagctaatctgaaacaaaaatcaacaatatgtccatctttgccacaaaaagaacaaatatatttttcaaactagcatgaaaagcaatttgatatttttgcaataactttttagttaaaaacaactcatccaaagtgcgtgtgtgcaaagcaaaactacaagcaagagaagatctatttttcaaatcatgtgaagcattaacatctctaatttttgaaatctcattcattaaaacctcacaattttcacaatcatcatcattaggaataagatattttaacctatcaatttcagatttaagagattcaatgataaattcatgttttttatacatcttctcacactttttattttttgcactcaaaatattaatagctccttcaaaagcactcacctcattatcttcatactctgtgtcagattcaccatgcgccatgaagcaaacatcggagacgttatttcccttatcatcatctccactttcaccatctacatcacttagtggctcgaaagcggcgcaaacttgttgaaaagccttcctaagattctccatcttcctcccttggttagaacccttcgacttgtagttgttgggcttgttgttgttggtcttcccaccatctttgtcttctcttttgcctctcccaagcttaggacaatacgaacgaagatgatcaattgaaccacattcaaagcaatgatttggaccacctcttttcctgttcctggcattattcatagctcgagcaattcggttagcagccaaagccaaatcctcctcctcgatttgttcgagttgatcatcggatgtggcattaaaagcagcaagaaaagaaggcatagatgaagaagcatcaacaaccaaagaggaagaagaagaaaccaaagcactcgatttagaatcaactttgcgagaaagaatattcatctcatgtgttttcaatttagtataaagtgaatccaaagtcaaagtagacatgttaacagattcctgaatagatgtaactttcatctcccaaatagacatgtcgagaccattcaaaaagtgacgagaaatctcagattatggatagttagcatcataagaagaatcaacagatctaagatcactcaaaattttagtaaatctagaaagatagtcatccaaagcctctccagattttatctcaaatttaatgtactcctttttaaaaagatctcgacgaagctctttaatgttatttgttccttgatgaaaattcttcaaagcattccaaatctcatgagcagtttcaagatgtgcaacacgatcataatcagaacgagaaatcccactcaaaagaatattacgagctttgcaattattttcaaattcagtttttaaagcatcagtattaattgcttcaggaatcacataaggatgagaaactttcctccaaatatcataattttcagtcataatgtaagattgcatcttactacaccaatgaggaaaatcagttccatcgaaaatatgaggcttagttgaaaacctagcgggagtagccatggcaaaaagtttagatcgataaaaatccaaagaagaaaacgaggctctgataccaattgtaggatcgtaaagggcctttcccaccccaaaagctagccattgaggtgaggagctccaccacttatatcttaggtcctttgcccttccacaaccaatgtgggactattcaacaccatttatcccccctctggttggcttagttcttgtgtttcgatcctacataagatgtctagccaatcacacattggatcagctctagtcttcagtaatttctagcttttgggtgggtctcactagctagtgctatgtgtggaatttaggagttatacctctgaccgtgctgatgttgataacttgttggatgatagttgttgcttcagttgtttagctgaccaatttccaatattttctaggatcaaatcctctctcgagaaaggagttgtgaagttctgtacaactccaacaaagtcttagtgtcatcgagatatccatgaattgaatcatcaaagctggattgtttgcaaaaatgagccatttcatctgcccaacagttccatatgaggtgatgaaacttttgaaatcaaagcaatgtagactaaaaggtaggatgatgttcaaattttagtatcctttatagctcccaaaagtacctgaggtgatatcatagccatgagtgcgcaggaggcgaaatgccattgcacacgttggtatgtccagcatcacatcctcctcattgtgtagccagcatctgcaaacagtaataaaattgaaagatcaaaggaattggtacaaaacactataaattctgtgtaatccttttgttttggaaaggtagatgaaaatttcttctgagttgctgtcacctgtatgttctgtccaatatgtctcttatctcacacacaaaaatccgagaaatccccgtcctttcaagagcatcgaccgtgcatagctgggagtatatattttgcggatacattgctgggactgcagagaaatcttatgtccgttagctgcatatggttgacatttttttttatctagttcacatatacacgaaaagtgatttttacagtacttgacaaggtaatgagaaatactatattttacgatatatataactggatgtttcttcatgctataacaccaaaaacaaaaaaaagttaggaaaattagaaccatgccattataattttgtaaaatttgagatatgacatcctgacccacatatcattgactcatatcggtcctacatgtcattgaaataccgatggcatatctcaaactttacaaaattataatggcatggttccaaattaccaccagaggggtagtacttaggggtagtactacactagaaaaaaaatgtaaataaggtatttgtagctccggtaccacttcaaacactgtaaaatttttgtatattaatccatatggattgctgctgctgctgtctcgtacctgggccgccaaacttatttgtaaatgaatccaaatagttgagcgcgctgtcattgaaactatagattgctgcagctgccgttgtggaaggtgagttgaacaacgatccattctttctttgatacgccattacttcatcccaatcttgtaggctccctaacccttccgatacgtatgccataaaggcttttcttgcagaaactgttcaagcgccatccctgatatattgtcaaaattataacagtgggaaattaagaacaaactttaatataaaactaggaaggtagcccgcgcatatgcgcgggcatgtgcgtaaaatttttttacgaatgtccatatgtggatggttttctatcaaaaatattctttcactttatcataaactaaaattaaactaattcgacgtgctttgaacgctggttacttgaaacatataaattgaactaaaattactttaaaccgtgttgtttctaatacatgagaaaatttgtgtcgaaacaatagatgtgttccctatgaatgtccaattatttttgttagattctgtttgaaattttaaatatattcattttattagttttgctaaaatgtttgaatatttctatttagaatggattataaacccaacaaaaacaaattttaaattagataaattttattttattttcatttctttttatctccattttttttggataaatccactttatgaagcatcttttttgaaatgctttgatctctgtaagtcagaatgaaaatatatgtgggttgatcctacaacctgccatggggtaaaggtatcaattctaaattatctcgctccaattaagtaagaaaaaataaaatagatgtcgtagtattttcttagcaaattaccactaaactggaatatcatgtaataattgcatatttctagattgttctattctatatgtcacaaattcacgatgtactgtaggaagttttacccaaaaaaatagatatggtcttttaatttctatctgtaattggcttatatatagctgaggccacatcatggttgtttcattcttaagattccttggtgcaaccaacgtgcccggtacaatcggtttgttgttcaactggccacgtgacttcatagaccatatatataatttagaagctatgatcattttatgattatttatttatctcctgaagtgatcatttattgataaaagcatcaatatcaaaatgtatgggtaaatagcttctatatataagctgagaaaaagttgatagaaagtcgttagatgtctatcaggatataagtaatgggtcaaccagttttataaaaaattgagctgtgatattttgatttttagtgagcaattttagtattttcttttctttagggtaaaatttgctataggatattaaaaaacatgtaattggccgagagacaccgtaagaacgcgtatctgttgtggcacaccgaaaaaattggtaattagctactggtggctcacgatattattttataatatccaaaggaaatgcagagagagacaataacaaaagtataacttttcccttacctactaagtctggcttgcaaacacctttgacgcagcaacagcacccgccggcggtgagatggctctctagagaggggagagggggtcaaggagggcccgtgcacctgggcttgtggctccatgtcatttccgcacttgttgccgctacagtgtgagggctatgctggcgctaatgctccgccacacaccacgcttggggtgagcacaacgtggaccacctcttaattcatgtcgagtagggtgtcgcagagcgcaggctattgttgtcgatctcggagtcttggcacgccacgctgccataccctccaccgcccatgtcgtgactaccacggcgttagagcgatatgcgagccacacatggcaagaaggggcaaaatcatactttcgtgattgtttctctccccttttcctttggatataacaaaataataccacgggtatctagtagctaattaccagttttttgcggtgtcccatagcagatatatgttcttgcagtgtctcttagctaattatactttttttgggatgtcctgttgtaaattttacctttattgagaagaggcttcaatatggatgtgggttcataatgtaattttttgttagcagttaatatagtcaatatgggcattaagttattgttttcacttagaaaaataatagctggctagacctaataggtggagatttgtttgtggtcttttctttgctcatgaaaataattttaattttaattatcatagagatataaaagctgtgaaaagtaatgctgcacactgcaagtgaacggggatggaggaagggttgagatgtttcttttttttagaaaaatattgattgatttgatgatctaaaataatgtgttgatgtttaagtaaaaaaccgatggttggatgttatttttttctcagatttattaggtttttttttctaatttaagtgagataagtatcagcttagcgaaatacccatagggaaggagaggaaggagaggaagggaagatggtttgggatgttttttattaaaaaaattagatacaataatgatgtaaaataatgtgtgtatcgatttaagtggaaaacaatggatggatgtttctctaatttaacattgtcataccacgatttagaaatatctataagatttttaatggactttaacacctatttttgagattactttcgataaagttaatttttgttttaagtgtgacagggataaaaaacagaaaggaacagggagcctactaattgatcactctagcgtggtggactgtatgggggacgtgggtggttttggttttccaccgatttaaataaaaatcaacggagatttatctattttattagggtgccacgtggcgacttgagagtatttatagggtgccatgtcacggtttgggactgtttgtaggatatttaatgaattttgaagtataagatagatagatagtactacgtacatatggtttttctctttatcttatatggtagaaaattatattttatatttttctcccgattatgctatgtactttttttactttatcagacatgtattttttcttccgacgaacggaacataagctttattgtttttttccgaatcatcgtactgtacttatgattttttgttttgccgacggtacgtattttcccttttatacagggaatgtattatatacacacctaatgattcgtaataggtccaccaatttaaaagaaaatcatctatagatatagatataatctaatggtctaaaaatgatgggtccaccaattaaatgaaaattaacggtgagattagacagtgccacgtggcggcatatgagtgtttatagagtaccacgtggtggtttgagggtgtttttaggaagtttaatggactttgagtatataatagatagatgcccgacatattagaattcctcagcaataggaaaatataaattataaaatatatcatgagtagtttgatgcatatgttatattaatgttgtttttaatgctgtagtaatttgttattaaacctatttggcaaagaaaaaaatgtatatgataattgattaaggaataattgtctaggaataccaatcaaatagtaagagggcttgtagaagcgtcgtgactatatttgaattttattgttatagtatagaaaatcctaatttaaaaaggccatctaatttgttttcgatggttttagcactgtacttatacttacttttagggttttatagttcttttttatcgtgcttacagcatacatgtgcatgttccttttttattcacgtgaacggtaatatctcaatgttttttttcttgatagctttttttcatcgtataagtatggtctaaaataatgggtccaccaatttaagtgaaaatcgacggtgggattgtagaatgacacatggcggtctaggagtatttctaggagtgccacatggcagcgtaggagcgtttgtaggaagtttcatggacttttagtatataatagatagatagatagatagatagatagatagatagatagatagatagatagatagaagatagatagataatagatagatagatagatagatagatagaagatagatagatagatagatagatgtggatagtatgcagatatatgccaatctaccatgttcagtagtgtgcagagaaaaaacctggattttccagaattttgctgcctaggtacgttctacaataagttataattaagtgctcggtcgttcttaactgctattaatggaggaaaagctaattgcattgtgctccatagagtaatgaaatttattcgcaatcccttcataagggacaccatagatatgctagctgagtccagatcattttttttccccttctaatctgatctgttttcaaataatagaactcccaaaaaacacggatacaattcccagttagttccgacactttcatgcatgatatttgcttgatttcaatccatcctgacatgttattgtcttgccgctagtaattttacacttttaaatacaaaagctaattaaagaagtataagtacaatataaatgttcagaactgaattttattaattagtttttcactaattggctaacctttccaattcgatcttccggaggtgaaaaatctcatcaatatatgtttgcataacaggtaatcgcaaacccatcccagcggcaaggctaatcagaccagaaaaagtaatgttgaaaccagcgggagcaatagttttgacatccatcgcaacagagaaatttcttccgataaaatttagacctgtcaacaagcataattcacagcaataaggtctcaagagcatcgaacattaaggtacggagagcggcagtttactgatcctttttttaaaaaaaaaattagagaagggtattttttacccggccattgaaataggaaacttagccccacaaacaacccaatctctgaaattttctcatatagagatttgaactcagaacattggagtactactctggtcactgcaaccactagtttactgatctttttttttaaatgatttaccgagctcttttgccatcaataaatatttgaagcttgaaacaaaggttaaaatacttagtaggaaacacaaaattggtgtatatagatctctctcaaaaagtaattttataatatcttcaacttacaatattttataaatttattctaatacaaaattataatcaaagtcacaccttaaattctcttaaaatgtcagatatcatatactgtttttactagaggcagcactttttacctctcttaatgtgatatggacctacattccacctcttgagcgcaacaacacaagccaatgtacacaaaaggatatctttgtcgactgatgaacttgatgggtttataccccatgatccattgtcctgttggttttgcagtatccactcaatacaccgcggataacatggagcctgaggagaaccacgctctgacaccatactcacccatgctgtgtcatacaaggacagtgataattcaactccctgcagcttcttccttgtgttagctttgagttccttgttgtgctgcaatattacaacagaatattaaactcaaccaaggaatcagataataagagattagatatactagggtgtatctctaaattaaatacatgatactagtctctccattttaaaatatatgacgctgttgacttttcacataacgtttgaccattcgtcttattaaaaaaatatataaatatcatttgatttatttttttacttgttttatcatcaaataaaatataacctcaacttatactttttcgtatttatattaaatatttaaataagacgaatattttaaacgatatacaaaatgtcaacgacgttatatattttaaaaatgagatagtactttagtttacaaggatctaagtgcaagatattgttggtaggctatttaaaccttgaccacctcaaagaactttcagatcaatatttttcaatggacttcaataatgtcatgtgttcgtttgatcaagtatttacagatagaaattagtggtagtcaaactagaatgcacgaagcgcgtttagaagtggggcgagtagagataatcaaagccaccaaatgggtaccatgacttgcagacttcccacatttccctcaaattctatcctcttctcaacacctgttgctgctgggaaaacaaaatgaaaagaagtgaaatatgtcgccaaaaccaatccaatcaccactagaatatgaaacttcaatggctgaaaattacagataccagtacctgtgcactcacacaagttttttttatatacctttgaccatttatcttattaaaaaaattgtgtaaatatgcaaaaacataagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 68888 - DNA, 1098 bp, Oryza sativa
attcctgcagccccccagactgaagctgctgttgatataccataatatttggattgtactgcattgaacagggacaagatggatttcaagagcatattatgaggaaaaccatcaatacgttccaaaaaaaaaaaaccttcgagagacaaagttgtaaaaccaatattatatagaaagctaaagtgttatctgtctgaataaccctaaacttagaaacaataaaatgagccatactaaagaatcctcttaatattttatcctctgatcgcatgaacaaaattagggtgctatatggcataagtatgaaaaaagggttaactcaagtactaacactttcagttatttgacatatggtcgggaagcaagaaacgcataaatgtaatttgacatgctaatactacatacaccacaatttagtaaagcaatgcccttttaaaatttgacagcatcgttttagactaaacgcgacaaaagtgcataaatagatcatgtgtgaaacagatatgtatatgattgagtaactggagtatgttaagagtaactaaaatgcaatcttaaaaataaaatcatgttcaccttcaagccagggcagatggattcaaattcaatctttaagcttcataaaaatattgcccttcaaataattcctagggtgtggaacaatggccatgaatccggtaactgacatatcaaggcctcctagaataattgacaatgatgaagaacacattgcatttaccaaggaaacttatcacaaatgcatgtactccaattatacatgtgtccaaataaacatgtcactgcattgagacttcgaatcagtaacacgtttccattgtgaatttagaggatgtcacaggaaacatatttagaggatatcactgaaagagatgctcatatttatataacaagcatcagaaaatggtgacgaataaatgtattatgatagttccggtaaccgaacagaagaacatatgcaaattatactgcattagtttttttgtctaaacatgtatataataccaccaccaccaaacatagaagaacagagacaaatcattcaagggtaaactaccattgattcagatgcgatcgtca

SEQ ID NO: 68889 - DNA, 8705 bp, Oryza sativa
aagagagggagatgcgggagaggatgcgcggtcgcgccgatgcggaggaggcgcgtcgattgcggcaaatagagagagagagagagggggggggggtgcggagaggatgaggaccgacacgcgcccatgtgggacgtccgatctaacacatcggatgattttacaccgttagatatgtgatatgatgaatgagtaaatgaataaaatcatttgtttaactatagggtagatatgcaaatagtagattaatgagccgatcggctgacaagccgatggagtagtttcagtcgatagccgatattagccgatgccgatagggttttgagctattggcaatatgtcaaatgtagataatgatataaaggcagtcggctgatgatgatgcaatacaacgacaatataatccagtagaaactaatcggctaacaagatgatatgatagaacaagttctgatccgatggttaaagcatgcattggctggaggtccgatgtcataaaatccacaagattagataaatcaatgaaacctttgttgtcaacggctaaatacaacttatatgtatatgcaatccttataagccgatgcaacatccagataacttatcggctagcaccccgataaaacattagcatgaacctatcgacttagcaagatttatattatcaacaacaatctagtaggtcgaacctaccaatgcagcacgagattgtatatgataatctaatactcggtaagccgatagatctatctaatatgatggatatagcaaatctatttaggccctctttgtttaggcttataagccaacttataagtcgaaaagtctaagccaaaacaaacaagcagcttttttatttggcttttttgaagccataagccactctaacactattaagccaaaagctaggttggagaagcttttttggcttatatgagatagatgtatgactccaccactaaacttaggacattaaatccactgacttataaatcatataagccaataaactgacttaaaagtctaggccaataagcctaagcctaaacaaagagggccttagaacatcattgtgattgtagagatatatcggctaagacagaagatcagacctaaccgagccagtcccaactaaaccgatgcgtctctaaacacaatgcaattagggatagaattgaggtatcaggtaggcaaatatatcaaccaaaccagagcgatccaagagatcgaagcgatgcacccttgaacaacaccaatgtagtcaacagattcaccagggccagcggaacgtaggacttaccccttcgccggagatggaaagctgatgcaaccccacgtcaggtgccaagtaacgtcagatgacaagtaaaaaccttagtaaagagggtggtgatgcgccgagagtagttgtattgattgagagattgatagattacaatgaccccgggtgtacatatttatacccatgggtagatactagtccttgtaggacaataaagaaaatttcctaaagataaaaggaaaacacaaagtccttatcgaacactaaacacactttcataaagataaaaggaaactaacgaactattcctaattaatagatacacttgccatgccgcatcctccttgaactcggactcttctggataaatttccttcaattgatccgactccatcaagaacacaactgctgccgatttgatgactcccatcggccgattctaagactctgaagccgatactaactttaggccgatgatgactttgggcttaccaaattttggcgttaacacatgccccaaattttggagtatgaaagctcatgcttcaatcttatctcatttcttgtcttggtgactccaaaactgatcttcctttgcttcgtgcagtcgactttcatgagccgatactgtctgcattagatgagccgggctatcaaactcgtagcaaaagaatctctctctgatatgtgctgacaatccttgaaatgcgagatctgctagctgctcatcgctcaggctcaaactataacatcggctgcagatattccgaaatctttgaatatattccatagccgattctccttcttgctgctgaactgatatcaaatctaaaagcttcatctcatcgatgccagcaaagaaatagtcatgaaattgcttctcaagattggcccatcctccaatagaattcgatggtagtgatgaaaaccatgtgaaggctgatccagtcaaacacagtggaaaaaatctaactctcagagcttcctcagccgttgcttccccacattgcactaagaattggctgatttgttcctgtagatatatcatcttgccctgaaaatttggagtaatttggaactatcggtgtggcaatggaaccctatcaaaccactcggcatatggcagccgatacacagaagtatgttccttaggattgattccaaactgctcctctattacctttgcaattctattggccaaatcttccctataatgatatctttgaattccttctggccgatattgttgatatgcctcatcatgctgacaccgatgtgcttgccccccgagccgatgctgatgttgttcttcaatctaccccccgagctgacttttttgaataattaactcatcaactgttaccttgatcaaactttgtaatgtatccgccaaaactccagattgattaaacaatgcgcgatgaattgcttcatcaactgtatcttgaagtgtttcaaccatcggcttgcgagattgctacttcttggtattgacttcctcttcagacatgttgggtgcaaaacttgtgtcccaccgggcgtgccaaaaattgactcgaaaaacacacactggcttgggagatctgcttagctccagtgtaggtccaaaggttgacgatatgtgggtgtgcccgtcagtttgatcctgcaactgacaaaatatgcaaatagtatataatgagccgatcggctgacaagccgatggagcagttccagccgatagccgatattagtcgatgccgatagggttttgagctatcgacaatatgtccaatgaagataatgatataaaggcagtcggctgatgatgacgcaatataacaacaatataatcctttacaaaccaatcggctaacaatatgatatgatagaacaagtactgttccgatggttaaaccatacatcgactggaggtccgatgtcataaaatccacaaggttagataaatcaatgaaacctttgttgtcatccgctaaatccaacttatatgtatatgcaatccttataagccgatgccacgtccagataacttatcggctagcacaccaataaaacattagcatgaacctatcgacttagtaagatttatattatcaacaacaatctagtaggtcgaaactaaccgatgcagcacgagattgtatatgataatctcatactcgataagccgatagatctgtctaatgtgattgtagagtattgtgattgtagagatatatcggctaagacaaaagatcagacctaaccgagacagtcccaactaaaccgatgtgtctctaaacagaatgcaattagggatagaattgagatatcaggtaggcaaatatatcaaccaaaccagagcgatccaagagatcgaagcgatgcagtcttgaacaacaccaatgtagtcggtagattcaccagggccagcggaacgtaggacttaccccttcgccagagatggaaagccgatgcagccccgcgtcaggtgccaagttccgccggatggaagtaaaaacctcagtaaagaaggtggcgatacgcggagagtagttgtattgatcgagagattgatagattataatgaccccgggtgtacatatttatacacatgggtagatactagtctttgtaggacaagaaagaaactttcctaaagataacaggaaaacacgaagtccttatcggacactaaacacactttcctaaagacaaaaggaaactaacaaactattcctccttgagctcggactcttctggataaatttctttaattgatccgactccgtcaagaacacaactgctggcgatttgacgactcccatcggccaattccaagactctgaagccgatactgactctaggccgatgatgacatcgggcttaccaaattatggtgttaacaaatgtgtgtggtcaaatcttcctccagttcatctaaggacaccaagcaaaggataggctaagatagagaggattaactactgagaaacagtgtttagggaaaacttaagtttaatcctaacgcgatacttcaggaactggcaacccgctgttcccagatttcgctctactacgtactcggacagggaggacttaagtgatctagagggctgtcaccacctctacacctacctcaaatgtactgtgggatacgcatcaattattggataacaattacctaaacacaacgtttaagcaattaatatctactttagtgtttataactcaccaaagcaatcactatattttacttgattatagtgaacaataatcccgtttgctattaggaactaaccaagagataattctcacaagataaatctaaattactcaggaagatagttcagttgaaatcagagtaataaacaaaataaaagaaataggagaagattaccgacaacttcggaattcttccgacttcttctactctactctcttcatattctagtataaaatatagtacaatagagcctcttataattcagctcaagcttggaagtgtgtgtgaagtgagggaggtccttaaataggacagttaatgacggttagcgaataggaaatgtccaaagtgccctccaaccgtcatcagggatgcatccgggacgtccacgccaaaccccagcttggacgactgtaattgtggttcggccgaaccaggggtacggccgaaccctggctgggctcccttggcctgtccttcggcccatttctctttctgggcttgccttatccgattctcggaattttgggctaattcttcaatgttttgatgaagttcaaagctcctccttgtatggatatgcatcctccttcacttttagttgcttttcctcccaccttcggggtttatcatatacatacaaatatacaccaacacttgtggaatatgtgagacttaacacctatcactatgttggatgttttattatctggactttatgcatatgttggcgatatagaattggcatttaataaccactaatagttgctcaaaactactttgtaaactcgaacctaagtcttcacagtattattaaacaaggcagtgaacccacacaaacctatcttggcctaaggcccacgatgagttggaccggacaggtagccttaagctgggcctcggctcgtcccaagccaacccaagccatccattccaaattttagttgcttagcaagttttaagaattaaaccactaacttgggtacattgctcggcttatccataattgagggtgcagctatccgattagattatactctgatcagaggtgtacatctttacccataagacacgtcttcctcacgtgtcgccgcatgcaccataccaccatggtatacggacggaggaggtgacatagttcctaactcatcctagccatgaacaagagtaccgactgaacacccgcctacggacagggctccccggacaggtaggttatagttgagccccatggcatcaggacatccctcaggagtgaccacccggatgcccgtcctgtgccacgatatctcgactaccacgacatctgtatccgtgtccttttgttcatgtccaggttgagccccaaactaagccttacccattagacatgtggaagtacggtagtgctttgaaacagaagcccgaagaccgatccttatgatggccgaggtgctactatgaaaaccatgcaccccgagcgcaatctaaaacattttgggaattttgaatgacgaggagttgtatgtccaattccaacatatgtcgcaaattacgttgcgccgacgaggtccagggccacgcccatccactttgttcaaatatcaactgcatcgcaatcctcattccaactctctagcccgtgacatcttggtaccagattcttctggttccgatcccatggcctccacaaaagcccagctcgaaatcgccaaaaacctcacctcaaggctgcacaaatctctgatttgtcctggaagatgattgccttagaagcactcgtgccgctcgtatctattggcggtccttaaatcataatatatgactatcaatacctgcatataatggaataaaatatggtattcaacttagtggtagggtttattactaatcatttctattagtgttggtatatatttggatgcaggtgacaaactaacaaagttgagaggaaatatacatgaaggaggataatcaaacacatatacaaacttatggagttttggacccaaaaacccaattaaacacctccaaatggcccaatccaccatgccaatgggctaagggcctcaaaattagtgtccacgaggaaaaatgagccgaacggagccatcccgggttcggttgaaccaccagtttagccaaacccatttggaggccgttgatcgcctgattttacatcgatggccctgattacatcctaatggcggttccggggcattttggacatttggcataggctctaaccgtcatacctgcctataaaaggaggagctaactcttatttccaacacacaactttgagctgaattacaagaggctctgttgtatcttttgtacattagaaataggtagagagtgaggggaagctctggaggaatgcccggaagtttggtgctcatccgacttctaccacgatgagtgtagcttcatagtaggaattctggaggagtaccggagttgtcggtacactttactccgggttcgcagaaacttcttctataaagtaagcatttgggatcctttcttttttattatttaattatttagtctaagtgagatatatttccatctttgtgggttcattatttagtattcgtactaagtgctctagtactaggactccggatagagaaggaagttcctacgcaagtattagagtagtaattgtttattgtgtatcccacagatttgtcagaggtagacggcaggtggtgacagccctgaatcccgtcccagtaatcctccgcattcggataaatcatagagctatagccggaaccacgttggcagaccagcaggggtcggtgtccggagcatcatacaggaaattatgttttactcagcttagataattaaaaacatagaaagtcctctctagcctgcctagcctaccttcagttgttgttcttggatagtcttagccttagatagattatacacgttccctgagttcgatatccgtttggggttacccgaatgtcacgcctagaaattcatgaaccagaatttctaagctgaatgtgcattaaactaaactaggggtgagactaatcacagtgaatctggttgatcgcccataaccgcgagcacgactattcgaatagttttactctggccagaggtgtacaactgtacccacaagatatgattccacacatgtcgccatgccccgaagtatcaccatgatactgcaaagggggaaatcgtgacaagaccctccgcataaccctcccctaaccattcacaccacgctaaggtttcacccccacccctcaaaaggcagtgggcggtcccctcttgcgccgcggtgaatccggcagctagacaaccggacaccccggccgacccaactccatcacgcccaccatcgccaccggtgcctaggaaagtgtcgagctatacttcagatcaagcagttacccactccctcttgtggtcagcacggtaagtctcccagggtttcccgtgaactggtccttaactgccatgggtgcgaccagcgaaaccatgcacccacagcccaccattcagtgtattttaattaactaacaccattgcggtggaaccaatccaaagctatgctaatagtcaaagtctatgtaataatgtgatccccctttgtgtactagttgaactaagcatggctaagcatttcctaaaccaacatctaatcattttgaaacccaagttatcaatggcataaggtaaacaatatatggctgaataataggacccatcccatatgatattgtaaaagaatgcaacatttaatagaaatgcgggatatttgtaaattgggtacaatacgatcaaatgtaatacatgacttgccttgctctcgcactgatgagaccacagcaacgtcttcgagaaaccgcggatcgacgaagcggccgaaatctacgcgacaaacaaagcacaaaagaaaaacacgctataagactactgtaacagagaacaaaaccatttttaatagattctagggatttttatgaatttattgagacttgaatggacttaaacggagctcggatgaattacttatgaattttagaagataatctgtgtttttactaataaagaaaaggccttaattaattatggcgcaataaatccccagggctgacgtcagcaaggggggcgccgacaggtgggccccgcacgtcagcgactcaagagagaggaaagggcaccggcatgtgggccccacgggcggtggctcaaagtggagggagt

SEQ ID NO: 68890 - DNA, 26635 bp, Oryza sativa
cggagtggaagacgaaggcggcgacgaccacccggtgagaggaggggcggacgagcggcggcgacacctagaggaggggaggagaggagttaggagaggagacgatgaccacggcggctttaaacgccggccggagatggaggggaatggatagctcaccggctcgcgagggagatggggttccgatggggttccggcgacgcgaggtggtggccgagatgacccacacggcggtgaagctagcggcggcggcggcttggcgcggcggcggctctagcggcgacggcgcacggccggaggcggtggtaggcggcggcgctagcggcgagtggcgcgggcgcgataggaggcacgggagagagcggcgagcgcggaaaaaggaagaggggactccggggagggattttataggcgagggaggggagaacatggccgggaggtcgtggttggcgccggcgacgacgtgggggaggtggggagagagagggtgttgggggatttcaagtcccccaccacttgcgggcacgcgcgcgggggagatgcggggaaggtggaggaggtgggtggcgtgggcgcaaggtgcgggagcgagaggcggggaaggtgggcggcatgaggagcggtggtttcggtggcggttggcgccggggcgtgggcgactggaggtaggggacgacctgacaggtgggccccacctgtcagcgtcccagagaggagagtggggtgatgggccggactagtcaaggagggagagaggacgcgggaggaaggaaggttgggccgacggcccaacaaaggaaatagggaggaaaagaaaagggaaaaagggaaaggattctcctgggattaaatattgcggttgtcacgcccggaaataccctagtaatttccgaactaatttgtgcatgaaatcctcgtccaggaatcagccgaggtacacaaactgacaatttaatatacagattcatcataataataacgttacatacttacaaaagaaaagaaaactgctgcggaattacggtctagcgaagctccggctccactctcacaggcagctcaactggggtataagccaaacgtcttctcctttgcgacttgtcttcaactgagatttgattgattattgcaaggtgagcatatgacatactcagcaaggcacacaacaaatatgcaagtgcacaaggataccaaagaatggcataatataggtgttgatagaaaacacgaggcctgggagatctgcttagctccagtgcaggtccaaaactcgcctttggatgtatgagcgtgccagttgatttgatcctgcaatcaacaagaaacaaagacaaagaaaccgtaattaaatccataaatgatagccgatcggctaaatgccgatgacatatcatttatctttgagccgatgttatatgtaaatcgatcggcaattgttaagaaaacaaatcagaactaaatctactcgatcggctgtaaatatcaatgatacataatccttatatcgatgtatacttgaatcaagtaattgggatagatcggtcaccttgccgagacagtataaatcacttacatcgaaatatatattaataatgagattatatatatattcatagcatagccgatcagatagatctagcgtgtatcggctaatactccgatactactttatattaagatattaaagcaaagagaatatactaaacagaaatctaatatacttaaatgcaacaagatcttaacatgaagggcagatccaacatgttaattgagcatgtagaacaaaagcaattggatcagataagatcggctgaaactccgatactaccctaatcggcaaccagtaggcaggctagagattgaaattttaagcacgacttaatagatcaaactcaactgatacagcattaagtatgaaaagaagaacaatatctagacgatcaagccgctggatgtttcatagagtggtggatatctcatataatctaagccaatgtcgttatttaacctaatcggctgccttctggtagcagatgttagccgattgtaggttaaatgacgatattgtcaaggattatgtaagatatatgataacttgacggactacataaacaagattagagtatcataaagatggaagcactaatctcgagaacacaagccgccataacaagttttacctcttgttgaacatcaaaaccgatgcagctcaacccgaaagcaataactcgttgaaataaaacgaaagcaaaaagagtggcgatgcgccgaaattgtattgaacgtgtgtgttcatcattacatagggctcggggtctatttatacccgagaaatacaagatatgtccatattggacacgactcttatctctaacaaactctaagataccacaagtctttgcggcagacttttgcccacatttatctctaaggaatttacataaaatatcctaattaatagatacaattgccttcccaggactctatctatgcgtggcaatcatcttgaaacacatcaactcgaacccaatgtcgcacatgggtcgtattatcggaatcggctgtatcacttaaccagactgactcagacttagccaatcccagtcgtagccgatccggactccagccgattcttactctgtttccgaaaaaaaccttatcttcgagtccgcttcgatttcatcttcatctccgatgttgatattaccaaatttggttgttaacaataggctcatttgcaaaagcagcatttagcaaacatttaagagaagtaaaatagtagagcaattaatcatcaattttaatcaacactgaacatcacacccatgctgcacaggcccaaccaaacctaaacaaccatacccggctgtacagatctatctccaaaccaggaatataccattccaaaccaggagctaatcaaattttaccagttatagcatcatctattatggtgagaagtgtgagactatcatgaaagacattgttagacccgcccataaccgtgggcacggctattcgaatagttttactctggccagaggtgtaccactgtacccacaagacacgattccacacatgttaccatgccctgaagtaccaccacgtcactgcaaagggggaaatcgtgacagtacccttcgcacaacacaactcaaagcattgcaccgttcctggatcataatcacccccttataaacaaggcatggactccccagcgacccccgtgggcttatctccgccacttctcagtctggtgctccgcaatgaaccatgctatacaaaagataaagccgttgcccatgctggcttgtggttggcacggttaatgtttcacaactgaaacttgtgaaccggtccttaattgtcatgtgcatgaccatcaaaaccatgtgctcacaacccaccattatcaagttttagttagcatattaattaattaaccaatcacgattgaccatcgtgagctaatcattaaatatccatcattaagtaatagtaaaacattagttatcccaatcgtgtactaatgtttctaagaatggctaagcaattatgtctaacatctagctgaaccaatatataaagctcaactagtcaaattataataacccaaggtaatcaagaaatagggtaatcaatgcaaattgaccataacaaaggaataagttcacaccacccggtgacattcgaaaataaatgcacagttgaaataaatagagactttaaatataggatcaacatgctcaaaggaattgtgtttgggatctgtgtgacttgcctagcaataatcggtctttaataagtcttctggaatacttccgatgcacacgcgaacctttgcaacggcggaaacgacaagctaacacgcaaaacaaagaaaaagactaataaaaaccaaataaacagtacatataaagtaaacaaacatgtagatcataattttagatgaatttagagacttaaacggcatcattccgatttcatatgaattagttatgaattttacaagatttaattccaattaaacctattaaagaaaagactattccaaattaattaaacaatttacaaatgatttataactgagggaaaagattaaaacaacctccagaaaatattagattatatttggtagatgacatatagtaaaatgaataatatgccattgaaaagagaggaaaggatttatatggctgagattaatcttgaccaagtcgaccaagatcggatggcttagattgatctggcaagcgagcctcacgagatatcgactcaacgagtcaattctacgtgacacgggaccacccaaaagatcaactgaaactggcgaacggaaccagcggctctgaacggctctaacctaaaggacgactcaacacggacgaacgaatgaagcacggggaacacctcattcgaacgaacgagtgaacgactcaacaatggctatggctaaaccggtgggctagaaacgattcacggtaaagccccggtacgacaaacgataggccggtaggaacctagggatgcacctacggctttacaactgggctaccgggctacggctaaagcggcacacgactgcgacacggcacagcagcgacggcaaacggtgactacggtagcgggacggcagcgacttggcacgctcgagcagcagcagcacggctgtagcagggagtggcacatcgatggctaggcggctagcgcagcgacgacgtacagcggctaaacggcgacgcggcggcaacaaggtgctggcggcagcggcggtgcacagggcagccggcaagtgacgcggcagcggctgcgctagggttagagcaacagcggcggcgacatgaccgagggattgaaacctaacccgaggggacacggatagaagtctcaccgaaccaaagcgatcggagagggagggtcgttgacgctagacaaacaacggattagattagattggattaaggccctagggacaaaatatctacaccggtgaacgtcatgggagcggcggttgccggcgaaccacggggcacattaatgcaaacgaagggcaccaggaggaagaggaggcaacggcgatgcttaccaacacttacgcagcgacgaacagtgacagaagatggccggcgacgagatcgggacggcggcgagatactatccatggtggcgacggtgtttttggcgaccttcggcgacaacggaggggtggacggccttcggcttggtgctgcgatgccgacgacggcctcggggtgaaccggcgacgaccgcaacagcgaggaggctcggccggagatcaaaccgaggcggcaaactcggccttcacggtgacagcgacttccagcgagacttggcggaggggaaccggtagacggggtagagctcgaccttgcggagccgatggaggtggcggcgcaggagggcgacggcctaggagacggcgcacggctgctgcagcggcggccggaggcggcgaagcttggattcttgtcggcgaggtacttccagaggtcttcgtcttcggggaagtggaggccggtcttcctctccttcttgcgaatccaacggcggcagcggcgaccgaaagcgacgacagacgacgacgaacggtgcggctggagcggcgccggcgcttggagagagaaggagagcgtggggagagcgattccggcggcggcggaagaagggacttgagaggataggtataggacgactagtgggtcctttatataggcacgggagctcgggtccgggcccaaatcgacgggaaaagtcgggaaagtctagggttctcgccggagtaaggaaagattgaaccgcgaaattggaaaagatttccatagaaacttttagtgatttcttggggaaaaggaagaggagattgagaggatcccattcccgcaactaatttggaaagaggagcaacggggaggtcggatttggaaggatatcggcggcagctgtgcacaggctggagagctcgggcgctgtccagaggtagaagaaggagcactgtagcgagagggacgaaaaacagacttttctgcgtctgagaggaagggagagaatgagctgaattcggcccaagctgaggggaaaattcttattacttttccaaataaattaaccaatgagatgatctttcaattgttaaaaatacttccaatgctcaaataattaaaagaaaaatcttgaacatacttggacactctaagtatttaataatattgaaaccagaccatttaatgattaatttattaattaaataattactgaaatattctttgtattattaaaattaatacttgagctctgaaaaattcgagaaaattccagagagtataattaatcatggagaatttaataaaaaataaatccagccatgctttatatttaggaaattttatttcccacatttaacttcacttgtaaattaatgaacatttaatataaattctattaataatttattaaataatttataaatcctaatacgaaaattcaggttgtgacagcggttaatgaattttaattggttaaaattatttatagggctgtgaaaattccactaaaaatcttgttaatacattaggacatggggaactcaagaaaaattccaccacgctatttctgactattaattgcatttattaattagggattcaactctaggttaattagaacaatttcttcggacgatttattcaaccaacttttaaagaaagaagaacggggaaacttcagggcatgacaccgaatgtaaagtgctacagtggtattccgtgcgcttcggatttatctatggttgtaagaaattccaacaagcatttctggcgtcgttgctagggaactgttgctaatttattcgagtctaggtcatcctcgtatttttgtttttatttcttcttttttatttctttccttaatggagtgttgtcgaagcgataactgcgtacgtcgaaggacgtggttactcaacagtgtttgacggagcgtggggctcctcaccgggagaccgcgcaggcccccctttgccggttcggccgggggcgctaagtgagattcttcgccctcgatctgaggaacgtcagcgagcgagaaagtgcacaagacacaggcgacgtagacaggttcgggccgctgagaagcgtaataccctactcctgtgttttggtggatctgtgagtgaaggaataccgagagccggagagccagggagagttcaggccctccctcttctccttttttcttcttcttcttttctttttctcttcccctctccttaggcctgggcctccttttttatttggtcaggggtcaccacatgggcctctcgctgcctaagaaaggaaacatgctttttacaatgagggctagtctacagccggaagtgacatctgacaagcagagcacacgcctcctgccccgctcgcccgcttttcccggggacgcccatttcaaccttcatttaatggccagcgacttccttgccatgcttgcgctgaagcctggaatgaatctgaccgggactgacatacccactcctggagttggcatgccggctccggctagggacgagagccaggaagctctcatcattccgacgggacggggcgaggcgtgtgacaggccgcctgttgccacctaacccgcgatcttgacctgtctgtgaccggtcactcaccgcgaccggtcacggaccggataagcgtgcgctgcgccgcattaaacgcggcgtggcgcgctcgtccaacctgctataaatgcggttaggtgagcccgctgtgctcacctaacccacacacgtggcgccaaaaccacagggggtcggggcaccccagccctcggggccgaaacgggagcggcccgacccctcggggagacagagggaggggtggccacgtcaccttcgagcccgacccccccgagggggtcaggccacgagggtgaccgcggctacccaagcctctagtcacgatacccccggccccatgtcaccgacagtgttggaaacagtaaatgtattaatttaagatttttctttgggatccccctttacatgtccctagaggactatttataatcctattacaggttcacccctttagggtttaggctttacaggggaatttacatggttgcccttatgaaagggacgtttgcttgggtatacagtgtaatttggatacatgggcctctaatgggccgattggcgaacaggcctgagcggccgggatggccccttgagcctcctcaaagttgggcttgttattgcgaagtctccatccttcggcatacacccttcgcccaagacgcatttggtcttgccggataccagcacgactcttcggccttcgccatctttgcttcatagtcctcgctggttgcacggtttcggcaggtctggtcgaagggtctcatgacatactgccaacaagcccctcacgggcaagggtgagttaggagcttcggccgagaccgtgcaaaccatgtggtatggtatgaggcgccccctttcgaccgacgctcctgccgaaacctataatacagtcctacaggaaatgtgtacactttgtgcatatgtatttttacggttagtaaattttcctagctttcgccttttgcaaacggcgaagccgtccttatttttttccgtgggccgcaataaacagtgacaggcttcccttcatgggcttagcactgtgtagctcaatgaatgggaatttaccattttgcctaccctcgtgacacatggcggcttacgattgggtgggaaggcgaattgacgcttgggtgggttatatatcccccccttttcaccgccgcacccccgtcattttcaccgcgagctctctcttttccgccctctcacttcacggtcctcttgagtcactagtacctttcgactgttcctcttttcgtcacggcccacacttttcaccatggctcctcgcaagccgaacccagcttccgtgacgggccctgatcccggcaggattgatgacgacaccaccgcctatctcggggcttcgcttgtggacgaggatgagttggcaaagctggtcacctccggcgtgctggcggagaagcaggcctcccccaggaaaggctgttgtgccgaagcccggcgatagccggacggtggtcttcgccgtgttcttcgagacggccttcggtttccgtgcaacgtgttgttttcggagatccttcgccttttttaggtggagctccctcaactaagcccatcggctctcgtccgaatcgccatcttcgactgggcgtgccggaccgctgggttcgaaccattttttacggcaccattttttacgcaacgtaaactcgaagacggtggtcactcccgcagggacgaagaagacagcgttcgggagcgtgaacttcaatgttcgccccgagcactctgatctttggccggtcaacgccgccatgttcaagttggctcgccactggatgtcgaagtggttttaccactccatccccttcgaggccgggtctgagtcggcgaaagctctccgatggcggcgcagggcgatcgcgccgaacaagaagcccaaggtcaccgtcgatggcgccatggaagcccggttcgccctgctttgcaaggtctactcccgccttagctgccgtgacctattgtcaaatgctcctttgctatgttatgtaactttatctcagccctatatgagtttttcttaaataaaagtttgataaaaattgttttcaagaataaaagaaatgtctctcggaaaaaaaaacatttttctctcgagtaaaaagtaaaaataatgacaaaaataaaattatggcaaatttatgggatccatgctcattaagttttcaatccaattcctttttagcatgaatgtgaacaactaatcttgaggctatgataaaatcttttcaactttttgtggtccctccggtatttgttgtccactgaccttctgcaggaaataaaaagacaactaaggggaagtgtataataatctcaacattcataccacgctccttggactatgagaagacagatgctcagggaaccaggcagagcaaatgcaaagttgtgttgcattcttgcatccgaatcaaagcttggtaagtcctatctagtaagaattcgaaacaccctgtgtatcattgcgtcacatatgtccaccctgctaggttacccatcacctctattgctgccataaaaaatgataaaaaaatataaaatataaatataaataaaaacaaaataaaagtgaaataaaataaaagtaattttaggcacttcatgcgcctagaattacttgaataaaatttggctcaccggtattttaccccggtggaagcccattttgctttccatcattttgttgaataaagacaaggtacaaaacaagtgtgggggagtcttttcggaactcctgacgtgcaacagcatcgactcaacatgacaatatgttgaacacccgcccacggccgcgcacaaaacttagcagtcagaaccaagtcttggttgggttggtcgaaccaagtgttcatttgacccatgcctggctcagttctgtcatcgttcgccgtgtggtcaggtttgcgcgtctccttccttatcctcccttgtttgtgagttaaactttggcagaaaatttgaatacaatttagtttaagtccaaatgaaaattgaaagcattaactctcaacaaataaaaagaaactgaatacaattttcctatgattaatcatgtatactttttattctttgccaacacttgtcacttgtgaacaaacatccattatagggaaccttgctaatataagtaattgatatatgtgatatggttatgacaaaagaaattcttgtccaactgtcatgatacttgggattttgtctttgcgaaaattaaaaaattcttttagagcaatactcctcactgactatattattacctacaaaggccatatatgattctcattgcaaaatcctgatatatgtttaggctgcttgcattacattgagctttgtcaaattattgtgacccgtgtgagatgcttttcatactttcatgatcaagatcacgtacactccatatacacacactatgctaaacttctacactggaaggtagcatccctcatccatcatttattttacccattatccacaaaataaatactccatgtcatttatgcctttttctccaaaattctttcaaagaaaaaaaaacagagatagagagaggcatggctatgcaaaagaaggaaaaaaagtcttgctcatacaagtatggagcattgataaacaaaagagaaaaaaatgaataaaaaaatctgctcatacaaagtatggggcatgatgaaaaaaaagggaagaaaaaaagatagccatgcactctctcaaatttccaaagagagaaaattggaggaggagatatatcaaaggagttgttatcttctattttcctttttccatccacacaattctccatacccatacacagatcacacacatgcacattcttgatcagagagtatgacttgctatctccttgggtccggtatcttggctttgctatatatgtgatgcaggtatgccccgattgatccctaccgagctccacctatacaacctagtagaatagggacaattcggcaaacatgcatggtgaggatccacaaatcaaaccacatgagtgatctgagagaaggtcatttgaggagtaaagctactttgcgaaaataaatgaaaaccctaacagattgataggaggaaaaagaaggacttgaatcatgaccgttccattcatcaatttcccaagatggtaagttagatagggcaaaggttcataggtacaggtatgacttagaataatttgtgtacttgtattgtatcttgggaaattttattccacattaatccttaacctttactcgggacgagtaatgagctaagtgtggagagttttgttgacggttgttaagtgccaaaataacaccgtcaatacttgcagaaaaccataaatgtgaaacatccaacatagtggtaggatttatttataacaatttccacgagtgttggtgtatatttgtatgcaggtgatcaaccaccaacgttgggagaggatgaggataaagaatggaaatatattccgtgctgatggactcacatggttttgagctacaacatataaaatgtgcaatcatttggagccaaaacatggagcatcatgaagtggagcccacatgtcagcatcctgaagaaagatgtgggccaggggagccaaccagggttcggccgaacccctagctggcccagtccagcccatattcggtatgacggttgtactcctcatcccaatgatggttgtggccgtttctaccggtggaaactgtcatagagaggacacttgtcaagaggagatgaagctagaaggaatatgctcatatgatgcttggagcatctccactctctctaagcaactctccacctataaatacccctctcctctccctcattcacacacaccaaagcatgagatgaattacaagaggctctagtgcactttattgtatattagaatagggagagagtaagctagaaggaatcggaggaatcccggagttgtcggtaatctcctcttacttttgtatcttgtttattactctgctttaatagaaatatcattatgagtaattaagattttcttagtgagaattacttcttggttagttcctaattagcatacgggatcattgttccctatagtccatttatttgtagtgattgctttagtgtttgaaggacgcggtgtctgggtaattactctccagggttgctgcgtatcccacggtacgtttgaggtgggtgtagaggtggtgacagccctcaagagcacttcagtgccccctatccaggtacatagtagagcgacatctgggaacagcgagttgccagtgcctgaagtattgtgttaggattaaagttaagctttccctagacactgtttctcattaggaaatcctctctaccctctgcccatattagctttgtgtcctcggatgaacctgacgaggagataaacacacacgttcccttggattcgatacccttggaatacttcgtaggggaagtgctacatcggtatatccgtgcgcttgcggattctatccgtgatcgtaagaaataccaacagtctgtggcagcacaggccactctgggattgattgcctagaaacccgtgaagaggcgatgtacatgggcaacaacaacaacgagtatcatccacaatgaggtcagtggtggaaccagccacgcctattctatcaaggaggtaacaataacagtaatttctgtaaccaaccctccttgaaagatctcgtctttgcgcaagctaaaaccactgatgctttaggcaaaaagcgagctgctaatgacaaggtcttagaaaactgttggcggctgttaaatgtcaattctataccgccaacatctgcataaagttcagataataaaacatccaacatagtgataggtacataatctcacatattccatatgtgttggtatatatttgtttgcaaatgataaacctcgatgatgggaggaaaatcagactaaagtgaggagaaatgtgtacccctgcaaggatgggttgtgaacttcatcaaaacatcagtaaatcggcccaaaataccgaagaatgaatagaggaggaccggggggaacatgagctgatggccaggccaggagggcccagcccaggttcggccgaaccaccacctccactgttggatgtggggtttggcgtggacgtcccagatgcatccctaatgacggttggattgcacttcggacatttccccttcgccaatcgtacctacccctatataaggacatcagctcactcacttcaacacacactcccaagcttgagatgaattataagaggctctattgtactatattgtatactagaataggaagagagtagagtagaaggagtcggaagaagtccggagttgtcggtaatattctcctatttcttttattttatttattactctgaagtcaatataatattcttcttgagtaatttggatttatcttgtgagaattatctcttggttagttcctaagtagcatacgggattattgttcactataatcaactagaatatattgattgctttggtgagttataaacactaaggtagatattaattgcttagacatggtgtttaggtagttgttatccagtaattgctgcgtatctcacagtacgtttgaggtgggtgtagaggtggtgacagccctcgagatcacttaagtcctccctgtccgggtacgtagtagagcgacatttgggaacagcgggttgccagtgcctgaagtattgcattaggattaaagttaagctttccctagacattgtttctcactagaaaatcctctctatcctagcctatcatttgcttggtgtccttggatgaaccggaggaagatctgatcacacacgttcccttggattcgatacccttggaatactccgtaggggaagtgctacatcggtatatccgtgcacttacagattttatcagtgaccataagaaataccaacaagcatttctggcaccgttgccggggaatggttgctgatcatttccgaaccctgttcatcctcgcatcctttttactttttttttaccttcacccctgctatcctagagaagtattcctgtcaaactcttctcgaccatggagcaactgctttttgagctgtctgctcctcggggcgaattctatgaaccacctccttcatcagagcccatttatacaactggctatgaaattcgtcccgaactaattagtatggttagggaaaaacctttttttggctttgatctagaaaatctctaccatcatctgcgatacttttaacaagtttgctcatgccttaagattcgtggcatgagacaagaaactgtgcggtggaaattgttcccgttctctcttcaagagagagcaaagcaatggtacacctctaccgttggatgtgtaggcggtagctgggagaagttgcgagacagattttgtcttgccttctttccagttactcgtattactgccattcgagtagaaattctcagttttaagcagatcaaaaatgaatcaatcggtgcagcctggtccaaattcactaatttagtgtagtccggaccaaccctgtccttacccgagtatgtgctactccaacatttccatacgggtttggataaggagtctgcattctatctggacataaccgcttgaggatcgttcatgcacaaaacgccgtcagaaggaaggacaattttggatcgcattctagaaaatacttccttcatggcgcaatccaatgaaccctagccagaggcatccatgtccaagatagaggaacctctaacgatcgagccactcactgaaccatccacttctgctagctcgattgatgagaaggttcctaagcagccgactgtcgagaatgaagaaattcagactccggattatgccgcaattctgttcagggacggctttgacgaagactacggcaataccctgaactattttagaaagaggaaaccacccgttcctttgccacctcctaatcctatggaactcgggttcctacgagaaactgtacgggagttaacatccataatgagcgatgaatggctaagggaggcagaactttcatccaaagtaattcggataaataccgctccccgaatcattccttgccatctggaagggaacgacgtcggtattctctacagtccaactgtccgggccaatctcgtttcctagtcttttgcattcgcttatttaagcgataaggcaatgaccccgactaacaaattcttcaaacatccaaacggaaatatcattgaaggatttgggattgtacaagatgtgcctgtctgctttgaagacagggaggcgatcttggatttccacgtctttgaaattcaagatttcgacatcctaatcgggctgcccattgagcaacttctcattaacacaccccgattagatagcctcaaaataatactgggagggaatgaatttcagttccattctcacgagcaaggatcgccttgaccgattccctcccataaattgagtcagcggaggaggttagtgcagctccccactcacgagtctcccgaggcccttctggaagatgaggtccccgattttatcaaggaagaagcagatcccgttgagactctcgacctgccaatcatggaaccgtcacctcgacctccgcttgagcataaacctctacctccaggcctacgatatgctttcctacacaatgacagagaagctcctgtcataatcagtgacaagctctctgaaaacgagactcaacgtcttctcaccatgttggaaaagcatcgttctgttcatggctactcgcttcaagacctcagggggattaatcccgtgctttgcacccatcgtattcctattgaccccgagagtactccttccagggaacctcaacgatggcttaataatgcaacacgagaggttgtaaagaaagtggtcttgaaactctagcatgccgggattatctatcccgtaccatacagcgagtgggttagcccagtccaggtcgtgccaaagaagggaggaatgacggtcgttgcaaatgctcaaaatgaactaatcccgcaatgattacaggaaacttaacaaggctacaaaaaaggatcatttcctgctacccttcattgatgaaatgttggaacggctggcaaatcattcctttttttgtttccttgatgggtattccgggtatcatcaaattcctatccatccggaggaccaaagtaagactacgttcacatgtccgtatggcacctatgcatactataggatgtactttggactgtgcaacactcctgcatctttccaaatgtgtatgatgtctattttcttggacatgatagaggacattatggaagtcttcatggacgactttttggtctattgaaagaccttcggtcattgtctacgaaatttagacaaagtcttacaacgatgccaagagaaggacctggtacttaattgggaaaagtaccatttcatgggccatgaaggaatagttcttgggcatcgagtgtccgaacgaggaatcgaagttgatcgggttaaaattgatgttatagatcagcttcctcctcctgtgaacatcaaaggaattcacagcttcttgggacatgccggcttttatagaaggttcatcaaggacttttctacaatcgctagacctctgaccaatttgctagccaaggatgcgccctttgtgttcgatgacacgtgcctaaaatcttttgaaattctcaaaaaggcactcgtctccgctccaatcattcaacctcctggatggactctgcccttcaagatcatgtgtgatgcaagcaatttcgctgttggtgcggccttgggccaaaccaaggataaaaatcatcatgcaatctgctctgctagcaaaactctaaccggagctcagttgaattatgcaactaccgaaaaagagctgctcgcggttgtttttgctatcgataagtttaggtcttacttagtgggaggcaagctgataatctatactgatcatgctgccttgaagtacctgctcactaagaaagatgctaaaccacaagatggattttgctgctccaagaatttgacttagaaataaaagataaaaagggagtagaaaattccatagcagatcatttgtccaggctgcagatcactgacacgcaggaacagccgataaacgacttcttgagagacgacatgctgatgatggttcgcgactccaacccgtggtatgccaacatagtaaactacatggtatccaagtacataccaccaggggaaaatcaacaaaaactgaattatgaaagtcgccgtcatatatgggatgagccatacctatatcgggtctgctccaatggcttactatgaagatgtgtgccaactgatgagaacttaagatcatagagcgatgccatgcctcaccctatggtggccattacggtgcattccgcactcaggccaagatttgacaaagtggtttcttctggccaacaatgtacgaagactcaaaagaattcgtcagaagatgcacaagctgccagaggcaaggaggaatcactgctcgcgatgcaatgcccctcacatacaatttgcaagtcactaaacgattaagtagagatgtatgcaaagaatgtcgagatattcgatgtttggggtatggactttatgggacctttccataagtctcgcaactgcgagtacattctggtggcagttgactatgtctccaagtgggttgaggctatgccatgcaacaccgctgatgcgaggcatgccaagaagatgttcacagaaatcatctttacaagatttggtatccccagaatggtcataagtgacggaggttctcacttcattgacaaaaccttccaagacctcctacgagagatgggagccaaacacaatgtggccactccttaccatccgcagaccagtggtcaagcagaaacatcaaacaaacggattaagaatattctgtagaagacggtcaacaaaatggaaacaggatggaaggataaattgtcggacgcactgtgggcataccggacagcgtatgagacacccattggaatgtccccatatcagataatctacaggaagtcatgtcgactacccgtggaacttgagcaagtatactgggccatcagaaactggaacatgggactttgacggagcaggagaatggaggaaaatgcaaatcaccgaacttgaagaatggagagagaaggcctaccacaacgcaaagatatataaagaaaggacgaagcactgacatgacaaaaggataaaaatcaagaaattcaagccaggagacaaagtgctaatgttcaactccgaggttaagcttttcggtcacggaaaattgcgtagtaaatgggaaggaccgttcaacgtcatcaatacctcttcgcacggggcaatcactctccgcaacgattcaggtaatatattcaaggtaaacggtcaacgcttaaaaattttcctttagccaaatgaaactttagatgaagaagtggatgtcgttgaattaatcaattatgaaccatgatgatctcatcttatgcatgcttaaaaccctttataattgtcatgtttgtgcttagcttagaaattagtaggcttaggaaagaaaatggaggcctgccggacccaccagggttcggccgaaccagggcggcacccgttcggccccatttttggatggtagactcccccgcccgtcctgagtctgtttagatgcgagtttggaggtagagcgatcggatcactctcctgagctagttcctctctttcttcctcctttgcaaaagcctctctattcaatctcccattcaccctcaaaaacctttgatccaagtcctagtgaacacccatggctggtatatctcaggacgggttcccggccaatatcaagaagatgaggtgaagtcgtcagagccctcgatccataagctcgccgtgcaagtgaagaaactccgcaaggagaatatagagcttagggatcgcaacacggagctaggggtagagcttgctgaaattagaaataatttcgatacccttagtcgcggtttgtgcgctaagatcaagcgcgcattcgtagaaatgggaaaggaaaataagtattacgctaattagatgtttcctttcccatgaataaaataatagtaggtggttggttttatttttccaatcatgtaagcacttgctatgaataatgtggctcattggtattaaccccaatgtttgccaaagtttatttttgttttatgtttaataaaattcaggttttgaataagtgtgggggagatatcccagcttctggcatgcagataatctgaaaattgctgaatatctgaacacctggaaagcactaaactctacagaaaattgcagaggtagtggacaccagagtggtccggccgaaccaccaggttcggccaaaccagtgttggccccaatacctctcagttttcataggtaagcaggtgagcacgtcttgtatctgtatatctccaccatggtatagtactagagctgaaaattcagaaaacaatcggttcaagcataagaaagataaaatttccaactaatgaaattcttcatatgattgatcttgtatatctatcattcttagctgaacttgtgcttgtgaaaaaccttccatgtttagggaaccttttgcatctaattaatagctttatgtgagatgattgaagatgaaaggaattcttgcaactcgtgttatgactcttgggaatatgttttcaaaataaaattgttttaaaacctcaatcctccaatttacttcatcttatacttaccaaggccatatgcaagtacattactgatcaactttattatgcatatagttgcttgacattgtattaagctttgtcaaatttatgtgacttgtgttagatatctttcatactctcatgatcaaggggtcattgccatttccatctttttccacatatataattaagctaagcttctacactggaagtcggctttccatagaaaaaattccatttaaataaactcctatattagactatgctttcttctgctggaaaagttcgtggcaaaaagaagatgaaaaaaagaaaaaaaaaggggaggaaaggcatggctatgaaaaaaaaggggaaggaaataaaagcttgctccaaaaacattgagcaatgttggaaagaaaatatagccaagccccttccatgatcatgccagaaaatattttacttttccatttttcaccacaaataaagacccttgatctaggagtatggctgatgatcttcttaagtccatatttttggctttgcaatatatatgatgcaggtatgtcccgatttatccctaccaagctccacatatcagccttagaataggggtgaattctggcacattttgccttagtgaggatccaaaaagaaaatatacatcctagagagacaagagagagagtcaataggaggagaagagctgatttacgaaaatttctaaaaatcccatgagtctgacagagaagcaagaaggactgtaatcgagatcattccatttatcaattactcaagatggtaagatagctacttataaagtttacaggtacaggtatggttgtgaatgatttatatgcttgattcataccttgacgaaattcattctgtactaacctttactcagggatgagcaaagggctaagtgtggggggtgttgttggcggctgttaaatgtaaattctataccgccaacatctgcataaagttcagataataaaacatccaacatagtaataggtgcttaatctcacatattccacaagtgttggtatatatttgtatgcagatgataaaccccgatgatgggaggaaaatcagactaaagtgaggagaaatgtgtatccctgcaaggatgggttgtgaacttcatcaaaacattagtaaatcggcccaaaataccgaagaatgaatagaggaggaccagaggagaacatgggctaaaggccaggccaggagggcctagcccaggttcggcagaaccccttggtttggccgaaccaccacctccaccgttggatatggggtttggcgtggacgtcccagatgcatccctgatgacggttggagggcacttcgaacatttctccttcgccaaccgtcatacctacccctatataaggacatcatctcactcacttcaacacacactcccaagcttgagctgaattataagaggctctattgtactatattgtacactagaataggaagagagcagagtagaagaagtcagaagaattccggagttgtcggtaatcttctcctatttcttttattctgtttattactctgaattcaatataatattcttcttgagtaatttagatttatcttgtgagaattatctcttggttagttcctaagtagcatacgggattattgttcactataatcacctagaatatagtgattgctttggtgagttataaacactaaggtagatattaattacttagacgtggtgtttaggcagttattatccagtaattactgcgtatctcacagtacgtttgaggtgggtgtagaggtggtgacagccctcgagatcacttaagtcctccctgtccaggtacgtagtagagcgacatctgggaacagcgggttgccagtacctgaagtattgcattatgattaaagttaagctttccctagacactatttctcactagaaaattctctctatcctagcctattatttgcttggtgtccttggatgaaccggaggaagatctgatcacacacgttcccttggattcgatacccttggaatactctgtaggggaagtgctacatcggtatatccgtgcgcttgcggattttatctgtgaccgtaagaaatgccaacaaaaacataaatgataaactagatggctttgcttctgcatttcaaaactagctaagctttaacaagatgattgaaacccggcaggctcaattagctgttttagtacctgcaaatgaatcttggaggattctggggcagcccgaatcctccgtttaaaatgttaaggtgatcacaacgaggggaggttagtccactcgtgatctgctgtaccctaaccctgcagggactagcagtatcgccaaggaagcgccatctggtaattcggctgatgaagaggttcagcaagagaagattgtgtagcaggagtactacgacacacaattgctgccgtttccacaaaggaacataaaaccgtaagtagacgagcagttcgctcgttttgttgaagtgatcccgaaaaatccacatcaacgtgccattgttggatgctatgcaagtgccaacatacgcacattatctcaaggacatcctcgacaataaaagaccgctcccgccaacggaggtggtcaagctgacggagcagtgcagcaatgtcatactcgacaagctcccggagaagaagaaagatccggggtgtcctacgattatgtcaggtcccgaaactaatgattccgaaaccgacatgtttagactgtatcaagccctggattagtaaattgatataggttcaacaatctagatcttcattgcatacgtttgaataaggctccaaaggatatattattacaaaatatatgggtatttacaaacttgtggcaaactaatacaacagaagctatagaatgacttaactctaatgtttggctatagacttaaaccatctatctaatctagacttgagaattaggttgaaatgaaactaacttatatgattgaactcccagcttaggcacaaactccaaaatgactctgaaaaaggtgaggttgaagcaagggtgagtacaacgtactcagcaagctattatattcaataatgtatgaaatagtagcatttgagtaaggctagatttaattgcagaaagcagaggatgtagaagaagaaagcctgtaatgactttaatgcaacagtatttagtaaaatcttgaatttggtttctaaccaaataccatatgagtcccgctactcaattctgtgagcatggctattcgaatagtttcataaatattctactacagtagatgtacgctttacccacagtccacgagttgccaatatttattagcttagtcatggcctagtattacgttattaacaattgtggcacctgttccatgaactctagtccccatgcgctctaaacgtaacgttatcagcagcgagaggagttctggcgctcccggggtctttagagagaactgattgtatgacaccatgtcatcgcaatcagggttcacaaacagactagtcatcataatttatctcaaatatttacctgcggctcggtaaatattacaatcgcccttcgcggcgtaaatttgcctcctgcgcgaggacttacaaaagaaaccactgtacagaggtaccacattgttaattaacataatatctaggtctgtccccattctagaagctacggtcgtactcgttcgttcttcacaagtacttgggcagtcttatgtcggttggaacagtactagccacccggaaatcaaccattttctactgtactgtttcaatctaagttcattatattttatgcagtctaactagccatggctaagcaaaagctagcatatctggtttgctatgttcagtttatgcgtttgaaatcatgtatgactaatgcatagaaaagagatatagaatataggacatttatgctcaaaggagaggaataataacttgctttgctccaacgcacataaatccgagatagacaacctgattatccgatcctcgaaataccacaggttgtcattcaaaatacaatagactctacttgaagaagagaaagaaccaaattcaataaaagccatgaaatgtcaaaagaatgataaatggctagaagggctagagtttagagtataaatatctcctttataaggtatataggttattgggcttatattagttgtatgatttctaaagggttggaggctagggtggagggaggatcaagcaactaatgttgcttatattttatgtgaaagctttgattggttggaaggatgggaagtagctagtttggatagttgtcttggttaggcgggtatgtagctagctatgatttggtggcggtaggtttaggtagtatcatatctagggtttggttatatgggagttaattgtggtgtaagacaatatatcggctaggttctatattttatgtataggttctggtgggtgaagagtaggtggctgagagtatggtggataggcgatactggtgggtgtgggacttagatgacggttggaattcaactaacaaggtgtcagctagagtttggttgtatgctagtcgatgctagagcataatgactagatttggtgtcttctgtagtcggtgtcagcaggcagcatatcgactagagggaataggaggtgggtgcaggtttagtagggtggaagtgttactccgacaaccgtgggtggcggcggagcggctaggatcacacagagcccgagaactaactgtgcacagcgtgctgtggaggtcgatggaatagtgaagcttcgaccgctatacgcatcgaggcgtggggtgccaggagcagcacttcgaccttgggattggtttatgccgggctttacaaccaacggttcgacgtcggggccaatagaccacgcgaacgtccccatggaaggcgtaaagttccaaccggcggtttttagtggctaaagagtatttttgggtaaaaaggaaatatttgaaaggaaaatctaagtttaaattgggaattcaaatataagattaaatcaaatatttattcaaatagtatttgaataaattaaggaaattcaaataaaatattaaaatagcaaatttggtatcaaaatgtatattttgaatttatataaatttaggtccaagtttgactggaatcggatctacggtttaggagatatgggcttctaaagattggatttgaattaaatagagaaattgtaaaaagtcactgttgatggacctacctgtcagtaccttttttccttttctttttctttttctttctcttcttcttcctcccgtcgttctcttccttccttctgcttcttttttcccgagccaatagagagagagagagggagagggggcagcggctttccggcggtcggaaggcggcgacgccggtgacgggtggtgttcccgagcaccgcgcagccggggagggcggtggctggccgagagagtgagggagaaggtcggaacggcggatggaagagctcggtttggtcggttatggtggcgacggtggtggcttaaatcggagggggaaaggaagggagaagtaggggaatggatttgcctcgtcgaggcaaagttggtagcacaagggtttggattgggatgctttagggatggagatcgatcgatggccgacgatggtcgccatgggaggagagagagagagcttggctcatgtgtgtagagggagaagaagaactcgccggctatttatagggaacgatagacggttccggatggtcggttcggaggaggaggaagacgaggaggacacggcgacagctgcttaggggagaagaaaacggcgccggcggtggcctgtgattggtcggcgacggcggcgcgtacacgtggctgatagaactctctattggatcacctaggtttagatctagtcgggtggttctatttgagatgaatgactgaacaacaatagagattaatggaaaaagggtttagggatgtgactggttgacgcgttggatgaggaggaagtcccggccatcgtcgttgtcgtcgccctgcttgacgtgggcggcggcgatggtggtcgtgacggtgacggtgctgcgcagcagtggcggccgtaggcgatcccggcgaggtcgtgggcggcggtggagtctttccgtcactggctgcgcccccttgatcggttagggttttgggg

SEQ ID NO: 68891 - DNA, 11590 bp, Oryza sativa
tttatatggcacagtgtgacgggggcccaccagccattgggctgggcgcccccgatcagggcgcgggtcaaggccccattgagccgttgggctcaaggggagggagatctatctaacattctccctcttgatctcagtatttcttttagctttttctattccatcacagatttacatatagagcatgtttcatcatcacggttaattaccgctggatttgacagccactatatacatctctattcagaaacagatactttaacttttaggccctacagtccaggactcataaggcttcccttaaacccatgcatgctacatgttctttgaacatgttgggaggtaggcctttcatgagcggatccgcgagcatcctctctgttcttatgtgctcgagactgattgtttgatcccagactttgtctttcacaacatagtactttatgtcaatgtgtttggcagcaccacttgagggattgttgtgagagaacattactgtgggtttgctatcgcagtataactttagtggtttctcaatactgtcaaccgcctttaaaaccgggtatgaacttctttagccagttcacctgccccgttgcctcatagcatgctataaactcggcatacatagtagaccctgcagtgatggtctgttttgagcttttccatgaaatagctcctactgtgagggtaaatacgtatcccgatgttgactttgtattatcttttgcaaagtcagaatctgaataccccactgtctggagcgattctgattttctgtaagacagcatgaggccttttattccttgcaaataacacaagactttctataccaatttccagtgctctgggcctggattactctgaaatctgccaagtaacccggtaacaaatgccaagtcaggtcgtgtgcacaattgagcatactgtaggcttcctacaactgatgcatttggctttgttttcatttcattgagctcacactgatttctgggacattgcgatgccccatacttttcgcctttgactataggagcaggtgcagcactgcatctgttcatattgaatttcttcaacaccttttctatatatgccttttgagaaagtcccaatgcatactttgttctatctcggtgaatctctatgcccaaaacatgtgagtcctcaccgaggtctttcatgtcaaagtttgaggataagaatttctttgtttcctgcagtagactaacatcactactagcaagtagaatgtcatctacatacagaattaggaaaataaatctcccattcttaaactttgaataaatacagttgtcctcgacattctcttgaaaacccaaatttctttattgttccatcaaatttcaagtatcactgtctcgaagcttgttctaagccattgggctgggcgcccccaatcagggcgcgggtcaaggcccccttgagccgttgggctcaaggggagggagatctatctaacagtggcagctgtagtagggttgggcggcgggagaaggagagcacggcacggcgtcgatgtggcatggttggcaaggcagcggtgcaagccgtgggcggcggcgtgcgaaccacggcaacggtggtggcggcgtatccatgtacagaggaaggagaagggaggtaatatagacttattcctgactgggccagatgaaggaactttggcccaaaatgaataggaagctttgctaattttggataaattttaagaaggtattagaaatagaggaataagattttaacccagtatcatatggtatggactaaaggaaatttggatttttgaatgaaaaggaatgaaaataaatttcttagcacaagagcaatcattcatatatttgtaatagtattattcttgtgccgagaaggaaatcaagccacagagattaaattggtggctaggtcaaaaggaggaatttggatatttggatcaagagtcaaaggataggtttaagatcaaaggatgggctaacaattaattccaataaaattggaattactttggtttaggttcaagggcaacattgggaaggtttcttggactacaattcacaaaggggtttttaaataaatttaaataaaggaaatcatggtaaaaaaggaagtatcaaatcacgatataactgaagataggttttaaataaaagtcataaaataatttaaataaacgaagaagttttacgcaagttagttttaggaggtctctctctctctaattatattttcctaggtttagaaggttaataagaacataagaaccggcatgatcaggaaattcttcccgggtgcacacgagtgaggacaaagtgtgcagaaaagacttgtgttagtctgtgagggcattctatgacctatgagagctatcagatgtaagcggcccggcctgggagaggcggaacgttacagtcaggatcaagtgtgggcaaaatccatagaatattcaagtggtcgaagtggagcatggtgaagttcatgcagaatttcctgaaaaaggaaacaacgtttcccaggaaccgttattggaagacgctagtaaaatccagtacaccggccaagaagctagagcaaccggctcagaagaagccatctcccgcaccaaaaccaaagagggtgtggaaggaaaagccaaagacgcccgctccatcacctccggagacgggtggaaaatctgcgaactaaactgaaaggaggtacggtcttgcacgtcggacccaaaatgacacgaccctcgccaacaggtaaattggtatgtatccgcatatttattttcatcaatttgaatttttgcatcaacacatgtttgcatcaacacaggtaaattaggtttactaacctcttgcagagaatgaactcaaaatggaggagaatggacatcaaatcagacgatcaatcaatcggacgatgtcgagaatcagacttatcaatgaataggccaagaactcagaaatgacacgactaattgggccaaagttcagaagtctgtggaggggagaagtccaagaagccagcagccaaattatgggctggttgggccggcctctggttcggccgaacccccctcatcgccgttggatgcagggtttctcctggacggtgtagattggcccccaatgccggttggagggtatttccgaccattccaaccatcacaaccgtcattgggaggctatataaacccctcactctctccatttcaaaacacactccaagcaaatctctctcattttctctcaagtttagtttagtgttcttaagctagtagagtaggaatagaatagaaatcagagtccgaaagccttcgaaagagttcgggtatgactctagtagctctcctttcctcttttgtaagctttgtactttatttagaatactcttctttatacatttcttgtaacaaacccaaattgtagaaacttggaaattcaatataatgaaaaaaatattattgtggtgaaaatttgttttaggtgtttttggatcttctatgcatcatttcattttgcatatataaattaaattagaaaaaaaagggtaatacgattagtgatgagtataataaacaacaaatttaattagttataactcagcttttgcatctcaattaaaaagatgaaggcaaccaaaattaatttaaattggaataaaagaaggaaacttgtttgaatttccaaaaaataactgcacatgagaaaaatctcaaaaaaaaaatcaccaaatggagttcaccactacagtaacttgcagtaaaattggcgcatgcttttgagcagtgtagtcattccaaaaaaaaaaaagaattcgtcaaaccctcagccctctctaaaaatccctgggaagaaatgttcctcacctcccctattcctgtacttctctgatcaacgggcccaagcaccctggaccccacctgccagtggcccagcaccccatcccactctccttctctttcccatctctttccttgcagatatttcatcgaacacataggatgcgagccgaaagtcgtcgcctccaagccgcccattcctcctctgcccgcgaatctcactgcaaggctgtgcaaagctgacgacgcctctgccccgcctctgcccgatgccctgccgcgcccagcgctgccctcgcagccgctgcgcccaaccgacgccgtccctctgcccggagcgacgagacgctacaaactcgaccgttgcttcctccgtctgcaaagccgccgacctgcgtctgccgtctgcaaagccgacgcccctgcctccgtgtctcccggctgcaaagccggcctcgcagcgcgcctcgccaacccggagccgacgccctctgccaaagccgacgcccgaagcgacaaggcgagaccgaccgcccctggcttcctctgactacccctgcactccctctgcaatccctgcgcaaagccgacgcctgctgcccgccgtgttccccgccgaccaccgcctgcgcgcgcgagagacgccgaacgcgtcacgacaacctccgcgtccgcctctcgctcctccctcgcctataaatcgaaccctcgcgctagctaactctccagaccaccttcaacctccactcctaaagcggaagccctaaaccctctgattcaccgggaacggccgcgccaccgtcgcgccccgcgccggccaaacagaacgccgccgctgagcccacaccatcgagccgtcgcctcggtgagtttcctctcgattcctcgcgccatcaggctcataggacctccataaatccattttcgaaatctcttttatgacccctcgaccggagagccgccgccaccattgccgccgccgaccgcctcgggagctcgtcgccacgccacctcggaccgcctccgcccaaaaagaacgcggggtaagccaccacatagtccctaggtgcttccctgtcctttaatcgagtcgccgttcgccatagccgccggccgccatcataccgaaccactgccgccgcttgccatggccagccgcctctagccacccccggccacgccaccgccactaggagatgcacgtgaacctcctctagccacccctgcctctgccctagccagccccgcggccgctcgccgccggccagcccatccggagccgccctcgtgctcccctctgtctgttgcgaacggaggaagaagacaggacctgttcgtaaataagaaaaactctagggctcttgatacaaagcgccaatacacttacatgttggaccgagacctagatctcaatagccgcaagattagggtctgttctgtgaaacatcgagacacttacatgtggaccccactgtttaaagtggatgcgcgctaccgtaatacgttttgcatgtaggaaagcgtactctatatagtacgcttcagccttttgtaaagagaaattaataaatctaagaaaatggtttcggttaattatttatgcactataaaatgctgaaactttgtaaaatcatagaaaattcattttaactccgattgaggtgaaccaaatttcgttagattcataataatgttgtctttaatactgtacactcaaattatcaccactgttgtgaaaattttcactaatttaaatttgaatagtaaacttcgtatttaccgtactttaaatattagaaacacgataacttgcacatacaacatcaggtttaggcgattctttctcatttatattaaatcactctctttacactgaacatgttcatgcaccatgcatcatattttatcttggagttttattggatgttcatttgaatgtacgtttaaatttaattagaggacgaatcgattgttgccgttggcgagagtgtgcaggaccaagagttatttgaggaaccaactgagcaaggcaagtcctattcaattcctacttcgatcatgttgaatcctatatcttcgcaaatgctttattattttataaattgcatgcgatgttttataaagaaaatggggtattggtagaaataacctaattgctgcattacctaccttgatatattgattatcgttgaagccctaggctgagaatatgtgtgtgttgtacatgcacaatgtgggtatattcgagctgctactatagctacttgcttagccatgcttagaaaatttccaatggttatatatgacatggtaatcattctttacaaatggaatatttttatagaggagttgcctttgttgtttatgaagattggaaactgaaaataatgattttagacttgggcggcaagtggtgtgcatatggtagtagttgcgcaccgatagggggagtgttcgcctaggtcaattaaggactgaactacgtgtcaccaactaagattacagtgcaaccacatgtgttggttatggggcaaccttagcttattatgttgcttattgcttaaccttgcattgggaggccgttgtagtagggactagtctgagcaatggttcataggagctacacatgtgaccctctatgggaacggttgtgttcgccatatggcatgggcgtctgagcatatccaatattactgatagtgcctcgttgagggaacggatgtgttcgcctcacggcgttaggattaggttggggcccatctttcctagtggcattggttcatggccattgtggagaaacactctccgtgcgcatgcaaggttaatctttgagcaatgtagtggcttcgtcataggctagcaaaacaggtaccggtttggtatcgcgtggcatggtttacatgattgctagctcgtgtcatgtgcgtaaagtgcacaaactctgcagagtctaaactaattgattagccgtgctcacggtcatgagcgacttggtgaaatgatacaagtataatgttcgtgacttttgttaagtaaattctgaaatgggtatggtaaataatggtgatgatttatgcccagcatgggttaagaataaaattgttacttgttgccatggagggcacaaggatggcactatgataacattaatgttactattactgttgtttatcctttgatttacaaaatttcgttgcaatctactattatttactattgtgaaacaaaatttgctttatgctgaaaatgagccacaaatatagccatccttgatctcagcttacaataatcctaggtttcccaaggtttgggtaggacttgccaatacctagtgtattgacccacctattgttgttgtttttagacttggatgcaggatgtgaggtgcctagtgacgattactttgcaccgggtaccggagtttttgaggacggttctttctagggtgattcttagtcggttgcctgtgtggtttggtagatgggcataccggaacatatatatctttatcttttccgctgcgtttaaactcttttatttggccggtcggcctaactactatgtaagacctatgcaccgttaagttatgagaaccacttatctacttatatgtcaagtatgattgtatggatgtgataacaatgttgtggacgcgtgtactagccattgatcatgggactagtacagtgtacgctccaggtattcgggaattcaatccccgggtgccgacatttctggtattcaaatattttccgagtatatgaatgccagcttagtattatgttcatgttatactgattatactgctagcttatctgggagatgcatcggtacgggtataatgtttgcttatgcaattactctatgtcatgacgatgatattagagtagtatctggtagtttaggcatggtgtctagattacgggatatcattatttggggttatatgctgccgatgagaggtgggccgctgatggtgatagctcagtacgggtattcactactagaaaaatcatttgttgccacgaaaaaaatcgtggcatcaatactcaaattgtggcaatagatacatcttgccacaattgtaaaatcgttgctagccgtggtaataggttattgcaacgatttttattttgtggtaataaatttagatgttgccacggaatggatgtggcaaaaagtcatattgcaacacttcacatcgttgtaataaaaattattgccaccactccatatgtggtattagttttacgtaccaaattaaaagttcaaatattaatctatcatcctatctatttatctacttatttttttgattttgtgtcttggctaggattcgaacccaagacctatccttcacgcgtgctctcctttaccaactcatctacgcatcaattctgttggaaaatgcatatcgttccatttgagcctagctaactgagatttgaatcatagatttgaatatctaaaagatttcaaatgaaaaagttatcacctataaaattgtagatctcgtcgagagctataatttccatataaaatttgtctcaatccgtgtccatatgaaaaaattaatttaaattatgagacgacaatttttttattgcaatgaatttgttgatcgtggcaaaaaaaaaatagtgaaaagtaccatgtactatataaattgccacaaaaattaaaattgtggcgatagaacatgtttttttgcaacagtacgattttttgtggcgatatatcattttctattgcaacaaaagtattaaataaaacaacgattataaatcgttgcaataaaaaataattatttgccacagaaaaattatcattgcaatagtataatatattgctacgaattattttttgttgcaataatttggtggcaatagctcaattatcttgtagtgattcctccgtgtgtgtatatagtcctaagttaatttcttggggagggtactcctccgtatttaaccccggttgtatgatcatgacgggttgtcgtaaggaactcgacagtcaggggtggcttctcgaagtaccaggagggcatcgggtagagggtattagctagttaatcatataattagaatgtatgtatactatgtatactagaagtataggaatatattttctttctattttctttccacttagcttagatattttagtatgagaatgagtagctccatgcttgtgtgtcactctaccctttgatttatcttaacccctacttagactatgattattacaagtaatatataaattattagtatagttctctctattatgatcttcccatgggattaaacaaatatgatacccttggaatactctcgggtgaaatgctacaatggtatatccgtgcgcttgtggatgaactctgtaaccataatatatcaagagtatttctgcgccattgttgggaattatatttctagtaatgtcgttaagaaataccaacagcgagtcctcttcacccttgacacagtaaagaaactggaagtttggactgaggtgctgctggatacaggctaatcaaggccggccttgatgccaacatggttgacaacgacttccaccatcagagcttggccatcctgaactagtggagctgacggtgttggctctataccagtcctatggacatcagtcaaactcaacctgatgacttggaggaggctgcgctagacatggtttttgcgcatctcttaaaggtggcgcaatgcctgtcctgaaattgggattgctaagacacacgctgcaaccaagatcatcgatgtaaaagacgctaccctagagaacgcggaagatgcccctaaagatctagagctagcttggtcagtgcctctaatcctgcatcaactttatcgtgcaaagagaggaaacattatcagcatgtgacccttgctgagccagtgacaaagcaaaggaggctggtgactcctccccacatcgtgagcgaacaggactacttcgcctaggcaatgttggacgacgacgaagccgggacgatacacctcgatggttcggcgatattgtttccaacactgtttccggccaatgcgcgttctgaatttggcaagattcaatctcctttgattatgtgtcgatatacatctccaaatctgagtctatcttgtcaaatttcgctcttaacaccggattccctagcactgggcttcctcttgggacttagcaactaactccttggcccagtgatgtgttggttaggcacaactagttaatgaacatgttagttctatagtagagccaccatgtgttgagtttaaacatgttattcacattgctagtgtcacgaccgggaataacccaacaggcgttccttacgtgcgtgcattattccttgtcccaggaggcaaggtacaccaaaagttgatacaattcagagtttaacaagcggaagcgtaaatagttaatttattacatgggcggcgaaggcccagcacaccagaagacaaacgacaaacagcggaagactagggcgacgaccacaggcgcttgacggcaggcacgagctagacaccaaagccttcatcttccaggaactcctcttctgagtttaggaaaaattgagcaagactgagtacaaccaccgtactcaacaagacacacccacaagtgcaggataaatgcaagggagtacaagggggttataatataaagggttagggtttgcagtaaacagcattaaaagacacttagttgctcaaagctattttgtaaatacgattctagagctatacaagattattaaacaaggccgtcaacccacacgaacctgccttaacccaaggcctacgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagatgtgacatagtttccaacccatcctagccatagacaagagtaccgacccaaccccacctacggccggaacctccgggacaggtaggcaggactgagcccctagcagcaggacaccggccctgtgccatgacatctcgactaccgggccgcagctcgtgtagccttcatttgccctagagatgtccatcgacccccgacttcgtccatctccatccgtgtacttttgtttataaccagactgagccacaaactaagccttacccactagacatgtggaagtacggtagtgctttgcaacagaggcccgaagaccggtccctatatggccgaggtgtgactgtcaaaaccatgcaccccgagcccagcctaaaaccattttgaggattttgaatagagggggaggtgtgaatccaattccacaatagtccaacaattacatagtgtccaggtgaaaagagtattcccaaagtctagagttgtaaaaccacctaatgttgcctaattaaccagcgaagcatctacctaaattcatactatatatagaaaatatttgaattcaaattcaaatttgaaacgggtatataaacttttgacttataaactttaggtctataaactttagatgtatagaaatactatatatagaaaatatttgaattc

SEQ ID NO: 68892 - DNA, 2025 bp, Oryza sativa
  unsure (1)..(2025): unsure at all n locations
taattcaaattcaaatttgaatcgggtatgtaatcttttgacttataaacattaggtctataaactttagatgtatagaaatactatatatagaaaatatttgaattcaaattcaaatttgaaacgggtatataaacttttgacttataaactttaggtctataaactttaggtgtataaactttagatatatagaaatactatatataaaaaatatttgaactcaaattcaaatttgaatcggatatataaacttttgacttataaacttttggtctctaaactttagatgtgtaaacttgaggtgtataaactttaggtgcataaatttactaaaataggaaagtaatgcggtgccaaaaaagaaaaccaggtggagggggggggggtgaattgatcgctacccgatcgcccttgcgatcgaccttgaagaggatgcagcagctggagggggtgcaggcgatgcccaggatcacctagaggtgtgaggccctccgccctttccttagatttttgaagtttttcttcttcttttttgcgtttgccgggaaaggcgaacaatgtacattcggcctcttccctccttattgtagccgaaaacgtccctttgggtatttggaatgtatgactctatcttagccactttttatggtcgatgcctttggcgtatatgattatgtcattttcgtattatgtaatatttcctcttctttcgccaattcttactatacaaatcgtcttttgccctttctgcacagtttaacagggtgttcgccaaaaattgtgtattcggcgaagcaaaaacaagaaatttgtggcgttgaagggtttgccaacggtgcgatgcccatttcggcctgtttattgcgaaatagtgataaacggccgcagctataaggtttttaaggttgccgactggctacaggcgctgacagctttcgcacttcttgacttgctcaacacagactttcagcatggtgggccagtatactccttgttgaaacactttggaggcaactgttcttgcggcctggtgtgcgccacagagcccctggtgtatgcactgaagcaaaggttagagtatgccggagcgatatagttggcccgagaccattttgtatttcgcggctctgagctgtaagcgctttgcttctgcttcatcttccgggagccagccgttcttgaagtatcttacgaatggggttcgccagtctgttggatcctcgcccagttctgtctggtcgattgccatgacatctaggccctctgcgggcacacttggtgcgtataggacttcgaaaaagatgctcggcgaatgtgggcccccataagcagtagatttcgccaaggcgtcttcttcctcgttctggcctctagataaatgttcaaccattatgccagcgaagcacttttccatagaccgaacagcctccaaatacttcttcattccttcttcctttgcctcaaaggagttatgaacgtgacctgccaccaacttggagtcggttcggatgagcaagcgccgaacccccaatgttttcgctttttttaggcccagaagaataactttgtattctgctgcgttgttggttgtgtcgaactgcagccttgcgacataccgaatcggcacaccccctggcgaagtgagtaccgccgcaacgcccgcccacttgtgcgaccacgagccgtcggagtacatcacccagggttgttcgacgggctcgggctcaggggcgaatgccagtgtccattcagccacgaagttagctagcacttgagacttgacagcagtgcgggcaacaaaatgcaagtcgaaaggggatagctccgccgcccacttgctgagtcgaccagtaacttccttgcctcggagtacttcgcccaaagggtactgcgatgacaccgtgactttgtgggcttgaaagtagtgtttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 68893 - DNA, 48895 bp, Oryza sativa
tgcaagcttggggggttttgttgacggtcattttcgatcagtttcgaccgtcaatatcactaaaacaggagagaattagtgatgcttgcaatgcataaatatgttagagtaataatattccactagtattaggtctactaacctttttgcagagaatgatcataaagtgaaggagaatcgacatcaacgcccacgataaatcaatcggacgatgtcgagaaccagacttgtgtatgaatgggccaagaactcagaattgacacgataaactgggccaaaattcacaaatccgtagagaagaacaacagaggaggctgccagctgaaattgggctagattgggtcagcccatggttcggctgaaccagggggttcggccgaaccctcctcagcgccatccgatccagggctttgcctggatggtgtggattagcccccaatgacggttggagggtatttccgaccattccaaccgtcacaaccgtcattgggaagatgatttgcttcagaaatgatacattagaccaagttcatctccatggggagctccagtcatttttgtggaaaagaaagatcatacctagaggatgtgtgtggattatcatgcactaaatgatgtgaccatcaagaataagtaccctctgcctagaattgatgatttgtttgattagcttaaaggtgccaccgttttctccaagatcgatcttcgatcagggtatcaccagttgaggattaaagaggaagatataacgaagacggctttcaccactcggtatgggttgtttgaatgtactgttatgtcttttggacttaccaatgaccctgctttcttcatgaacttgatcaataaggtgtttatggaatacctggacaagttcgtggtggtctttattgatgacatccttatctactcccgaaccaaggaagagcatgaagaacatcttcgtcttgcactagagaagttacgagaacatccactgtatgccaagtttagcaaatgtgaatttcggacgtctgaagtaaagttccttggacacgtcatctcagccggaggagttgccgttgatcctagtaatgtggaatacgtaaccaactggaaacaaccgaagacagtatcagagattcgtagtttcctgggtcttgcaggctattaccggaggttcatagagagtttttccaagatttctaagcccatgacacgcctgcttcagaaagacgtgaagtacaagtggtcagaagaatgtgagcagagttttcaagagttgaaaggtcggttaatatcagcacccattctgattttgcctgatccaaagaagggtttccaagtgtattgcgatgcatctaagcttgggttaggttgcgttttgatgcaggatgggaaggtggttgcctatgcatctcgtcagttacgtccccatgagaagaattaccctactcatgatcttgagttagtcacagtggttcatgcgttgaagatttggcgtcactacctctttggtactcgtacggaggtgtacacggatcacaagagtttgaagtatatcttcacccagccggatctgaacatgaggcagcggagatggttggaactgattaaggattacgacatgggacttcattatcacccagggaaggctaatgttgtagcagatgctctcagcaagaaaggctattgcagtgctacggaaggacgacagttgccgtgggagttatgcaaggaatttgaaagactaaacttgggaattgtcagtagaggtttcgttgcagctttaggagcaaagcccactctggttgatcaagttagagaagttcaaatcaatgatcctgatattcgagaaatcaagaagaatatgagaagaggaaaagctatcggttatttggaagatgagcaaggaaccgtatggttgggcgagagaatttgtgtcccagacaataatgagttgaaagatgcaatcctgaaagaagctcatgacactttatactccattcaccatggtagtaccaagatgtaccaagatctcaaggagaaattttggtgggcgagtatgaagcgtgagatagcagagtatgtagctgtttgtgatgtttgtcagcgagtcaaggcagaacatcagaaacccgcaggtttgctgcaacctttgaagataccagaatggaagtgggaggaaattgggatggatttcatcattgggctacccagaacgtcatcgggccatgactctacttgggtgatagtcgacagacttaccaaagtggctcatttcatccctgtgaggacaacatattccggaagccatttggcggaactgtatatggcaaggattgtgtgtttgcatggtcttcctaagaaaatagtatccgatcgaggtagccagtttacttcaaagttttggaagaagctgcaggaagagatgggttctaagctgaacttcagtaccgcatatcatctgcaaacagacggacaaactgaaagggtaaatcagattttggatgacatgttgagagcttgtgctttagacttcggtggaagttgggataagaatttgccttacgcagaattctcgtacaacaacagttatcaagctagtctttaaatggctccttatgaagcactgtatggtcggaagtgccgcactccacttttgtgggatcaaacaggagaacgtcaggtttttgggactgatattctaagggaaatagaagagaaggtaaaaatcattcaagaaagattacgcatagcccagtctcgtcataagagctatgctgatagtcaccgcagggatctaagttttgaggaaggagatcatgtgtaccttcgtgtcacgcctcttcggggagttcatcgttttcacaccaaagggaaattggcaccgcgtttcgtgggaccttataagattgtcagtagaagaggtgaggtcgcctatcagttggagttacctcaatccttggcaggtgttcataatgtgttccatgtgtcacagttgaaaaagtgtttaagggtacccactgaagaagctaatcctgagcagatagaaattcaagaggatctgacttatgttgagaaaccaatccgtatcttggagacagatgagggaagaaccaggaatcgagttatccgtttctgcaaggtccaatggagtaatcagtcggaagaagaagctacttaggaacgagaagatgaattaaagtcagcccatccgcatcttttcgccagctcttccgaatctcgaggacgagattctgtttaagtaggtttgtcacaccctaaaaatcctaaatttataaattgttgtttaaatggaattattagaaatgattttaaaagccttgaagaaaagatctaattttaaataataaattccaatataaaagtgggctaaataaaagtttattaagtacttctcttgattctatagttcctagatttttctgggatttatttgagccaagaaagtatttttaataaatggaattgcatttcatgaataatttaaaaggaaaaaggtatgaaaatcctcttttggctttgggccgaaagtcggcccaagtctctttctctgcttcggcctgctcgcgctcggcccaagtcggcccgccaagctaagccaccctctctccctcctctctctcgctgacaggtggggcccacctgtcagggtcgtcttcctcctcccgccgcagccgcgccctagccgtgcgcaagccgccgccatcccttccaaattccgtcacccctttcccaatccgatcaaattgatagaggggaaatgatcccttcgatctcctctatcttttctcctatagaaacttcatctaatttcgtttggaaatcgtcggattcgagctcgattcggatttgtttttttctcctctaaccctaaaatttccatcgtcgccgccggctgccgtgggcctagccactgccccctagcccctataaaaggaccccaagacctcctctgtccgccgccaccttcgccttagcccgctgtcccttgtagcgccgcctccgcgtcagcccgtgcgccgccgtcgccaccgccagtccagtcgtgcgccgccgctgttccagtcgccgccgtcgctcgggaaggccgccgccgctgttccagtcaccgccggagctttgccgttgtcgtcgacccgaacgtctcccctgcttcgacctcgccgccatcgccgttggttgccgtccgtcgtcgtccgagcccttggtgagttcgccgcattgccctctacccgtaggtgtggtccgtttgtgccgccgcgccgacgttcgcccgcgagcacgaggtgccgagccgccgctggtgatgtcatcgtcgatgtcagcgccacgtcagccgtagaccgcggtagatcggttagatctcggccatccattttgattagattagatctcggccgttcgttccatagaccgtttccgtgcacccggtccaccgtgaacccgagccagcgtgggcaacgggtttaccttttgtatagtgtagttcattgtggagcaccagactatgaagtggcggagataagctgacgggggtcgctggggagtccatgccttgtttataatggggtgattattatccaggaagggtgcactgcttttaattgtgttatgcagagggtattgtcacaatctctattctggccagagtaaaactattcgaatagccatgcccacggttatgggcaggtctaacaatgtcttacgtgattagtctcacacctctgaccataataaatgatgctgaaggtgttctatagtgatgctgaaggtgtggaggattaggcgtagccctggtgaagctgcttgtgggatggagtcgcctgcgctgtttatctttttccgctgcttagatctttattgtttgagaggaactatctacctctgtaatgactttatattcgcttaataattagataaatacttgcactctattatcaatttgttattgtgtgcctcggctgattcctggacgagggtttgcacacatgtaagcgtttggagttttggatagaaattccgggcgtgacaattaaccatcatgagctaccattgaatataaccagaagtaatgatgtagtgtgattcatcccattaataagctaatgtttataggagcaacgactcgcggcctgatgctccggaagaaagcttctggattttctttgaagttttccggaaagttgtaaccagtcatgcaccaccctattttcacaacaaaagtgaaaacaaccaaggttagcctgtaaaggaaaatgattatacagagggtaaatacaaaatattagttcaggtaatctctattatgtatcttccccggcaacggcgccagaaatgcttgtcggtatttgttaacgacattactagaaatataattcctagcaatagtgcagaaatactcttggtatattatggttacagagtttatccgcaagcgcacggatataccattgtagcatttcactcgagagtattccaagggtattgttgtcgaagtgacaactgcgtacgttgaaggacgtggttactcaacagttgttggaaacggtgaagtgttttatcttttgaatttttcttgggatccgcccttacatggctgtaggggtttatttataatcctattacaggttcccctatttgggcttgggttttataggggaatttacatggttgcccttatgaaagggacacttacatgggtatagagtgtaattgaggtacatgggcctctaaagggctgactggcgaatgttggcccaatggccaccgggcttgagcggctgggatggtctcttgggccttcttgaagctggactcgttatggcgaagtcaccttcctttgtcatacactcttcgccgtatagtcttcgcccaagatgccttcagcattttgggagaccagcgcaattcttcacccttcatagtctttgcttcaaagtcttcgccatggtggggcttcacccccgatgaactcgatgtcttgggcttgaacccttactggttgcatggtttcggcaggtctggtcgaagggtctcatgacatatcgccaacaagcccataacgggcaagggtgagataggagcttcgggcgagaccgtgcaaaccatgtgatatggtatgaggcgccccctttcgaccgatgctcctgccgaaacctattctggagtcctgcagagatagtgtgcgctgtatgtatatgtatttttatggttagtaatgctttgtggttttcgccctttgcgaagagcgaatccgtttttatttttatatgggccgaaatgaacagtggtgggcttccttttgtgggctttttcactgtgtggctcgatcgatgggtatttactgtttcgcctacccttgtgccacgtgcggcctatgattcggtggggaggcgaaccagcgtcttggtgggctatatattccccccttcccctttttcaccgccttaccctcgtcattttcaccctgagtgctctctcttacatggcgcccttggagtcaccagacctttcgctcgttctccctcttcatctccgcgcacacttttcgccatggctcctcgcaagccgaaccctgccttcacgacgggccccgaccctagccggatcgacgataacaccaccgccttcttaggggcttcgctcatggatgatgacgagctagcgaagttggtcagctccggagcggtggcggaggggcaggccttcgccccggggaaggccttggtgccgaaacacggcgacaaccggacgatggtgttcgctgtgttctttgaggccgagcttcgatttctgtgcaatgtgttgttgccggagatccttcgccttttccaggtggagctcccccagctgagcccgtcggcacttgtctggatcgccatcttcgactgggcgtgccgaaccgctaggttcgaaccgagcgccgagctttttggcaccgtgttctacgccactgtgaactcgaaaacaatggtcactccggctgggacgaagaagatggcgttcgggagtgtgaacattaatgttcgtcccgagcagtccgatctctggccggtgaacaccgccatgtcgaagtgggatcgccattggatggcgaaatggttctaccactccattcccttcgaggctaggtccgatgcggcgaaaaccctccggtgtcaccgcaggtcaattgcgccgaacaggaagcccaaagtcgccgtcgacggcggcatcgaagcccggttcgtcctgttgcgcaaggtctgctcccgccttagctgccacgacttggtggaggagtctctactttcctaaatgcacttgtgtttcgccccccccccttttcttgttcgacgcctgatgttttgacacgttttgttttcgcagtgctgactcttgcttaggctgataccgaagctcgtaggatgatcagcgatgtgtcggttactgagtatagccaactgctcacgcggcaggcagccggccgggcgaatcgggtgtatgatggcgatcttccaccccgggtgaaacccttcaaggccgatggcgacgaggggacgtccaggaagcgtatgcgcgggcaggtgaagctggcccctcagaagagaagggcccccgcctcctccgactctgacgccgatgacgaagataacatcgaagaccatgatgacgaagaggaaggggaggacgaaggggaggtggaagttgcggccgaaaaggctgcgtatgaggcagtcgacaaccgcaccgagacccatggctacaccccaactccgagtcccgagcatgtcgaaaccgggctggagtcgaatagctcccccctttgtcgaaacgatttggagtaaatgctattagctggtaaattgaagtaccaagaatgggcggcgccatctagagcgagatgtattacctttgccttggaattttagtcgccatgagcggcttcaatcgtggactcgtagatgggcaaagacatcgtgcaattgctcccatgagtaaatgctattagctggtaaattgaagtaccaagaacgggcggcgccatctagagcgagatgtattacctttgccttggaattttagtcgccatgagcggcttcgatcgtggactcgtagatggacaggaactcttttgggtccgtttcgcctgagtatcgcggaacgggtgagaacttgaactggggtgggattggacgaatcttgcttcccccactcagcggcagccccttttcgccccccgccttgctcacggcaccttgctgtagaggcccgtttggatatggcatggcgaagggcgaagtcatggcttgcgcgtgcggttgggacacagtgttcggttgcccggcccctgtaacgccccgattttcgttcgggattaaaaatcaattaataatgcattttctagcaatctaataaaaagttaaaccaatttaatcatgtgaaataatgggagaattaaaattttcccttaaaaatcattggccgggaatattttgtaatattctttgcgtccgaaaatactctccggattttttttccatgaattttcggagctcaacaagtaatcttaaagtcacaaagttcgattaatcaattaaataaaaagaaaaccaaataaaaatccctctcctccctcttgggctcggcccaactcccccttcatcctctcgagcccggctgccctccttttcccctcctcccttctctttgggccgtcgacccggcttgccccctccttcgcgcaagtccgcgtcgcctccctcctccccccgagcgtccgataggtgggcccctcctgtcggggtcacccccaacctctagcccgagccggcaactgccatggccgcctgagctgcccacgtcgccgcccgactcaagttgcattgtcggaatcggctgcttcggcttacctagcctgacttagacccagccgatcctaatcgtagccgatctggactccagccgattcttgctctgtttccgaactcgatcttcgcctccgactttgcttcgatctaatcttcttccccgatgccgatattaccaaatttggttgttaacacatgccccccaagtccggaatatttgataatatttcggatttgctgtaaatcgactccgagcaagtttcgcactttgccgtttttcgacccttactaccgtgctttaaatactaaccgttaccctcgagaaatcttacaccgtcctcctccgttttcgccactgaaaccaactttgccatctctctctccggcgatccccccgacgcacaagacgatccccaggcgtttcgttcccgaccaaatctccgcccgcggcgatgtcgtcttccaccagcccttctactacgccatcggtcgagtactgtcacgtcccaaaacgaccctaaaatatatcctttaaaattatgcctagaataattaaaaatccttgtgaaagcctccaaaaattaaaatgtgcaaagttaaaagtcaaataaggcttggaggatttttgtatatttcctaaaagcctaaaatgtgtaaataaattttagtggaattttcagagcacaaataataattgttaagaaataaacaaagttaaaaaggttttataaaaagaaaaccctaaaaatcccccttccctctcttgggccgcattcagcccacttccctccccctctctcctgttcccccgcggcccactcagcccctccccgcgcgcgcaccgctgacgggcgggcccgcccgccaccctcgctaacgggtggggcccacctgtcatccccgtcctcccgccgctcccgccgccccgcccgcgccaagcgccgcggccaccgcgaatcccgccgcctcccgccgtccccgcatgcaataaagtgggggaaaatattccccgtgaacccctctccctttccccccatttttccctctctctcccgcattcaaacgggcagatttgctcccgcaaatcttgccggcgccattgatggcggcaggacctcccggccggtttacttcctcccccttccaaccctatttaaacccaccctgcacctccttcgcccgtttctaccctttgccgcgccttctcctcgccggaatcgagctcgcgccgtcgctctctctctcctccatcgccgacgacctccggccggccttctccgctcgccgggaccgtctcccgccccggcgttgcctcctccggcttcgccgtaccgccgccgtccacgtccaccctctcgtcgagctcgccgaccgccggagcaccgccatccccgtcgacccgagccgcgccgccgcctttttcgtcgtcgccatcgacctagggtgagccgtggaccgccacctcttttcccccttcccttcccctctctcggccgccgctccgccgtgcctatggccgccgccggcgaccataggggcgcgggcgccgcctcccgccggctgcgccgtcgtggccgccttcgggcgctccgagtggccgccgcgtggggcccggccgtcagccgcccgtgccctctggtgtggctgacgcgtggggcccacggcgccggccggtgcgagcccgggtgcgcccggtctaccatggaccgtgaggctgcgcgtgggccccactcccgtggacccggtccgcgcgcccctccccctcggctgacgcaataaactattttttaattaaaacttaaataaagaaattcgcaaatattcatttaaagagcatataaacttcaaatgcccataacttgcccattggaactcggaattggaccgttcaagtctctaatttttccttaagaagtcaagaacccatttttgtgctttattcctgcttgttatatggagtttattagagtaaaatcctttttcctttccgttggtcgtgtagacgctgcagcttcggaagatccgctcttcgtggaggttgaagccgacgtttgggaaagcgagcaaggcaagtcccatcgtccttgaacatattgaatcccagtttataaaattagtttgatttaaattattgcattatcgctttatttaaattcccgcgttatcactgttttatttagccatgcctatttatctttgttatgaccttattattattgttattgttattattcccttgttcaccctagaataaacaaaacctcaactagtggacactctactcatggtaccactagtatgaatttaggtagatgcttcgctggttaattaggcaacattaggtggttttacaactctagacttcgggaatattctcatcacctggacactatggaatggttggattattgtggaattggattcacacctccccctctattcaaaatcctcaaaatgtttttaggctgcgctcggggtgcatggttttgatagtagcacctcggccacataaggaccggtcttcaggcctctgttgcaaagcactaccgtacttccacatgtctagtgggtaaggtttagtttgtggctcagtctggttataaacaaaagtatacggatggagatggacgaagtagggggtcgatggacatctctagggcaaatgaaggctacacgagctgcggcccggtagtcgagatgtcatggcacagggctggtgtcctgctgctaggggctcagtcttgcctacctatcctggaggttccggccgtaggtagggttgggtcggtactcttgtctatggctaggatgggttggaaactatgtcacgtcttccgtccgtataccgtggtggtatgtggcacgtggttacacgtggggaagatgtgtcttgtgggtaaagatgtacacctctgatcagagtataacctattcgaatagccgcgccctcggttatgggcaagcctagcaatgtacccaagttagagttttaattcttaaaacctgcttaacaactaaaatgtggaatggttggcctgggttggcttgggacgagctgggacccagggtcgggttgccaattcggtctgaatcatcgtaggccttgggttaaggcaggttcgtgtgggttcacggccttgattaataatcttgtaaagctctaggatcgtttttacaaaatagctttgagcaactaagtgtcttttaacactgtttactgcaaatcctaaccccttatattataacccccttgtactcccttgcatttattctgcacttatgggtgtgtcttgttgagtacggtggttgtactcagtcttgctcaatttttcccaaacccagaagagaggagttcctggaagatgaaggctttggtgtctagctcgtgcctgctgtcaagcgcctgtggtcatcgccctagtcttccgctgtttttcgtttgtcttcatgtgtgctgggccttctccgcccatgtaataaattatctatttacgctttcgcttgttaaactctgtattgtatcaacttttggtgtaccttgcctcctgggacaaggaataatacacgcacgaaaggaacgcccgttgggttatttccggtcgtgacaagttggtatcagagcctccttgaccctaggacgagctttagatcccaagccttagcaaaattttcgaaataaaaatcctttcttatttgtgaaaatcctctagtctctctctccgtcttgctgcttcatttatcatcaaaagctgatctctaaaatactttttttctcttttgtctttgcttgtagatggccggcagcctcaaccgtcgtggcctggacctgactggcttcgttttggagctgcggggcatgtgcgttgtcctggggtatccgcatggagtggactaccagggcaagcagctcccggagcaggagggtgacgatgcagagccccacgctgcttgggaggtcactgcagtgatcctcactggctcacccgagaggacttcgttggcagtcaccgcgggtggagattctttctccgccgcttgccagaacgccgcactccttgccatcggcactcttcaccagcgctacccggacgagttgcagcactcgccctaccgctaccacccttgtcgaggaggagcccgcgactacgccaccttcagggatgctagctcggaggatgatgctaccatcatgcatctggcgcgcatggtggaggcgtacaacgcggcccgtatcgacttccatcgtatggtgcgccgtgggttggtcgagaacaacatgaagatcctggagctgcgttaggagaatttgcagctgaagaaggacttggacgcggtggaggcgcagctgtgtcagctcaagatcgcccagggagaggtctgtcgccccaagcgccgccgcgtctgccgcagcctgaagatcaccgcccgcaagagtacctccaggcctgagcttgttcgtcagtccttggcatggacttgcttcgtggagacccctcgcgccgagcccacgccctcggttcctcaggaggagggagcctctggtgttggtagcacggaggatgtgctgttgcttaccttccgccctggcccgttgcagaagtagacgagcagttagtaggcttgcgcgtgtgttcttctcgtttgtttttctgcttgagtcgtgtggggcatggttatgctggtgtgtggtataactgtgtcggagcctgtctttattttatttgcataagcaacttgaaccttaatgaaccaatttaatagcagaaataaattcaagaattatggtagtcgtgggtggttagttttaatagtcagctctctctgtttgctggttctgtatgggattttcagatggtgacaaccaggagaagcgcggttaccggcgaaggcaatcaccccgaaggcagcaaccacagcaaccatggcagcccacctccacctcctcccccgccaccaccaccaccacctgacaccaaccccatcctcacccaaatcctcgcccagcaggccaacatgatggctgctttcctccaccacatccaaaatccgccacagcataatgctccacctccaccaccacccccgcaacattctaaactcgccgagttcctccgcatccgcccgcctaccttctctagctccaataaccccgtggatgccttggattggttgcatgccgcggggaaaaagttagacaccgtgcagtgcaacgatgaggagaaagtcatctttgccacccaccagctgcaggggcccgcatctctatggtgggaccacttccaggctacgcagccagaggggtagcctattacctgggcctgcttcaccgccgctttccggaggacccatgtgcccgccggagtcatggcccttaagaagagggaattccgggagttaaagcaaggcaaccactctgtgatggagtatttgcatgagtttaacagcctggcccggtacgccccagaggatgtttgggaagatgaggagaagcaggagaaattcctggcagggatggaccctgagctgtctgtgcgtctggtctccggggattatccggatttccagcgtctggtggacaacagcattcgcctggaagccaagcacaaggaactggagtcgcacaagcgtcgcttggcaaatttccgcaatcaacagggggctaaccaaatgatccgatacaccaatccctatccagggggatcctcctcgcagcagcagcagcaaccacgctccgcgccccgacctcaattcgtggtgcgtgtcccacagtcgcagcaacagcagagtcagcaaggtacccgtgcgccccgtcctcctgcgccagccgtgcagcttggacaaggccgcagggatgctcaaggtcaacaacgtctgtgcttcaactgcttcgagcccgggcactttgcggataaatgcccaaagccgaggcgccagcaaggccaagcgcctccccgacccaacaacggtggtaaggatgtcactcggggtcgtgtgaaccacgtgactgccgaggatgtgctgacaactccagacgtcatcgttggtacgttcctcattcattccatccctgctaccattttgttcgactctggagcttcccactcgtttatatctgtgccattcgtggagagaaattagctgagggtagaaaggcttaggaaccctctgctcatcaccacccttggaggggtaatgacagcaaagtattatagccctgccgttcctatagaaatccagggaattcctttcccctcggatttgattcttctagacaccaagaacttggatgtgatcctcgggatgaattggttggctcaattccaaggagtagtggatcgcgcaagacgcactgtcactctgtatcgggggcctgatcaaccagttgttttctttgcacccccaacttccgccggcagttcagtacttaatcagctaggattgccagaaatacccatcgtcagtgagttcggtgacgtgtttccggaagaactacccagtatgccgccccagcgagagattgagttccagatagatcttgctccagggaccactcctctatacaagcgaccctaccgtatggcagcacatgaactggccgaagtcaagaaacagttggaagagttgaaagaaaaggggtatatacggccgagcacttccccctggggttctcccgtgatttttgtggagaagaaagacaagacaaagaggatatgcgttgactacagagctctcaatgaagttactatcaaaaacaagtacgctcttccccggattgatgacctgttcgatcagcttaaaggtgccactgtattctccaagatcgatcttcgctccggatatcaccaattgcgtattcgtgaagaagatatcccgaagaccgcgttcaccacgcattatggactgtatgaattcacggtgatgtcgttcggtctaaccaatgcgcctgccttcttcatgaacttaatgaacaaagtgttcatggaatacttggataagtttgttgtggttttcattgacgacatcctggtgtacttacaatcagaggaagaccatcagcagcacctccgtctggcattgggaaagttgcgggaacatccattgtatgccaagcttagcaagtgtgagttctggttgtccgaagtcaagttcttagggcacgtgatatctgctaaaggagttgctgtggatcccgaaacggtgactgccgtcactgattggaagcaacccaagacagtcactcaggttcgcagctttttgggtttggcaggatactaccgaagattcatcgagaatttctccaaaattgctagacccatgacgcagttgctgaagaaggaagaaaaatttgtatggagcccgcaatgcgagaaagcattccaaactctcaaagaaaagctagtttcctcgccagtgttaatcttactggatactcgcaaggacttcctggtgtactgtgacgcttcgcgccaaggattggggtgcgtgttaatgcaggaaggtcatgtggtagcctatgcctcacgccagccacggccccatgaaggcaactaccctacccatgatttggagttggccgctgtggttcatgctctaaaaatctagcggcattatctcattggaaatcgctgcaaaatatataccgatcataagagtttgaaatacatcttcactcagtcggatctgaatcttcggcagagaaggtggttagagctcattaaggattatgatgtgggaatccattatcaccctggtaaggccaacgtggtcgcagacgcgctgagtcgaaaaagcagttgcaacactcttggcgtccgtggcattccaccggagcttaatcaacagttggaagccctgaacctaagcatcgttagccatggattcttggctacattggaagccaagcctaccttgctcgatcaaatccgcgaggcccagaagaatgatctagatatgcatgggatactcaagaatatgaaacagggtaaagccgctggtttcacagaagatgaacacggaaccctatggaacggaaatcgtgtatgcattccggacgacaaggaacttaaacagttgatacttcaggaagctcacgaaagtccttattccatccaccttggtagcacgaagatgtacttagacttgaaagagaaatactagtgggttagtatgaagcgggaaattgcagagttcgtggccctttgtgatgcgtgccagtgtgtcaaggcagagcaccaacgaccggccagacttctccaacctctccaagtaccagaatggaaatgggatgaaattgggatggatttcatcaccggacttccaaaaacccaaggcagatatgattctatatgggtagtcgtggaccgactaaccaaggtagctcggtttattcctgtgaagaccacctatggagggaacaaattagctgaactctacttcgctaggatcgtgagtctccatggcgttcctaagaaaattgtatctgatcagggaagccaattcacttctgacatctggaagaagctccaagaagagttgggtacccgattaaattttagcaccgcgtatcacccgcagacagatgggcagaccgagcgtctaaatcagatcctagaagatatgctccatgcatgtgttctagattttgggaagacctgggataagagtctcccctatgccgagttctcctacaataacagctaccaagccagcatacaaatggcaccttatgaagcgttgtatggccgcaaatgccagacaccactattgtgggaccaagttggggaaagccaagtgttcgggactgatatcctgagagaagctgaagctaaagtcagaaccattcgggataatctaaaggtggcacagtcccggcagaagagttatgcagatacccgacgccgtaacctggaattcgcagtggacgattttgtgtaccttcgggtcacgccattgcgaggagtacacaggtttcagatgaaagggaagctcgcacctcggtttgtgggtcctttccgcatcattgctcgacgcggagaagtagcttatcaattggagctgcccacatccttgggcaacgtgcatgatgtgttccatgtgtcgcaactcaagaaatgtcttcgagtgccgtccgagcaggccgattcagagcaaattgaagttcacgaagacttgacctacgtggagagaccagtgaaaatcctggacaccatggagcacaggaccaggaatcgggtaatccgtttttgcaaggtccaatggagcaaccacgccgaggaagaagctacttcggaacgtgaagacgagctgaaggcagcccatctagatctcttcgccagttcttccgaatctcgtggtcgagattccgtttaaggggggtaggtttgtcatgtcccaaaacgaccataaaatatatcctttaaaattatgcctacaataattaaaaatccttgtgaaagcctccaaaaattaaaatgtgcaaatttagaagtcaaataaggcttggaggatttttgtatatttcctaaaagcctaaaatgtgtaaataaattttagtggaattttcagagcacaaataataattgttaagaaataaacaaagttaaaaaggttttataaaaagaaaaccctaaaaatcccccttccctctcttgggccgcattcggcccacttccctccccctctctcctcttcccccgcggcccactcggcccctccccgcgcgcgcgccactgacgggcgggcccgcccgccaccctcgctgacgggtggggcccacctgtcatccccgtcctcccgccgctcccaccgccccgcccgcgccaagcgtcgccgccgccgcgaatcccgccgcctcccgccgtccccgcttgcaataaaaagtggggggaaatattccccgtgatctcctctccctttcccccattttccctctctctcctgcattcaaacgggctgatttgctcccgcaaatttcgctggcgccattgatgtcggccagacgtcccggccggtttccttcctctcccggccgccctctcccccttccaaccctatttaaaccctcctgacacctccttcgctcgtttccaccctttgccgtgccttctcctcgccggaatcgagctcgcgccgtcgctctctctctcctccgtcgccgacgacgtccggccggccttctccgctcgccgggaccgtctcccgccccggcgtcgcctcctccggcttcacggcaccgccgccgtccccgtccaccccctcgtcgagctcgccgaccgccgaagcaccgccatccccgtcgacccgagccgcgccgccgccttcctccgctccggccgcctttttcgtcgtcgccatcgacctagggtgagacgtggaccaccgcctcttttcccccttcccttcccctctctcggccgccgctccgccgtgcctatggccgccgccggcgaccataggggcgcgggcgccgcctcccgccggctgcgccgtcgtggccaccttcgggcgcgccgagtggccaccgcgtggggcccggccgtcagccgcccgtgccctcgggtgcggcagacgcgtggggcccacggcgccggtcagtgcgagcccgggtgcgcccggtctaccatggaccgtgaggctgccgcgtgggccccactcccgtggaccaggttcgcgcgtccctcccactcggctgacgcaataaaccatttttaaattaaaatttaaataaagaaattggcaaatatgcatttaaagagcatataaacttcaaatgcccataacttgcccatttgaactcggaattggaccgttcaagtctctaatttttccttaagaagtcaagaacccatttttgtgctttgttcctgcttgttatatggagtttattagagtaaaagcctttttcctttccattggtcgtgtagacgctgcagcttcggaaaatccgctcttcgtggaggttgaagccgacgtttgggaaagcgtgcaaggcaagtcacatcatccttgaacatattgaatcccagtttataaaattagtttgatttaaattattgcttatcgctttatttaaattctcgcgttatcactgttttatttagccatgcctatttatctttgttatgaccttattattattgttattgttattattcccttgttcaccctagaataaacaaaaccccaactagtggacactctactcatggtaccactagtatgattttaggtagatgcttcgctatttaattaggcaacattaggtggttttacaactctagactttgggaatattctcatcacctggacactatggaatggttggattattgtggaattggattcacacctccccctctattcaaaatcctcaaaatgtttttaggctgggctcggggtgcatggttttgatagtagcacctcggccacataaggaccggtcttcaggcctctgttgcaaagcactaccgtacttccacatgtctagtgggtaaggtttagtttgtggctcagtctggttataaacaaaagtatacggatggagatggacgaagtcgggggtcgatggacatctctagggcaaatgaaggctacacgagctgcggcccagtagtcgagatgtcatggcacagggctggtgtcctgctgctaggggctcagtcctgcctacctgtcccggaggttccggccgtaggtggggttgtgatgaggacatcaacaccatcgatacatccacgtccccccatatacagcatgatggtcctattacccgcgctcgtgcacgtcaactaaattatcaggtgagttctttcttgagttcatattcctcgtctttatacctcggagacgcgtgcactcgtgttttactcaggaacgatggagaggatccaaagggaagaggattcgcgcggggtggattcggactgcagggcagcgccaacttctgacggccgccacgacttcatgcgaactccgatttgggcgtgtaagtacttcatggaaagcttatcaagtctactttcaaatggatccagccacatgtccatatctgttctggagcggccgcaattgtcattttactcccgactattttttgtccatggtgctgcgtcacctcttttggcccaatgggctgtgtatccatgttgggcccattaggggcgcggcctagggttggagcacgaccctatggtcgttcttcccctctttttatacctctagtcgccgccaagaacaggcgggttttgatgatagagattgcttcttgctaccggctcgcagcgcgcgtgttggctaaaccgcccgtctgcctgtaatcggaaccccaccatattgtgtttgatagtgaaactttcatctttatctagcaatctcagtgcttgtcctacttgttcttgcttgttcttcgattgcttgcaggacgagtgccctcgtggccgggttgacgcgcaccacaagttcgcggcgaccattggagacggtgtatcggttgctaagacgcagcgtctttggacagttgtagtcgggccgtgaacgtcgacttcatctaatcgagttaccccttacctctcatcgaaagattgggccacaaaccctagcgggttcgcatcaggtggtatcagagcgtggttcatcggtgagagaatttacccttcccttcgtcattaatttttttttcctatagtccagaaaagaccaacaaaaaaaaatagtagattagtttttccatgatcctatagaccattgtgccttttcactagtactgcttagttaaggcttgttgagttttcgattgcatcggttgtgttaatttgctggtcttagtgttaggcgattagagtttcaagttcttgccaccaccgcacatcgccaccttcatcaattttgccgtcatcaccaccgtcaccaccgtcgcagtcacccaccaaatcactttctatttgtgtttgatctgttgccgatagcttttgttagttgccttgtatcctgccgccactagaaaggaaatagaaccctgattcgagtgaccttccttaaaacagtcatatctttttcatacggactcgaaattaggcttataatatatccacggacatctaaaaaaaagttacatccgattctcttgccgggttcggcaaatttaaaatcgccaaattcctcttgcaaaattctgtttttgtggcgagaagcttcgggacctattcgcatagaactttaaaaaaaattctacaagcttcatactttgtccgtttgagataagattttctgtggttggttctagtgtgctcctggttgtgaaaaaaatatcaaaaaaaaaaagttgtgcctctctcctcagcactagagagagcaagcaaaaaaaaaaaaaaaaaaaaaagagtatccagcgagcacaccacaccattccccctttgtcaccaccttctaccaccggttcttgttttcgttgctgtttgggtttgtgttttgtggcgtcctttgtggttaggctcgcgtctctacttcgactagcctaggaccagcactgtacactatacccttgagcgattattcaatttgctttggctaatgtggtttctagttttctcttgagcattgctttcagcccaccaacagctccaccacaaacccgactacagcttgacaggtcttgttgctacagcaccgatacacctcgttccacggttgctaacttgtggtgttgctgtcccgctcctgtgggcaaggtaagaactggtaagagcttgtgagacaagctgcgagtgaagtgagagtgagcgtcttgcaaaagctacatcccaatagttgtgtagggcttacattacatcctccattgttttgttgtccttcatttctaaaccatggtaggtccagaggataaagatgaggagggtgcatctcattccccacgcaccaaaggcatcatccaatactttacaaggcaagtgaagcagcacacagaaggacttgatacagatttgcaggtgacaaatgagaagattggacaattggagtccatgcagatctccaccaacactaagcttacagggttggagacagcggtcgcctgcattgacactagccttgctgctcttgtgaggcattttgatgctctcaatgctggaggcaatggtgggggtaatgacgatgatattgacggagagtacgtcgaggataatttagaggatgaatatattgctgacactgaacaagatgatcgagatgctcaagatcgtcgacggctacacaacaatcgacgaggtatgggtggtcaccgccgacgcgaggtacgcaacaatgatgatgctttttctaaaattaaatttaagattcctccttttgatggaaaatatgatcctgatgcgtacctctcttgggagattgctgttgaccaaaaatttgcatgccatgagtttcctgagaacactagagttagagctgctacgagtgagttcaccgattttgcttcggtttggtggatagaacatggcaagaaaaatcctaataacatgccacaaacttgggatgctttgaaacgggtcatgcgggctagatttgttccttcttactatgcacgtgacttgctgaatagattgcaacaattgagacagggtgcgaaaagtgtagaggaatattatcaggagttacaaatgggcttgcttcgttgtaatttagaggaaactgaggacgctgccatggctagatttttgggtgggttaaaccgcgagatttatgacatcgtagactataaagattacactaatatgacccgattgtttcatcttgcttgtaaggctgaaagggaagtgcaaggacgacgtgctagtgccaaggctaatttttctgcaggtaaaacttcatcatggcagacacgcaccactcctccggccggccgtactgcttctccatcttccacacccacaaccagtcgagcagcacctcctccatctagtgacaagtcagcgacaaaggccgctcagccagcaccgagtgcttcttcaatggcatccacaggccgaatgagagatgttcagtgccaccgttgcaagggctttgggcatgtgcagcgtgactgccctagcaagcgagttttggtagtcaaaaacgatggtgagtactcctctgctagtgatttcgatgatgatacacttgctttgcttgcggctgaccatgcagataatgagccaccggaagagcacattggggctgcatttgcggatcactatgagagcctcattgtgcagcgtgtccttagcgcacaaatggagaaggcggagcaaaatcagcgacacacgttgttccaaacaaagtgtgtcgtcaaagagcgttgttgccgcatgatcattgatggaggtagctgcaacaacttggctagcagcgagatggtggagaagcttgcacttagcaccaaaccgcacccacatccataatacatccaatggctgaacaacagtggtaaggcgaaggtaacaaaactggtgcacattaattttgcaattggaaattaccatgatgttgttgaatgtgatgttgtgcccatgcaagcatgtaatattctgctaggtagaccatggcaatttgatagggattctatgcatcatggtaggtccaaccagtactcttttctgtaccatgataagaaaattgtgttgcatcccatgtctcctgaagatattttgcgtgatgatgttgctaaggctgccaaatccaaatgtgagagtgataaaaaagcccaatctgatggcaagaaacctgagacaatcaatttgaaacccaaattcttacttgctactaaatctgatattaatgagttgattgcatcaccttcagttgcctatgctttggtatgcaaagatgctttgatttcacttcacgatatgcagcattctttgccccctgctgttgctaacattttgcagcagtactctgatgtgtttcccaaggaagtgccaccggggctgccaccggtgcgcggcattgagcatcaaatcgacttgatcccaggtgcttccctaccgaaccgtgcgccataccgaaccaaccctgaggaaaccaaggagattcagcgtcaagttcatgagttgcttgataaagggtatgtacgcgagtctcttagtccatgtgcggttccggtaattttggtaccaaagaaagatggttcatggcgtatgtgtgttgattgtagagctattaataacattaccattcgatatcgtcatcctattcctaggttaaatgatatgcttgatgaattgagtggctctattgtgttctccaaagttgatttgcgtagtggttaccaccagattcgtatgaagttgggtgatgaatggaaaacagcatttaaaacgaagtttgggttgtatgagtggttagtgatgccttttggtttaactaatgcacccagcactttcatgaggttgatgaatgaggttttgcgtcctttcattggaaaatttgtggtggtctactttgatgatatcttgatttacagcaagtctatgggtgaacattttaatcatttacgtgctgtttttaatgctcttcgtgatgcacgtttatttggtaaccttgagaagtgcaccttttgcatagatcgagttccttttcttggctatgttgtaactccgcaggggattgaggttgatcaagccaaggttgaggcaattcagagttggccgactcctaaaacggtctcacaagtgcggagctttctaggactcgcggggttctatcgccgctttgtgcaggatttcagcaccattgctgcaccattgaatgcgcttacaaagaagggagtgcctttcacttggggcacatcacaagagaacgccttccacatgttgaaagataagttgacccatgcacctctcctccaacttcccgattttaataagacttttgaacttgaatgtgatgctagtgggattggattgggtggtgttttgctacaagaaggaaaacctgttgcatattttagtgaaaagttgagtgggcctgttctgaattattctacttatgataaggaattgtatgctcttgtgcgaactttagaaacatggcagcattatttgtggcccaaggaatttgtcatacattctgatcatgagtctttgaagcatattcgtagtcaagggaagctgaaccgtagacatgctaaatgggttgaatttattgaatcttttccttatgttatcaaacacaagaaagggaaggagaacatcattgctgatgctttgtctaggagatacactttgttgacacaacttgactacaagatttttggcctagaaacaatcaaagaccaatatgcgcatgatgctgattttaatgatgtgttgctgcattataaggatggaagaacatggaacaaattcgtcatcaatgatgggtttgttttcagagctaacaagctatgcattccagctagctccgttcgcttgttgttgttgcaggaagcgcttggaggcggtttgatgggacattttggtgccaagaagacacatgacatccttgctagtcatttcttttggccacagatgcgaagagatgttggcaggttcgttgctcgctgcgctacatgtcaaaaggctaagtcacgcttacatccacatggtttgtatatgcctcttcctgttcctactgttccttgggaagatatttcaatggattttgtgttaggattgcctaggaccaagagggggcgtgatagcatttttgtggttgtggatcgattttctaaaatggcacatttcataccatgtcataaaactgatgatgcttctcatattgctgatttgttctttcgagaaattgttcgcttgcatggtgtgccaaacacaattgtttctgatcgtgacacaaaatttcttagccatttttggagaactttgtgggctaaattggggactaaacttttgttttctactacttgttatccccaaactgatggacaaactgaagtggtgaatagaaccttgtctactatgcttagggctgttttgaagaaaaatatcaagatgtgggaagaatgcttgcctcatattgaatttgcttataatcgttccttgcattctactacaaaaatgtgcccatttcagattgtgtatggtttgttgcctcgtgctccaattgatttgatgcctttaccatcttctgaaaaactgaattttgatgctaagcaacgtgctgagttgatgttaaaactgcatgagacaactaaagaaaacatagagcgcatgaatgctaagtataagtttgctggtgacaaaggtagaagggaattgaattttgaacctggagatttggtttggttgcatttgcgaaaagaacgatttcctgatttgagaaagtataaattgatgcctagagctgatggaccatttaaagtgttagcaaagattaatgagaatgcatataagattgatttgcctgcagatttcggggttagtcccacatttaacgttgcagatttgaagccgtatttgggagaagaagatgagcttgagtcgaggacgactcaaatgcaagaaggggaggatgatgaggacatcaacaccatcgatacatccacgtccccccatatacagcatgatggtcctattacccgcgctcgtgcacgtcaactaaattatcaggtgagttctttcttgagttcatattcctcgtctttatacctcggagacgcgtgcactcgtgttttactcaggaacgatggagaggatccaaagggaagaggattcgcgcggggtggattcggactgcagggcagcgccaacttctgacggccgccacgacttcatgcgaactccgatttgggcgtgcaagtacttcatggaaagtttatcaagtctactttcaaatggatccagccacatgtccatatctgttctggagcggccgcaattgtcattttactcccgactattttttgtccatggtgctgcgtcacctcttttggcccaatgggctgtgtatccatgttgggcccattaggggcgcgtcctagggttggagcacgaccctatggtcgttcttcccctctttttatacctctagtcgccgccaagaacaggcgggttttgatgatagagatagcttcttgctaccggctcgcagcgcgcgtgttggctaaaccgcccgtctgcctgtaatcggaaccccaccatattgtgtttgatagtgaaaccttcatctttatctagcaatctcagtgcttgtcctacttgttcttgcttgttcttcgattgcttgcaggacgagtgccctcgtggccgggttgacgcgcaccacaagttcgcggcgaccattggagacggtgtatcggttgctaaggcgcagcgtctttggacagttgtagtcgggccgtgaacgtcgacttcatctaatcgagttatcccttacctctcatcgaaagatcgggccacaaaccctagcgggttcgcatcaggttgggtcggtactcttgtctatggctaggatgggttggaaactatgtcacgtcttccgtccgtataccgtggtggtatgtggcacgtggttacacgtggggaagatgtgtcttgtgggtaaagatgtacacctctgatcagagtataacctattcgaatagtcgcgccctcggttatgggcaagcctagcaatgtacccaagttagagttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccttgattaataatcttgtagagctctaggatcgtttttacaaaatagatttgagcaactaagtgtgttttaacgctgtttactgcaaaccctaaccccttatattataacccccttgtactcccttgcatttattatgcacttgtgggtgtgtcttgttgagtacggttgttgtactcaatcttgctcaattttttccaaaccgagaagaagagttcctggaagatgaaggctttggtgtctagctcgtgcctgccgtcaagcgcctgtggtcgtcgccctagtcttccgctgtttttcgtttgtcttcatgtgtgctgggccttcgccgcccatgtaataaattatctatttacgcttccgcttgttaaactctgtattgtatcaacttttggtgtaccttgcctcctgggacaaggaataatacacgcacgtaaggaacgcccgttgggttatttccggtcgtgacaagtaccctgaggtatgtcctcaccagctagatcccttttcctcgcatgaaatcgatttctccttttctcctcatgttttctgcttcccaattcctttggatttgcagcacctttccagcctagtcgtgattcccagcctttcacacaaaaaccactattttcttggcccacaatctcgaccccactaatttcatcatcggtgaaactaactggatcccctttagactagcaaaccctaacctgggtcactggaagaataccttcaagtcttggccatctctcgaaaaacctactcctgataagagctggaccacctggtaccaacgcgtatcggctagtaagaaagttcactaggacgaaattggaatcggccaagcactcgctctcaccatagccaattctgctaagaatgaacctctgatggctgccgccacctacttctgggccaacaccatcaatgctttcttattcaaccaagggctaatgactccaactttaatcgacatcaccatgattactggattagatgtaacttcatcggctaaccctatgagcatgaacaccaagagccaattcgacttcaagaccaaaagcataggtggctggtctggctatgtggaggcatatatgggccaagggtcttttacccctcgagagcatgtagctttcttgctcatgttgctggaaaaattcctcttctgtggatccagttgtggccctacaaccaactggcaatttgtagccgaagccttggaatcaaagaaagaatttcctttgggcaaaatccttctcggctatctgtaccagatgttgaataatgcatcggctaaaatagccgtcgactcaatagttggagcaggtggaccatggtggctgctgcaaacttggttaaacctgatagtcatgaaggttgtcaatcggccctctgtgacagaagctgaattccaattgccagagctgattgtggaagatgacggagaagagcgcacccatcgcagatgcatgtcatatggagaatatgcatccacaccaaccgatgctggagcgaagctatcggctgagctactcaaggactggttgtcgcgtcccaaatcgactctaaaatacattctcaaaattatgcatagaataattaaaattcatgtgaaagcctccaacaattaaaatgtgtaaatttaaaagtcaaataaggcttggagggtttttgtacatttcctaaaagcctaaaatgcgtaaataaattttagtggaattttcagagcacaaataataattaagaagaaataaacaaagttaaaatggttttataaaaagaaaaaccctaaaagtcctttgccccccccttccccctcttgggccggctcggcccagctccctccctctctctcctctcccccgcggcccatcggccttcccccgcgcgcgcgccgctgacgggcgggcccgcccgccaccctcgctgacgagtggggcccacctgtcatcccctacctcgcgccgcacccgccgcctcgcccgtgccctagtgccgccgccgccgcggattccgccgcatcccgccgtccccgcgcgcaataaagagggggaaatcactccccgtgattccctccctctttccccccacttttccctctctctctccctcggattcgtttggaaactcccccgcgaacttcgccggcgcatcaatggcggccggatcttccgcggccgattccccctcatccggccgctctctccccctcccaacactatttaaacgttccccgtgcctccctcctccgtttccgccactcgccgctctctctccccgtcggaatcgagctcgcgccgtcgccctctttctccgccgtcgccgccgagctccggttcgccgccgccgtcgccccggacctcctcccgcttcggcatcgcctccttcggcttcgccgcgtcctcgccgacctcgtccactcctccgtttcacccgccgatcaccggaacaccgccgtcctcgtcgacccgagccgcgccgccgccttcctccgctccggtcgccgtttccgtcgtcgccgtcgacccggggtgagccgtggaccgccgtttcacttcccccttccctcccctctctcgggcgccgctccgccgcgctggtggtcgccgccggcgaccatcggggcgcgggcgcgtcgcctcccgtcggctgtgccggcgaggccgccttcgggcgcgccccgcggctgccatgtggggcccggccgtcagccgcccgcgccctcgtgtgcggctgacgcgtgggacccacggcgccggccggcgtaagccgcgtgcacccggtccaccgtggaccgtgaggctgccgcgtgggccccactcccgtggacccggtccgcgcgcccctcccctcggctgatgcaataaatccgattttaaattaaaatttaaatgaagaaattcgcaaatattcatttaaagagcatataaccttcaaatggccataacttgaccatttgaactcggaattggaccgttcaagtctctaatttctccttaagaagtcaagaacccatttttgtgctttgtttctgcttgttatatggagtttagtagagtaaaagccgtttcttttccgttggtcgtgtagacgctgcagcttcggaagatccgctcttcgtggaagttgaagccgacgtttgggaaagcgagcaaggcaagtcacatcatctttgaacatattgaatcccagtttgtaaaattatgttgatttaaattattgcattatcgctctatttaaattcccgcgttatcactgttttatttagccatgcctatttacctttgttatgaccttattattattgctattgttattatttccttgttcaccctagattaaacaaaaccccaactagtggacactctactcatggtaccactagtatgattataggtagatgcttcgctttttaattaggtaacattaggtggttttacaactctagactttgggaatattcatatcacctggacaccatggaatgatttggttattgtggaattggattcacaccgccccctctattcaaaatccccaaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggatgaagtcgggggtcgatggacattctccagggcaaatgaaggctacacgagctgcggcccggtagtcgagatgtcatggcacagggccggtgtcctgctgctaggggctcagtcctacctgcctgtcccgggggttccggccgtaggtgggattgggtcggtactcttgtctatggctaggatgggttggaaactatgtcacgtcttccgtctgtatatcgtggtggtatgtggcacgtggttacacgtgaggaagatgtgtcttgtgggtaaagatgtacacctctgatcagagtacaacctattcgaatagccgcgccctcggttatgggcaagccgagcaatgtacccaagttagtgttttaattcttaaaacctgctaaagaactaaaatgtggaatggttggcctgggttggcttgggacgagctgggacccagggtcgggttgccagttcggtctgaatcatcgtaggccttgggttaaggcaggttcgtgtgggttcacggccttgataaataatattgtatagtattagattcgtgtttgcaaaatagccctgagcaactaaatgtctttaaatgctgtttactgcaaccctaaccctttatagtataactcccttgtactcccttgcatttattctgcatttgtgggtgtgtcttgttgagtacggtggttgtactcagtcttgctcaattttccccaaccccagaagaggagttcctggaggatgaaggcttcggtgtctagctcgtgccttccgtcaagtgcctgtggtcgtcgccctagtcttccgcagtttctcgtttgtctctgtgtgtgctgggccttcgctgcccatgtaataaattaactatttacgcttccgcttgttaaactctgaattgtatcaacttttggtgtaccttgcctcctgggacaaggattaatgcacgcacgtaaggaacgcccgttgggttatttccggtcgtgacactggttctgcagcttctacgaaggttttaagaaagatgcacgaatctggtttccctacgaagactcagcagaccttgaacttccatcagactttagatttgaagacattaaccatgaaaaattccaaaaatccagagaaattcttatagctgcaatcagcccatgcatcctccccgtcggcattcaccaaggaagaaacatgcaagtctcctacgagttttatcacccaatgagctcggccagacaacttggattgggccaactcccaatcggcttattctttgccgactagattcagtgccgaggacaaatcaattccactctaatgatggatcggctactaaacctaccaggaccccctctgggcagcgttgataatattgagttggcaggatttagaagcaaaaactttgacagatggtggggtgaatggaagctgcacctatttcatcaatcggcttcaatgtatatgacagatctattccctgacgtcatgccccaggtaaactttgtcattactaaattgcataaccagttagccgattcattacttgactaacctcttgctcctgttttgcagacaacagagtcctcccctcctcatcaaagtaacagtggcaagaacattgaatatgcttcaggtctaattccgaatggaggtggactatctccctctttcatcggttaccatgcccccaagacttcaactcaccttcacggcctaactagggaaccagccgatgcaggcaagaaaaggaaaaccagatcatcagccatgagtaccttagccttggctccaaagaaaaagaccaaattcaagaaaactcaaccacaaccaactgatatgtcgactgatgatctgcccgtcttggatccatctattgaacaagctttagatgaagaggaaattggtgaagatgttgaccaaactgtagccgaaataagtgacacaaaaagaacaccatcggcttcacccaagcaaacgcctccaactccttctgcccccgttcattttataagagtaagtacctctctatgactttttctgaaattacctctctcttcggctaattacccatagactttgtggttgcagaagaagaaaactgctgtgaagaaaaaaacagcagcaacaattgttaaatcggctccaccagtaagatgtccttaattcttttacttaatcaatctcaaccgattctatataacacttgtctatttcgcagcctcctcctccttctcctcctgtacaacaatcgtcaagtgatcagactccatcggttgtgggtagtcatcacgtcgaagaggaagaacaatcagctgctcctgctatcccagtaagtttccctttgtctcaacaaatagatcggctataatttactcagctcttattctttccgaaattgtctctgcaggctctagccgatctcttctcttttgacatcagagattaccttgacgaggcagaagaagacacttcaagcaaagccctagctcccctatctgatgatgtgagaaaaacacttgaagacatctctcatcggctagaagcctcttctttagacagtttggtagttgactgtgggtcaattaggacgcggctgcatgaagttcaagctctgattcccgaagatttggccgatgtcctaactccagccgcttatctcgagcaacatcagttcaagctagaaaaagccaagctaagactagccgaacgccgtgatcgcaaagagattgaggccacaatccaagctaatcggcagcttgtgcatgaagaaaaaaccaaacttgatcagctatctaaaagtccgatcaaatccaatattgatcggctcgaagctcgcaaaattgagctcttggcacaacttgaagaatgcaatgccgagctagatatagaacacaaaaagctagccgatctcccaaaatcaattgaagaacaaaaagcaaggctcaaatcggctatcaagaatgttgctgacctaaccaagtctctgaaagtcatctctggaactgatgctcaagatgcccaagctattgaagaagtagaacaaatcaggcaaagggctattttggctatccagcgatacttgtctcaataacttttgtgtaataggactcagaaatttttgtaatcagccaacaaaaatttgcctcaaaaaatttgcaaaaatttgcattgcattttgatatatatgtgcccccctaattttacaatgacaaaagcattgataaaattataaaacaactaagggcgatataacaatatcgtccattgtacatcggcaaaccacaacggattacaccatgaaaaacaactaagggcaatataaccatatcggccattgtacatcggcaaaccacaaccgattacaccatgaaaaacaactaagggcgatataaccatatcggccattgtacatcggcaaaccacaaccgattacaccatgaaaaacaactaagggcgatataaccatatcggccatctcaaggtgatgcaaacacatcggctgtcatgcatcggcaatactagccgatcatgcgttaacccaaatacttgggtaatatttcttcaaatacttgccattgagcgctcgcccatagacttcaccatcaagcccgtgcaacatatatgctcccttagacacaaccttataaatttggaacgatccttcccaattcggcgaccacttgccgaatttactatcacgagtgccaatcggcaaaatcaatttccatacaagttctccttccgaaaaatccttaggtaccactttcttattataatgccgagaaatacgttccttatccttggtaacctttgcaagggctcgcaatcgtgactgaaccagatcctccctctcatcggccataaggttgtaatactcattagctgttaaatcgttttgtaattctgttcttcgagagccgattctaacctcccatggcaaaacagcctcatgcccataaacaagtttgtaaggagggacttggatcgatccatgacaagccatcctataacactacaacgcttcggccaactgagtatggcattgccgaggataatcagatattttccgcttaatcaatttgatcaaacttttattagacgcctcggcttgcccattagcttgtgcataattaggtgaagaattcaataatttgatacccatgctatcgacaaactgaacaaactcgtcagatacaaagaatgacccctgatcagttgtaatagtttgaggaataccaaatcgatatattatatgttcttgaacgaattgaattgcatccccagaatcaactttcttcaaaggaatcgcctccacccacttggtgaaataatcagtcgccaccaatataaacttatgtcctttactcgatggtgggtttatcataccgatcatatcaattccccaacctcggaatggtcatggcttaataataggattcatagtcgatgccggagctcgctgaattgccccaaacttctgacaatcttgacaccccctataatatctgaaacaatcctccagcattgtcggccaaaaataccctgcacgccaaagtaaccacttcatcttatgagccgattaatgagtaccacaaattccttcatgaacttcactgattgcaactttagcctgatcggcacccaaacacttaagtaacactccatcaatcatccgataataaagctcatcatccaacagagtatactttaatgccttatatcgcaatttcctagaagccgattgagacggattatgcaaatactgatgcacatcatacctccaatcaacggctgtcattgctgcaatttcaaccttaacatctttgatcatcggcttatatcccgatgccccttgggccaaatcattagcttcaatattttattctcgagtgacatgctttaaagtaaccagccgaaactccttcattagttcttggcacttctcattataaaccatcaatgtatcattcttgcattcatactctcctgccaattgactgattactagcaaagaatcccccatgatttcaatggtatcggcttcaacttccttgagtaattgcaaccctttgagcactgcctcatactcagcttgattattagtcgcatacggtttaatagtataagcaaactagaaacatgcccccctaggggaaattataactacgctgataccacaaccatgagtacacaccgatccatcaaagaataaagtccatggcactatttcaaccgagccgattgaatcatcacgatgttccacaataaaatcagctatagcttgtcccttaatcaacttcggcgactcataccgaagatcaaactcggttaaggaaaatatccactttccaacccttcctttaaatattggagccgatagcatgtacttgacaacgtcggccttacatataacagtacactcgttggacagtagataatgcctcaaccttgtacacgaaaaatacagacacaagcataacttctccacaggggaatatctagtttcagcatccaagagccgacgactgagatagaatacaactcgttccttcccttccaactcgtaaatcaaaaccgagccgattgacttctcactggccgataaatataacctaaacagtattcctttctgtggaggaatcaaaacaagaggagagctaagatattccttaatattatccaaagccttttgctactctgccccctaagtaaactgctgatcggctttcaatctcaacaatggtgtaaaaggttctaaccttccagacaaattagaaataaaccttctaacacaatttatcttgccgatcatctcttgtaactctgtcttattctctggaggctgaatcttcttgatcgcattaacactcctttgagttacctcgatccccctctcatgaacaagaaatcccaaaaactggccagccgatacaccaaaagcacattttgtcggattcatcttcaggccatattttctggttctctcgaaaaccttcctcaaatcagctatatggtcctttgtttctctagacttaacaaccacatcatcaatgtcgacttcaaccaaccagccgattagatcgtgacatatgtaattcatggctctttgatatgtagctccagcactcttcaagccgaaagtcatgacaacccattcaaataagccgattgtaccaggacacctaaaagctgtcttatgaatgtcttcttcggccataaaaatttgattgtatcatgcgtttctgtccataaaactcaaaatcttatgtcccgaagcagcatcaactagttgatcggctactggcattgggtattcatctttcggggtggccttattcaaatttcggaaatcaatgcataccctgaccttgtcgtttttcttgataacatgaactatactagaaacctactcagcatattggcaaggacgaataaaaccagcatcatacaatcttttaatctcagccttgaccggttcaagcatgtcggccttgcatctcctcggaggttgttgaagtggcctaaccactggtttgataggtagccgatgttcaacaatcgatccgctgagtccaggcatctcgtaatactcccaagcgaagcaatctctaaactcttttaagagctctatcagcttggttctaaactctggagataagttcctactaataaatgtcggccttagatgatcgcctagacctatgtccacttcttccaaatcatcggccgacatgaaaccttgaccttgcttgtcatcgagatcatctaccgtgtccgtagtgtagacatttgaaccctccacgacgccctcaaaataatagcttgggttctccatcttcaattggctgtatatcagaatcggacacttttagaaaatctccatcccagacttttccagataaacaatcaaggccatccatttcccaaagagctaaatcggcactggcaacattaactgacctgtcggctggtacgatctctattttgtcgccttgccactgaatcaaacattcatgcatagttgaaggaatgcaacaattggcgtgaatccaatcccttccaagcaacaagctgtaagaacctttcccattgatgacaaaaaacgtggtaggaatagtcttactgccaactgtcagctccacatttagaacacctttggtttctgatggattgccaccaaaatcgttgagcaagtttgtcttgacgagatcctcggcatttttacctaatttcctgaacgtagcatagggcatcaaatttaccgcagccccaccatcaaccatcagtttagacatcggcttcccattgacgtagccgtttatatacaatggtttaagatgccgattctctgtcccctcgggtttctcgaacactgcctgttctggtgacagaaccaacttagccaattcctcttccacctcgtcgacatcggcttggtctatcccgaattcggctggcagggtaaagaccatgttaaccggtgccgtcacaacactcttcccttttgccaacctctttgcctcatcggctgcgatataatcggctacagtaacctaattcttaacacgccactcctgccttggctttgctttcttcagccgatgattaatttcttgttcaacctcctgaaggcgctccctgttcctcaatctctgaacccttctcttctgattcttcgtgaaaataccaaaaggacaccattgattcttcctgattacattgtcttcttggccatgatcttgatttactggacccaatctttgatgaacagaaactcttgtctgccttaaccgattgcccctattatatgatcggcttgagttctcgacgctatcactgcacccagggcagttttaaatagatggcaacctcataccttcattccagcagaatctaaagaactcacaacaccaatgaggatcaaaaccatcatcgtatttctcatgatccttctcctgctgcttgtcatacttcttctgatatttgttgataatcttagccgaattcacctgaaaacccattgcacgggccctatcggctgtttggccagctgtatgcaccacattaataggaaaaggattaccatcgaccttcatcggctttttggaatcatcaaacctaatcttgcctccctcaatggccacctgaatctgctatctaaaaaccttgcaatcgttagtagaatgggacccagaattatgtcatttgcaatacctctttctgcctaattcctcagccgatgggattgtatgaccagcaagaagttgaatttgcttctctcggagtagcaaatcaaagatcttgtcaggtttagtaatatcaaagtcatacttctcttttccagaactttttacccattggcatggtatgacctttttactcctcacccactcggctgcagctattttagaaaagtcctcatcatcatccgacccatacatgtacggataaacatgattaaccttctttgagtttttcctaacttccgcggacctatgctcatgcaaggttactttctatatcagatgtgacaagctatcaaagtcctcagacgagaatttctccctaatcggagcaatcataccctgaaaagccagatcggctaactgggcaacagttaaactcaagctaaagcatttgttcctcatttccctaaatctctgaatatactcgtgcacaggttcatcatgccgctgcttaatcgctgtcaagtcggataatttcatctcatgaaccccactgtagaaatagctgtggaattgcttctccaaatcggtccagctattgatcgacccgtacggcaaagaggaaaaccaagtaaaagccgatccagacaaagataaccggaataacctaaccttcagagcgtctatagccgattcttcaccacactgagctaagaatcggctaatgtgctcataagttaacacaccatcttgtcccgaaaatttggagaagtccggaactttgaaccgattgggaagaggaactctctcaaaccactcaggataaggttgccaatacaagcttccaatctcttttggtttaagcccaaactgttccctcattacgtcagcaatcacatcggcccacggttgttgctaagctaccccttgtgactgttgctgcatgggctcaaactgaccatactgagacgcaaactgaggttgagccaatccccctggctgatattgggcttgcggggaagcaggctgatattggaaattcaagttacccccttggtaattatgaaggttcggctggatattacgtaccaaatgctcaggaacaacttgaggtattactgtgccatccggctgtacgtggtgaaccaagtgttctgggacaacttgatttaaaaaatgttgtacaggctgaccaccaggcgttgcaaacccggccgatgcgcctattgaaccttggtgctggatcggctgaacgatttgttgtcttaacggcgtctgctgaatcagctgctaccttggtggtgtttgctaaactgattgcatgacctgttgctggattggttgcacaacctactgaattggggtgtctgctgaatcggctgctgttgtattggatcaacaataggttgaggcggcagaaacgtggcagcaacatgatcttgggtcagccgattcgcaacctgcccgccatgctgtggctgctctctcattaataaccgagggttcactggctggcctggcgccattgctgacggaacaggtaggggagttgacgccagtgccgtcggctgagatgttcgtgcaatagagggaaccgcctgagttgatggctgaacattggtaatcaaagaccgataatttggaaagacacctccttgcaaataaaccgggcctgcagcctgctgctcagcttttgaaccatcggctatggacttcatcatgtttgataaggtattgactaacaccccagattgattgatagtatacttacattctagttaaccgatatactagctcataccctctatccgatgccctcctggtactacgagaagccacccctggctgtcgagttccttacgacaacgcgtcatgaccatacaaccggggctaaatacggaggagtaccctccccagggaattaacttaggactatatacacgcgcggaggaatacccgtactgagctgtcaccatcagcagcccacctctcatccgcagcatataaccccaaataatgatatcccgtagtctagacaccacttctaaattaccagatactactctaatgtcatcgtcatgacatagagtaattgcataagcaattacaatatactcgcaccaaagcatcgcccagataagctagcagtatattcagtataacatgaatataatgtaaagttggcattcatatattcggaaagtatttcaataccataaatgtatatagaagagtattctaataaaagtacaaagcttacaaaagaggaaaggaaagctactagagccatatctgaactcttccgaagacttccggactcctgatttccggactctattcctattccactagattgagaatactaaactaaacttgagagaatatgagagagctcttgcttgaggtgtttgttgaagtgaagagagtgaagtccttatataggctgccaatgacggttgtggtagttggaatgttcggaatttccctctaactgtcattggggagtgatccacgccgtccagcccaaacctggatccaaattcagcaggtggcctacaacattgcttcacttcgtagacttgtgaattttggcccaattcattgtgtcaattctgagttcttggcccattcatgcataagtctgatcctcaacatcgtccgattgatttatcgtttgagttgatgtcgattctcctccactttatggttattctctgcaaaaggttagtgaacctaatactagtggaatattattattctaacatgtatatgcattgcaagcatcactagctctcctctattttggtaatattgacagtcaaaactgatcgataacgaccgtcaacagtcgtttctctctgtgtgtgtcatttggtagcccatgtaatagatacaatattgtcatgcccgggaaatatgcctttctgaatgttaatgtattaatccccatcccaggaaaagccggggtacaccacacaaacttgatacaaaagacacatctttattatatcaataatatttacattattacaaaggcacttaaggcctggcaaacagaaataaacaacagtggactagcgagcctacggctccatcttcacaggcgctcaattggggtataagccaggactccacctaggatttcctctccaaagctttctcttattgaaggggggaaagattgagcaagaatgagtacaatcacagtactcagcaagtcacaccgagagatgcatgattaatgcaagggggtacaaggagtaataatatagggctaggttttgcggtaaacagcatttaaaagtcgcctagttgcccaaagctattttacaaaaatgatcctagagttacatagtattattattcaaggccgtcaaaccacacgaacttaccttaacccaaggcctacgatgattcagaccgaactggcaacccgacctgggtcccagttcgtcccaagccaacccaggccaaccattccacattttagttgttaagcaagttttaagaagtaaaccacaaacttgggtacattgctaggcttgcccataaccatgaatctacctaaattcttactagtggaaccatgaataagtacccactagttggggtattattttactagggtgaacaaggtgatataaacaatagcaacaatgataaggtcataacaaagataaataggtatggctaaataaaacagtgataacgtggaaatttaaataattttataaactgggattcaatatgctcaaggatgatgcgacttgccttgctcagagggaacggccttccgaaccttcggcgacaaccgcgaaccacgcttcgagaacctccggaacgacagaagctacgcgcagcacacaagcaaagctacaagcctataaagaagcaataacaatacataaaaagaaaggcacatggttctttaggttataacaaacattaagagacttgaacgggtcgattcggagttcgtatgatcaaaatatgattatcgtttaatgctgttatgtggagatttgcggattattataattaagctttgcaaccataaagacaggaaggctgcactgttgacatgtggaccccacatgtcaacctaaagggccacggtagaccaagtacatagagacggtccacgggtcgacggaagcggaccccatgtgtcaaccgaggcaagtggcccacaaacggaccccactagacacctgttgatcagaaaaacacacactggcctggaagatctgcttaactcctgtgcaggtccaaaatctcgctttaggttcgtgagcgtgcaagttgatttgatcttgtaatcaacaagaaaggaagacaagaaaaactgcggttaaattcataaacgatagccgatcggctagttgccgatgacatatcatttatctcggagccgacgtcatatttgaatcgatcgacaatgatgaataaataagataaaactaaatctagtcgatcagctgtagatattaacatcatatagtctttacttcgatatatacttaaactaagtgattaggatagatcggtcaccatgacgagacaatataaatcacttaagtcgaaatatacattaaagcaaagattatatagaggtttatagcatagccgatcagatagatctagcatgtatcggctaatactccgatactactttatactaagatattgaaacaaacaagatatatcaaataagaaacttaatataactttaatgtgacaagatcttaatataaagggcagatttagcataacaagcaagagtatgatatcaagtaagatcggctgaaattccgatgctatctctattgataatcataaaacaagctagatatcaaaattatagatagaacttaatagatcgaactcaaccaatgcagcattaagcataaagataattgtaagatctaaacaagatgatgaaaacctctaagagatgataagtatatgatataatctaaattaataacgaggtttaactctgtcggctactttctaacagtaaaaaccaaccgatgacaagttatataatgaaactaacagagattatatggtatttatgataactcgatgaattacataaacaagattagagtgtcataaagatggaagtgctaatcccgagaacgcaaatcgccatgacaagtttacctctagttgaagatcgatgcagctcaatccgaaagcaagaactcatcgaaataaaacgaaagtaaaaagggtggcgatgtgccgaaagtgttattgaacgtgtgttcattgattacatgggtttgtgtcatatttatacccgagatacaaaatatgtccttgccggacatgactcttaccataagtctttacggcagacttttgcccaatcatatctctaaggaaattacataagatatcctaattaataaatacaattgcctatctgagagctttatctctgatgtaaccatggctactacactacagcagaaacagcccctagagacggtttttatgtgatgtagagatggctatacccgtctctattataggtagagacggttttagcacccgtctcataggcgttgccattgctcccgtgtcaaacgattagagacggttcaaatagccatgtgtacgtctagagacggtcgatagatacggttgggaccgtcgctacacgcatgactacaaattcaaatcaaatttgtagacacgccgaaaaccatctctactttaaatttgaccgtctctaatataaattacgaacattccaaatttgaaatacaaattttcagattaaacatgtagagacacttgatgatcttagccacggttgcttccgtctctatcatatagtagagacaatttatgtcttgtttaggcacggttctaaccgtctctattaatggttaatatattacttatttctctcctagagacaatatccatttctatagacatgggtgcacccgtctctacacagtgtctaattaacaaataatacccgcatctagcgctattagtcacatatgccaaacatttcattcagaaaatccataaacacaataatatcagcagactgagttaccatcataccacattgataatattttcaacactagtagcttagcattaaagaaaaagcaatatccatacattgttcccgacgagaaaacttaaatatgtttccggcagcagcaagtgctaattctaatgcaacaagtagtgcgaaatgatgcagtcgccattgtaaatcagtcctcttcacttcaagtctgagatgatgctgtagtactagacgatggagtagtatttggtgtctggcttccttggttaaatttggatcaaactgaagagaggatagaatggaggattatttgatgactaacttccttggttctaatcaacctacatatacatccatgaatatgttattttgtcagcttatggctatataagttgcaacattcaaaacagtaatcttgtgcccatacctcttgtcttggaatgagcctagcaaagtgaaggtggcagcctagacatcaaattatcttctggatatttctcagcaagatatgataccataaaactaatgaagccatttacattactggagctactcccttgttcacttcttcctgacatattcaaaaatcttccaccataatagtttgttggagtaatggttggacccatgcctctaactctaccactatgatcctttccaaacacttctaacatagcttgttcaaaatcagcttcagtgagttcttggccatctactcttttctcagccaatttcatatatacctcattctacatggaaaaattgtactcttactatagtgtattttattatagaaagagttaaagaaaaacaagtaatatgtcataccattttgtcttgtgtagcatcattaacatatctgccatcttttgtcttatggcattcatcaaagaaggttgctctgtccacctccactctatcatgttcctgcagattatacatgtcaagtgcatgagaaatagaagcaataatgaatgaagaaatacatgctaaacttcttaccagctctttcctctttcttgcaaagctctttcttcctaatttgtgtggatgcttaatattttgtgcattctcttggttttgatcactgattttctaatgatacaacatataccatcaatgagttgatataaatcaaagcgatggctgttcactcactaaaaagttcaacacatatttaccttagagtcctctgagtaccagtaagaaactagtgtaggccattgagattcattaacagtttggggtaccatttgcaatactcgttccatgggtaagttagccttgtaatactttttcttcagatttgacttgtattgcctccattttccatctaactggtggagaagccaatccttagctcttccatcaattgcaaactttctctagcacatatgaaaagagtgaatggattatacaggaatcaccataaaaatatgatttaaaaaccatgtgaattaaacaagcaatacctgtacttcagaaatcaattttggatgatatattctcttataaagtttatcattccatttaagaatgttcagtggagctagatgtggcttcctaacaagtgttcctaaataggatccaagaactatagaagattgtgagcaaggtgcattgaaacgatccaatttgacaataatcttaacaccttccggaagattttcaacatttgccagtttagttggtcctcgacgtcttttaatgcggccatcaggatctgtcatgtttaaagatttagtccacaagcatacaagttttaaaagcgaataaacaatatatcttacgatactcatagcagtttgaacgccattctgcatttgttatgttctgttcttcaacatagtgatcatttgggaccatttcttgattctgtactccattctctgaaaaatccaagccttgcagtctttgggaccttgctgccatttgcactatatttaaaaaacagattagaatgttacaggtgcataagtaacaatataacccttgcatattgaggtacattagagaatgcaaattctaggaattgagatactcctgttttatatgcagcagttgttctgggcttattaatccagtccctattcatttatccagtactcaattactgaaaaacataaataaaataacatcgaggaattagaatgttaggagagccaatgtttgatgtattgttgattgttaataagttactatgcatcgtattaggtgctatcaatataatggatagagaagcaacaatccaattcatataaattactgtaaataacagtaccag

SEQ ID NO: 68894 - DNA, 10163 bp, Oryza sativa
gtttcccttagctgctagctgttgtaaatatcctctacgatgaccaaattacagttgcacaaatatgcaaagttacatgccagtcacctatacattataaaataattagatgcaagcaggaaaaacaaaccatctgtgcattaaatttttttccccaatatacttgggttgctataacagataattaagaattaaatactttgtctgtaagcagaacacaaatcaaacatcagctgtgcaagtgtgcagaaacagtattgcaattaggattgctactgttgccaggattcgatggctgaggaatttgggcaataccaggaagaaaatcaccgatgaatctgcggcgtgtcgatgctgctgctgtggggcaaacgatgggtgtgtggctggcggatgacgcgggggccatgcatctctggcggcgccagcggcgctcagcctggaaggcacaggcggcgatgggtggacggtgggtgctaggcggcacaggcggcgttcaccccggacggcgcaggcggcgatggcgtgggtagtaggtgcgcagccctggcgtcgccggcggcgctgagcccagacggcacaggcggcggccatggggctcatacgcgagaggccgccgtcttcacggtggagctaatggaaagattggaacagattttacaagagaaggagaggggtttgttctcttagataatatcgtaactacttccgagttccaagggagataaaaaaaatccgcatgaatgaggtaaaaagttggaaagattgatctttttggagggaacgagcaaaaaaaaattcctaccaaattgtttagcgctgattaatgtgattgtagagacggtctattatcctgtccgtaattagcgtatctacgtaagaggcaaagtgggagatgggctttaatagggacgacgtgcttagccgtctcttacggaacgtctctacaggccgtttttgcagtagtgctatggatacaaccattgctcacatcatggatgaacaaggagatatcaagatcaagtcctccaagtgctggaatccgattcggccacctgctacattgctgacttcaaacggccaccgaatctgcatacgaccactgttttcggcccgtaagtgcttgatggaaagctctcggagccctctttacagcctcattgccaaattccatgtcgtttggccgcaatcacataaataaggtgctgcgtcacctgtcttgggcctctggaattgtaactaatgtgattccactcctcatcgccgacaatgtcaaccaccgccagtcctctgagcgcatcaacctctgagaatgtcgaggtaagtacccatcggctaatcctctttcttttccgtgcaagattggtttttcttctgctcaatcttcgattttcctccttctgtagcatctctctcatcaagtcgcagtccctagtataaccgatgagttccagtttttccttggcccaattggtaacccagaccccacagagttcatcaatggtgaaaccaactgaatcccctttagatttgctaaccggatctaagcctatggaagaacaccttcaaatcttagccatcggccgaaaagagctggcccgcttggtataacaggatgtcagctagaaagttaaccaactgggaagaaatcggcatatcccaagccttggctttaactgcagcagacatggcaaaagatgagtccatgatggtagctgccacttacttctggtccacagccatgaataccttccttttctctcaaggaccgatgactccaactcttttggatgttataatgattactggcctagatgtgacctcatcggctaacctgaccatcttgaatatccaatccacccaagagttcaaaatcagaagcataggcggttggtcaggctatgttgccaagaacatgggtactaggccgatctttgcaagggagcatgcagctttcctcatgatgtggcttgagaagttcttttttcatggtccaagttgtggtcctactgcaaactggcaacatgtagacaagaaacaatttccccttggaaagtatctgctagagctatctgtaccaaactctgaacactgccataaccaagatggcctctggagtatcaatcggcacagggggtccctagtggttactgcagatctggctaaacttgcacaccagaatggttgtcaatcggccaccattagccgatacaagatttccaagatgtgagccgatcatcgatgatgatgcagaaagaatcactaaatgccgatgcaggtcctttggagaagcggcatcggttagcattgcatccaagctatcggctgaacccttcagagagtggttcaacaacttttacgatgggtttcccaaaaacactagaatttagtttgcatacgaaggacatggcacttgtaagctaccaggcgatttacggtttgatgagatcaactccgaaaaatatgacaaatctagagaagtattctcagcagccatcgtccttgcatccttcctattggcatccatcaaggcaaaaaaatccaaatgacatatgagttctatcatccgacaagtgctgcaaggcaattcggcatgggtcaactgccgatcagcttgttctttgccgataagatccagagtagaggagaaatcacttctttgcccataagatccagagtagaggagaaatcacatcaccacttatgatggatcggctgctgaacatagaaggaccacccctaggcagcatcaacaatatcaagctaaggatgttgagaagtgcatcctttgaccgatggtggatagagtggaaaaaacatcggcttcaccaatcgtcttcaatgtatctaatagatctattccctaagccgtccctcaagtaagaatcttctcctttgtcaattatgttaactacaagccgatgaattaatcttgaccttgtgcaaattctctcttgcagacaacagaatattctcctcctcatcatagcaacagcggtgtagagatccaatatgccccagggctactgctcaatggtagtggactatctcctccggtcatcggctacaatgcccccaagacttcaacactgctgcatggcatgccccgtgtgccaatagcccctgatgctggcagaaaaaagagagcaaaatcggctgctgcaccatcggctgcaaagaagaaacccaagaagcaaaagaccactgccgatgaattgccagccatagattcggatgtagcagaattcctgaagggtgaaacaatggcaaaacatgtggatgaagcggctgaacatgtcagtgaaacaagggaacaaactcctccagccgatccacctgctcctcaaagaacgccatcacctccagtacgtcccacatacaaaccaagagtatgtgcatgttttcaatcttcagcttaagtctattatgcctttataccaattctcaactttgattttcttgcagaaaaagattgcttccaagaagccacaagcaccagctgcatcgattgatttttaaacctcatcaactttcctctctcagttttttaaataaccgatgctaatttgtacttgtattttcagcctattcgtcctccaaccccaatttccaaatctagcgagccaactccatcggttgcaggcggtcaccatgtggaggaaaaagaagaagtggcagcaccagctcatgctgtcctgtaagtatataccttaagtttacaaatcatgtcggctgccatcctttttacttaactcatagtcccaatgtttctctttttcaagttttagccgacatgttctcttttgatatttggccattcttagataagaggaagaaacaacaagcacagctctggtgcccttagccgatgatatcaagtcaactctactagacatctcaaaaaggcttaaaggctctctggaaaccttggttgcaagctatggatccatccgagacagacacaatgaaatccatgacaagatcccggatgagctagccgatgcccttactccagcagccaaccttgagcagcatcggcttaaacttgaaaaagcccaaaggaggattgccgatcggcgtgaaagaagagatcttgaggcaaccatccaggccaacagggtttctatgaatgaagagaaggccaagctcgatgaattggaggctggtccagattcaactcaaactatcattgatcagcttaatgctcaaaaaatagaactcctggctgagttagagcagtgcaatgcacaaatcgcccttgaacagcaaaagcttgcagacttgccaaaagccattgaggatcagaagtcaaagttgaaggcatctagcaagcacttggccgatctaaccaaatctcgaaaggtgatcctaagcactgatgcagtcgatgtccaaatcatagacgaagtagatcggattaagcaaagggcaatatcagccatcaaaaaatacatgtctggatgagctaaatcttgtaattccaactttaaatttgcaaacataacttttgggatgcaatatataactttctgcttgtggtgaaaacttgctctttgatgtgaccatggctactacggatacatccgttgctcacatcatggatgaacaacaagatatcaagtgcaagggtgctggaatccgattcggccacgtgctacactgctgacttcaaacggtcaccgaatctgcatacgagctccgttttcagcccgtcagtacttgatggaaagctctcggagtcctctttccaacggatccagcctcatcaccaaattccatcctagtcaacagcagatgaagaaataaggtgttgcatcacctgtcatgggcctttgggcttgtaactatgtttgggaccccggcccatgtagggcccatgtggggtgcgccccaaccaggtggaggacgacgtagaggtcctcccacctccttaaataattaggtaccctctagagtatcttgggttttgtttagataaaagtttagcttcgctacttttccgtgtaatcccgtgatcggttagatcaccggtttgctcgttacggaacctcaaacttatcatttttgctccattcctatctgcaattcagattgcttttatcttgttcttgcttgtttcttcgatttgcttgcaggaataaggttgatctgcactggcaagatcaacaacctacggagaggtgtatcgatcgctaaggcgtaacacaaaaacgtctagtacggttgtagtcgggtcgttaacgtttctcccaaatcgtagttatcatcaactcaccaaaagatcgggccaaacaacagccttgagtgccgagtggagctcagggttcatcatttggtatcagagctttcgttgctcggtgagttttatctacccataaccagaaaattgatataaaaaaattgtcctgtacctagccatattgtgccattgcattgtttttatcagtttttgctttgttgagttttgtgttacatcgtcgagtcgagttgctggtgttagcgtctagttcgtttagagtttcgagttctggtcacgttttgtaccacagtcatcgtcacctccatgtatctgttgtcgtcaggacctacgaaaacggaatcggctcgctgccacgattctatttttgtagtttgcaaaagtttttaccggttggttttgcagttgttgagttgcatctttggtttgctgactgccgtgcttctgttttggccgtgcctgtgtcctgcacgagaggaggaaggtgaattaccatatctgattttggaagtagtcaagtttgttttggaaagatatagtagattggattggttaaaaatcagtttcctttttatcccatacaccaaattcggctgccatccactccacctcctagacgacttccactcacccctttggccgagtccgactccctccctccctttcacggttccgagttgtgtcaaacaccttggtgaatatttgtttggtgtcggttttgagatctgtttggaaaaatggaaccggcataaattcagcattccatttttgtataattttaattttgggtttagacttttacatttgagtccctgtaatttttatatttacgtttgagtccctgtagccttatattgaggtccttgaatctgtttttgtaaaaaaaatcaaaaaaaaaagaaaagcaaagaaaagctacaccctaaaaaaaagaaaagaaaaggaaaggaaagaaaaaaaagaaagaagaaagaaagaaaagagaaaatattgttatgtttgagctgaacttcatatatcagagttgtgcatgagttgttcctagtgctatcttatggtatcgtttgtgtctagactcgcgtctctagtacgttctagcctaggaccagcacggtacttgactttgaaccattattcaattttgcattctctgatttgaaccattgctttcctttgctacatattttaagcccacccagagctctacagatttgattgcagccgtacagcaagtgtttgccaaggcatcgatacatccaacctccattggggtgcttggttgagtcggtgtatgtcacctttccgcttgctttggtaagaacttgtaagagcttggttaaaagcttgagtgtgtgtgatatttgagctgccactacctagtagttgataggagcgtgcatatatttgtgtatgtttcttgcttgctactaaccatggcaggattgtgaaaggggaaacgagatggtcatgctcaacatcgacttcttcaccatcaacgagatatatcgtcttcttcacgctttgcatataaggtacatgataatgatcttgcaagggtagaatctaatttgcctgtttttgatggtaattatgattccgccgcttatgttaattgggagctagcagtagacaaacaatttgatgagtatgatttctctaatgctcaaatgattaaggctgctagtaataagtgtactggttctacatctttttggtggtatattgttggcaataagtttgaaacttgggatgaatgcaaaacaatgatgagaaaaaattttgtgttttcatattataaacatactctccttgagaaattagaacatttaaaacaaggtgacaaaaccgtgcgggagtactttcatgactttaaaatttgtatcacttatagtggtttaaaagaaagcaatgagaacacaatgactagattttttagagggcttaattctgatattcaggctgggcttattaacgtgacatataatcatataggccacttgttcatgcttgcttgcagtgttgagagcaatattttaatgaacccaagggagaaacaatctatgcttgtgcctcctattactgacattttgcagggagctcagtacattcaccatgaggagaagagcaatatgatcgagatgccatctccatcgctcacgaaggaagaagagaagactggtgcacctacattatctgaagagggcataaaaggtaaattaaatggtgttgatattactcaaggtgagtgtgcttctcccttgtcacatttctccactatccatgctaatctagagcaaattttggtggaaactacttctgatttgcctttgtcacgagttgatttacttgttgttccttgtgataaagaagagttgtgtgataatacttcacttatatccatgccacaactagtgaatgaaaatgctatttctagtgtttctttgtgtgctgattttaagcatgttgttcacattgctaatgatgttgaggaacgtaaattgataacttctttaaatactttgggttatgttcagtttgatgatttttgtgagctcaataatttggaggagaaattatttgctaactctgatttgccatgtccaactaatgctatttttcatatctttggcgaatataacgatagaggaatatatttggtgcatagagttttcatttgttcgaatttagagaaacatgttattgctaatcacactacttcgagtttctctggttttgattggatgaaacatgttattttgaatggactatgtgaagagcaccatatggaaaaaccgaggatggttttccgtgaagaaggggaggatgatgtgaccatggctactatggatacatccgttgctcacatcatggatgaacaacaagatatcaagtgcaagtcctccaagtactggaatccgattcggccacgtgctacactgctgacttcaaacggccgccgaatctgcatacaagctccgttttcggcccatgagtgcttgatagaaagctctcagagtcctctttccaacggatctagcctcatcaccaaattccatcctggtcaaccgcagatgaagaaacaagctgctgcatcacctgtcatgggcctttgggcttgtaactatttttgggaccccggcccatgtagggcccatgtggggtgcgccccaaccaggtggaggacgacctagaggtcttcccacctccttaaatagttaggtacccctctagagtttcttgggttttgtttagattaaagtttagctttgctactttgccgggtaatcccatgatcggttagatcgccggtttgctcgttacggaaccccaaacttatcattggtattgaattcctatctgcaaatcagattgcttttatcttgttcttgcttgtttcttcgatttgcttgcaggaataaggttgatctgcaccggcaagatcaacaacccacggagaggtgtatcgatcgctaaggcgcaacacaacaacatctagtatggttgtagtcgggtcgtcaacacttctcccaaaatcgtagttatcatcaactaaccgaaagatcgggccaacaacagccttgagtatctcaagtggagctcagggttcatcactcttgaattttccttttgaaatccagactttttatatatatttgcccccctaattttgcaatgttgaaggcattgataaaattataatttggactatgggtgatatatcaaataccggccatcatacatcggcaaagcacaaccgattatgataagaaaaaaaaacactaaggacgatataatctatatcggccatcatatatcggcaaagtacaaccgattatgataagaaaaaaccactaagggcgatataatatatatcggccatctcaaggcgatgtcaacacatcggctaacatgtattggcaaccatcagccgatcatgagttaatccatacagttggatagtatttcttcagatacttgccattaagcgctcgttcataaacttcaccatcaagtccttgcaacatataagcccctttggacacaattttgtatatttgaaacggtccttcccaattaggtgaccacttgccgaatttattatctcgagttcctattggcaagatcaatttcgagactagctccccttcagaaaaagactttggcaccacttttttattataatgccgagcaactcgttccttatccttagtcacctttgcaagggctctcaatctggattgaactagatcttctgtttcatcttctataagattgtaatacttatcggctgttaaatcatcctgtaaagctactctccttgagccgcttgtagtttcccatggtaaaactgcctcatgtccataaacaagcttataaggagggacttgaaccgatgcgtgacaagccatccgaaaagaccataatgtttcagccaaccttgtgagccattgccgaggaaaatcagaaatctttcttttgatcaacttaatcaagctcttgttagatgcctcagctcgcccattagcttgtgcataatatggtgaagaattcaacaacttgatacccatgctatcggcaaactgaacaaattcatcaaatacaaagattgacccctgatctgttgtaatagtctgaggaatcccaaatcggtagataatatactccttgacaaactgtattgcatccccataatcaactttcttcaatggaactgccaccacccatttggtaaaataatcggtcgccaccaatataaacttatgtcccttgcttgaaggtggattaatctgaccgatcatatcaattccccatcctctgaacggccatagtttgatgatatgattcatagccgatgctggtgctctctgaattgctccaaattttggcaatcttgacatcctttgta

SEQ ID NO: 68895 - DNA, 11245 bp, Oryza sativa
ttttttttgccaacacaagatcacctaatgatttgcggtgcattaaacagagtcgccaaaatcaataaatcaaaattggctagtgaaaccgatttcgagattaattcgctttcgtggaatcacacgactaatttacgagcaaattagtaaagaagataatatcgtacttacgtgacgacgaacgactagtttccgagcaaactagcaaaggataaccttctcgctttcatggagaagcacgaccgtttttcagcgcaaaacggcaaagattaaccaaattctagggttgctagaactcagccataaaaacaaaatagaaaagaactaaaaagtaaaagagatgaatattagattgaaattgggttcccttctattctaccgtggaccaatatatatagctaattgctctgatcttttggcatgtctactcggtcccacgcaatatgcaatgatggtttaccggaatatttgaaacaattcgatccaacaaactctttatcttctaactagataaataatatcgcacgcggcttggctcggtcgccgcagccctgctctcaacgcagatgccacgtgatggttggatccagcgaataccatcacatccatgcaagcagcactcccatcacagccgcacgtctgagcccctggctcgctcgatgacgatgaagactctttggatcagtaaatacgacacctgactttccatctgcaggagcaacgaaggattcccttgccacttaatcacccaattagggataatcacctgcctccgtgattaacgtaacgtgacggtcacgccctgtatagcttctgtagcctgcataaaaaccaaatatacatatgcatatatatgcaatcagcttgcacaggcaacaatactataaactacatcggtccatattcatttagtcaatactagcacatatgaccgacgcatcacaatttcctacacctgtaaactgagtagattttcaagtgaatcatttgacagttgtatcatctattctaaaccaatctggtaactataagccaaattatcgtacaaacacatgccccctgttttcggtataagaaggacgtataacttttgctttaccgaaaacaccatagaattaatcaatccagaccacgatcgtcctctcagaacaatactccacacacggtattagtcctaagcccatccacaatcatcttctcaaaacgatactcccacatatggtatcagtcttgagcccatctacagtcgtcctctcaaaacgatactcaaataagtatttgttctaagacaatcaagttttctaccttctcaaataaggataataccttctcaaatatttcccatttagtactaaactatactacaaattcagttgtccgtaatgtccacctaactgaattggctgcagttcttgggcctaaaataaattaaaaacaatcccatctaaacttcgatacattttaaaaaaactcatcctatagctcggcaatatatttagtcatccaacaaaggatggaattcccgaatacctggagcgtacactgtactagtcccatgatcagtggctagcacacgcatccacaacattgctatcatatccatacaacatacttgacatataaatagatgaaatggttatcataacttagcagtgcaatggtcttacatagtagttaggccgactggccaaataaaagagtttaaacgcagcggaaaagataaagatacataagttcttcagtatgcccatctaccaaaccacacaggcaactgactaggaatcaccctagaaagaaccatccttagaaactccggtaacagaaggaacacccgtttcctgcaaacgagactaaaaacaacaagaggtgggtcaatacacgaggtattggcaagtcctacccaaaccttgggaaacttttgttactattgcaagctgagatcaaggatggctatatttgtgcctcatttttagcgtaaagcaaattttgtttcgcaatagtaaataataatagattgaaacataatttttaaaacaaagaatagaccataatagtagcagtataagtaccatcatagtatcatccttgtgccctccatggcaacaggtaacaaattcattcttagcccacactgggtaaaaccatcaccaatattcaccatacccatttcacaattcatttagtaaatcaccaacactatacttgtatcatttcaccaagtcgctcatgaccgtgagcacggctaatcgattagttttagaccctgcagagtttgtacagctttacccacataatgtgatttactctagtttgtccggtacctgtcggtaccaccacactctacatattgaatgcggtctacacactgggtggtaggaaggtattatttcaaaggggtaggcaagcttttcagtaggtgcattctctgatgttttctctttttactgaaagaaccaataggaaataaaagaagaaaagtggcaggcaaccaaacataacaacacacagtcatcgcattatgtcttgctcaagttttttttttcacttgcgtgactaattgatttatggcaaaatctatttcaccctagtgcatcatatcctgggcttctgtgcttagctagctgatatatcaagtgtgacaggacgaaagagatgactacctttccatttgataccagtaaaaaaaatgtaatttcaatgtggctgtaaataaagctttttttttgcaaatcaaatagaattctagaataatttttcccagggaaagattttaaaatatttatttctagatatagtatacatgttgtttgaaaaccacttgtttgtaaaatagtagacagtgacgtatagacactgcttttaattccattttattttattttaaatcaagaaagattaaggaattttattttggaaaacctcaaaactcagagtcggtgcatgtattattttacatccaaactgctaattatagccggtttatctattatcaaaaacacactttactgtcttgataactagaatcctattatgccaaagaattttcgttgttaatttttcctgtcaatgtatctaaacaccggtccaaataatgatttaacagtccaagaaaaatgctgaattaatctattggactattaaaataccgaaagcatctacacccctcacaccaacaacgactaaactttccaaaccgaataatagagcatctactcggtctaaagtgcaaggatactctaaacggactgatagggaccgatgtgtcataagcaatattacttggtaaatataaaacaataccaactccttgccaacccacacaaaacatgaccgaaataaattctaaagaataatatatataaatacaagaaaaaaaaatatctccagcccttaattatttcggtctctaaaaattaatatcaacatttgtagtaattagtcaatatgcataactatatggtaacatccccccatgatataaagacccatatgacatccaaggataagaataaaaccatgagggataactatacataccttagaattggttccatgacataggtatcagtggcataagtgaagaatatatataatatggtggcgaaagaacctaatgattagatgtaaactgttgatttggtgcacacctcctaactcccttctcattctttgcccccatgtggacaccccgagtattataccatctagtgtccaacacgaccaccacatactattggagaagtgggatccatacacgcataaatagccactcgtcctcaatgtgtccatgatcgcggttgacaaccttctgttataataaccgaaatgtcgagtagtaagcacaagacataatcgtaagatagcttgccagtccaccacgtcatatgcccgtcaaccactcgaaggtggcgaccaaaagcataccccaatgactcgatccaaagcgctatccccaattatctcaagcgatcaaaacccgttactcatgcttagctagtccctaggaatgcgactagcctcacactttcatcgcaagcaattaataaacatagcaaataccataatagggttaaagtgcagcgaggtacatgacacataatagggtccgaggtcccaacatacaacacataaatatagcagcggaagtctcaaatagagttcataagcaaaagataaaatcggtggtgccacaaccccactagggcaaaccaaccgggcaagagccaagctgcaagagatcactcattgccctcaccacccttggcagagcactgaccacacaagaagcataactcaaaaccggattcctctcctgaaattgcagacaccgggttaagtacaagattgtactcgcaagtcttacccaaaattatatatacataagggagaaagaagtatgcaagctttctagcctatggtgggtctctaggttcaacatttgcataaagctaattttattgagcaattatgagtaaaataagcaaggaaaagtaagtctagcatcattttaatttatggacagcaagtatataattctgaaatgtataagcaaataagcccaaacggcgctctcatcatcaaccatggtccaccaaagtccataccaacatggcacaacatgccaacaccaccatcaaacataatcccatccataataatctacatttgatgctaacatgagtgagatacacatcaagcaatgtccataaccaaggacgcggctattcgaataggttatactctgatcagaggtgtacaactggacccacacgaaatgaacaaagatcaaatgctacacaccctgtcaagtgcggtacacaagtgattcaagctcattacatgccctttcttaaccccaccccaaccacctataccacgctggggttcccgacgactcagtcacgtgcgtgcgtgatgtgaccaaggcgggcgggccacgggggaggcacccccggccaacataggcacccgaggccctccaaagggctacctgctctcacgtctctccaatgtggtataaataatgatagtagaactagtaaaggacaagctggtcccaaataaggcatgtggtaagtatgaagggtgcttgaatagatgtcaaaatgttcgatccttaatgactcagacggggctacttgcatcagacgaaaaccaacctcctttcatcgccctatcacccgtccaagtccaacatatttcatcaaccattatttagtgtaagtactcaagttttatgcccaataaagcaagttgtctatgtaccacaattaatagcaatgtccatccctatagttctattagcactaagcatggctaagcattaatgaataagatatcccaagtaatcccatccagtggtaataggttataaggacatcaatattacaagaactaaatgcataaatagtttcttcccatacaccataaaccgacaatattaatatctaggcaatgcatgcacatatatatatgtatagattgcaaccaaatcatttttagagaaagcataggttctatatgcttaggtgcttgccttgctgctgagggaagtcactatcctcctctggatatggctcattactctccggaatctccaaatctatcgaaaagaagcaatatgcgaataagagccaaataaacatgtacatgcaaaatgatcaataaattatgaaataaatacagtgggtagatcatattttaacttgaatttaggtgaaagaatcaccggattatcacttatggtttgggagatatgaaaatgacaagctctcaggtgctgaaaatggcatttctgtaaatattaatgtttcctttacagcattgcaagcaacctataactcaaaccaagttttcataataatgattatttttagagtaaagtacatctttcacatgtcctaagaaaaattatttcatagctatatatgttgccattatttatttatggattttacaagttaaaatcatgggaatgctaaacaactcctaaacaagatttaagaggtagttttgccaaaaacaacaccacaacagcaaagagtactaaaatataagctcaacaaaattggtttcacaaatttagcttttaccaataatttcttacgaatttattaagagctataccacacaagggatacatatagctatttatatttttactgggaaaaccagtacaaaagttggtcatttttattttacaacgttgaagatcacgtttttcttaatccacagaaatttggttcactgaattcggagttcatatgaattagttatgaatttttaaagcgcacacctctttcagctcaatagctatctcagaaatcgatttctattttcactccccttttctccaacttccaccggacttcactcacatggcagcaacctggacgtagggttgtgcgaggctaaggccttgggctgatggcaagagatggagcaaggtcttgggctgcgcgcaagagacgttgcttagggctgcttcacccgaaatcaaaaaaaatgacttcgggttaggttcagccccctttttagtgcaaccaatgagtggaccacctataaaacggtgctaggatgtttaacatggagggaattcaaaagaggcaccatggatgaaaaggaagctcaccaaatggaggaaaacaaaatgctgctgctgcagccctgtaggctgaaaccagcactcttttattccttctcgatctctctcaactctccatgcatgtgcaagatgttgggatggatggaaagcttggatgatgggaattgttgtggtcaaacatgcaggaattgatcttgggctattggatgtgatttggggaggaggagtgagatgagagctcagcttgatgaagaaaagatagaacaagcagtgaagatgaaaggggttttctctgcccccccccccccttaagtcctgaggtgggagcacgcccatggatgtgttgtggggctatagaggcacccaaggtcagtgacaagtgggcccaagtcgtggctgtctatgagggtgagagaggtgggtgaaaaactgagtatagattcgttcttgtaatttccaggatttattttctttccctctcttggtaaattcaatttgactaggtaaaactagttcaaaaattaagggatttggtgtggtgacaggtgttggtttctaggttccatttttcaaagtttcactcaaaaattcaaaatattttaattctggtgaaaagatgaaattggttaggctgaaagttggtttgaatttttaggaggactaaacagaagtaaaaattccacaaaatttatattttttggtgataaataaactagtatttgaataaattattataaatgtacacttctgttcaagttattgttcaaatagaagtggtttcaattttaccgattagagttaactttgtcatcgcctatgatcaaattgcaatatagtaaatatgaaatgtaaaggacaacaaaagcacttctaaatacctggttatgaacctagggctgttacaccctacttcaactttaacatctgtttcattatgcacctgaacacttcctttaggaatccatgccatacctctcttcttcacattctctacacttagcttttctagctgcttcttctgccaatttgacaagctctgtgagtgtctcggttgattgccattgccccccgagctcttcagcagattttgacttgttactaactctgccgaagatgcctctcgcttcatactcacatggtgtaaattttctagttgttgtacacgtgcatgccccctaggttcaataacatttttctgaactgaagccttttgtacacccacacgtgcactagtagctaagcccttttcttgacctctagacttcggcacccatatttgctccttattgaactacctcccacctgcgccgaagaccacttcttattagaccacctagaccgatttgttttaccaaaacggtcatccttggcatgtgacattcctagagttgcaaaattcaatcggccttcattaatagccgattgtatcttctgacgaaaagtgttatagtcagtagtacaatgatcaaacgaattatgccatttgcaataaattcgttcttttagatcctgaagtgatggcatgacatggtgatcaagtaatttaatataattatttttcaacaatgcatcaaaaatatgatcacacatggttaagtcaaaagtatacttcttctcctctagccgacacttttgtgcagatggttttaaagctaagcaaacgaatggttcagatttgccatctacccattcgactacacggttagaattatccactatagtagcatcagcctcattaatattttccaattttagttttgtgtctctatctctagattgatgataagcaaaccatgtagacataaactttggcaatgatgatatggaaaatttaaacactttactattaccaataagaaaattaacctccccaatcgatccctttgagttatttcatgatgatattactagtgcaaatattatttttagataaatgatcaaattgggaaataatcgcattacctgcagactttacctgatctgatgtgttggagaagcgtggtgatttcttcacatgaacaatgtcctcgttcatcctctaatggccctccaacatctcctctgtgttctcaaggtatcgtgctccatcgacttgatgctcatcaactttcttggcacgaagttcatctggcaaaacaaaaactcctatgtctctagagaaatcaagcacaactacctcgtctttgttagacgataattctaaatttatcggcttttgttgtttttccatgacgcttttccttttctttagaaggcgtgcaagtttctgttttcttagctccacgctttctaccttgagctcccactctaactcgcgtcgttgatcctcagataaatcatctaatgtgacaatgctattgtcgggatcgaaagtgtgcttatgatcaatattgccagttcgtatttcagtttgccccctagccgaatttacaacatttgaactctgtgcgtgtttgaaaatatacatagtactatttgattgacattttgaagatggaactactagtggaacgactattaattcggctataatcgctactagtatatgaagccgaattatttccactagatattatgtagtgcgacccataagactgagatataacatgtgactgaccgatacttggcatggcatgcaatgatctaatagaatcaactgaattataaataccgccatagccatacatatctttcatcggcaaattttgttgtgtagtaataggttccgaaataatcgccgatgaattaaaaggtgcgcctacatattgtttattgctaccattattaaaatttaaagcatgtgaattattttgcataggctgtgacttgttattctcataatttaaagatcttgaacattgatttaaagcatatctagcaacattgacatgagtgttgatggcacttgaagaattattttgtggaacgagcaatgtgtctgtagagtgtacctcacaactggcatagcaaggtgaccacgtagcactccagtacgcatccatgtatttttctggtgcaatcaatgatgagggaatgttaggtcccgatctttcgataggtactgataaacagtcgatttgggcggagtcaccacacaactcgatccggcttctgaacgaacacgctactgagcctcccaatcgcagcaccacgtctcctctggttatcaaccgtgccgaaacccgattgacctcgccgagatggctaatccttgcatgcaaatcgaagaacacaagcaagaacaagatagattgcaaccaaattgcatatgaatgattaagcacacgaatttggggttccacaaaccgatctagcggcgaaactgttcttgacagattaatctaagcaaaacccgactctaaacgatgacggctactgaataaaaaagattagggacgtcctagggttccctagggcgcacacccccttgagctaagcccacgacacaattacaaggcccaaaacccaaatcagattcggactggatgagatacgtggcttgttttgcagattcccggtagctcggtaggaattttgacatgggaccaaaaccatatgaaattagactccataagctttgtaacaagtactcatgggccccgaaattccttctagatcaacagctaggtccgttcgaagttgatgctattaggaggcccgaatccgaatccaaaacatgtagaattttatctcgtcttctatgggccaaaagtgttgtggtgaggtagaagtagacttggagaaggtcttggtttggtccccaatcaacttctttaattatccatgcattaggtacgctcggtctcttttccttcgcccaagcaagtacttctgcaaacgaaaacacacaaaactcattgtgtagcaacgtttgttcaaataaatatataacaagtaaatctaatgtagaacatatgaacatttatttaattaatacataaggtagttatttatggttatatccgagctagttatgttcttatcatcctccctttcttgattggaaaccgtcctcggtttcaccttgtcatggagtgtattgtacttatctttgtctatcacaacatcctgtgcggaacatttcttgatggacatatgattggatcctaaaatctttgtagtcgaaaacctcaacactcctcttgcaaaccaacttgtaactcatttaaacaactagaggaactagatagagaattacttatatgcatgcggtcctctagacaatacatttcatcatgaaaaggaggtatagtcaaattcgaacaaatatatactcgatgcacattatattctcctttactttcataattgccaataatatgaaaaatcacatcagaagggcatggcaattcaaatctagcaaataatttcttctttaagcagttgagtggacaaatatcatcaaattgaatataaccccaagtatttaaagaagatagcaatttaatttcttcattctcgctagcaatgtgaataacatgtttaaactcaacacttggtggctctactatagaactagcatgttcattcactagttgtggcatggataaagtgaagcatcgcacaactcttctttgtcacgagaaacatcaagcaaattgttttgtgacaaaggtatttcagcaattgtttccaccatgg

SEQ ID NO: 68896 - DNA, 15198 bp, Oryza sativa
  unsure (1)..(15198): unsure at all n locations
caatagtatctttcctggtatctctgaaaatcacatcgattctatttttcgtcctttcaatactatctttgaaaattccttgattccattcttcatcctttcaagattatcttcgaaaatttcagtaaaactcatgggtaccaatttcatttttcgaccattttgtctaaatgtgtatgtattagcaacaaaattatgcgaaccattatatcatatagccatggttgaccaaacaacaaagaacattcttgcatagggacaagatcaaaattggcagtatcatggtaatttccaatcaaaaagtttattctcacaactctatttaccttgaccttaccacaagagttgaaccatttgatgtaatatggatgaggatgcggttgtgtaggcaattcaagtttctcaaccaaatctaaactcacaaagttattacaactctcactatcgattatagtacgacatgctctatccttaaccacaaactttgtttcaaataattcgtggtactgccattgctccgctttctccatttgagaacttagtacttgttgcaccaaagtactgtcatcacgtccaccttgttggtatcgctgattttgagcgcgactcatacctgtcattaagaatacaaaaacaacaacaaacaatgaaggttatccctaataatctgctacgcggtgtagtggtgccccttaacaactcagccaaacggagcaccttaccaagctcttacaagtgtcttaccagcaatgctaaggacggtacaaccggtggctagttcgtgacaccttgaaggacgtgatgtggcgattgcaaggatcagcggtgctgaccagaagtatatatgtgtagcttgggaggcacaatatatagtagcaaaggaacgcaattgtactaatcagaaaatgcaaagttgaataatagttcaaagtactagtcaatgtgctggcctagtctagactcaactctagctcaagcaagcacccgacaaaactaatgactagatatgaatcaatgcacaactctgcactctgaaaacatactcaaaggatgatttttttttttctttctaggtacggcttttttaagcacctttctgcccttttttttgtgcggctttctgccttttctttgcacctttctgccttttctttctttttttattttttttacttttttttaacaagaactgaaccactgacttcaaacaaggactcaaatgtaaatatgaatattatagggactcaaatgcaaagtgcaaaactaaaattgggtcacctcaaaaatggattgctcatatcatgtaggttccgtttttataaaaatatctcaaattggctaaaggaatttcagtgtaacaatacttgattgaggaaaatacggagagaggtgctagaggaactcagtcacggtatggatgactcgaccgaacagaccaaaaagccaaacaaaattggttccacccttatccacaactctatatatctctccctctccctgtatatgctattttctaggagatatttaatagatctgatactcgtgcgcgcccgaggggccctaatacgcgactagtcgcgcggccctccagacgcgcgatcagccgatcagtactactagtatagttcagtactagtactacaacagaactactagtagtactactacactactattactactactattgtcattatactaccactagtattactactataatatatatatatttatatgtatatattttttatgtataaaaaaatatatacatatacaaactttgtatacgatgtgtacaaactttgtatacgatgtatacaaactttatatacgtatgtattaaaaaaatacaataaaaactagaaaatacatcacttatacaaacttcgcatacgcgtatacaaactttgcatatgtacgaatacaaactttgcatacatacgaatacaaactttatattcatgcatctttgaaaaaacagggaaaagaaccgaacagaagagaaaccggaaaaaaaaagaaaaaccaaaccgaaaagaaacgagaaaaactcactactccctcctctcgcgcggcgcgtccgccgcccctctccgcgcgcgacatgtgtccagtcgcgcggggaggggtgcacgcgactgatcgcccaatagctttttcggtgcgcgcccacaagcacggcaacacataaaccctcctttcccctctgcgcgccaaaagcacggcaacacagaagcaatagcaataaatcaactctctaaccgctcgataaaattttttggaaactacgaaaacggaaacccaacgacgagacgattcaatttttcaaggtcctggcaacaaccaaccagatgaaaaactggacctaaaacaactcagacagacttgagtgatgaaccctaaacctaagtgatgaacagatgcaatactcaaaactaaaaattaaatctaaaattaaaccagcactcgacacgacgatgcaacatagaattcaacaaagcaaaatctaatagaacaatgcaacggctcaaattgtccaggtaaagaataaatatttttatgtggcaattttctggttatgggaacataaattaactaacgggcaactgcgctctgataccaactaatgagggagttaggtcccgatcttccgataggtactgataaacagtcgatttgggcggagttgcgacacaactcgatccggcttctgaacgaacacgctactgagccccgcaatcgcagcaccacgtctcctctggttatcaaccgtgccgaaacccgattgacctcgccgagatggctaatccctgcatgcgaatcgaagaatacaagcaagaacaagatagattgcaaccaaattgcatatgaatgattaagcacacgaatttggggttacacaaaccgatctatcggcgaaactgttcctgacagattaatttaagcaaaacctgactctaaacgatgacggctactaaataaaaaagattagggacgtcctacggttgccctagggcgtagacccccttgggctaagcctacgacacaattacaaggccgaaaacccaaatcagattcggactggatgagatacgtggcttgttttgcagatttctggcagctcggtaggaattttgacatgggaccaaaaccatatgaaagtagactccataatctttctaacaagtactcatgggcccaaaaattacttctagatcagcggctaggtccattttaagttgatgctctcaggagggccgaatccgaatccaaaacatgtataattttatctcgtcttctatgggccaaaagtgacatgatgaggtagaagtagacttggagaaggttttggtttggtccccaatcaacttctttaatcatccatgcattagttacgctcggtctcttttcctttgcctaagcaagtacgtctgcaaacgaaaacacacaaaagtcattgtgtagcaacgtttgttcaaatatataacaagtaaatataatgtagaacatatgaatctttatttgattaatacataaggtagttatggttatatccgagttagatatgtcctcgtcaatcaatctgtacaccaaacaaatataccaaaataatatacagagacaagcactgacctgatcgtttctttatctcttatgttcctgcgcgtgtgttgctattgtgccgtgcgaagaaacaaaacaaagtcaactcttgatctgcctgatcgtgtgaatattgcaagcttgtgatgagattagatagcgtcgccgaatggcgaaacgataccgaagcaggactgactggccgccgccaccgaatagatcaattcggcgtgcagctgacaaaaatgcacagtagattgatttcggttgaatcgcaggaccgaaattgttttcaccagtggagtcgccaagatatgttgacgcttttttttgctaatacaatatgacctaatgatttgtggtgtattcaatagagtcgtcaaaatcgctagatcaaaatctgctagtgaaaccgatttcgagattaaatcgctttcgtggaatcacatgactaatttacaagcaaattagtaaagaagataatatcgtacttacgtgacgatgaacgactagtttccgagcaaactagcaaaggataagcttctcgctttcgtggacaagcacgatcgtttttcagcataaaacagcaaagattaactatattatagggttgctagaactcagccatgaaaacaaaatagaaaagaactaagaagtaaaagagatgaatattagattgaaattgttcgggttcccttctattctaccgtggaccaatatatatagctaattgccatgatcttttggcatttctactcggtcccacgcaatatgcaacgatggtttaccggaatatttgaaacaattcgatgtaacaaaatctttatcttctaacttgataaatatcgcacgcggcttggctcggtcgccggagccctgctctcaacgcagatgccacgcgatggttggatccagcgaataccatcacatccacgcaagcagcactcccatcacagccacacgtctgagcccctggctcgctcgatgacgatgtagactctttggctcagtaaatacgacacctgactttccatctgcaggagcaacgaaggattcccttgccacttaatcacccaattagggataatcacctgcctccgtgattaacgtaatgtgaccacgccctgtatagcttctgtagcctgcataaaaaccaaatatacatatgcatatatatgtaatcagcttgcacaggccacaatattataaactacatcggtctatattcatttagtcaatactatcacatatgaccgatgcatcacaatttcctacacctgtaaacggagtagattttccaagtgaatcatttgacagttgtatcatcaattctaaaccaatctgtccttcacacatgcactaactataagccaaattatcatacaaacaagtttaatagtataagcaaattcaaaacttgccccccgaggagagattataaccaagctgataccacaatcatgagtacaaaccgatccatcaacgaataaagtcaagggcacaatttcaaccgagccgattgaatcatcacgatgttccacaataaaatcggctatagcttgtcccttgattgccttgggcgattcatacctgaggtcaaattttgtcaaagcatatatccactttccaactcttcctttgagaactggagctaatagcatatatttgatcacatcggctttgcatacaacaatgcattcattggataacaaataatgccttaacttggtgcaaaagaagtataaacacaaacataatttttccactagagactaacttgtttctgtatccaatagcctatggcttaaatagaaaatagctctctccttgccctctagttcttgaatcaaaactgagccgattgacttctcatcggctgatagatataacctgaaaggcactctcttttgtggaggaattaaaactggacgagaactcaaatatgccttaatgttgtccaaagctttttgctgctccgccccccaagtnnnnnnnnnnnnnnnnnnnnacgtttacaaaggtgtaaaaggttctaaccttccagacaagttagatataaaccttcgaacaaaattaatcttgccgatcaacgattgtagttgcatcttatattccggaggttaaatcttcttgatggcattaatactcctttgagggacctcaattcctctctcatgaacaagaaaacacaaaaattgtccaaccgatacaccaaaagcacactttgttggattcatctttaaaccatactttctggttctctcaaaaactttcctcaaatcggctatatggtcctccacctgctttgatttaaaaaccacatcatcgatatagacctctaccaacaagccaatcagatcatggattatgtaattcatggccctctgatatgtagcttcagcactcttcaaaccaaaagtcatcacaacccactcaaataagccgattgcaccaggacatctgaaagcagtcttgtgaatgtcttcttctgccataaaaatttgattgtaaccagcattgccatccataaaacttataatcttatgtcctgaagcagcatcaaccaattgatcggcgatcggcattgggtactcatccttaggtgtagccttatttagatctcgaaaatcaatgcacaccctaaatttgccgttcttcttgataaccggaactatattagaaacccactcggcatatcggcacggccgaataaaaccagcatcatataatcgagtaatttcagccttgatagcatcatacatttgagccttacatactatatattcttatttctacataatattagtaaacaattatgaaatcaaatataacattttgaaattaacatatcatatttaacaaactagatgatgggacgaccacatgacatcaaagagtatacataaaaccaacaaaaacataccattggaaattaaacataataattattttttacatgtcatgaagttttctctcctatctagatctaggcaaatagataagagcaatgtatataattttattccattatattacattataaaatcactagaagatgagagaaccccatagcatcaagaaaccacataaatccaacacacatatcaaagcaaaatacaaaaaaaaaaaagagaacacaatcatgggagctagcttttcccctcactattttacatgcatagatccatcctaaaaggaggtttaaattaccaaaaaactatgtatatagagtgcaaaggcatagatctaatcactgtagaaaaatccctcgaaaatttgaagttcaaaacctacccctatattttggtgcctttaagatagtgaaaatcgtcagatatgaatagaagctcggggaggaacaagactatatagccggcctgatttttgcatgcgacgaaaaatggtcgcctgcgaagatttttgcaaacggcaccaaatgggcacctacgaagttccatcttcgcaggcggaccacataattagaccacctagaataatcgcaggcggtcccttatgtggtccgcctgcgaagatggagctttacaggcggctcgcttggtccgcctacaaagatctatcttcgcaggcggaacaaaaccatggccccggtatcatttatcctaggtggtgctccggtttttaggtgcctacccatctgcaaaaataaatggccaacgtcgctaaagaccatttttctagtagtattgataccataaaatataatttcgtttccaaatatcctaaaggcgtatttgtctttctcaaccctaacgacatacgcatatccagtacaattgttcgattaaaatatacctgttgcgatcagtgcatttgattccatattccctcccacacgattattaaagacatctccccagtactatatatggtgcttgcagtactatatagcatccataaaatataaaatccgctctaaccaaccaccatcccctcacacaacacgctagctctaataatctcatttgcaccacagaataggacatataaatgttatagttaattaatcacacagcaacataccctgtaactagctagctattaaacagacattcctctgaccatgtgcatccatatatactatagtattttgcatgactactaaactgattagcttagctatagctcacttgcagacaacccttcagtacacttcaagctgttggactcactgaacagacttgtccaggagcgcgcatccagctctcgatcaaaacaagcacagttaagtgcatctctgtactaatgatactcgcatctgcagcggccagcacacagaagctagcttgcacacttaatttgagtactcctttaatttattgagtatactctttacagacctatcctgatcatttgccgggtttctagagaagtgtaaaagttaattgactgcagccattcatgaaagcctgtaggtttcaaaccatgcatatgcatgcgctgccccttcacgatttctgaaaacttctgtaacactgagaaatcagcgggttgccaatgccgtggcctcctggtgcaggaggccacagctggtgcacacaaggatgttcttaaattcatctatgaccgtgtttagatctaagggtgaaaagtttcagtgtgtcacatcggatatatgaacacatatttaaaatattaaacgtagactaataacaaaacaaattacagattccacctgtaaattgcgagatgaatttattaagcctaattaattcgtcattagcaaatgtttactgtagcacctcgttgtcaaattatggagcaattaggcttaaatgatttgtctcgtaatttacacgcaatgtgtctaattagttttatctttttgtgtatatttaatatttcatgcatgtgtctaaacattcgatatgacaggatgaaaagtttttgcgtaggaactaaaccgggcctctaaatgtagtcacagttgacatctagctagtatatttctgatcgcccgtatgttgcttgtgcgtgctgtactgcactttcctggatgcaatcactgtcttgtttgttaaattctctgcagatcacagggaaacttagcctgttctcatatgcaatggaaaagttaaggctagctagggatggggcttgtgtctgtactcaaggctgcgcaaagaagggaacaaactgagcgcagaacccgattgaaactgtatattctatcagatgatgaatacaagagctatatatatatatatgaatgtcttctggtatacatgttttttgttgggaagagaaaatgaaaacaaagagtagcatggagaaatgagaagggaatatgtactgtagagaatggaatccgtgcaagtactgctagctgcaggaatgcatcagaggaaatatatactagagagcatgttctgcatcatatgcatgtgcatggtttaactgctggaatgtgtcagtactgagagcttaatttgtagacaggggagggaagatgacatcttcatcctcacttgccaagcactacagtcaccttgtgtctgtacatgcagatagctctaccttcctcatagttgaaagctgatcagcatgacatgttaaaaacacagagataaacacgaggaaaacaacaataaggatgaaccaggctatgcatgttatactagctaaccagaccaattcagtcaggtataagatacacaggcttgatttactccttacggatggaaatatttgtatttacttgctggttgaatattaaatatttatttttttaatgatcattgagatcctcttcagaaactacaaagtaccatattttctcaaacaaatttaagatactttctaatattttggatacccaagggtactaaggacatattatcactaaaaaaaatgtggtaccgtgaatgttaagaaacttcttagatattatactagtataaatctcacctggcaggggaaaaaatacacatgttttccatgatattgaaaataaactaccaatacgaaagttcagatatatacgcgacatagttaatactgtaattgaatattgatcttttgatagatttccgttgttatagaagctgaggtcatatgagttttaatgaagtgattattaattgttcgatattcatatacttgcacgttgaatagaggatacggtgaaagagcactaattaatttaaactgacaccagcaataaaaataaatagataatggctgagaatactttgccaacatgcacaataagaaccagataatattggccacgataaaacacatgcaatctaaagtttatgctatcagctgatatcagttgaaagatatttctgtcaatgataataaatatttatttaaccggtctactacataaaattttataactacaattcaacacattgtgacagagtatgacaaatttttgattttttttcatgtggtatctttgaagaaatatacactatttccacagatcatctatggggggtaagagaattagcataggatataaaacaagaatacaactatatttgtttagcgtaatctaatttgacattgtttgagatcagccgcaagatgttttgaataactggcaattcagttcattcaattagtgtaatatataaggttaaccagagaaagtttggaactacattatgtgataattttcgtgcatcaatgcaaggttttaaattggaattcagtaccttcttacacagcatataacaagtcactttagttctttttttcattacagttccctttcaagagaaaaatgatttcttcaaatcattccaaggaaataagcagaattaacatataggataaaacaaggataaattcagatagtgcaaaccaacatttcaatgaaacacgagtggtgaataaatacaaattaaacatttgtaatcaagttgagatacaacagtggatatgaaatctactgttcttttggggcttccccgagtctaagctcaagatctagttcttcaaccgaggagctacgataaagttttagtatcttttcatgatgttggtcatcaccaccatcttgctgttgatgattactggttgaagaagttagaatcagggggtttacctccaaatcgattcttcttttcttgtgacttgcttcaacagtcttttcatcatccgcgcggtcgttatcgtacataaagtcccttcttgatcggcaccccaaaacagtagttatcttcaattcatttttcccaacacgcaggtcaagattagaactcaccgtgtcatgatcctgtgccaatcgaacagcaccaagaaacaacgtctccctcttaccatgttctctaccagccgacggcgacttcgatgagacaagaggggcgttcaggacttgtttgcccaaggcagttctagcagctgcaacttgaagcaaggatctagcagggtacgcgacaacatcacatatggaattagggttagtgtcagcagcgagaatactgccacttctagggtttgggctgtaggcgtgctgcagggtgccaatttggggagggcatggttgtatcatgtagttttggtttggcggcatgccgtggctttcgccgccggtgccgtcctccacaaccccagagagcttgagccttgcccggtccctccggtggacgttcatgtgcccgcccagcgcctgcgccgaccggaactcacggccgcagaagctgcaggagtaggacctcggcggccagatgcagcccccgagatgccctgcggagtcttccgcgaaggcacgttcctcccatgactcgtagtaggaggtggagctgccgccggcgccgatggtgatgtgaggggtggggaagagaggcgccttctgatctcccagcttcctcctggccaagatccagtaccttgctggatccatcaaatgacactaactaacttttacagctctagctcttgcaggtgccaaagatgatggaaagagggctagatagagaagaggtgaaacatctgaacccaggattgaggaagacagcagtacatgtgaggatctagctatgagagggccggagcagaaggggggaagaagagctgcaagctagccggggaagttagaaagaggcttgatttgcttgtctttatggatgcaactgactcatattctgatcgtctgtagtactattaattagttcctccaaccaataatagtacccaatagggccccatcattttcttctcagtttcttacacaagtgtgactttcctggatgcaatcactgtcttgttgttaaatgctctgcagatcacagggaaactttgcctggtctcgttaagcaatggaaaagttaaggctagggatggggcttgtgtctgtcctcaaggctgcgcaaggaagggaacaaactgagcgcagagcccgactgaaactgtatattctatcagatgataaatacaagaaccaaaaaagaaatataggaatgtcttctggtatacatatttttttatttgggaagagaaaatgaaaacaaagagtagcatggagaaatgagaagggaatatgtactgtagagaatggaatccatgcaagtactgctagctgcaggaatgcatcagaggaaatatatactagagagcgtgttctggcatcatatgcatgtgcatggtttaattttaattccactgctggattgtgtcagtactaagagcttaatttgtagataggtgagggaagatgacatcttcatcctcacttcccaagcactacagtcaccttgtgtctgtacatgcagatagctctaccttcctcatagttgaaacctgatcagcacgacatgttacaaacacagagacaaacacgtggaaaaccacaataaggacgaaccaggctatgcatgttatactagctaacctgaccaattcagtcaggtaataagattcacagggttcatttactctttgccacttaccataccatatgtgagtacgggtggaaatatttgtatttatttgcacgttgattaaatatttatttatttaatgatcatttagatcttcttcagaaagtacaatgtactatattttctcatacaaatttaagatacttttctaatattttggatacccgagggtatactaaggacatattatcataaaaatatatgtggtaccgtggatggtaagaaacttcttatatattatgctggtaaatctcagctggcaggggaaaaatagacatgttttccatgatattgaaaattaactaccaatatgaaaagttcagatatatatgacatagttactgtaaattaattatattgatctttggatagatatccgttgttatagaagctgagcacatatgagttttaatgaactgattatccgttgttattaattgtttgatattcatatacttgcacgcgttgaatagacgacacggtgaaagagcactaatataattaatttaaactgacaccagcaataaaaagaaatggataatggctgagaatactttgccaacatgcataataagaaccagataatataatattgaccacgatataacacatgtgccatctaaagtttatgctatcaaccctactggagaactaatctttgttggcttagccgaaaaccacaattaatagccccggttccaaaaagaacccagactaaaaatcatctttagccccggttgaaaagcccatagctattttatgatctttagtctggttggtactaaagatcgtttttagtcctggttaaaaaagtgtatgccccctattctttttattcccggttggaaataccaactgggactaaaaatcggtgcatagtatataatccctagcacttatcctctagcaatcacctcttctttatcctcctcttttttcttatcctctccctttcctctctctattcttatcctctcaagcaagcaggccagagggcgagcgagtaggacgggcgggcggcggcgggcggccggcgcctctgccagagaggaggcggcagcgacatcgcaaaattgtttttgttcttttttttgagaatttgtgattcattgcatggatctgagatgtataatctgtgatgtatttgatttgtgtgtgatgtgaatatgtgaagtatttgtgatgttttttttagaatttgtgatgtatttggatatgatcaatttagagatttagagatgatacttttttctgcgatgatcgatttggggatgatttggggaagtagtgaaatgaatattcaaagttaaaacaatgaaaaaaagaaaaaaaatctaccaactggagctggcctggctccatctttagttccggttggtaacaccaatcgggcctaaaaatggatatttttaatcatggttattttaactaggactaaagatgggtatctgtagtcctgtattcgtagtcccggttgcataaccgggactatagggggttataaaccggggttaaaaaccctttgtccagcagtacagctgggagatatttctgtaactttagttttatatcatttgcacgataaaattaaccgctctactagataaaattttataactacaattcaacacattgtgacagagtatgacaaattattgatttttttcatgtagttatctttgacaaaatatacactattcccacatatcatctactggggaaagagaattaacaaaggatataaacacgaatacaactatatttgtttagcgtaatctaatttgacattgttcgagattagccacaagatgttttgattaactggcaaattcagttcattcaattagtgtaatatataaggttaaccagagaaagttttgcaactaaattatgtgataatttttgtgcatcaatcgcatgtaaggttttaaattggaatttatcactttagttctttttttcattacagttccctttcaagagaaaatgatttcttcaaatcattccaaggaaatagctagcagaattaacatataggataaaacaaggatatattcagatagtgcaaaccaacatttctatgaaacacgatgtcatgtgggaattgcagtatgcgcgaagctgcaacaggaagtcagtgacaaaaacatggtaaggaatagtaatgtcagtctttgagtttttctgtaacacctgcctcatacatctgcacgggtgttgaggatgatgaactttcttgttcgttccttatcatgttgcgcgtctccctatatgttccacctgcacgagattcttgtatggtctgcaggagaatggttagttcatggcagttgtacaaatgataccccgtacttggcaacgggattttatttgtacaaccgggaaaaaagtatatcaaagatccatctgctccatgcttcaaaatatgcccttgcactagataagcctcatcaatacgcggacgagcggctgagataaaagcaatttggtcgctaacgaccccaagcccttttgctatccgagtaatcagagaagtgcactcaacaggagcagagaactttatactttctaaccattgccttatcatacatttcacaggagaaattttgatttttctaaccatggcaaacatgataattaattcatctcccctaatgggtctcatatcacttctaggaaa

SEQ ID NO: 68897 - DNA, 5436 bp, Oryza sativa
aaaccaagaagtgtacttaagcctttccatgtaagtgtgtactccttatggaaaaaacgaaaggaaatttcatcttctatttctttcatagtgcacagaaattgcaaagtaagcaaacgagaaccaagctcatctaccacaataaatctctgccaaccaaccgctttccaaatagaacgaaattcaacttcaatacctatctttttcagcagctccggtgagtattctcgcgtgtgagcatactcccggtcgctcagcatgtagtaggcttgtctcttccgatcactgacaaggtcgaggtcggtgtcgttcaggagtcgtcgcggagcttcggcgtcttccatcaaaacatctgctgatgaatgagtactagactcgtcatgacgacttgatgaagagccggaccccttgaacagacgagacagtcgcctcctcattctgcacaatggagcaagaacggagtaactcggcgggggttagagatgacaagaatttcacacgccggttagtttcaccaaagcaacttgtatacatgcaactaaatattttaatttgagggaaacaatcaaaacttgaatgaacttgagagcaaactttggagagggaatgaaaatgtgttgaaatggggtggagttccctctcccggctggctggcttttatagggtacccataacagtcagaaatgacatgtgggacccactagccgttaccttgccaaaagtagcaggtaaccgttgcctggccggttgttcggccgaacccctggtgggcccaaccggccccactttcggccgttggattccaatgatcagtgtggtcttggcatagcgaatattcgttgaaaattttatttcggtttgctctaaaagattcatttgaagaatttcctcaaaattcaaaaatcctaaatgcaattttgaagttcaaatatatgatgatgcaaaaattcaaattgttgaaagcaaatatgcggatacataccaatttacctgttggcgaaggtcgcgtcatttaaagtccgacttgcgagaccgtacctccttctgaatcagttagcggattttccacccgtctccggaggtgatggagtgggcgtctttggcttcttcctccacaccttctttggttttggtgcggatggcggcttcttctgagccggctgctctagtttcttggccagtatgggtggttctaccggcatcttccaataacggttcttaggcatagttgtttccttctccatgaaattctgcataaatttcaccaggctgtccattttgggtggctccacttcgacctcttggatattctgtgggttcggcccatactttattctgaccatggagtattgttccgtcctcggttgaaactcaaacttctcttccttgccgttgacgtggaacgggcgccccaggatgagcggcgtctcttttcccgtgtccatgtccagcaccacgaagtcaaccgggataaagaaatcccgtgtcttgactgacacatcctccgctatccctgccgggtaacggactgacgaatcagccagttgaaggcgcatcggtgttggtgccaacactgtgaagttgagtctatcgaagacgtctttcggcatgatgctgacactggctcccaggtcgtataaggcctggtcgaattgttgtgccccgatctagcaagtgatcgtaggacacccctgatttttcttcttctccgggagcttgtggagtatcacgttgctgcattgcttgaccacctctgttgttgggagcggtctcttgttgttgactatgtccttgagataacgggtgtatgttggtacttgcatagcatccaacaacgacacgttgatatggatcttctggattacttcaacaaaacgagcgaattgctcgtccactgacggtttcctacaccgttggggaaacggcagcaaccgtgtgtcgcagtattcctgcggcacggtcttctctggctgaacctctttgtcagccgagtcactagatggcgcttgttttgatatcccgttagttcctacagggttaggatatagcggatcacgagtggacttacatcctctcgtcgtgatcgccttgactttacctcctcacgagtcgggtcgccccagaatcctcccagtttcatttgcagggtttaaggatgccaactgagctagctgggtttctatcattttattgaagctcagctggttttgaaaagcagaagcgaagccatctaacttgacattaatgttttctaggatcttatcattggccgcaagctttttgcttaatgcatcggtggttttagcttgcgcaaaaacgagatccttcaaggagggctgttagaaaaattaccgttgttgttacctccttgataatataggcgtggttggttccacccctaacctccttgtgaacgatacccattgttgttgcccatgtacatcgcctcctcacgggtttccgggtagtcattcccagaatgacctgtgttgccgcagacctcacatgtgacgtgagagtccaaggccttgacggtgccttgtggccgtttctcgtggtcgtccaagcatttcatgaggaggtccagcttggcagcaagtaactccgactccttgacggtgtgcatgcctcgctgacgcatctgaagtcgttcctcgttccaacccatattggagaccatcttctctattagttcaacggctccttgaaccattttagagaagaaggctcctccagctgccgcgtcgaggtgatagcgggacatcggggtgagtccattgtaaaagttctgcaggatcagctagtcgtccatcccatgatgaggacaggcggccacttactcctgtagacgctcccatgcttcaagaatagactcatctcttgtctgctggaaactggaaatccttccatgaagggcattggttttgcccatcgggaagaatttcgagagaaatgccctagagcatttgtcccaggtgttgacagcagcacggttggcatagaaccactgcttcgctctctcaagaagggagaacagaaatagtcgtagcctgatggtgtcgggactgacgcccttgatggtgtacatgctacagatcttcaggaactgttgcagatgagcattggcatcctcattaggcttgccacaaaacgggctagcctgcgccatcgtgatgaggctagagttcaagtcgaaatccacgtcgcctatgttcacctgtggcccaatgaccacattgtcagcagagggagcagcgaactcgtggagagtcttgttagccatagtcttgaacgtcggtggcgctggtacggttggtttctttgtcggtagagttttctgcggagcaactacttgaggcctgacgctccggaagaaagcgtcagaaatgcttgttggtatttcttaacgacattactagaaatataatccccggcaacggcgccagaaatgcttgttggtatttcttaacgacattactagaaatataattcccagtaatggcgtagaaatacttctggtatattatggttacagagttcatccgcaagcgcacggatataccattgtagcatttcacccgagagtattccaagggtatcgtatttattttatcccgtgggaatatcatgtagagagaacattgactaataatttatatatgactggtgataatcatattctaagcaggggttaagataatccaagggtagagtgacacacaagcgttaactactcattctcatactttataatctaagctaagtggaaagaaaataggaagaaaatctattcctatacttctaatatacatagtatacatacattctagttaaccgacattctatccgatgccctcctggtacttcgagaagccacccctgactgccgagttccttacgacagcccgtcatgaccatacaatcggggctaaatacgaaggaataccctccccatggaattaacttaggattatataccggcgcggaggaatacccgtactgagctgtcaccatcagtggcccacctctcatccgcaatatataaccccaaataatgatatcccgtaatctagacaatacgtctaaactaccagatactactctaatatcatcgttatgacatagagtaattgcataagcaaacattatatccacaccaaagcatctcccagataagctagccgtatatttagtataacatgaacataatgtaaagtaggtgctcatattctcggaaagtatttcaataccataaatgtatttagaagagtattctaataaaagtacaaagcttacaaaagagaagagaaaagctaatagaaacatacccaaactcttccgaaggcttccgaactcctgatttctactctattcctattccaccagctagatagtactaaactaaacttgagacaaatgagagagctattgcttgaggtgtgtgagtgaagtgagaaggtgatgtccttttataggcaccatccggaatctgaatttcttcattctcaacggatggcggctcgggaactttttcatcaatcgagtcggtggaagtggaaggttcagattgtgactcgattgttgaaggttcctctattatggacacggatgcctctagctggggttcatcgcattgcgtcatgatggaagtattttctagaatgcgatctagaattacttttccttctgacggtgttttatgcatgaatgatcctccagcaattatatccagataaaatgcagactccttatccagacctgtataaaatgttgcaaaagcacatactcgggtaaggacatggttggtccggactgcactaaattagtgaatctggaccaggctgcaccgattgattcgctttcaatctgccggaaactgagaatttcttctcgaagggcagtaatacgagtatctgggaagaaggcaagacaaaatttgtctcgcagcttttcccaactactgtttacacatccaatggtagaggtgtaccattgcttcgctctgtcttgaagggagaacggaaacaatttccactgtacggtttcttgcttcatgccacgaatcttaaggcatgagcagacttagcttaaagtcccacatatgatggttgtggttttctagatcaaggctagaaaaagttttttcactaaccatacgattagttcggagcgaatttcatagctagttgtataaattggctccgatgaaggaggtgtaaattggctccgatgaaggaggtggttcatagaattcgctcttaggagcagacagctcgaaaagagattgctccatggtcgagaagaatttaaaaggaatacttctctggatagcaagggtaaaggtagaataaaaaaaatgaaaagagatacgaggatgaactgggttcgaaaatgataagcaacaattccccggcaatggtgccagatattcttgtt

SEQ ID NO: 68898 - DNA, 1408 bp, Oryza sativa
aatcatgcacaaaaaaaatcaggtccagagatggatagcaccagtagctataccgtgttactctaaaatacagaataaaataattttatctcctggatgtaaatctatatttttgtttcataacaccacatttttcacaattacaaagagggtcgcctcaagcaatcgaaacatcaatggtcactacatgcatcgctagaaagaacatcatcttgatgtaaactgctggacctgaatagattggcctctctaacagcaccaggatcagctccaacatcatcttaagctagaaataacttcgatttctgaaagctcaggaagacattagcatgaggcatgtttgcatggttccaactcctaaactcctgagaaaccaaatgccttaaaaaaatttctcctttagccacatcaaaaatctttcaagcaaattacgtccaaataaaaagaagtaacagaaccggccatagaatttatgcattgcatcattattagtaattacaaagtcatcagcacacttcaatattcaaaatgccagagaaaacacatctttactggattcatccaatagcactttttcatggatattatgaagctatcgtttcattgtctggagctccaaaattggttggtgcatacaaaggagatactccacttaatatcaagcaattgacaaaattaacatattttcaaaattatggcacctcacaaaagggaaaattgaccttctgctgcagcctacataacacatatcagcagcacaacaattgcagttcaaagagtctacactgatgaataaaaattgatttggttgatagaaagaaccacccaagtactcaatacaaatagaaaattgcaataattgttcagtatttacagcgaaacctaaatctacaggaaataacagcctcaatctgccatggagaaacttttccaatatatttccactaagttaggcactcaggctagcaaaatgaatacaagattccaactaatcaatttctgaaataacatggtgtctagaaatgctaatcctaattttagtgctgttctacttaccctggagagatcttggtcgatgtcaacgattatcatgaccatgttggtggatggggacaaggctctttgaggcggcttcctcctttcattggcaatgcaaaaacagttctgcaccctccaaatcctactctgagtgggcctcacaccgccggcggaattccattagtatataatataattcaatctgcattcaacaaagaccaagagggattgagccctcccaagtatttgcaataaaaatggaagataactgcatgaataattgtcactctaatatcaatttacaagttcacattatacctctttgtcgacaaggccgaggaactcttgatgctccttgctaacagactgc

SEQ ID NO: 68899 - DNA, 12090 bp, Oryza sativa
  unsure (1)..(12090): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacaccttatattctgcttctgctactagaaagtagaaatatttccatttctcaaaacagctaaatgaaaaaacaatatgaacatttcgctgtgaagggaagtaaaacgaacaatccttttagcatatgaagtggagtagagcaccatggagttgtccatttagattagataagctgtctaacaggccttgtgtagaaaggacttccattaattattttggtctccctagctaatttgtgctttacatagagtcaaagattgcaattcaagtaaacatcattctaagcaagataaacaaaaaaaagagttgttctccatcactttcatgcattttcctgttaaatttaagctcatgtgtatatattaagatggttaacgtgtcaatcagatagcggttaattttatgctccacttcaaaacaaaacacatgtgttcttaggaggaaaatgcatcaccctacaggtctacaaagaaggtttgtgatcagctggaactctctaatcattgttataaaaaagaagaaagaaatccactttacatctcaaactttcactatgttttttcagttggtacttcctttaccggtgaaaatattggcggatggcaaaaacagtatagcaacgagctcaatcccttctttaatgcaatgatacgcagcttacctatgtgtttgagaaaaaaaaattagctcaagtaaggcactggaagaggcaatcaactgaaagaagtagaattgacagttcacatgaagaaaccagaattggtccaaaggttcatgtaaattcgcccctaaactgtcttaaatttggcccaaaactgcgcttaaattcaggctgcaaatgctattaattcagcccataagtgttgttaaatttagcccagaagtagaaatatacttcgcctaaaagtttgggtcaatatgcccaaaaattgcgagtagaatggcccaaagagttggcgtaaaataaacctaggggttcgtatcaattaggcccaaaagttgaacgtaaattaggcccaaataggagatgtttggaccaaaacatctggtaaattcagcctgaaggttaacatacagtcgggctacatctgggcgtaaattgggccctcaagttttaattaaatttggcctaaatgcaaccctaaattcagccaaatagtgagctaaatttcggcccgaaaattaagaccatagtatgcctaattttgttctaaatatgcaggtgaattttgctcagaatcgcgcgtaaatttgggctaattcggtccaaacgtattcattggcggcttcgccttcacctctaccggccggtgcgccattgattctccaccccttctctgcttctcctgttctccagtcctcctcttggttggtaatttgatggcacaagcgcaagtgcgcaacaccatcacaaactcactattacagaaacgattttttttcgaacgagtgtcccttaaggttgcaaggtactctttcatctgtgttcccgccaattcatgtacaagggaaagcagattcgacatcccctgcaattatacagcttttgcggtttcagctcatgcattaattgtgtgtagtattaattttctttctcatgggcataatacgatcgaaatgtagcaggtcagcatgtggcacgtacattttcaaaagcagttttaatggattggttgctacctgcagggcaagtatgtagatggttgcttctctttatgctcatctagctatatgttaagatcacctcttcattcttcaccacctcatgatgatgaaggaaatactcatggttgcaagagttatacacttgtggggttggagttagttgttggaaaaggacagacaactgagctgaaatcaagcagcaaatgcttatctttcgaagccaaatgtcaactggattatgtttcctggaaagattaatttgcaccacattagcaaagtattgttggacattcttctatcagggacacaattctgagcaaggactataagtctgtggaactatgcttcttactgaacgagatcatatatggatttgagtacacagtttcgactaaggacccttgcactttgaaaattccaagcaaaagatgtctatccaaattactgttcccagagttggatttcaaatccattttcagattccattaaagaaactaaatccatatgctgacatgctgttgtgtgtaccccgcatgaatgaatttctgttgttatgcagttttagtgtaatatgtggtttggtttgtgtagttctttgagtccatatatatgtatatagttggatgctatttttttccctattattttcctatgcgtggacaacccatgttcatattctgtcagtttccagatcacttttgtgcaaacttcacaatcttgatgtattggtaccatctctcacagtctctatgtcgtatgtgcgacaataaaatttcttgtgtcatatctgtggatggaagtatctataatggacataagagtatagtttctctatacgttttctctactaacaattaatagcatatgaatgaagaccattccttcctgtactgccttggaaaatcctttaagaaaaagcaaagcaagtctctcttctttatgtgtagtatttgattaactagcaccatgcccaagacactatatatatactcccttgcagggaaagttgtagattgtcctgatcagggccctgtttggaagattagctcaaggctaattttgagagctaatgtttagtcataaattggtaggctaaacattagcctagggtggtatgtttggatccatggactaattcaaggctaaaaggtggagagagagtagaaagagaggagagagaaggagagaaagagctgtttttttatggtccccacacaaaattagccccattagcaccccttggaggggctaatgttttgaagggggctaattcacattagctcaaaattagcccacctatttggatccttgagggctaatttgaggctaaaagatgagggctaaacattagcccatggaatcaaacagggcccagctatggtatgcaagaaatctcaaccaaatgttctccaaatgttcatggtcattcattgtaggcattatgcagagagtaggcttggaagacacccggaatggaagttacaccacctgtttggctgtgctgactggatggttatatatggcctaagcgtcttgtctaggattaacagggagtgtcccgaccattcctgtggctgcggaagacagtattctacggtggtattagtgaaatgaagtgagggagaaaggaagacgataggtttcagcagtaattgattatagatctatacttggggaagctgaagaaccgatcgattgggctctatacggaagctgaagaactcattctgagatgatgtattttagagtattatttatggcaaaatagtgatgatacaatttgtattaaaaaatatacccctaattgtagttaattcgggtttactaatagcagtctcattccaatagttgtttattaaaagtgcacaaacggttgtttctttatagtatgatcgattaatgcgatgtacacaacagtattgctaattcgtgtgcgcgccccagcaacatcatctgcgcttcctcccccacgccttttttcccgttgtttcccttttttttcccgcttttttccgattatttatttaatcttttagcacacgtgttttttcaaatattttgagttgaaagtttttaaattttaacttgaaaatttctaaatcttaacttaaaaattttcaaatttggacttgaaagttttcaaatccgagtagaaagttttcaaatcttgagttaaaagatttcaaatctgagttgaaagttttcaaatctcgagttgaaagttttcaaatatgggttgaaaattttcaaatttgagatgaaaaattgaaagttttcaaaatttgacttaaaaaattcaaatttcgatttaaacgttttcatatatgggtttaaaattttcaaaatttggcttcagatatagattttattttcaatttgttagttaaaaaaatctcacgggaagaataaagtcttatctactaccgtcattatctcatgctgtcgttatctaagactaatactagtctaaccaccttatcccagcaaaaacgcgcgttggcagcgcatacgcgccaactagcgatcccccgtacacaatcaactcacaatgtccttgctatgcttatgttgtaaaaaaaaacaaccatctctaggctctgagatgatctagtgcggcatgagtccaaaccactggatccgaatgtgccagccattgttgcctgatctagcattcctaggtgatctcatttctatctctggcctctcttcttttacaatgcaactaggaaggtagcccgcgtattcgcgcgggtatggacggtagactatgtttgaaaacttataaaggtgaaattttaattggaacttataaaagatcattttgtttatttggattatttgagcatatttagaaaaaaatattaagtaattggaatattttctctaattaaagacactcgatttttattgcatcggctcaaactattcttatttacgtagtgtacgtttaatttagctatacatgtttcaaaacatgtcatggtgcgactccatgttattgaattatttcttttccttttggcaaattaaatatgaatttttttcagatactattgatttaatttagctatgcatgtttgtagaatttttcataatgatatataatgtcactttcttttcataattttttcaagccaaataatagtctacaggtgtattaatttctaatttgtgattaattctaattcgtgattttaatcataagtaacataatgacacaaatagaacgtataatttggtccaatagaaaaaataacttccttaaaagagaaatagagaggaggtatgtacgtttgtatggtttgcacgcacgctgcttgcattggaagaggggacatctaaagaatgagaaaaaatcgatctaatccaatgactggacctattaattttagtgaaatcaaaggctagtagttatttttctcggattttctaagattttctctaatttattggagtgccacatggtgttatcggagcatttatatgagtgtcatgtggtggcttaggagcgtttatagaaatttttatggacttttactatataataatagaatgattggatatcgtcgaaatatatttgtagaattatttaagttgacatataatatatgttatcaacttttttaaataaaagaatagaataacatatatcttgaattaaataagatatgttactattaaaattgaaattaggaaagggaaggggagatgaggggagacagggagtacgtacaggaggagaacgtagaggagctccggaggggaacgtagaggaggtggggaccggtgtggagaggaggattttattttttttatttgatctaatggttggtaatattgggcctaccaatttaaaggaaaatcaacggttagatttagactgccacttggcaacttaggagcgtttgtaggaagtttaatggacttttagtattgtcgacgggggatacgctggtacaaggatctacgtaatacgacatcaagcagacagaaaacagagattatactggttcaggccccttgataggtaatagccctaatccagttgatatgggattatatgatggaaatcatagattacaaagggaacagtggaattcgatggtaccggcgagatcgtaatcgagctggttcgactagatctcccggcgacttggctcctgtagactccgacttcgtaggctgtggtggatgtgttggctatgagattcgatgccttaggtcctctcggggggtcccttttatatcgcaggtcaggcggtttccaagtagaactcggagacatcagaccctgcacgatacagtgacgacccagtcctgtccgagtaggactccttccatctatgaactccgtgatgaatttccttaatgtatgtagaaaacgtccgtatacgcgcaggtataccgtaccgatatgtgacgtatatcgaagggtagagggtataccttacccgtaaccctgacagtagccccttacttctgcttaaatgaactcgtgtaaccgatcacgacttctgatgtcgaggttgttgtcgttctcggtgtgaggaccgtagatatagggagtaatcgacaacaccatgtgaagctcaacggtcatgagtgaatttaaattgaagtccgaaaaactgccgcgcgtaacggaccaagaaatttccggcgaccatctctctcctttccttggaattcgcaccatcggaaatgcgtctatttaaggggattttggggatccattttgaagtctgcctgttgtaaaaaaactcttcagcctccaagcgttcttcgttttctccggctccgcacaaaccctagtctgcttatctcggtctcttctccggcgatctccggcggcaatggacctcgacaagtccacttccactagtgcgtccctgaagaagttgcaagaggagggcgctctcctcggtcgcgggaccatggagagggaaccaggaggtactgaacctgaacctgttctaggccgtatggttgcggttgaggactatattctctgtggtattctcccccggccttctgagtttctcctgctcgttttgaatttctacggtctttctttgctccatttgaaccccaattccatcgccttcctcagtatcttttcgcatctttgtgaggcctacattggggtagagccgtttctcgacctctttcgcttctactacgagttgcgtcggatagaatccaccagggtatctggatgcgttggtttccgactttgggatggcctgaagttgcgctatatccccttccagtgcccttcttctcgtagcaagtggcaggcgaggtggttctatcttcagatagaggattcagatccaatctttgttgttcctgaggaacaaccagacaagattccgtcttggaccgccaaacccgtcttgaccccttctcttcagtccttcattgatgccatcgatgacctccgagtacggggtttgtcggggtatgaagtcgctgccgacttcattggtaggcggatccagccactccaggctcgagcccacccagcctttgactattctgggccggaggacgcgacccgggtttctcctcggggtatttttcttgtatttaatttgacttccttatgtgcatgtttctcctgacttaccgaattctggttctcggtctacaggtatgaacagcgaaaccgtggagcgtcgcgtcggccaattgatgatcagtggcctgacaacggcgagcaatgtccccgtccccctttgcgagaaggagaaggctgagcgtgaagttgcaatcaacgtgagtgtattcgacgacccttttatttttgctcctggatcgcataatgacttcatgcggtgcaggctctcctctgaccgacgtcattggactgctcgtggaccaccaggcggcggcctcgttgaaggagggcgtctcccaggaggcatctgacatggccattgctgctgctgccacgaccagtggcagccatgtcccgaggaaggggaggaaattcacctccgtgctcggcagccgtcgaaaagcatcctccccatcggtaagtctcttgggttgttaattacgtagtcgaaggtgtcaccctcacgttgtactcggtttacttaggccttggatgcgtctccgccacctccacgacgacagaggctggtgacacttagcgagaagtaagtggacgaaatttgaggtccttcccttgattgaattctggcgacttgtcttgagggccagtcatggtaatcttttgtaggtcggcgcgggcgaaggcggcgcaagacgggtccggcgggaactccagcgcgtctcctgcggtggcctcgacagatgtcgtggtcgtgcctaggagccgtgaggtgacgcccagcggccctgttagcgatcttgtgcccgttcgaggcccgcctgctgacgtcctcacctggggggagctccatgtcgagatggggcgcatcctcgaggccggtgctcgcggcataagtcgcgagattgcggaggcgagggtggcggcgtcgtcggcaaacgagcgtgccgacaagctggtgcatgacctggcggaggttcgtgaggacctccagaaaatgagggaactagtggccggcaatgagcgacaacagcggggactcgagaaccgcatgtcggaactcgagaacaacctgtcagagatccgtggctcgttgcgggtcacctacaccggcctgcaccaactcgccggggaatgtggtgttgcgaccaccatcccggtgaaccccgacgagttctcgctgatgacttcgctcacagaactggccacggcgatggaggcgataccctccaagcatgcggccaggattggggaggagatgtccaacgggatttacaccggggtgtgtcacgtcctcgcgtgcgtaaggttggcgcaccctgaacttgatctccagcggatcttggattagggagcgaccaacgacgcgcgtaagggcgtgatggaagaagttggcgatctgggagagtctgttctcccactttttgaagagtaggacttcagttcccttgtactctctaatcagtcatgctttgtaaaacttttgttggctccaactgcctttgtgtgtgtagtcatcaccttaattttctttagcattttgatcccgagtactttgtttgtcgtttgtagagatgtcgatgtcgaggatgtccagcagcgcgggcaacctgagttgccagtgatcgttccggcacttgcgttcgagccacatgtgtcgcaggacgatgtagatcaaaatttgcccgtggaaacgggcatggcgacgacttccttaggttggtcatctttgttttcatctcctttactcttccgtctggattgacttgatttgctgtgttctcgaaagagaagagcagcttgacttagtcgtttccatgctgagcagatcttgagagtgcgcttgctgaccaagatcgtcgcatccaatattggaagacgaaatttgaggtagcggaactcaagaggactatgctagatgtgaagaaggagcaggccatggaaacactccggggtcgcgaggtatggttcaactcgtacctgaagagttgatgcacgtccatgacaagagtctgtagggagctccgagtaccccgtggggatcccgaggagtcggcggccggatacatctcgtggctgaatggggcctgcacccagctcgaaggcatcggcaagcgtattgatgaggctcttaagcaggagtgccgtcgatcgagccgatatgccggatggcatgtattggcttgcatacgagatcatcgcccgcagctacacctcgagtttctccacgaagggttttctcgttcttggagaactcggacggagatagatcacctggcaaagtcaatggcgccgctggcagagaaggtgttccagtctatggactggcgttggccttcctggtagtctctgttccctgtgacaaatatcttagggaaaagtgtaataggatttttacggaattgtaggaagtacttgtgaaatagaaaagaaaactatcttaactaagctttcttactctggacgtagtgtgtaagagtgtcttctcacttcgcgactccaatcagtcgtttgagttatacactctccctagcccccagccttgtcatcggagaattcttctcggaagataaggctcttggacctttgacctgcctcggttgaacaagcactgatcctagcccccagctgtgaagttggaaaattaatttccgattacacggcttggttaatacacacggtgagaactcttacacgaccagatcttacatggtctttcgtctctacaggatccgacaaggccttatcggctctgggcgtccccagctgaagatcccttaggttcctcggaggccttgtcaagacggcgtaacgggacatgaggataggtttcaacgctaggtgtcatctgggttagggaacattgggaaggaacactttgattgtaatctgtacatgaaaataggctttattgaaactgtaagatgtcttgcaagtatggatactattgacttatacatagaatttacgtaattaatcaatgttccaggaatttgccaactcgccaccgtcgccgtctgcaattttgaatgcgcctggccgcaagacttttgtgatcgtgtacggtccttcccatttgggtgagagcttgtttcgccctgcttggctttgaacccatcggaggacgtagtcgccgatcgaaagcgtgcgtgctcagatgtgcttttcgtggtaacggcgaagggcctgttggtagctggctgctcggacggcaactcgttcgcgatgttcctcgagtagattcacatcgtcgtttcgctgctcctcctgatcctcatcggaatacttctgtactcgtgtactttgatgtcttagctcggtggagagcacggcctctgagccgtacacgaggaagaagggtgtttccttgttatacgttgtcggtgtggtacgcactgcccatagtactgatgggagttcttcgacccacttcttgtcatgtgacatgagcctgtcgtagacgcgggtcttgattccttgtagtactatgccgtttgccctctcgacctgtccgttgctttgagggtgagaaactgaggcgaagcagatcttgactctcagcccgatacagtaatcctggaagtcggcgctgatgaactgggagccgttgtcggttatgatgcggtgtggcagtccatatctgcaaaatatccctttgatgaatttgatggcgttgtcggccttgatttcccccgtcggtgtcgcttcgatccacttagtgaatttgtcgatcgccacgaataggaacctgtagccgccctgtcctcgtgggaatggtccgagcatgtcaagcccccagcacgagaatggccaagtaagagggatagtctggagcgcttgcgctagtagctttgtgtgtttactgtgaaattgacaggctttacaccgctgaaccatgtcgcaagcgtctttgagggcggttggccagaaaaaaccttgtcggaaagctttttcgaccaatgtgcgaccggctgcatgtgatccgcagatcccttcatgtatgtcgaggaggagatgtctgccgtcgtcggacgagacgcatttaagaagtaccccgtttggcgctttcttgtatagatcgttgtcgatcatatagtagatttttgctttacgggttattttctcggcttctgcgtcgtcctcgggcaactcttcgctgcctatgaatttaatctgtggggtgcgctagtcgtctgtggtcttgatatcggcaacggcgcgctctgcctctgtagcccccgagctgatgttggggacgactgggctatcttcgccgcttgcctccttcactaatggctttgtcaggacgtctagaaaagtgccgggttcgagtggttctcgtctggacgcacgctgtgctagattatccggctcgatgttgtccttccggtatacgtgtcggaccttgatcccatcgaaccttttttccagcttcctaacctctgcgagatacttggataactcggggttagagcacttgtaatctttgtgcacctgcttcgcgactagttcggaatcccctttcacgaccagtt

SEQ ID NO: 68900 - DNA, 6179 bp, Oryza sativa
tttcgcaatatggccgacaacgtctttgtttctcacgacttcgccgagagggaaggaggagacaactgtgaccctgtgggcttggaagtagtggcgtagctttcgtgatgtcatgattaccgcgtagagcagtttttggatctgtggatatcgtgtctttgcgtcgtagagagcttcgctgacgtagtagactggccattgcaccttctctctctcgacaacaatgacagtgctaacggaatatggcgtggcggcaatatagagaaataattcttcattaggttggggagcaacaagtacagggggatttgctaggtagcgcttgagtgcaatgaatgcctcttcggcttcctgtgtccatacaaatttgtcttgcttcttcagcagagcgaagaatggttgtcctcgctctcccatcctagcgacgaacctgcttagtgccgccatgcttccggttagcttctgtacttccttgagtcttgtgggcgacttcatgttgttgattgccttgatcttctcgggatttgcttctattcctctgccagagacgaggaaaccgagcagcttgcccaatggtactccgaacgtgcacttctctggattgagcatgaggcgatatcttcggaggctgtcgaacgtttcccgcagattgtcaatcaatgagtcgcttgtcttggtcttgacaacaatgtcatcgacgtaggcctcgacattgtttccaagttggtcgctaattgagccctggaccgtgcgctggaaggtgtttcctgcggttatcagtccgaacggcatcttaacgtagcagaataccccgaacggcgtgatgaatgctgtcttctcctcatcctctttcaccatgctgatttggtggtagccggagtaagcgtcgagaaagctcaacaactcacaaccggctgttgagtccaccagttggtctattcgaggaagggggaagtgatccttgggacacgccttgttgaggtcggtgaaatcgacgcacattctccatttcccgttggccttccacaccatgactagattggctagccactctggatggagtacctctctgatgaaaccagctttgagaagtttgttgagctcttctcgtatggcttgttttcaatctggtgcaaatctccgcagtttttgctttattggcttggcgtcgggtcgcaccatgagtttgtgctcaatcacctcccaagggacccccggcatgtcggacggctgccaagcgaacacgttagcattgtcgcggaggaaggtgatgagcgtgagttcctattctcgcctagtgatgccccgatcttgacggtcttgtcggggttggcactggagagtggaacgatcttgattgcgccgtccggtttcggcgtcttgtttggtttgctcactttcttgggtggctcagctgtggcgggtgggctgggcgtgtgctcgaccatgtcgaggctccgcttgtcgcattgcactgctagcttagcgttcccttgaatagtgattgttcccttcggtcctggcatcttgaggacttgatacgcgtagtgagatgtggccatgaacttcgcgagtgcagttctcccaatgatggcattgtatgctgtatcgaattcagcgacatcaaaggtgatctgctccgttcggaagttatttgcttggccgaaagtcacaggcaacgtaattttgtccaatggtttggacgatgactggggagtgattctattgaagggttgatcggtgggatctccatcgcttcgtgggatccccatcgcgtccaaagtgctggcgaagagaagtttgattgagctgccgccgtcaatcagaactcacgcggcattgatattccgaatagtgggttcgaccacgatcggatatcgccctgggatgacggcagtcttgggatggtcttcttctgagaattctatcttctgttgagaccacttcatcttgggtgcagccccctgccacgtcgaacagacttcacgttccactttcttgtattctcgctttgaggagtacgccgtggaacctccgaagatgtgcgagacatggagatcggagtctgggtatgctgagtccgattcctgagtagccgcctcagtgtccttctcgaccacacgtactcgcttgcctttttccgatgccatgtgttttgcgagcgactttttgaagacgaggcaaacttccagagagtgtctgtccgacttgtgtatagggcaccatgctttcttcgcgtcgctaccttgtgggtctgggcgcttgggagggtccgcgtattctgctgcaagaacttccgcttgagctttccttttcccattcttgcgattgttcttcttgcttgactcaggtgcgtccttggctggtttcttctctcctctggtcttcggcttgttgttcttgcgtctcaatgcatcgtccgcgtgggcgcatcaatcgacaatctcgaataatctccgagtagtcgtgatgcgcctcgttgccaactcctaggtagtatagcgatctctgacaccggacttgaaagctcggattgcagaagcgtcggtgatttcggggattgtatttctacactcattaaagcgctgaacataatccctcaaggattcacccgggttctgtgtcaacgcatgaaggtcatcttcgatcgcgtggcgcttgtaagttccttggaagttggcgacgaactgctgccacaggtctgcccacgaagaaatcgagtagggcgggagatgcatcagccatgaacgcgtagagcctttcaatgcagttggcaaataattcaccaacgcgttgtcgtctgctccggcagcgtagagtaccatggagtagacctgaaggaattcttctgggtcggtactcccatcgtacttctctattgctcctggtcggaatctctcaggccatcggacatcgcgcagcgaacgactgaaagctctacacccagcgcagggggcggtgggttgtcggcgatcgtacatcctccgtggatgtctatctgattataaggatgaggaagatgatgacgatgacgatgggtcacctggttccggtgtacgattacgaggacgtcggccgggttctcgagaatcctgtcgtcgccccccgttgttgtcccggcgctgatctccatcgttgtcgtcattatggtggcgtcctcgactagcatggcccggcacccgccgttcacgatcgttttgatcgtggtggttgtggcggttatcgcggtcttcgtcttcgctcgagcggcctcctcgttcttcgttattgtgacgtcgtgaagagacgcgatgtcgggaacggttcctgttgtgtcgtgcacgtcgcgcctctcggcggccattcaggtgatcgcggagatcgccggtgccgcgaggtggaggggtggctcgatgaggcgattcccgctgttcagggttttcgccattagcaccaccagttggtggctgttccgggtgcgctgcagcggcggcctcttcgaacgcgttgctgaggttggtcactgattcccgtagccgttctgtccaccgtgcgagatcgtcgttcagaatgggatcgtagagggtttccctcagtattgcgttgacggccctgatgtgctgggctggtgtagtcacttgattttccgcttccgcattagcgcgcgctgacgtgctggtcccgtcgatagccaatacctcgcgtggcgtacttgttgacgatgagccatagtcttcgagcaagtgtagaactgacggctcgtgaggatcgatgtcgattaccccaacgaatcgatccgagatcagtgtcgctccttgttccttgtctgcatctctaagagagatacgtgactgctggaccttaggaggcggcgtcttcgtggcgctgagaaagaccttgcagcttcagaggtcgtgattctttgtcttgtgaataggacaatagataacacgagttggagaagtacgctgaattccacgctctttgcaggcacgaatttcggcgtgtacgttgtgaaaaacccagcaggcttgcaaggtgtgttttctggttttatggataggacaccaggaccttgtcacctcggaagttatcctcgtcgggccgtgattcttgtcgaaaagacaaggtttggccgcactaggatccttcttgggctcggatatcgtcgacgttccgttctccgcttcggcgggaggatccttcgacatggagtcgtcctgggttgaagccactgcgttctcgcttccgatcattgatggaccagccgagatcggcaccgtggtgtaaaccgggaagacgatttcgccgacttgagtccacaccagcattgttgaagcaggaactccttggttgaggttggtgttgactctgttgtcgacgaagctggatgacatagtagtagaaccttgagtaccaagttcccctacctggcatgccactatcgacaggggatacccgtagaccggatatagagggtattagggtacgctggtacgaggatctacgtaatacgacatcaagcagacagaaaacagagattatactggttcaggccccttgataggtaatagccctaatccagttgatatgggattatatgatggaaatcacagattacaaagggaacagtggaactcgatggtaccggcgagatcataatcgagctggttcgactagatctcccggcgacttggctcctgtagactccgacttcgtaggctgtggtggatgtgttggctatgagattcgatgccttaagtcttttcggggggtcccttttatatcgtaggtcaggcggtttccaagtagaactcggagacatcggaccctgcacgatacagtgacgacccagtcctgtccgagtaggactccttccatctgtgaactccgtgatgaatttccttaatgtatgtagaaaacgtccgtatacacgcaggtataccataccgatatgtgacgtatatcgaaaggtagagggtataccatacccgtaaccctgacaagtatataataggaaaatcaacggttagatttagactgccacttggcaacttaggaacgtttgtaagaggagaccgtggggttaagaatgtttgtaggaagtttaatagatttttagtatataatagatagatagatagataccaagacaccatgtaatgacagtcattgataaatcagttcgttgtgtcaccttacccccactgcattgcagttgaatcttctaggatgtgtgtggatgctagaatattcaaatataccataataaagttacttctgatttatcttttgttggtgttcattagtttgtacttacttaatcttattttacagtgtatttgtgaactaaccgttgtgagaacgattttgggcaattttttaataattgaccgaaatgatatttcattattaaaaaaaatacaaagccctgctttatttcaaaaattgtattgaacataaaaaattattccacaaaagttaggagatcaaaactaatccctaatacctgttatggtgtcaaccaaggattataaagaaaattaagccactacacctaaccactgagaggagatatataacaagataccggcccattgccatttgctagtctacatgatctgaccactgaggagctgatcacatagagtcacacatactagaccagacggatcaaacagatgacctgaggtattaggatggagtcatggaggagatcacagaagaagttaatgtggactatatatggaaggatgattattcccggtcacatcccttggttgaagaaacttttggccaaattcagacactgcatgctatattcagatggaagtaatttataatcttgacatgaagcaagtctagtttaattagttagtcacataaaacattgtcatttaaattattatctttgctttccaggtagcaaataatttatttaggcttgggagccatcaataagctaggcgttcagtagcatcaaggatattgaaggctaaggtctgccacaggccacagcctatgggacctgaggcctgaggttattgtgaaggtctcagtaaattcccttggtacttaacaaagtacaattgcttgctagtcttagcttgtgtaaggaccaatgtttccctagtgaaactgtttcccaaaagaaaaaaaaatcttgaagcatcatttattcaaaaatacacattttgcag

SEQ ID NO: 68901 - DNA, 2254 bp, Oryza sativa
atgccaactcaagccgtttgtggagattatggatatcccatacccacacggcatgtgtatccgactgggtatgtgatgccatgtatagatagaatatctttaaagggactcgggttaaattctaaacttgtatgacaaggaaatacccgggatcctagtcggctacaattgtatctaatctgtaactacctattccgttagggatatgggctttattttgtaatacggaccccttcccctatataaggaggggtccgggtgcctctaggggcacgattttgctcctagatcatacgatcaataatacactcggcggatcaatccccggacaggagtagggtattacttcttattaagaaggcctgaacctgtattaaattccttgtctctaaacccatccacttttccagcttgatagccacccccttttagtattgccgaaatcttgtttcgacagttggcgcgccaagtaggggtagcgtcaagttcttcgctgattagtgcgatgggtttcgtctccggcatcgacgacttcgtcttccctcccgggcaggcgttccggttcggcagcctcgacttcatcaccaacgacttcggcaagatttctctccttaacttggatccgaaccagtcggggagaggctaggtctccgccccgttcgatacccccgaactcggccgagttctaccccaagatcatctcgattgagtcggcttcaaaccactcggacgagatccaatctactccaacacgacctgatcaagacgatgggccctatccctcaatcctgatgaaactccccgatgatttggccactgtcttcaccaggagggtgtcttctccccgtaagcctagacgggatccagcttcggctccgatccagtctaactctagggaagtcggcatcatactccaacctctcgggacggtttcgatggaagaattagacagctacctcagctctcccggtgttgattctcgaccaacggagatcctcgagtacgacgacttcggctaccactatgactacagcaatttcgatgacttcgatgaaggctacgaagacaactacacgcctctcttcttcggcgtattcatggctgataacgagacggcagaatagcatcgagcccgagaagcggaagaagagcgcacatgacaagaagccgagcgtcaccgactggaggaaggacgacaagcacaagagcgagaacggctgcagcgtgaacaactggagcgcgagcgggctgcgaaggaggctgaggatcggcggcagcgtgccttggaagctggacgatgagcacgagagcttatcggacaacaagacgttgaaggaacggcggtttttgcacccccagcaaaacgcggtcgcagcgatcacccttctggaaactttgcttaaggaagatgtgcccgatcacgtcgtcaacatcttgaaccagaccaagaccatgatcgccgcctcggtcccagtgaactcctcaagcgtccgcacgccgactggcagccgagttccacctcttcgatcacaagactatcaccaaccaagcctcagcgttgtcggcgcaggatcaagccgcaggagcagggatcatggcgaacgatctgttcactcgcctcctgatcgacacagggagcatcgggctgcacagtctcgctctccacgtcacaggcgtcccgtcgatcttcgtgatactattaaccagcgttgtgcggcaagaggctacatcccccaccattcatcagatcgttacgacgacgacgtggatggagttgctgccttcacaagtgacctgcgtcgagtggattggccggccggcttcaaaccaactgggatcgagaagtacgacggcacgacaaatcctgagtcttggcttaccgtcaaaggcctcgcaattcgcgcagcaggaggagatagcaaagccatggctaattatctgcccgtggccttagcggactatgcccgatcttggcttcacgggctaccccgtggcatgatcgggttctgggcggagcttcgcgaccatttcatcgccaacttccagggtacttttgaatgccctggtacctagtttgatctttacaacgtcatccagaagtccggagaatcccttcgagattacatccgatgtttttctaagcaatgtaacaagatctcggacatcaccggcgacgttatcatcgccaccttcaccaagggctttcgccatgaactcttagtcagcaagtttggccgcaagcctcccaagacgg

SEQ ID NO: 68902 - DNA, 3821 bp, Oryza sativa
ctctggcttacgaatccaagcggaagcaaaagctgaccgaacgagagatcaatgctgtgcagcccgatacgccccaatatcttcggcggtcagagacagctaccaagtttgaccgctcggatcatcctgaccgagtggtccacctggggcggtaccccctggtgctagacccagtggttcgcaacgtcaagctctgactgctacatcaccatgccttttggattgaagaacgcaagagcaacttatcaacgcatgatccagagatgtttttcaactcagattggacgcaacgtcgaagcatatgttgatgatgtagtcgtcaagaccaagcagaaggatgacttaattgcagatctagaagagacctttgcaagcatccgcaccttcaggatgaagttgaatcctgaaaaatgtatcttcggagtaccgccagggaagttgcttggctttatggtatcccataggggcatacaggccaaccaggagaagatcaatgccatcctcaacatgaaaccgccgagttcccaaaaagacgtccaaaagctaactgggtgcatggcggcgctcagccggtttgtctcacgactcggcgagcaggggatgccctttttcaagctactaaagaaaaccgacaatttccagtggggacctgaagcgcaaaaatcctttgaagacttcaagaaacttctcaccactccaccggttttagcttcgccgtatccgcaagagccgttgttgttatatgtgtcggcaacatctcaggttgtgagcatagtcctggttgtcgagcgtgaagaagatggccatgttcaaaaagtccaatgaccaatttatttcgtcagtgaggttttggcagactccaagacaagatatccccaggtgcaaaagttgttatatggtgttctaattaccgttaggaaattatctcactattttcaaggccactcggttacggtggtcacatcgtttccactcggggacatacttcataatcgcgaggcaagtggacggattgcaaagtgggccttagaattgatttctttggatacatccttcaagccgcgaacttcgatcaagtcccaagccttgacagactttgtcgctgagtggactgagtgctaggaagacacgcgtatggagaagatggagtattggactatgcattttgacgggtcaaaaaggctttcaggcaccggagcaagagttgtcctgatttccccgactggagaaagactgagctacgtattgtggatagatttttctgcgtcccataacgtggcaaaatatgagacgcttcttcatggattaaggatcgcaatatctttggggatccggcgtttgatagttcgtggagattctcagctagttgttaatcaagtcatgaaagagtgttcctgtcttgatgataatatggctgcttatcggcaggaggtatgcaagttagaagataagtttgatggcctcgagctagcccatgttcttcgacataacaatgaggtagccgacagactggccaatttcggttcgaaacgagaagcagctccttccgatgtgtttgttgaacatctttatgaaccaactgtaccaaagaaagaagtaaccgaagctgcggacactcaagaagtaaacatcattgaagtcgacttgagggagcccctcatcaagtttctgactaaacaagaactccctcaggacaaagacaaagccgaacggatctctaggcacagtaggctttatgtcatgcatgagaccgagctgtacaagaaaagtccttcagggattctgcaatgctgtgtgtctttggaggagggaaggcaattgctaaaagatatacactcgggcatgtgcggcaatcacgtcgccgcacgaaccattgtcagcaaagcttatcggcagggttttttctggcctactgctgtgttcgacgcagacaaaattgtgcgaacgtgcgaaggttgtcggttttttgcccgacagactcatttaccggctcaggagttgcaaaccatcccattatcctggccgttcgtggtttgggggcttgacatggttggcctattcaaaagggctactggtggttacactcatctttttgttgctattgacaagttctccacgtggattgaagccaaaccagtcgtcatgattacagcagacaaggctagagatttcttcatcaacatcatgcaccggtttggggtacccaatcgaattatcactgataatggtactcaattcactggcggagtgttcaaagatttctgtgaagacttcggcatgaaaatttgctatgcctctgtagcgcatcctatgagtaatggacaagtcgaacgcgccaatggtatggtgcttcaaggaatcaaaacacgagtcttccaccgactgcatccttatgctggcaaatgggtagatcagctgccatccgtaatttggtctctgcgtactacgcccagtcgggccacgggtcagtcaccgtttttcctggtctatggtgtggaagcaatgttgccaagctaggtaaagttcgaatctttgcgatttctcaacttcaagaggagcgctacggagaagaccaagttgatgatctcaaccgactgtaggaagcccgggaagcagccttacttcagctggctcggtatttacaagggatgcgacgttatcacaaccgcaatgttcgatcgcgggctttcttagtcggagacctggttttgaggaaaattcaaactacacaagatcggcacaagttatctcccttataggaaggaccgttcataatttctgaagttactcggccaggttcttatcgactcaagcgtgaagacggtactcacgttgacaactcttggaatattgagcatcttcgttgtttttatgcttaggcattacttttgtatcttttcgtcctctttgactgctaacattaagttgctccttgagttaccagtcgggggctgttataattataatggagtgtgattcttatcaattcaacttgcttacttgatttatcgttgccctgttcgattttttggcttagtcagtgaggactgaaagtttttaagaacttttgcgggttttaagctcaataaggtttgacaaaaaattttaagaaatcaggagctgagtttaaattatcaagcacatcataaattcatcaatattgtacaaattgtgcctccatcatcataagttatactatacaatgtcaatcccactcagtttttcatcatcaagatcatcagacccagtcggcctgagatcggtgtcctgaaacctctcaattacatcagcagcgatcttgtcggcagccttctgtgcatcattcatgaggtcaagggtgtcttcttcactttcccatccgcaaaaccatctatgacatcaatatcaatcttcgggtacaaggatttggtcatcgccagtgccatgctctcccccatactttcagcttccttgatgttcttgaaatatgtatccagagcagctctcagcttgtcgaagatttccacagtgtcgaacgaactcggaccattaatattaaaaaacatggcctggataagtggtgtagcagcgttggcaacttcatccctagatccttcaagcttcttaattttgttgaccaagacgtcgaattgagctcgagatttaattttgcgatctgcatgaatggtttacatcaatgattgggtacgaagacaagaatggttctgaagtttcagttacaaatacattcgacgtctttcaaagccgagtccctctatttggtcaattcacccttgtcttttttcagagctttgattcgctcttctagctcggatatcttg

SEQ ID NO: 68903 - DNA, 17924 bp, Oryza sativa
ttacaaattcatcttcattcaataaagtggccgacaggatgagtaaagctatgagtaaagagacttacatttacgagatgagtagcctgattaagcgtttttgcaagcagagatacttcctcgtcttctttctgcttatttattacaatcccttgtggctgcatttcatcgtcccatcatttaaataggataggtgggcgagaatcttcagctgaccggatccgaagagcttcttcttcgtcgccggtcattggacctttacatattcgcggacgatgatgaagcaatcaaataaagtctgtcgagtcaaaatggatttagaagagctgattacctgttatgatttgtagtcaaggacgagcaggtccttgtactttattggatgaactagacttcgggtcggagtcggtatcattttggggagggctgcttgcttgagcctttacttctgggatgtcttcattttgttttgtgcccgactggtttccagtcgggggctcctaatcagcgctggctttagcttcggccgactgatttccagtcagggtatcattgctggcctctacattatcagttgctggttgattactactcgggcgatcttggtcagtcggcccggtttctatcgtaggaccaatctccgtgctagtcagttcaaagtcttttctagaaggatcaatgtcagatggttttctgcagattcaagatatgctatcaacatcatcttaatgatgtgtgtttgacaatatgggagatattgcgagaggacttatacctggatgacttcctgattttgggtattggatgactggatgttttcttcttcgggttggcctgttttggttgtttccagtcgcttctttaccgctagcttttctagcattgtcgccctcatcgtcgctcaagactagtttcctctttcgagagcccgactgttgagtcgactttgggtcgctcggctgagtagtcggctggatctttggtcctccattggcctgaccagtttgtcggcgaggagagcggcgttgagcgagtggaggatcagatttcatcagagaaaattcctatgcaagataatttaagctctcagccgataatacaaaggataaaaggatatcttgagaaaggccggattatttgatacataccggtggaggagggttgaaggcgttatatggtaccactggcagaaggtgtgagtagctaaccacgatagcatttgagaagattttatacattctctccttcataatcctgaactcaagagattctagatcttcacgattagggtcatttttgccatcaaactcgaaggcagtgtgggatctctccttaataggcgccagtcggctcttgatgaagtgtcgagtaatctgttccccttgcagaccttgctcttcgattttagcatgcgttccatcagagtaagcgcttgagcagcttcatctcccattggaagcgagttccaggtttcttgaaatgtcggaggaaggcaggaatactcgggaagcgctggctcaggattttgcacataaaaccaatttgcatgccatcctttgtttgaggttttgaaaggcatggagaagtatttctggcctaaggatccccttaactgaaaacctgccccaccaacgacgcacggcttgctcttgtttggttggggtttcaagaagaagatgcggcggaataaggcaaaatgaggcataatccctagaaaagcttcgcaaacatggataaaattggcaatatggactatggaattggggtttaggtgatgcaagctaatcccgtaaacctccaaaattccccggaagaatcttgaggttgggagagagaaaccaccatagaagaaatgagagaacactacgacctcgtgtgtgtctggggtcggaaatgcttcgccgcatgccggacaccactagatgatctctttcgctggaagaacaccatgcgccaccatctccttcaagttttcctccgttacatcggagggcgcccactgactttcgaagctttctctctcctcagccatgagtgcgagttggatgatgcgatttgatttggaaatggctaggaatggaggggaggttgatgcagtggttgcgcggaagatttttgtgggagatgtgaagttccggcgaggtggattgggatggatttgcgaaccctagctatcgccggtgtggttttgcactgtagcagggaatggggaaagtggcggaggtttcggcggggaagacgaaacggcgctttgctttagcgtatgtttcgctagggtatcaggaggtactaatgggcctgggcctaaacagtactttcagcccaattttattatcagcgtggctggttgtgatccttagggacttaggcatttgtttttgctttggcaacacttgctcacgacagaatagcccgatgctgttaaaatcctttttggcgcagttagataattctttggaattactacaatgcaaataaaaagatgcccaacagaaaagtgttatactaattttgtaggcctttttagactgcaaagctattcgggtcttcttgagatgactgattttaaatgttcattctctcggcatgttatatgcttgctttggtaatggcgtgagtcatggcttaggctattgagactcgtcattcgtcatgctttataccacatttgatggatcttttagagagattttactcggatttttatcatgtgtgttgatttatagacctttagagtgtttctcactcgggttttctttatacttctttggcacattaaagcagtcggtgggaggtttatcagatgccgcatatgcttagccatataatcccttgggagatttggttggaaaaccactcggatggatgtttggatgcactttgacatatgtttagtttttatttaactaatcacatagtcggggctacacctaattaactaatcacctgattttttctatttttcagcccttcacagtctttgattttactactcgggagaccaagactgaggaagctgaagcactcggattgtcgttttggattgcgagagaagattatttcgtcgactgtaaaggtctcaggggctactgtggagattatggataccccagacccacacggcatgtgtatccgactgggtatgggatgccatgtatagatagaatatctttaaagggactcgggttaaattctaaacttgtatgacaaggaaatacccgggatcctagtcgtttacgattgtatccaatctgtaactaccaattccgttagagatatgggctttattttgtaatacggaccccttcccttatataaggaggggtccgggtgcctcaaggggcacgattttgctcccagatcatacgatcaataatacactcgacggatcaatcgttgtacaggagtagggtattacttcttattaagaaggtctgaacctgtataaaatttcttgtctctaaacccatccacttttctagcttgatagccactccttttagtattgccgaaatcttgtttcgacaccgttcaaccttcctaaagatatctgagttgggcagtagcgacgttaatgtcctaggggaaatcgttttgtgcctgtgatatgtaatggaagctagtgtccctagcgcaaacatggatgtttagtttctgctgttatgtgttttttttttctgttttttctgtatcagactatgtttctgttctgggcctgtgtttcagactgggtgagtaaaattacctgctgtcaaaaaaaaaatccatctgcagactccactgaaaacgttaatccacatgttgccagtatcccacacaaatgagttactctgtgttcacagagaggatgtccttatagtgtaatatatggtttggcatgcaaaatatttggtcatgtggacattcagtgggataacatagtatttatgtattgtggtctgtgtagatctttgagtccatgtagctaataagatgctacatcttgttcacaatactttcccatgtgtgtacaacttatgcttgtggcttgtcggctaccaggaaattttaatgcaaaattcactttcttcgaagtattgtgtgtcacctctcgcagtccctgtgtggtatatatgggggatcataaaatttcttatgtcagatctgtggatggaattctttataaggaacaacgatgttagttttgataaagtctctctactaacaactactagcatgtgaatgaagaccggcccttactttcctgcccgggaaaagccattcagaaaagcaagtatctcttctttatgtgcattctttctttagtaccttgtgtaagacactatatacactccttgtacaagtgaaattatattaggttatgggcagtcataatcagttctggtatataagaatctcgagaaaatattttcctagttcatggtcattgtaagcattcctttctctatgcatgagcctcttttcaactttctctttcctaggagatggaatttagggttggaagacatctggaatggaagtaaaaccatatgtggacgaggggatggatggatacatctatattggatcagcaaggggtagtgatggagcatgcctaaaaaaaattggtgggtcaggcatggcgcaacagtcaatggtgttcctaaattcatgctagttggtacaccgtacaccaggtagcacgagtatttctaaatgttttaggctataggtcgtagcatgtgtattcctaattgttttaagctatataattatagtattacttgatattcgaagtactagtatataccttacccccggtaatttttgttataggttcgtcattggtggaagtgtgcagctagcgctaggggctaaattcctcgttgcgatggtgggcggctcagtggttgcgttgatcgttgagctatttgagttggaggctcttgagataggcagagcatctgtagtatatcatgcatgcatcggtactaaaggtgggacccatgtcagatatagcacctcgtgagaactgatgcgatgtataaagttggcaaaggtacttattgtgggtcccacatagattaaaataagataaagaaaacccatcatctctctcatacatgcagaccaaagacacaatttgactgatgcgtgggccctgtcatatgctctttctagtagaatcgggttctatgactagtacccagctcttgcttgagaccggctaaaaaacatatcataatgtgtggatgcggctgtatccttttctctctcttctagtgcctcctctaagtgaaacactgtgtatgctctcaggagcctgtcgatggtatcacactacaacatcaagccattaattcaatgtgatgctcaccaagaactagctaggaagccctctttctctcagatacagggtttcccaaaccgccggggccggggttaccgcgccccggcggtaagcacggttaccgcactgtaaccgtgaaaaccgtacaaaaccgtgcaaaatttatcaaaaattcaaattattttttaaatttatttgaatttaaggaggttaccgcggtatttatattactgtaccccgcggtaagcatggtaagcatggtaaccgcacggttgccggcagtaacgtaaaccctgcacggttgccggcagtaacgtaaaccctgctcagatataggaatttatgtgtagccactgcacaaataccacttaatttgaaacttaattggcaatagtttcagcaagtgattgaatttagctcatgggagatggcatgtctaaggtttcgttaagtatcaataactgatagatcaatgagattaggtgccatgattgaatttcagtaaatcgccaggaaagatgcacgcatgaacagaccatcgttcacttggttatgttgcaactagacaatagagcaaaacacaccggggtggggggttaagaacattacgttcacaacttcacatattgaagcttcatttcacggatgataaattacctttctcaactatttaaattgatgggatgaatcgacaaatgggatatatactaatactttgttctccctgtgattattcactggataaataatttagttggcttttaggaaaatttgtagaaccgcactagtcaatgctagctaaactatgatcttaagaacctttacatttttctaccgattcataagtgggcaccacaacaccagaattacatttatctaaaaacaactatatatactattccccgtgcaaaaaaataaaaaactatactatttatcacagcatcactgcagcacatgatgtggtaggcccaggactaccctagaatttggcctagagaagaccaggtattcatttttcttggcccatgaaaaaagcctggtccaacaaataaaaaaaaccgtaattctctctctcccgtgcactctcccctcccagcctccactccctcccaacagacaagcaacggcgacggcgctcccacgacctgcatggctggcgcgactccggcgctcccgccgtcctgcgaggcccctatgcgcgccgccactcctcccgtccgtccggctcccactaggcgctcgcgcccagccgtggcgcccggcggcgccgctaccttcgcgtgccacactggcgccggcgcggccgcgccctctccacgactccgcgtctccggctcttcgcccctggccagctggccacaccctctctgtcccgcgttcagccgtcacccactcgcccggcctcctgggctcccggctgaccagctcctggcctcccggctcccgcggtctcggtgtccggcccgacaacgctagtgcccagccacccaagccggcaggccccagccgccgtccgcccgtccggccagtgctagtgcactagtgcgccactccctctccggactccggtgaccaattcctcagtccctcactccctctcggcctctcccccttctagaatctagagttctagtagtagtagaccagttgatgacaattttgcatggtttgatggttgtcaggagattgaggcatggagaagtcaagcattgcgttgctttttcagaagcatgaagcaaaaaaagttgcatcttgtgatataccaatcccatatatggatgaagggtcgtctgttcgtgctgtagatgatgctctaattgatgaagacgtaaacgttgttgacgaaaggtcatgtgaagaacaagaacacctccacctccaaatgttcttcatttaggtaagattcaaacttatttgttattttctacttgtattgaaccatttagaattgaaccatttagagttatatactgtaccatttaccacattttatatcgaatcatatcatattgcattcggaattttttttttttgctaggcctaccctgagttcaaatcctgggtccactgagcacatcagtttctttcctatcacgtgagattcatctttgataccctcttaatggcattactgcacaccatagctatctactccctccgtccctaaatatttaacgccgttgatttttctccgtccctaaatatttaacgccgttgtttttcctccgtccctaaatatttaacgccgttgatttttttaaacatgtttgaccgttcgtcttattcaaaaattgttgtgaaatatgtaaaactacatgtatacaatgaatcaaataataggaaaagaatcaataattacttaaattttttaaataagacgaacggtcacatatgttttaaaaagtcaacggcgtcaaatatttagggacggcaggggtatttctttggtccatttatcatcttctttgtacactcatttataatggacaacttgctagcatgaacagtacttgctagcatgatggaaatactgaaaatcggttttaattaatagattgacagctcactccatgacaaacacttgtactatatatagattctcctggagtgagtttggtgtctcggctcgtcttctcttcccttgatactcacgcacctcttttctcgatccacctttttctttcttcacttcatcaccaaactctaaatacgaagggaacacatttttcctggttgctagagttacaattttggactgggagatgtcaggaatagccggatagacactgaagctatattatgtacatcctctggaagccaaatgtcaataggatgatgtgttgtcatctgttctgtaacagtatgtcgaagtgatggaggagattgtgatgtgtccatcactgctcacctagtacatgtgctaggccggaagtggttttcaattgccacgtataccaaaaatttgcccaaaagtcgcatttcagtgtacgaccttcacaaaaaaaatccccaaacatgcacaaacaaatagctctggaggtctttatcttccaaaacatttacactgtataaactgaattttagcttaacttttttggttttttgtaaaactatgaaaaaagcccgtgtacatgcgagagcatattatttaatgttttataattgtaattactccaaatatgtgaatatttaattttgggaaactttttaaatgaaatattgtttaagtctatttcaaacttatcattatgtttgggaatttctgaagtttgttttgattttattataaggatcataataatgcataggctctaaactaaaatttttcgaacctttgaaagctttgttaaatactataatcaaatagataatccacaccaaaggtccgctcatgtatgtcaaaaggccggttggagccggattttcaacaagttaagatggcatgaggtccaatgccataatttatttagcactgaaacaaatacttctttattgaaattacttaaaatagataaaatatataattttttttacgtgcctcaatccttttctgccactgtaacccacccttgtttacttgcatgcttctaattttatatcacaatgctatgatctatatcgtcaatttttttattatttttcactgacatgcaaaagatcaggacatgacctggaataactttttttgatcataagggatatagtgatgtaagtgggtaaaatgatttaaaatttataattgtttaatcgctcccgcccttatcgtcatcgttggccgaggacgctgctctcgtcttcgacgtcggcggtggcccgccgccggatccgctctcccctctggctgcaccgccgccaacacccctcccctccgtcggatctggggagggaaggaaggggagcctccaccaccggggagccgcgggggagggcggccagccgccgcccgctggatcccgcgcctccaccaccgccacgtggaggaggccaacgcgcgccaccatcgggaggagaggagaggagagaggagtaaggagaggaggcaccgcgcggagagacatgagtgaggagaaaaagagatagagaggagacgagagaaagaggggaaaatttaaagtgggtaagagggaaaagagggagtgtgtatttttgcgtgcgactctcttgataagtccgcacgcgataaaatcgaccacacgaaaaaatcgatttttctatgcggtcctcttaaatggtccgcatgcaaaaatgagcctatttttccagacgcgaccaattatggcccatctgcaatctaaatgggtccctgtacaggaaaatcattttttagtagtgtcatttttggatgcaaccaagttcaataattctcctctagcatccattccacgagtgtataaatatatctctagaacaacattggcatacttagaccacaattcatcgaatatgtgccccctgtagaacaaagggcattttgcaaaatctgtttgtcgaaacatgatttcggcaataataaaacggggtagcgcacgagacctaaaagtggatggatgtggagacaaaggatttagacaggttcaggccctctcaatgagaggtaataccctactcctgtttggggatttgaatccgccggatgtgtattgatctgacgattaggttgtctcatgccccctagagggcctcctgcccaccttatataggatggggggcaggattacaagatagaaaccttaaccaatacggtatcggtttcctaaatctattttacaatattatcaaaccaggactttaggctgttccgtaatatataaggaaacgtaatacccaagtcatgatctgttacatattccatacatataagttatcccctataactagtcggataaccatgccgtgtgggtatggggtacccataatctccacagtagcccctgagaccttcacagtcgaaaagataatcttctctcgaactagattactccaaagccgagtgcttcaatcatcttcgccatgatctcccgagtactttttccaagtcagaagactgtggagggctgaaaaataaagtcaggtgcatcgactagatgcacctaataggtgtagccctcgactatgcggttaagtaaacaaaccaagcatatagtcaaggaataaataatccaaccaaccgagtggcttccataattatagttaaccaagcgacttgatattaatatgtagcatatgcggtgtaaatccctgaataacatgatccgagtgatataccgaccgctttgtaaaatatgatgagtgtaacctaaagttggctacattattgaaaattcacatagcaaaacagctataaaaaagcttgtatgttgtgaataaagaaatttccaaagtattgggcatacgccatgcgcacactgctttaacagatgtgcttaagtccctagaagacacatggttccaccacacctggaaatatatggcatatgtggtataaaatccgagtaaataaactcataaaggatttaccaaccgcctgaaagatgaccacaatatataatcagcctaagccataatattggtcaataaaaatgcacacttacgtggcaaaaagcaacgatattgtatccaatcaattgcttaaaaacccaaacagcaccttgacttatatataaaaaagtcagcgggacagctatataaagctttactgtttgacaccttttaagatgcattgtaccaactcctaaaaagttaagtaactgcggtataaaaggattttaaggtattgggcacttgatcacgcgcactttggcctaagcaaaaagtgcctaagtccctaaaagaacgtgacaggccacacctgaaaatatgggctgcagacatattaggcctaggccaaaaaatatgccttcgacaccctttaaaggatgacgcatgtaacatgctcccgagtaataaatcttccgggtaatatagaccaagtgtagctcatatgaatagcttctgatctgaatgattatcccttatgggatactccaaaataaatataataattgaatcccgactggcgcaagtattcggttgatagcccttacggagaataataattggtccagtctttgagcatagaaaataaactcatgactatgaatccatgtggaatgtatccggaacaagtccaaattggagatataatcctcacgcttgagttgatgagcccctgagcatatagcttgtccttctgtcatagtcaaaattgtctattggcaatagctgacgcagtcggcatggagatgaaatgaccaacatgaagacgaaattgctcatcagaagtaacggaagatgtcagtggtagtaaagatgccaccaatcaaatgtaatgaagttgtataaccatggaggcgaagaaaccagtcagcaacagtcaggtcagctagcagtgaagatgtaggcgcccaacaacaacgaaagaacagtcggtggtgacaaaagcaaaccgacgatgaagacgtagacgcgcatcaacggtgatggcgaaatccaccaatcatgaagatgaagaaaataatcggcggcgacaaacgcatccgacggtaatgatgattagcggcaacagagatagccgactatgatgacgaagtttcccatcaacggcagcagagtaggctatgttgatgaggcttgacaagatgttgatgaagatgacgatgtcggtgatccagtcaatagcgatgtagcagccgatgataacgatgagatcctctatcggcagttgcgtagtaggccaaccgtgaagacaaataattggaggagagttgatgttgttgcccaactcgtctaaaccgaaatatttgaagttgttgaagtagaatgtctgttccgaagcaaagatgaagataatgactcctggagttgactcattggctgattaattgatttcttcagcttgacataaaatttgtcaaattttgagccttatatttgtgtagcccccgactctttggttagttgggaaacaactgaacatagagtcgagaattatagcttcttgtcgtcgaatagtcattacttgattgaagatatgtgttgaagatgtccaggtagaaattctgaatattggagagccacttgttgtagtaaaataacatggcattgcatgccgagatgtcgaggttcacaaagacgtcgtggttggtgaagtagcaaaacttgtgaagtagcagcaatagagtttgctggtaccgaagataataaagatgaagtcgctccaccatgatgacaaagttgtgttgtcgtgatgaagtgaacacgagtcggcggcaacagaagcaaaccggtagtgaagacgcgcagttgtgaagataaaagcaccagtcggcggcggcataaccagtcggcaacggaagacgatgatgtccatcagtagtggtagctgtctaaaccagacgtagaggtgagggcactagtcagcagcagatgtagacagcttgcgttgaagatgatgatgcttattagcagtgatggtgatgtagccagccgtgaagaagatagcatcagttggcgtcataacaggccagccgtgcaggcggtgacaccagtcggcggcggacgaggcagccggtcggtgaaagcgtagacgcccaacaacggcagcataataggccagccgtgcaggcggaaacaccagtcggcggcggacgaggcggccggtcggcgaagacgtagacgcccaacaacagcggcataataggccagccgtgcaggcggaaacaccagtcggcggcggtcgaggcggccggtcggtgaagacgtagacgcccaacaacggcggcataataagtcagccgtgcaggcggtgacaccagtcggcggcggacgaggcagccggtcggtgaaagcgtagacgcccaacaacggcagcataataggccagccgtgcaggcggaaacaccagtcggcggcggacgaggcggccggtcggtgaagacgtagacgcccaacaacagcggcataataggccagccgtgcaggcggtaacaccagtcggcggcggacgaggcagccggtcggtgaagacgtagacgcccaacaacagcggcataataggccagccgtgcaggcggaaacaccagtcggcggcggcgaaggcaagccggtcggtgaagacgtagacgcccaacaacggcggcataataagtcagccgtgcaggcggaagcaccagtcggcggcggacgaggcggccggtcggtgaagacgtagacgcccaacaacggcggcataataggccagccgtgcaggcggaaacacctgtcggcggcggtcgaggcggccggtggtgatgttctgactgatccattcctggagcgtaagagataagcttaaagccatgaatcccttttatgcatatctggatctggatcctgcagaacaaacatataggatgagtagtatctgatataaatataatactcgagaaaaaatcaagtattttaaaatatttataaatatgtatttctcctcttgtcaattttgatttccccgagcagatgactctgtacgtttaaacactctgcccgactagtcataaccaccaagcatcgggagtcggcctaggcacttcccaaacatgcatatgagtgatatgagttcgtcattaatggaacaaagtttcacggattagaatttactactcaggtacttttgcaattattaagagcagaaaataaattatcttatctctatgcttttgatttattccgaataatacttagcaccttgcgttattcggtccatccaacgagcccccgggtgctaggaatcggcccaaaggcaaccatccattggcaaaccgaacggaaagcataggaagatagaactccataactcgataggtacttttgtactcagattatgtcgcaagcaatcaagataaatattatgaaaaatatgatataacatctgtagcccccgactcactactcaatggaagaccaattggtgtagtgaggcagaggaaaaggaaaaatatcatataaagaataaaataaatgatgacttagctttgtaatattccccttggtgatggcagaagtggccaatgtgggaacaaagtcgtccatcaataacaatgaagacaccagtcggcggcgacgaaggcggtcgacggtgaaagcgaagatgcccactaacggcggcataataggccagccgtgtaagcggaaacaccagtcgacggcaacgaaggtgagccaacggtgaagatgtagacatccaacaacggcggacgaggcggccggtcggtgaagacgtagacgcccaacaacggcagcataataggccagccgtgcaggcggaagcactagtcggcggcggacgaggcggccggtcggtgaagacgtagacgcccaacaacggcggcataaaggccagccgtgcaggcggaaacaccagtcggcagcggcgaaggcaagccggtcggtgaagacgtagacgcccaacaacggcggcataaaggccagccgtgcaggcggaaacaccagtcggcagcggcgaaggcaagccggtcggtgaagacgtagacgcccaacaacggcggcataaaggccagccgtgcaggcggaaacaccagtcggcggcggcgaaggcaagccggtcggtgaagacgtagacgcccaacaacggcagcataataggccagccgtgcaggcggaagcaccagtcggcggcggacgaggcggccggtcggtgaagacatggacgcccaacaacggtggcgtaaaggccagccgtataggcgatgacaccagtcggcggcgacggaggcaggccggcggtgtagatgacgatgcccatcaacggtggtgtgaccaaccgaccgtataggcgaggacaccagtcggcggcgacggaggcgggccggcggtgaagtcgtggacgcccaacagcggcggcataataggccagccgtgtaggcggaggcaccactcggcggcaacgaaggcaggccggtggtgaagtcgtggacgcccaacagcggcggcataataggccagccgtgtaggcggaggcaccagtcggcggcggacgaaggccagccggtcggtgaagacatggacgcccatgaacggtggtgtgaccgaccaaccgtataggcgatgacaccagtcggcggcgacggaggcaggccggcggtgtagatgatgatgcccatcaacggtggtgtgaccaaccgaccgtataggcgaggacgccagtcggcggcgacggaggcaggccggcggtgtagatgacgatgcccatcaacggtggtgtgaccaaccgaccgtataggcgaggacaccagtcggcggcgacggaggcggccggcggtacatgtataaaataatagatcaaataataattagtgatctgtgaattaattctaatttatataagaaaatttagaacgataaaccagatccagatagaatttttggcgacgaagaccctgcccttttgttgagaggatcacggccaaagacaagagtagcaccgatgatgccggcacagagttccatcgcacttctcgacggaaaactcgacgcaacccctacctggcgcgccaactgtcgaaacatgatttcggcaataataaaacggggtagcgcacgagacctaaaagtggatggatgtggagacaaaggatttagacaggttcaggccctctcaatgagaggtaataccctactcctgtttggggatttgaatccgccggatgtgtattgatctgacgattaggttgtctcatgccccctagagggcctcctgcccaccttatataggatggggggcaggattacaagatagaaaccttaaccaatacggtatcggtttcctaaatctattttacaatattatcaaaccaggactttaggctgttccgtaatatataaggaaacataatacccaagtcatgatctgttacatattccatacatataagttatcccctataactagtcggataaccatgccgtgtgggtatggggtacccataatctccacactgtttatcatttatcaacggagcctagcttccatattcaacaggttgattgcttgcatgcatggtacattctttgaagcctcaacttagccaatggaaggtattgggaagattcaggagacattgcgccgtatggtagtttcatggctaaagaacaaagtttctgacgatccatcggcctgctttctgtcataaattcaactatattatggacaggaagtatggaagggcttaccaaaggcatgcaaatatgaaaaaggaagcggcagcgggtggttgcgggtatacattcctagtctttacaatagctatttcctagtttagctttagaccgagttctggtctagtttaactttacactacagaattagcacttttcttgtttaggaattagcctgaccagttttgtactagcagagtcaatcaatcaacaaaatttaaaggcttagcaagacaagtatcctagccaatcaataaagtttgttagagggtgcaaggttctatcgttctctagattcgttttgaccatctgcagccaaatatattaaacaactatatagcatccctgccttaccatgttcgattcagttatcaattttgagtgtgctttagtcagagaaattaagcacatccaagtctcttgcagaagaacattacgttcacaacttcacacattcaagcttcatttcacggatgataaattacctttctcaactatttaaattgatgggatgaatcgacaaatgggatactaatactctggactttcactggataaataatttagtttgcttttaggaaaatttgtagcactgcactggtcagtgctagctaaactatgatcttaagaactttacaatttttctaccgattcataagtgtgcaccacacagcaccagaattacatttgtctaaaaacaactatactattacccgcccccaaaaaaaaactatactatttatcgcagcaccagtgcagcatatatatcagtttctttcctaccacgtctgagatttgttcttgactacagattcatctttgataccctcttaatgttattactgtaccatagctatatatttctttgcttccaatatttatcatcttctttagtccgagtttatttcttataatgtacaacttcctccactacaccggaccaggtcatctgtgacgggtccaaaccctcacttttgacaggtttatcccttggtcacaaattagtggtcactgatgacttaacctcacctgtgaaggttgaaggtccgtcagtggtgagagacacctgtgacgggttacaattagcaaaccattagtggtgagagatatttctaacgagttataattagaacccgtgacagattatgccacctcaaacgagttaaagcagtcaacccgtcacaggtgtgaaaaatcaaccaaaaaaaaacctcgctgcaacaatgatttacagatccacgctgaataatccagaacattttagactacatttctgatccaagaacttacaaggatgatgttacaatgaacataaaaacaaactagtgcaacactgcaaact

SEQ ID NO: 68904 - DNA, 2969 bp, Oryza sativa
cggatccggtttcccccgacctggatctggcatcccctaactcgcccttggaggaggcggctagcccttggaggagccggatcaggtgatgaggaggtggctagcccttggaggagccggatctggtgttggagaggctggatttggcatcccctatctcgccgacgttcctgccgggcctcggcttgccgatggacttgacgaggtggctgcagcggccgccggtcctgcctgaactgcctgacgaggtggctgcagtggtcaccggatctcgcccttcctcggccaccggatctcgccacgccgacactcagggatgggacgccgacgcccggccacatctagccacatctggccggcgcccggcggcatctagccgcatcagcgcccgacggcatctggccgcccggccgaggaagaagggagaaagagagaagggcggaagaagaagggagagcacgggtggaggtggaagaagaagggaggcagaagaaaaaaggataagaccaatgggcgtgggttcggagcagggaggaggttatgacggcgatttttttaatcatctttgacgggcagacaaatatttggcccgtcacaggtgactttacctcacctttgacgggttccgcttttggcccgtcacaggtgactagttacctgtgacgggccatatatttctagcccgtcagaggtgactttacctcagttttgacgggttccatttttgacccgtcacaagtgacattacctgtgacgggtcgccgccggatggctcaccgatgatggcatctcatgatggcatctcataggatccgtcaaaggtgaccctcatcactaaccaacacttatgcccgtcacatatgtgccgtcacaagtgtgaggatctggcgtagtgctctctctttaattgacctatgctttcccacagacaaataaacagtacttgctagcatgaggggaatactgaaaatcggttctaattaatagattgatagctaagtgcatggcaaacacttgtatatatagtttctcccggagtttggagtctcgactcgccttctcttccctttatattgatgcacctcttttctcaatccgcgtttttctttcttcactacttcatcaccaaactctaaatacgaaggaaatacatttttcctgcaggttgctagagttacaatttaggactgggagatgtcaggaatagacactgcaggattttgtgtcatgtaacaatatgtcgaaggcattgaaagttgtgatgctttcatgactgctcacctaattcgttggttccattacaagtaagtggcatgttcggctgctttgtaccgtcgttgcgctgccacagccagaagaaacaacacactgttcttgttggctacagcacagcaaaaataagagcagccgaccagagccaagaatgaagatccatgtagaaaaagaagtacaatggcatgctggaacagaaaacgactgtaaccaagcactcataacccaacctaaattaaaaaaaaaattgccgccagaaattcttattagtgctagttctagccacgattcggcaatggtaagtgcctcatgtaacgttccgcttttcgtgagtcgttaaaaactaattcggcaaaatcctatatgtgaaaatttcgttctttgtgtgagagtataagttgtgccaagatctcaattcaaatctccattgttgttccctctcgtcgccatcaaaatcctccacctcaagattccaattccaattcaatttattccaaaggtcaatcgcctcctttgaatcatcgccaaatacttgtcccgattccacaaatatccgagtccaccttaaatccattccttgattcctccctgaaccctcgagttcggatatcgaatttgaatccaaatccaaactccaattctctccaattcaatttctctgccaaagtctgatttatctccctctggctcgttgggccgattcttcctcccttggcccatctcctccctcagcctcgcacatgcgttgcacgcgccgagcggagccgagagagagctctctcgccctcttgtttttctctctctctcccgtctccgttctctctctcttttctctctggcgccgatttcttgctgccgccatccgaacctccaccgccttcgtcactccggcgccaaatcccccgcccatcgccattcaattttcgccgccgcccatcggtttcccccccccccgccccccgcgcgcgcgctcgcgcatggtcagccgctcggtcgccgccgcgtcagccctgacgccgcccgtgaccgcgcgccgcccagccccgtctgcacgcgtgcgtccaagagacgaaggcagagcctcgctctcacgcgctctcccttctctctcagctcgcccaaaatcggcaaggagccgagctcctttctccctccccctttttgctttttcccttccatcgccaccgtcacctcctctgccgcccgtgagcgccagccgcgcccttgacagccagctgcccccttgaccgcctctcccgagtcgattccttcccatcgaagctcctcactcgccacctataaaatccgcactcccctcccatacctctcgctccctctcctccatcacaccatttccgcctcgccgtttgtcgtcgtcctcgccctcctcttccatcgtgcgtgccggggagctagcgagcacgaggagtcgacgaggagctccgcgccgccccatcctcgcgcctccctcactcttctttcccggccgcacgctctcggtgccgcgccgtccctggagcgccgcctccacgaaagccggacacgccccgccgccggctctcccttctcaccaccaccgccaacgccgttttctctcgccggtgatctccccaccgtacccatccctcctaccacacgctgtgccgcacccgccgccgctcgcctaggctcgccggtcatcttgctctgtcctggag

SEQ ID NO: 68905 - DNA, 5265 bp, Oryza sativa
tcaatgaagaccttgtgcaaggcaagtcacctttgatcatcttgcacctataatttaaatctaagtatctcttttccgcaaatattgcatgaataggattaacacgagtatttcggccacggcttgcgagatagcttgtcggccccaatcctaattgctgcaattaccctccttgaattattgaacacttaaacctcctttgtcgactgttgtgctttgatgcacgggcatcggaacacctcccctcaaatttaaaacatccaacgatgggtaaaacttggggttttgcaaaagacatggaaaacccgacacatgggtcggtgcttgcgaactgaatgaattttccaaaaccgcagaccgggggacgtaccgggagtacagtttcccgctcttgaacttaacgaccatttccttggaatttcattcgaacataaggcaagtgcgacaacatgggtggaatgtgacacccctggctgagtaattagctaatcgggggaaccatgatgccaagagacatgtggattcaacggggtggtgccggggagaacccccgggcttactggcacagtatggtctgggatctaacctgttgtcggtctgggacccctctcattggcatatggtgaacctgtgtcagcttttgaaatgccttgtcgtgaaagccccaagtcaccagacatgtctgatccacacgggctaggtgaccaaggctagtaacgtcgtgtgggtaaagtgtaccctctctgcagagtttattaaactgttcgaacagccgtgcccacggtcatgggcggatgtgaggttattcctagcgtagtattgtttgactactgctttgtgaaattgctgttgtggaatgggatcgatgtttagaaaatctgcagctgatgggatcagctaggcccgggtggccgtttgaaagttgttggccgggtgccaaccttgaatcaattcaaagactgatacattgcacatactccgaccggacgagacgcaccgtctcatccgtgtcgtttaagaagcactcacttagttgttttaagaaggagtttaactaaaatcaattgtgaaaacaagcagcctttcctttgaagcctgcattaaacacttaattcctatggcttgctgagtacgaaagtactcacccttactctatataaatatatatatagttcctctgccctgaaacttaagatgaagtgaagtgaagaatagggtttcgttctggtccccagccgtcgcctgtggtgttggatgttagaccgttggttccgctgctgttgttgttgttggtgtttcctcgtccgtgtcgtctgttgcattctcaggctgtcctgagctgcaacctaagttaagataaataagtcctctatttattttaaggattacaatgattcatgtttgtcaccgtgggtaccagcgctatgtcctgggactggtactgtgatcacggttttgtaggaagcggttcgcgccgtttttcctacgacacactcctatcaggtgctgttgtacggcggtgccagattggggtgtgacacctcaacagtgctagttttttccacgaaccatcactgccaagatcaatcaaatcagtgttggtttgtttcccgaatcaccactaatacttatcattatcccttatagtatttagggacggagcgtgtaccaacttttgccttcccagagcgtgtccagggacgggtggacaggagatcgatcccatcagaaactagctttatcatattcgttttcatatttttttctcagaatcgaaatcggaatcggaaacccggatacgaaaacggaatcgaatattatcgaatacagatacggagcgaatacaaatcgaaacgaatttggtaacgaatattaatcggaacataaaagcccctcaaattgaccttcacaaatcaacgaagaaatataactcgttattttttttaatagaacatatcaacattttcaattttagtgttaataattttgttatatccgattttgtggtcgagggagacgattcaatcaagagtaagacattacgaggctattattgtgttctaaaaacatgttctattgagttattgtgttcttactgctattattttggccatattttcttgtgactttgttttatcaagtaaaattttgattttcaaaaaatagcaacttcaaataatattttgaagcagtaaataatttcaactgaaaaagttatgaatataaaagttgtagaactcatcaagagctaaaacttttattttggtcatttcttcatccgaccaagtgatagtaacattgttcataaaatttgcatatctcttttataacttatgaaaccatatacgagatatgtaaattttgtaaacaatgttactatcgctttgtcggatcaaaaaatgactagaataaaagttatagatcttgataagttatacaactttgttgttgatgactttttgagttgaaatcatttagtatttgaaaatgttgtttgaaggtgtcatattttgaaatccaaattcaaactatttaaacaaagtcatatagaaaaatgacccaaacaaaagttgttgatcctgatgagttatacaaatttgttattgacaatttttccatttaaaatatatttactacccgaaaaattatttgaatttcttatattttaaaattcaaaatttatatagttcaatcaaactcggatgaagaaatgacctaaataaaattggtagatctcaataaattctataactttgtttttgataactttttcacatgagttcatttagtatcataaaatttaattcgaagttgagggaggatatatagacttaatatctaattcttaggcccgttggcccatttagatggagggatatataaacctaatcctagtttctccaacctcccaaactcccacaccttccaatctcctcccagccgccacccgccacccttcctccagctcccgcgactgcgtgcggcggacggcgacggtgacgtcgggggcggggcctcgtgcggcggacggcgacggcgggggctcggcggcgcaaggcgacgacgtgcggcggacggcggcgagtggaaccggccgcgccggcctcggggcggctgggtcatggcgacggcgggaactcggcggtgcgaggcgacggcgtatggcggacggcgacgccggtctcagggcggccggatccagggtcggcggccccgtagccgcgggatccgatgtcgtgaggcgatggcgatggaggggtcttggcggcgtgagtggatgacgtgcggtggatggcgacgagcggatccggcgtgcgacgtgcgacggcgacggcgggaactcggcggcgcgaggcgacggcgtgcagcggacggcgacgagtgattttggatgttgttaatttggattttgctgtttattttgattcggatatccggcaaaaaatgtcggatagtttccggccgaatccgatttccgacaggtaccatcgctattgtattcgaattcgtatccgagaaaaactatccgaattcgtatccgaatccgaaaacatccgaaaaaaatccgaccgcaacaatccgcatccgaaaaacaggattggaactcggaaattatccgtaccactttcatccctaatcccatcagtgttggtttttgtctaaccagcatggataggacaccacatttaaggcttctaggagtatgatagtggtccatgcatagcagtttgtgcggtgtgcgtctactatatgtaataaaaaaaaggtttaggtgccaatgttaaatttttcattcagtaaaaaaatgttaaaaattcttgtggacgaacgagtgaattcacaagagttttccataacaaaatcgaatgaacacagacatgcatgatttaggcttgctctactactcttggaattgttgtagtcaagagctttctgcagcccctctgatcatactgatgcaaagttgcaaaaatatggaacatgcagatatatactgggaatcataaatcattatttgcacgttccatttgcgtgggattcctaattaattactcatgatgtttgtgtcatgtggttttcaaatcttgttaggtaaagtttttcattgccacatcaaaggatgcatatggttatacgagactatgacacgctgtgtgttaaaccgaaattaagtgaagttaagacgaggcaaactgggtagatgagccctagaccatcaaccacatttctcctttcaaatttaattggttttaaaataaagagattttttatttctccaattatatactcacaaagtaggcaatgaacttcagttggatgtaaaagataaacactgtacattaggcgatttaaaggaggctgaatacaccatctaaggacatgttaattgaacaaattttaatcatttatatgggatttgaagattggatatatttggtgcagttaagggaagaaactgttctagacaaaaaaaaaaaactaactagctggtactaatttatcttctcataaaactgctacctatatagcaatgcaagctttaagcctccacttgtgttttgcatgtcactaagtacttcagggctgttgaccactaaggtatatccaactcagctcgttttagatttcaaccaaatatattttaaccaatgtagttcttctagttaggaattttttaaatccacattaactatttctcaacacgacttgtgtgtttagttaggttggagaatgcagttgttcaattttggcatgaggggcatcaggaaagttcatgcaagcaagaaaaagaatgattggagttgaactggctagtggaccaggagcttctccgtgccatgctactgtccgatgatgcacgctactacgtgctacgtttcgtgttgcaggtgattggaacaacggttattcagggaaggtagctagaccagctgtaatgtagtggagccttattagcgacaagttgcgcactctggatcagagcaatatcaaagtaggatgggaggtattaacctggcaattggtgcctagctagcaggatcgtccttgctaattaccttggcaagtgaaccacactactagggaaaagcattatcgcaatcgggcaaaaacggtcttcgcaagcgtggcggccgtccgtccgtaagcaaacgactgtgaagatcggcaggacggccgtccgtctgcgaagataattttcgcaggcggacgttggctagttcggtccgcctgcaaaaatagtaagcggccgcctgcaaaaaaaaa

SEQ ID NO: 68906 - DNA, 2364 bp, Oryza sativa
taactcaaaagtgttgccaaaatatatatattacaatatttttttacattgtcacttcaaatacgccatccagttatattatggcatagcagtgttccactcccgaagatccttgaattcgtcacttgtcactagggcaccctctgggtcgaagaaatctcctttcacatgtcagcattcatggtgtatgaagttgcacagatcacactggacatttgtgatgcctgtatcgttaaagcttgttcgacgttctaatcttggcaactgcatgcattgaagataaacaatatattagtatcataaatatgtgaagctttctagtacatagtatagatacttacatcctctgcgttaaccctgtacctctcattaaccctaaggaattcgcacgcataatacccgcaaaggacagttcctctaagttgcttgtggacacatcatagaaaaaatagttaaattttgcaattagtgaaacaattggaatacattaagtgagtggagtattactggccaataggtatgtactagcagcttctcccttgtttgggtctgttctccacccttgaacttgtagtattggtacgcactgtatggatgtcgtaccgtttcacattaaggaggatatttaattataatattcatataaaaatgtaagagtcacaatcacttactactgtaagattgttagaaattctttgtatgactggtgtctgtaatcgagtgggtctaagactaccacggttccgtctttagggtggatgagtaaacagatataatgatcgctatatattaacaacaacattgtttgttagtaccagctaaaataagacatatgtgtagaagataaatgtaccagacttactcaaaattataagcggccatgacgactctcttattttgaaagtgcaagaaggctcgtccaatgtactgtgcgacaataatcaatttctccttgtgcaagcccttcttgtatttagctatctcttttggagtcttgcccttcagctggtttgaccctggtgctagcctcacggtatgctgtgtttgacagatccgagttggatccaagaagccgataggttcttttttcttcttagcatccatgtattgcatcctacagaagaagtttgttagtaacattcacatggatttgtattgtacatacttttcatgtaattaattaaaactcatactcacatcaccaaacaccgacatagttgacgcccatcttatgccgatgatatatggtgttgagatctgagatatctagccatacgtaaccttcggcaccgaaacaatctgccggtgatcgagctgttatattgcccaagcctttcttgctcgcttccatgtagaaggtatttaaccttctcatctcccatggtccttcgtttagtgcccactccggcaagagtgctttcccatgttcgtacttttccgggcaatcattagttggcaagcatgttggcccggctagtgcagcggccttctgggggtcatcatctctgagtttggcacgttccttaccccctctgaagacggttaccatgaacttctccttgttctcatctttgacttggaatggtggctcctaagcactctaggcacctcagaattggtagtggccttctcagtgacggggtgcttgcacctcggggtatttcgcaggagaagggtcttcaaatatttctggctctgtaccgtcccattccaatcctggtacttcttctatatctgtcccgactgatgccacaaattgcacctctggctctgccactgtaatctccatgtggacatctggcactacaatctccatgggcaccttcggcactgcaatctccggtggcacttccggcactggattgtccttatgcatctcgggttcctccgccttatcagtcaccttcctcttaggttgtctcggaggttttcccaaccccggttttggcactacagattttcgcgtggcgtcggtgcccaattcaaaggatatgtcattcttgtgccaaagaattacaagatcaaccgcatccccaagtatggatacagcatcttgagtagggaagtctatgtcgtaggactcaaacccttcgtggaccacttgcggctgcactttggcatacgcattgcctatgaactcttcattatatgttctcccagtgatagcaatggctatagcggcctcaagagttttcccggcgtgtccaatgggaacgtgcaatctgcagggtgtattctccttgaggtcatcaaaggggtaatcaggctcaggttctttggtttcggggggaggcaaaagcatgtgcttgacgcagaaatccatcatttgcctttcaaaatctgcagccccttcgtctctaagtt

SEQ ID NO: 68907 - DNA, 5202 bp, Oryza sativa
ttactattatgccacactatgaactgaatttcacacgtgccgtcttaggggcgagggctctccttttggcgaaacataggtaacaacatgaaacccttcgtcctttctattcacgcttctctcgccccttcttttcttcgcctttgctgaccgttcgcttttctttgagccggttgtgttagctgggacctcgtcgtctttcgacggatcttttttcttgggctgccgttttgatcgtcgtggcgccgtttcctacgagaaggcatataccaaatttactattagctcgggctaatagttatcacggtgaacagtttacatattaagtttacttaccccttctttagggggaatagttatcacggtgaacagtttacataccttaacaacaagactaaaggtaccttcatagtctacatactataacgctacttaaacccttttgcaactaagcgagctttatatctatcaagactaccatcttctttcctttttatcttataaacccatttgcaatcaatgacatttctacccttctgaggaggaactaaatgcgatgtattatttttaatcaaagccatatactcagcatccattgcaagtttccaattcttatctttcaaagcatcttgtaaattttcagacacaccagttgaggtcaaaagaccccattttactgtaccatcagtgtagattttctccttgcgaattccactttgcagccatgtgcgaagacgtgctgctgcgtcagactcctgattccgatctgcaattccaagtccgcgcctcgccgtcggatcggcggcagcgataattccaagtccacgccttgccgtcggatggccaccgctgccaccgctcctccaccggctaccgtcgcctcgttttcctctctcccgtttgtgcgcgtgcctgtcggtcccttgccgcgtgcctgctggcccttcccgtgcaccgctaccatgcaagtcttgccgcatattgccgcgccgtgccggtgcctgccagccgcttgccgcgcgtgccgcaccgtgccggccacttgccgtgtcgcccgtccgttctgcttgccgtgccaacgccgtgtttgcctcagctcggcagccgagccgacaaaccctagcgttgcttggtcggtttcgtgaccgacccgagccaccggtttcgtggatcggcgttggaccgcacacgttgtcccgaaccacggtaggtcggctccttgagatgctgacctatggggcctatctgccagtgccgtttccccttgttgtccaccctcgggcgtttaagtataataattgaataaggatttttggtttatagtaagaacacagtgaagcttctaaaattcatatgtacttcatctgtattccgttttaatccattcaagattcagtaaattcataaaaacacctagaatctattaaaaataattttgtttcctgtttcaatagacttctagaaggtttgcttgtgtgttttgtttgttgtatagaatgcggcagttccgacactcatgtctacttcgaattggtcgctgaagcccctccaactcaagagcaaggcaagtcatacacaaaccattgatcatattgaacctatttttacaaatccctcgctttctatttaaattgcattgtttttataatgtcatgtgggatggattcctattgtacttagcctattgttatcctatgtcatttatagcttgggaaataattttactggatgattggtttaggtgatgcttggatcaattagcacactatgggtttcacattaactttagtccttaatttaatgattgattaccaccatggtaataagtaaactaaaatatgctaaaatggtgtattgtgggtgcatggttttgatagtcgcacccatgacaattaaggaccggttcccgggaaacactggaagaattactcgtacttaccacaagacaacatgagcaacggctggatttggagtgtagctttttcctagccgacgtactaaggcaagggtgggtgtgatggagtaggatgggtcctatgacgacctctgttgcttccagattcacctaggcatgagggggctgcccactgccggtaggggtgggggcaaaacctgaggtgggcacgattggttagggagggttatacaaagggtcctatcacagtctctttccgaggtaccttggtggtattgaggcgtatgataacatgtcgtggggctgtgtcttgtgggtaaagttgtacacttctaatcagagtaaaattattcgaatagtcatgcccgcggttatgggcagtcaaccagattcactattattagtctcacctgaatatttggacttgttgaatggtttagttcaggtggtttgcttgggcctgtttcaacgtggtttagcattggatagtgatgtttaatattgattaatttatatctagtgttttactatattcaacttgtgattttaaaatgccagctttatgaaaatatcctataccctcctttggtactatcttgcatcatgccttctattggtatggattgttgagtacggtgggtagtactcagtcttactttatttttcccccaaccctcaaaagcaaagtattattcagatggagattattgggaagagtaggcttgttgcggacgtcaaggatgcctgtggatttgtagacgctatgttttctcaagagatcgatgattagttaactcgattatttatttccgatgcatatataagacttatttatatttttgtaagacgtggacctgtgtatcaatattatcgtcaatgtaccctggttggtcctggacagatattttaatacacattctgcttgaaattcgtgttaacgaatttttaggcgttacagacatcacatttcatttcattatatgcaggcattgacagtcagatattatgatttaagaaccatcaacagtcgccatgatggcagcgcaccggttttgccgtggttggaggggtcgttaacgtgaatgaccttggcggcggcggcaacgaagttggcgaggaagaacggtgccagggaagtcgtggccgagggtggagcgtgaggagtcatatgcctacggacgctggcctgttgacggtgaagttgagagctccgaagcagaattcggcccctacagcgaagcggagtgtctggacagattcgaggacaccggggcccacctggacaagttggccggagttgttggcgaaaaatttgaaggagttgaaggagaaaagtttggcggtggggaaagtggcggtttcgcgaacgtggccccgtgaaatgcatgccatctcctcgaagaaaagacgattgagtgccccctaactagcatgccaattttcgatttctaggatcgagaatatgaggtgcgctagatcaaggagagatggtgacatagacgattatcctggtttaggccctagcatggggtaataccctacgtctggtgatgtagattggatctatgtcaactaaaaagacaagagtgttaccgcttagggttagtgccagcgcccttatagagctagggcaaccgacgacatgcttcgtacagtatccctcataatccgggtacctaccatctgcttactagggacgagatagacttccttatctcttatccctttctatatatccaaagtattacatgggcctaggacactcagcccaccctatgtagtatgacccaaatgcctgtccttgggtatccgggtaccgtgtgccccatagcatgcatgacggtggaaggaggtgacgacgcgcctcgccgtgatcagcagtcgacgagcgggatggttgcctggttggcagctgcctccgccggtacaccatgcaatgatagaaactacgtcgctgctggtgtgttgagaaggtccagcgagagcaaccaatgggtttgcattccacacttccccagcggcgcgtcgagaacctccagccgtggttgttcacattcgctagtggcgggcggggcagcaacgacgaccaccaccatgggccacagtggcgggggcggcgttcgcgactacatcatcgccaagtgcacatgctcccactggttcggactcctctggtgtggccggcgcgacgactgctacacgaggactcatacacgcggtcaatgttcgacgccatccttgccggctacgtgacggcttcttccacctggatttgcacccaacaccattggtagtgtggcacctgccgcgcaaccacaccgcatgcatggtgagctcgccatcgctcgatctgcttccatggcggagctcgacaaggcttcaagggcggcactattggtatttcttacgatcacagatagaatccgcaagcgcacggatataccaatgtagcacttcccctacggagtattccaagtgtatcgaatccaagggaacgtgtgtgattatcttctcgtcaggttcatccaaggacacaaagctaatgtgggcatagggcagagaggatttccgaatgagaaacagtgtctagggaaagcttaactttaatcgtaacgcaatacttcaggcactggcaacccgctgttcccagatgtcgctctactatgtaccaggacagggaggacttaagtgctcttgagggctgtcaccacctctacacccacctcaaacatactgtgggatacgctacacccacctcaaacatattgtgggatacgcagcaaccactagagattaattacccagacaccacgtttacgcaattaataactactctagtgccgatcaaacactaaagcaatcactataaataaatggactataatgaaccatgatcccgtatgctaattaggaactaaccaagaagtaattctcactaagcaaaccttaattactcacaatgatattttctattaaagcagagtaattaacaagatacaaaagtaagaggagattgccgacaactccgggattcctccgattacttctaccttaatgtaataccccatatattaaaagatttttaggttttttttgtttgggttgatgtcacgccctgaagttcccctcccttgctctaaattcataaaataaatcgtccgaagaaattgtttaatttaacctagagatgaatccctaattaataaatgcaaataataatcggaattggcatgtggaatttttcttgagttctacatgtcaaaattcactaacaggatttttagtgg

SEQ ID NO: 68908 - DNA, 4502 bp, Oryza sativa
gatgcaccgtcgcccgcgtcgccggccacagtcgtcttctcgccggccgccgccgtcggaggccgcttgccgccgccgccctcgccctaaccggccggccggcttgaagccgagccgagccaggccgccttcctcctttccccgtgagccgccgcccggtgggccccgcctgccagtacccctccctctccccttgtgccgctgaccagtggggcccgcatgtcggcgccgccccaccccttgctgacgtcagccctggggcaatattgcgcaataaatcgattaagggtttttcttttatagtaaaaacacagagaatcttctaaaaatcataactaattcatccgagctccgattaagtccattcaagtctcagtaaatcaagaaaaatgcaaagaatccattaaaaatggttttgtttcctgtttcagtagtcttatagcatgttttgcttgtgtgctttgtttgtcgcgtaggtttcggccgttccgtcgatccgcagtttctcgaagacgttgctgaggtctcatcagttcgagagcaaggcaagtcatgcaatacaattgatcatattgtacccaatttacaaatatcccgcatttctattaaatattgcattgttttacaatatcatgtgggatgggtcctattactcagctatatgttgtttcccttatgccattgataacttgggtattaaaatgactagatgttggtttaggagatgcttagccatgcttagttcaactagtgcacaaaaggggaccacattaaagcatagacttgattattggcatagctttggtttagtgccaccgtaatggtgttggttaattaaaatacattacatggtgggctgtgggtgcatggttttgctagacgtgcccatggcgattaaggaccggttcgcgggatgccctggaagaacttatcgtacttaccacaagccagcgtgggcaacggctgggcttgtagtgtagcttttctctagccgacgtacccaggcgagggtgggcgtgatggagttgggtcggccggggtgtccggttgatcggcttccggattcaccgcggcacgaaaggggggctgcccgttgcctgctggggacgggggcgaaccctaaggtgtggtgcgatcggttagagggggttatacgaagggtcctgtcacggcctctttccggtatgtcgtggtggcatgtcggcgcacgggaacgtgtcgtggggctgtgtcttgtgggtacagttgtacacctctgatcagagtaaaactattcgaatagccgtgcccgcggttatgggcggtcgaccagattcaccgtgattagtctcacccctagtttagcttaatgaactgattagttcaggtggtggtttgggcctgttgcaacgtggtgtaacgttggacagtgattggttaatatggattaattactacaactgttttactgctttcaactactgctttgaaatgccggctttatgcaaaagaacctttagcctcccttggatatatcttgcatcatacctcctcttccggtatgacttgctgagtacagtgggtagtactcagtcttgctctcttttcccccacaccagagttgaagtccttctcagttgaagatgtctcgaagaggttggtttcgtcgctgccgtcaaggatgcctgtggaatggagtcgcccgctgcaggagtcaagtcttcaggcttagctcgcttttctctttttccgctgcatttgtaatcttttatatttttgtaagacgtggatctgtatgtcaacaattgtcgtttgtgtaccctggctggtcctggacaggggtttaatgcacattcagcttagaaattctggttcgtgaatttctgggcgtgacaagttggtatcagagccgaccttgaccgtaggacaagccaaatggaaaccctaagagccctctgaaaccttttcatctgcatatgctttttgcacttggatttgtttcgggaaaaattttggggttttgcctctttggtttgtgggaaaaatcttggtcgttcattcggatcggatccttaaaattagctcggtctagggttttagaaaaattttatttggagtttatttgacagtcagtggggaatttatcgggtgatatgcattaggtcgtgtctatattcgatggggcaatgttacgcgcatcatttttcatgcatctagtttatgcattaagctatagtttagtcagtcgcattagtgtctttatccgggttcatgaaaaatgttctatgcataaaaatcatcatgcttggctagttgtttgggccatttgttgcttggtttaaatttggatttgagcatgcattgattcctatcccttgtctaccttagaagtcagacatgttcttcgatcgcaagcgccgctccaagcttcagagtcgccgcccttagctttatcgtcttcttagttttgtttgcttgctagtttccgtgcttaggtttgttgcttgtgggttagtcggcggtcgatatcatgtgtgagtggtatgacagcctttattaggagttgtgtgcctctttttcagtgttttaatcaagattaagataattgcacttaatcttataagaaagattagtttccgagccgtctgttttcttcctttctcttatttctacctatcctcctccagatggtgaagacaaggaatgatccccgtgactccaacgacgccagtggcagcgaagagcagaccgatggagctcatgtcagtggtgcatctggcagcagatcatctccaccgcccgaaaacccaacagtcactcaaatgatgacaatgatgatgcaacagatgcagcaacattaccatcagatgttgcagcaggcgcaacagaaccagcagtttggtcctccaccatcacacgtgtccaaactgttagactttcttcgtatccagccacccactttctcaagcaccaccaacccaatggaggccaatgactggctccgtgctattgagaagaagctgaacctactgcaatgcaacgaccaagagaaagttgcttttgctacacaccagttgcaaggtcccgcttctgcctggtgggataactacgtggcgacccgtctagatgcaacggaggttacttgggcagagttttgtcaaagcttcaggaaggcacagattcctgaagggattatggcacaatagaagagagagttccgtgcgctccagcaaggaaccatgtcagttacagagtacttgcatgagttcaaccgccttgcgcgctacgctcctgaggacgtgcgcaccgatgctgagaagcaggagaagtttttgtttgggctcgacgatgaattgaccaaccagctaatctccggagtctatgaggactttgagaagcttgtggacaaggctatccgccaggaagagcaacgcaacaaaatggaccgaaaaagaaaggcagctcagatcagctttcctcaggggaacaatcagaagcctcgcttcatgacgggacagctaggtgggccttccaccctgatcgtctgtcagcaccgtccctatcacccgagtaacttcgacaacgactacaacggtggcagtcacaacaacagtaagcagcacaaccacaactcgactccacccccactaatggcaccagctcagtcagatccgccagctgtgtcagctcagtcagaacaacccaagaagagggctgtaggaaagccaggaccctgcttcaactgtggcaagcacggccactttgctagcaagtgtccgaagctgaatcgcactggacccaggttcatccaggcccacgccaatcatgtgtctgcagtggaagcacaggcagcaccagaggtcgtgttgggcacgtttccagtgaactcatatccagcaacagttctctttgattcaggtgcctcgcattctttcatttccaaaagatttgctgggacacatggattatcggtagtggaacttaaaataccgatgcaggttcatacccctggaaatgatatgaggacagcacactactgcccctcggtgactatagagatcagaagatcaccgtttctatccaacctcatccttctcgaatctaaagacctggatgtcattcttggaatggattggttgaccagaaacaagggagtgattgactgcgcaagccgcaccatcaccctaaccaacgacaaaggggagaagatcaccttccgttccccagcgtcgcagaagtccgtagcgagtctgaatcaggctgctattgagggtcagacagaaacagtggagaaaagtcccaggaagttggaggatattcctatagtacaagagtatcctgaggtgttcccagaagacctcactacaatgccaccgaagagagaaatcgagttccggatcgatttggcacccgggactactccaatttacaagaggccgtacagaatggcagctaatgagctagcagaggtcaagaagcaggttgacgaacagctgcagaaagggtacatccgaccgagtact

SEQ ID NO: 68909 - DNA, 2017 bp, Oryza sativa
gctaaggtgttttccaagatagacctacgatcaggctatcatcagttgagaattcgggaagaggatattcccaagacagccttcaccactcggtatgggttgtttgagtgcacggttatgtcctttggactcaccaatgcaccggctttcttcatgaacttgatgaacaaagtgtttatggagtttcttgacaagtttgtcgtggtattcattgacgacatacttatttattcaaaatcagaagaggaacatgagcaacatcttcgtctggtacttgagaaattgaaggagcaccagttatatgccaagtttagcaagtgtgacttctggttatcggaggtcaaatttctgggtcacgtcatttctgctcaaggcgtggcagtggatccatcaaatgtggaatcagttacaaagtggaccccaccaaagacagtttctcagatccggagttttcttggacttgcgggctattaccgtcggttcatcgaaaatttctctaagattgccaggcccatgacacagttgctaaagaaagataaaaaattcaaatggtcagctgagtgcaaccaaagttttgaagaactcaagaagaagttagtctccgcaccagttctaattctgccagatcagacgaaagacttccaggtctactgtgatgcatctcgccaaggattgggatgtgtgttgatgcaagaaggcagagtggtcgcatatgcttcgcgacagttgcgcccacacgagaccaattatcccactcatgaccttgagttggcagcagtggttcatgctctgaaaatctggcggcactatcttattggcaaccgctgtgaagtttacactgatcataagagcctgaagtacatcttcacccagcccgacttaaatctccggcaacgaagatggctggagttgattaaagattatgacatggggatacactatcatccaggcaaagcaaatgtggtagcagatgctctgagcagaaagagctattgcaatgcagtatgtaccgaaggcatgtgtgacaaattgcagcaagatcttgagcacctaaatttgggcatcgtagaacacgggtacgtagctgccctagaggcccggcctacgctcgtggatcaagtcagagcagctcaagtaaatgatcctgaaatagctgagctgaaaaagaatatgagggttggaaaagctcgagatttccatgaggatgagaatggcacaatctggttgggagaaagattgtgtgtgcctgacgacaaagaactgaaggatctcatactcacagaagctcatcaaactcagtattcaattcatcccggcagtactaaaatgtaccaggacctcaaagagaaattctggtgggtcagcatgagaagagagatagccgaattcgtcgcactctgcgatgtttgtcagcgagtcaaagcagaacatcagaggcccgcaggactgctacaaccccttcagatcccggaatggaaatgggaagaaatcggaatggatttcataacaggtttgcccagaacatcgtcggggcacgattcaatctgggtggtcgtggatcgactcaccaaagttgctcattttattccagtacacactacctatactgggaaaaggttggcagagctttatctttcaagaatcatgtgtttgcatggggtacctaagaagattgtatctgatcgaggaagtcaattcacttcaaagttttggcagaaactgcaagaagaattggggactcgtttgaatttcagcacggcttatcatccacaaacagatggtcagaccgagcgagtaaatcaaatcttgtaagatatgttgagagcttgtgcacttgactttggtggagcctgggataaaagtctaccgtatgcggaattctcttacaacaacagctatcagtccagtttgcaaatggtaccgtttgaagcattgtacggacgaaagtgccgcacaccacttttctgggatcaaacaggtgagcgccaactgtttgggacagaagtgttaaccgaag

SEQ ID NO: 68910 - DNA, 1519 bp, Oryza sativa
gaccatacaggatcttggaacgcagaggtgaagtcgcttaccagctagagcttccacctaatatggttggtatccacgatgtgtttcatgtgtctcaactgaagaagtgtttgagggtacctgaggaacaagctagctcagagcacattgacatccaagaagatttgacctacgtggagaagccagttcgtatccttgagaccagtgagagaaggaccagaagcaaggtgatcaggttttgcaaagttcaatggagccaccactcagaggaagaggccacctgggaaagagaagatgaattgaaggccgcccatccgcacctcttcgccagctcttccgaatctcggggccgagattccgtttaagggggtaggtttgtcacgccctgaagttcccctcccttgctctaaattcataaaataaatcgtccgaagaaattgtttaatttaacctagagatgaatccctaattaataaatgcaaataataatcggaattggcatgtggaatttttcttgagttctacatgtcaaaattcactaacaggatttttagtggaattttcagagccttggaaataattttaaccaattaaaatgagcaaagtgcaatattaaatccctggaaaatcttttcttctttttctttttcctccttttttctctcttcttgggccgtcggcccagtccgttcgcctcccgcgcgctcgccctcctctcagctgggccggcccactccctccctcctctctccgggtcaccgacaggtggggcccacctgtcggccccttcttcctcctccagccgacggcaccgccgccgccgaaaccgccaccgacgccgccggtttccccgtttcccgcgcccactccgcccgtaccccacgcccacgtcgccgcccaccttccccgcacctcccgccagctcgcgcgcccgcaaacggcgggggatttgaaatttcccccactctctctctcctcctccatttcccccacgtcgccggccaaatcggccacctttccggcctcgtccgcccctcccgagcccatataaaccatccccgcactcccctccacctttttcctctttccgccgctctctcccgtgccctccatcactcccgcaccgctacacccgccgccgccgccttttccactcctccggtcgccgctcgccgccgctggagccgccgccgagccaatttgccaccgccattagcttcgccgccgccaaagctaccccggccgccgcatccccatccaatcccgccatcggggcccgcttctctccgcgcgccggtgagtaccaccatagccgccgccgtcggccatggctctcgctcgtcgtgggcaccctctctccctctaacccctcacacttcctctcttagggtgtcccggagctcggccgccgttcgccgtcgcccttcggtcgctgaccgtcgccgtttgccgtcgtttcctcccgcgccggccgaaccccggtgagaactccctctctcttcttcccgcgcgcgccgcc

SEQ ID NO: 68911 - DNA, 2364 bp, Oryza sativa
gaactgattagttcaggtggtggtttgggcctgttgcaacgtggtgtaacgttggacagtgattggttaatatggattaattactacaactgttttactgctttcaactactgctttgaaatgccggctttatgcaaaagaacctttagcctcccttggatatatcttgcatcatacctcctcttccggtatgacttgctgagtacagtgggtagtactcagtcttgctctcttttcccccacaccagagttgaagtccttctcagttgaagatgtctcgaagaggttggtttcgtcgctgccgtcaaggatgcctgtggaatggagtcgcccgctgcaggagtcaagtcttcaggcttagctcgcttttctctttttccgctgcatttgtaatcttttatatttttgtaagacgtggatctgtatgtcaacaattgtcgtttgtgtaccctggctggtcctggacaggggtttaatgcacattcagcttagaaattctggtccgtgaatttctgggcgtgacagttgacttgttaaaataaagatgttaacagaaaaaaataaaagaaaaatatttttagaagtgggccaacatgagaaggcccataaacccagcccattagttctcccctaaaacctagagagaggggaaccgaatcccacctcccctcatagtgccgccacccctctccctggccggtgcctccttcctcctctcctcctgtgttcgcatctctcccatctacagcaaattgctctccctagatctccaccttcatagcttggatcaagaagcgaagtagaaaaacggaacgatgaggagaggagtagaaggaggggttagaccggagtctcccctattgtctcctcacaagttctctaaagaaaccctaggtgaggcttatccccttgttgtatcagtttttctagcatggctttagtgcattaattcgtggttagggaaggctagagaaggagtttgggtatttgtggttcggtttgttgaagttctgcatgtgggcagatttgcagtgcttcagtgtttcgatgttttggggctctaaatgttgttttcttcaaaagtgtataactaggaagttgtatatatgttcggatatatcttctgaccaaagggcgcgatttttatctcaagtggtttaggagatataatttttttagtatgactgttgtttttgtgtcataatctggatagtagtagattgaactatttttggaggggctaaacagtagaatcagcccggctgcctatagacaaagttgtagaggtttttcttagctttccatattggtaaagtacaacctgattgggcgcgtagaactccagttatggttgttttagtgtggacagtctgaaattctggacagattctaaagcttgctttcaagcgcaaattagaccatttaaatagcacaataaaaatatgctttctacatgaaagttgtaggtattgctctgtagattttcaaaatttatacattttccgtcatagccttttcatatttcgagatataaaggtttgaagcagcagtcttgtgtataatccaagtggtgttccttgttattgagttttgatgggatggggcagtaggttcacctttttattgttttatacgcatgtttgaatgtgtttgctaaggttttgtttgtgattaggtggtggtccatcagctcgtgcatgataccaatccttcgttgaaggcaagtgtatgacgaactaattgtgtgattcatggattgtttactctatctatttatttctgatatatttcaacgtgataagtaactgcttgtattcatattattgttcatgccatttagatttcaagttgatcttatgtgtacgatcttattcttgttttaatattctggattctgattctgcttaaataattcaaattccctgcttgccatggatgtgtttcaatttggttctttgattccggtttcaattattcaagtaccatgtgtagtcatggtactgcaatttggttctttattcaagttcccgtggataagcgctgatcacgcttactcggctttgccggcaaatgttaggatgtattcactattgtccggaatggaaactactatttcaattcatgtctgcagggatgggaactactatctcctttgacttggtgtttggaaatgtgtttcctatcaaagaaagaaaatcttctgttcatgctttattgtcaatgatgtgtatatgtgttttctagttccatattgtacttgctgattatttttatactcttgtgttttatttggttttaggtacgcattgagaccgacatgcatgggcgggaagtagcacccttatattcacatctacttgcaca

SEQ ID NO: 68912 - DNA, 17575 bp, Oryza sativa
catggattataaggatggatcgtattatgggaatgatattgttattagtttaacttataattgcctgttgtggatgtccgtatttgcaggggtgactctgccgaaatttctaataattttggaagttagtggtttgagtgtttttttggtgtggcactctaggtacgtggttacctggggtgttacacttactctctcccttatcattcccataacaataaagtacactaggtcctcttgtaattcatcttatgctttggtgtgtgtgaatgagggagaggagaggggtatttataggtggagagttgccttgggagagtggagatgctccaagcatcctatgagcatattccttctagcttcatctcctcttgacaagtgtcctctctatgacggtttccaccggtagaaaaggacacaaccgtcattgggatgaggagtacaatcgtcataccgaatatgggctggattgggccagctgcgggttccgccgatccaggggttcggccgaaccctgattggctcccctggcccacatctttcttcaggatgctgacatgtgggccccacttcatgatgctccatgttttggtccaaataattgcacattttatatgttgtagcttaaaaccatgtgagttcatgagagcaaaatatgtttccattctttatgctcattctctcccaactttggtggttgatcacctgcatacaaatatacaccaccactcgtggaaattgttagaaataaatcctaccactatgttggaagtttcacatttgtggttttatacaggtattgacgacgttattttggcacttaacagccgtcaacaggcgccgtggagctccaggcggcgtgtctcccctctttgcgttgtctgccgcgttcatcggcatcagcacttgatgccttgagctgaccaactcagtggctgctggcaggggaagagaggtgaggaagatgatgaatcagtctgacatgtcactggtggagaaatgatttgtgctcccgattggtaaccctctgtaaccccggtttttcaactaggactatgaatccgggactaaagaccactatctttagtcccgattcaaatacccgggactaaagatcgatttttagtcctggtcaaccaggactaaagataaaatcgtctttagcccggattaatgttaccaaccgggagtaagggattttttttcttttttgttttttttgcttccactgctgtttttctatttccatctcgagcacaatcgcacaaaaatcacatgcataaatcatttacaaatcacgcacaacacacctaaatcatccacaaaaatcatttacaaatcatacacaacacatgcccatccacaatccacaaatcatccccaaatcaacaaaaaaatctacacatcaattcacaaaataaaaaaaagctccacaggaccacaaccaccacccgaccacctcccctcccggatccggtggaggagagtccgccgccaccctcgcaccgccctagtgccaccgccgccaccccgccggctagctcgccctgccgcctccccctcccagatctggcggaggggaggccgtcgccccgccgcttccccggccgcctcccctcccagatttggcagaggggaggccgccacccctcgccactttcccggccgctcggctcgccccgccgcctcccctccaggaccggcggaggggaggccgcccccgccgccccgccgcttcccttcccctcccactgccggctgttgctaagagggagggagagggagagggagcggcttgatatcgagagagggagaaaaatctctccgcagagagttgagagaggacaatgcggagagatttttctaagtgttgattatataatctggttggtaacagggcggggagaatgacgcagagagggctgatccggatttttcttttgtcccggttggtattaccaacggggactaaaaatagtataagcatgacaccagcctgacaatttgtcccggttggtaaaaaagtaccccgggctttttgaaccaggactaaagatttagtcccagttcttactcaatccaggagtatagtggattttggctgaccgggcaaagatggtttctccagtagtgagtgggacattaattattttcaaatatattttattgacttagatatgattgacacatcagcgccacattggcgaaaccacaatgtttcaaacttcgaacggttttaaaaattgaggggtgtattatacccggttttgaagtaaggggtgtatttcagacaaatgctatatagttgagggtaaaatggaccgaataaaatatgtttgtccgtcgctaatgacgtgcttaatgaatttacgttgcacaattaacaaaaataatccatataaatcgagggtacatttgcaacatttttttttggttttatttgccttttcagtttttttttttggtgttgccatatttctttgacggttgcactgttctccactttttttttcggtcaaatacgatgcagcgctgcacgcttctctcctgctgggcagacgacgcctgcaggctgacggcttttgtcagcggcccaacggcgtcgtcaccatcaccttgcgtccgtccatccggaacagtgcactagagcagttgaacagtgcggggttcctaaccacacagcctagcgctgcgaaccacaactagcgaactagccttatcatttccgttagatgtttggatcaataatgaccgcaaattcatagctgttactgcagctgaccctggaggcctggacgccccatgtcttggaaaaccgtgcacgctttgtatataatcacatgaagcccccgcgtcctgctagacccttctcacagcgccagattttgaagcttgcagcagatcgagatattcgagttgggtcgccagctaggtgcacttcaccacttccccttttctcatccacagatcgagttcgattaatttatctttattagttttattttgtttcaaagctaggaggaggcgctctccagttaaaatggttagtcttttgttttagttagtttctaacggcaaaacacccaacttatttgtcaaataattttcatttccgctggttatcaaaagagagaaaatacgactatacgagcatttgcgaatttaccacttttttttcaattttgcaagcatgccgctcgaacaacagttcaagttgaattttcgcaatgttctagtgacagtcttgcaataacgattcaaaacagtggcaaatttataattaccccaaaataagatgttgaagattcagcaggtttagtgttggccgaacgacagcgattcctcatagtaagaggaacataggtcatttacatataggccttggtagaatctctattgttagatttttttttctaaaaggtatatggaatttttatattgatagtattgatgtctaattcggaatttttgttgggatgatgattatatcattgttcacgtgaaaaatcatgtacgttgctttcttatggtctagcgagaattgttaagcaattaggagtccgactttcaccccaagttagcatgtgagggttttaaaaggatttcttatatgactccttatgtatttacaaaagtgaacgaacataaaaatagacttaaatacgaacggcatatcaaagtatcacagaaaccatctttaatttttgagcactgctcccgtccagcaaacggtaccccaggtaccggtaaccccaggtacaaaacttaatctgaccattgaattagagcggggcacgatcgggattgaacttaatgtagacccccgtttttataacggaatcactcatattaatagtaccatttccctggatcaagtagtctggtactcacggttacattgttgaattatcaagtgcgcatacaaagattgtttagcgcgaattattacatcataggcccgcgggcagtcttagatcataggactaaacggtccacaatacaaacaataacagaaataggtaaggcagcagattataggcagcggctatgccattgccacaggcaacgaccataactaagacctacagagcgccgtcatcctccgcatcctcctgaagataagcatagggatcctcctcgacttcattgccatccactgattaaattttgtaatagcaagagtgagtaccaaccgtactcagcaagccatcataacaacagtgcatatgatagtgtcggtgatatgggaccgggagtatcatggccagaggcttgaggcagacacaatcgcccacgtggcctggcaccttcggggacgtcgggcccgagggtgaggtgtccgccctcctcctgattccccccgagggggggtcgggttgcgcttgccccgaccccgagggccgaggcaccccgaccccttaaggaagtctgcgccacatatatgggataagtgagcacagctgtgctcacctaacagcatttattgcggtctggtcaagcgtgtcacgctgcatgcagcgcaatacagcgcgctcttttatccggtctgtgaccagtcacagaccggtcagatcaacggttaggtggcgactggcggtctgacgcacgcctcgccccgtcccgtcaagacgagtgcctctaggcacacgtctccagccggagctagcgtgttacctcttagagatggcacgttagccctggttagatgaataccaggcttcatcctaaccattacaggcaaggtgttacacgaagaagggcaaacatgcacgttgttaatctgacgcgtggtggacaagaatgaccggtctgacactggtcgcgtcagcaacgagcagccacgatcccacgttgcgcccgtctccgccgggagtggaggtaggtgtgggctgtcccatcgaagtgtgattcggacggcaaccatatcaatctccgttcgtaaagagaaggaaagtccagtttggaaagggaagggtgcgtgtggtatccccttgaagtataaaaggaggaccttgcccacagagtagagggttgattctggcgagattgagagcctagaacaagggagagtttggctcacactttgtagctcattcatacacaaatccacaaaaacacaggagtagggtattacgcttggcagcggcccgaacctgtatacatcgccgtgtctcgcgttcccttgctagcagacaatctttccacatacagagagagcttgagatctcaccctaagcccccggccgaaccggcaaaggggggcctgcgcggtctcccggtgaggagccacgagctccgtcatctggcgcgccaggtagggggctcagcgtgtgttttctgagctctcagactcttccgtgggcgccaagtttcccttgttcagcctaatggccgagcgagcaaaggcgcacgacctctctccgagtgtgagcggcgacgacggggagctgaatccacgccgtcgagctcgtactcccccatctcctccgcgcccaagccctaagcagggggaggcgcttgagaaggtcgacaagtccatggcatcaccagtcgcaggtggtgcaggaggacggcaagatggggagcgccgcctcctcgtctacggcgacggcagcacgcctcagggtgcgcttcaggctgctggcgcgctcctacgacatccgcctgtcgtccatgacccggagtctccagcccaacgatggctggaagatgtggccaacttggtcatgacggcacagcagcgcctgggtgctggtggacggtccgccaccaccaagacctccggtgccgctaccaccggctccgtgtcgtcaaggcggagggcgcggcgagcggcggcggctgcacgtcattcggctgctactccctcgtcgacaccttcgactcgggaggatcagcatggggagccggatgcccgcctcaacatcgagcgccggcgtaatagccggcgtaccccccgtgcaacggagggtgcctcctcgtccagagtgtcacctcgacatggacgtgaggaccagccctccgtgcctccggctggtggtgttggctgtagagcctttgtggcgagtcttcggaatgtccgttggcccccaaggttccggcccaccatcaccgagaagtacgatgggagcgtcaaccccaccgagtttctccaggtctatacgaccgggatcgaggccgctgggggtgacgacagggtcatggcgaacttctttcccatggccctaaaaggacaggcgcggggttggctgatgaacctgccacccgcgtcggtccactcctgggaagatttgtgccaacagttcaccatgaacttccaaggcacatatccgcgcccaggcgaagaagcggacttgcatgcagtacagcgaggcgatgatgagtcgcttcgctcgtacattcagcggttttgccaagtccgcaatactataccttgcatccctgcacacgcggtgatctacgcgttcagggggggcgtgcggcacaaccgcatgctcgaaaagatcgcttccaaagagccccagactaccgcggagctttttcagctcgcggaccgagtggctcgtaaagaggaagcgtggacatggaactcctccagttccggagtggcagcttcggccgcccccggatccgccgctcagacagggcggcgtgacaggaggaggaagaagaggtcggaccgttccggcgatgagggtcatgtcctcgccgtcgagggcgctccgcgggccacccgaaaggggaggcctgcgagcgacaaaaagaaagaggctggtactcccagcaaggagcgccccgccggcaggtggtgctccgtccacaacacctccctccacgatctcgcggactgtcgcgcagtcaaaaatttggctgagcgaacgaggaagtgggaggaggacaggaggcaggaacgccgtgagggcaagtccccggcggttccttccggcaaacggcgaagtgaggccaagcagaaggcccccgctgttgacatcgatgatggtgatgatgacctaggtttccaagaacctggggccaccattgccaccgtcgatggaggagcgtgtgctcacgtctctcgccggagcttcaaggctatgaagcgagagcttctggccatggcccctactcatgaggcgacgcgtcgggcgcggtggtcggaggttgctctcactttcgaccagaccgaccacccaccgtgcattgcccggggagggcaggttgcgatggtggtttcccccaccatctgcaacgtgaagttgggacgtgtcctcatcgatggaggagcggccctcaacatcctttcccccgcggcttttgatgccatcaaggccccggggatggtgctccgaccgtcccagccgattatcggtgtgacgccggggcacacgtggccattaggtcacatcgacctaccggtcaccttcggtggacccgccaacttccgcacggagcgggtgagcttcgatgtggcggacctcagtctgccctacaacgcggtcctagggaggcccgcgttggtgaagttcatggcggcggtccactacgcctacctccagatgaagatgccgggccccggtggccccatctctgtccatggcgatcttaaggtcgcgctcgcttgcatggagcagcgtgccgaccgcctcgctgctgcatccaagcccgagggtggtgacgagaggcctggcccctctgcccccaccgccccgaggcagcggatcgctacatgcgacgaggtcccggtcaaggaggttgccttgggcgacggcccatccaagaccacacggatcggtggtctcctggatggcaaataggaagacgcgctcgtctccttcctgcgggcaaacgctgacgtcttcgcatggagaccagcggacatgcccggggttcccagggaggtgattgagcaccgtctcgccgtgcggccgggcgcgaggccggtccggcagaaagtgcggcggcaggccccggaacgtcaagtcttcatccgcgaggaggtggcgagacttctggaggccggattcatccgtgaggtcatccatccggagtggctggcgaacccggtggtcgttcccaaggcgaacggcaagcttcggatgtgcatcgactacaccgaccttaacaaggcatgtcctaaggatccttaccccctgcctcgcatagatcagatcgtcgactccactgcggggtgcgaccttttgtgttttctagatgcatactctggttaccatcagattcgcatggctagggaggatgaggaaaaaactgcgttcattacccccgtaggaacctattgttatacatcaatgcccttcgggttaaagaatgcaggtcctacttttcagcgtactactcgaatttctttgggtagccaaataggacgtaatgttgaggcgtatgtcgatgacttggttgtaaaaacgcgcaaccaagaaactttactttcagatctagcggaaacttttgagaacctccgctctgcccgcataaagctgaaccccgataagtgtgtgtttggtgtacctgcgggcaagcttctcgggttcttggtctctgcccgaggcattgaggccaaccccgagaagattcgagctatcgagcggatgcgcccccccagcaaacttagggatgtgcaatgcgtcaccggttgcatggccgccctaagtcgtttcatatcaaggctgggagagaaggcgctacccttgtttaagctcctcaagcgctcggggccgtttacttggacggaggaagcagaacatgccctcactcggttaaaggcatatctcagctctcccccggttctagtcgctccagagccaaatgagtccctgctactttacttagcagcgaccccccaagtagttagtgcagcgttggttgtggagcgcgatgaggacaatcctcatttcgtgcacccccattctgtgctaacttggcccgggagcaagcagggaggagaggcccccgagtcaaacggtggcctaaggcccctgacgaccggagacggccctctgcccgctcgtcagacggtgctgggtgcccccgaccctcaggaaggccccgaggccactgcgggaaggccgcacttaacgccctctgaccccgaggctaaccctgtgctgactcgacccgggaaagagcagggagaagaggcccccgagccgaacggaggccagaggcccctgacgaccggagttggccctttgcccgcttgtccgacgatgccaggagcccccgacccccaggacggccccgaggccactgagggaaggccgcccctttcatcctccgaccccaaggtcatcggtacagaagacaagtgcgccccgaaaggccacttgaacgaagaacgccccggggatacggcccctagcagagaggatcggccccaccgaagggtgcagcggcctgtctactttgttagtgaggccctccgggacgccaggacccgatacccacaggcccagaagatgctttacgctattctgatggcctcgaggaaactgcgccattatttccaggcgcatcgggtcactgtggttacgtcttaccccctcggtcaaatcttgcataatcgagagggtacaggacgagtggtaaaatgggcaatagagctttctgagttcgatctgcactttgaaccacgccacgctatcaagagccaggccctcgccgattttgtggcagagtggaccccggctccagagaccgtctcaatgcccgaggccagcacgaacccctcacagctgcctcacgccgcccactgggtgatgcaattcgacggttctctgtctcttcagggcgccggtgcaggggtcacgttgacctctccaaacggagacgtcctcagatacttggtccgtctcgactttcgagcgactaacaatatggcagagtacgagggactccttgccggactcagagtggcagctggactggggatccgccgcctcttggtgttaggcgactcccagctagtcgttaaccaggtctgtaaggagtaccggtgctctgacccgcagatggatgcctacgtgcgccaagtacggcgtatggagcgccattttgacgggatagagcttcggcatgtgcccagacgggataatgtgattgccgacgaactctcacggctcgcgtcctcgcgagcccagaccccaccgggcgcctttgaagaaaggcttacccagccgtcggcgcgacccgatcccttaggggagacggatgtgcctgaccggcccccgaggcccgtcggagtccaggcctcgggacccgaagggagcgcttcaagctcccttagattgattgcttggatctctgagatccaaacatacctcacagataagactctacctgaggaccgcgaagggagtgaacgcgtacaacgcatttccaaacgctacgtgctggtagaagggaccctctatcggcgcgcggctaacggaatcctcctgaagtgcattcctcaggaacaaggcgttgagcttcttgcagacatccatgagggcgagtgcggagcccattccgcctcacgtaccctggttggcaaggcctttcgtcaaggattttattggccgacagctctcaatgacgcagtcgatctggtccggcgatgcagagcgtgtcagttccacgccaagcaaatccatcagccggcccaggccctgcagatcataccactgtcatggccatttgctgtctgggggcttgatatcctgggaccgttcaaacgggccccgggcgggtttgagtatctgtatgttgcgatcgacaagttcactaagaggcccgaggcttatccggttgtcaagatcgataagcactctgctcttaaattcattaagggcatcacggcccgttttggagtgcctaaccgtattattacggataatggcacccaattcactagtgaactcttcggcgactactgcgaagacatgggcatcaagctctgcttcgcctcacctgcccaccccagaagcaatggccaagtggagcgcgccaatgcagaaatcctcaaaggccttaaaaccaagaccttcaatattctcaagaagcacggcgattcatggatcgaggagttgccagcggtgctctgggcgaaccgaaccacaccaagccgagcgaccggggaaacgcctttcttcctcgtctacggcgcagaagcggttctcccatctgagctcaccctgaggtctcctcgggccaccatgtactgcgaggctgatcaagatcagcttcgtagagatgacctcgactacttggaagagcgaaggcggcgcgcggccctccgagccgcgcgctaccagcagagcctgcggcgctaccatcagcgccacgtccgggcccgatcactctgcgtcgacgacctcgtcctacgccgcgtccaaacgcgtgctggattgagcaagctctcaccaatgtgggagggtccgtatcgagtgatcggtgtcccccggccgggctcggtacggctggccacgggcgacggcacggagctgccaaacccgtggaacatcgaacaccttcgtcgcttctacccctaaaggggggggggtcgggtgtcagattttggctcgggccaaccccacacccccctcgggtgtgcaggattggccgggggctaccacacatgcacatatattccctttttccttatttcagcatttcaatagaagcagtttcaattttctaaaggttgtgtctgtgccgtttttccttctgaagaatcttaacttgaaataaggtcactcgtgctcaaccttgccctagggggctcagttcggtcagctaaaatcgccaaacggggcccagaaccgagccgtgccccggggcgtggtgaactccgggggggaaccggcaaaaacccacaatcgggtcacccatacccctcggtcaccacgttcccggcctggccagtctcgacatgtggatctccccgggcactggccccgacccgagccattcgaggactgggacttgggcacgagcccttatttcaagctaaggcgcaaaaggaccatggcacagatcatcctcatcgcatatgtatagcaaaataaaactaacacaaaaatttttcatcatttcatttctgattgcagattaagttaatttgtacaaaaaagaggtatgaaggccttagaagaaagaaaaagaaaaaaagattggcgggggcctgggggctcattccaatgcgcccgggtcgccggcctcgtcgccgccgtcatcctcatcgctggcgtcgctctcctcgtcggagctgggggcgaacgcgagcagaggggccgacccctcgaagccgtcgacgatatggtcggcagcatcccggacgcgcgcgcgcgcgtcgtcctcggttccgggagggaactcctccagcgccatccagggagagaagtcggggtcccgggcctggtagctcgccagcacgagttcgaccgccccctgggcgaggtccctcgaggatgacttgatggtcttctcgagctcctcggggagtcgttcgaggacccaggccatcctgttgaggtgcggagcgaggccttccaggttgctagggcgcgtcctcgtctggcctttccagaggcccgcttgccgaccggcgcgatccatgcgggagaccgagtcccaaagcatgtcgggccccatctcgcccgccaagcggagggcctcggcctccccgatggaagaatccagcgcgcgctgcatgtcagcgacggtgtgttcggcagccgcgaggcgagcggctaagtcgctttcgcccgcagccgccccaccgatgcgcgccctcgcggccagctctttctcccgtgcctcgaggttggcagcccgctgctccagcgcggctctctcggcacggacgcattcaaggttgcggcgcgcctgctcctcttgcgccgcctcgtgatgaaccctgagttcctctcgacactcaaggttgttgttggcccgatctttcggtgagttgatgaaaactacgatttggaagaaacgttgacgacccgactacaaccgtacaagacgttgcgttgcgccttagcgatcgatacacctctccgtgggttgttgatcttgccggtgcaaatcaaccttattcctgcaagcaaatcgaagaaacaagcaagaacaagataaaagcaatctgaattgcaaataggagttaaatacgaatgataagttggggttccgaagaacaagcagacggacggtctagccgacacgcgcgctgcaagcaagtagcaatggctaaactttaatctaacaaaacccaagaaaccctgaaggggtacctaactatttatagaggtgggaggacgaccaagagggtccaagggtcgtgctccaccagattggggcgcaccccacatgggcctcacatgggccagggtcccaaacaaagttacaagcccattggcccaatacaggagacgcagcaccttggttttgtgattgcggccaaacgagatagatttccgagatgaggctggatccgttggaaggaggacttcgagagctttccatcaagtactcacgggcccaaaacggagcacgtatgtagatttggcggccgtttgaagtcagcaatgtaacacgtggccgaatcagattgcagcacatggaggacttgatcttgatgtcttcttgttgtttcatgatgtgagcaatggtcgtatccatagtagccatggtcacatcatcctccccttcttcacagaaaaccgtcctcggtttttccatatggtgctcttcgcgcagtccactgaaaacaacctgtttcttgcaatcaaaacaagacaaactcgagacaatatgattagcagtaacatgtctctctagcttgcatattttatccggaactacaagatgttctaaatctgaacaaatgtaaactctatgcaccaaaaatattcctctatcattatattcgccaaagatatgaaaaatagcattagttggacatggcaaatcagatttagcaaataatttctccttcaaattatcgagctcacaaaaatcatcaaactgaacatagcccaaagtatttaaagaagatagcaattcgcgttcctctacttcattagcaatgtgaacaacatgcttagaatcagcacacaaagaaatagtagaactaacatgttcattcactagttgtggcatggatataagtgaaacattatcacacaactcttctttatcacaagaaacagcaagtaaatcaacttgtgacaaaggcaactcagtaattgattccactaatggttgctctactatagcatgaaaagtggacaagtgtagctcaccttgagaatactcaccttcatttctctcagcaccatttaatttaccttgcgaactttcttcagataatgtagctgcatcagccttctcctcattcgcgagtgatggaagtgacatctcaaacatatcgttcttctcattttggagacttttctgaacttcctgcaaaacatcagtgataggaggcacaagcatatcttgttgctccgttggattctccaaaattttgcgctcaacaatgcaagcaagcatgaacaattggcctatatgattatatgtcacattaacaagcccagcctgaatattgaaattaagccctctgaaaaatctagtcattgtgttctcattagattcttgtaaaccactataagtgatacaaattttaaaatcatgaaagtactccctaacagttttgtcaccttgttttagatgttcccatttctcaaggagagcacgtctatagtatgaaaacacaaatctttttctcatcagtattttgcattcatcccaagtttcaagcttattccccacagtatgccaccaaaaagatgcagaaccggtacacttattactagcagccttaatcatttgagcattagaaaaatcatactcatcaaattgtttttctactgctagctcccaattaatgtatgcagcggaatcatactttccatcatagactggtaacttacatgcaacttgtgcaaaattatagtcatgtacctcatatgcatcacgtgaagaagttgtcatatctcgtcgaaggtgtagatgttgacgttgagcatgaccatcttgtttccccttgcgcaatcctgccatggttagcagcaaacaagaaacatacacaagaatatacacgctcctatcaactattaggtactggcagctcaaatgtcacacacactcaagcttttaaccaagctcttacaagatcttaccaatgcaagtggaatggtgatgtacaccgactcaaccaagcagcccaatagaggttggatatatcgatgcctcggcaaacacttgctgtacggctgcaatcaaatctgtggagctctgggtaggcttaaatatgtagcaaaggaatagcaaatgctcaaatcagagaacgcaaagttgaataattgttcaaagtcaagtaccgtgctggtcctaggctagaacgtactagagacgcgagcctagacacaaacgataccacaagatagcactaggaacaactcatgcacaactctgatatatgaagttcagctcaaacataacagtattttctcttttctttctttcttctttcttcttttctttttttttttctttccttttcttttctgttttttttttggtgcggctttttttttctttttttttgcacctttctgcctttttttcacttttttcttgattttttttaacaaaaactgactcaaggaccttaatgtaagattacagggactcaaacataaatataaaatttatagggactcaaatgtaaaagtctaaacccaaaattaaaattatacaaaaaatggaatgctgaatttatgccggttccgtttttccaaacagatctcgaaaccgacaccaaacaaaaattcgccaaggtgtttgacacaactcggaacggtggaagagagggagggagtcggactcggccaaaggggcgagtgggactcggccaggaggtggagtggatggcagccgaatttggtgtatgggataaaaaggaaactgatttttaaccaatccaatctactatatctttccaaaacaaacttgactacttccaaaatcagatatggtaattcaccttcctcctctcgtgcacgacacaggcacggccaaaacaaacacacacaaggatcggcaaactctagatgcaactcaagaactccaaaactaaccgatagaaacgtctgaaaactacaaaaatagaaccgtggcagcgagccgattccgttttcgtaggtcccgacaacaacagagacacggtggcagcgacgactgtggtacaaaacgtgaccagaactcgaaactctaaacgaactagacgctaagaccagcaacacgacgtgacgatgcaacacaaaattcaacaaagcaaaaactgaaaagaacaatgcaatggcacaatatggctaggtaaatgatacgaatttttttgtatggctattttctggttataggaagataaaaactcaccgagcaacgaaagctctgataccacctgatgaaccctgagttcctctcgacactcaaggttgttgttggcccgatctttcggtgagttgatgaaaactacgatttggaagaaacgttgacgacccgactacaaccgtacaagacgttgcgttgcgccttagcgatcgatacacctctccgtgggttgttgatcttgccggtgcaaatcaaccttattcctgcaagcaaatcgaagaaacaagcaagaacaagataaaagcaatctgaattgcaaataggagttaaatacgaatgataagttggggttccgaagaacaagcagacggacggtctagccgacacgcgcgctgcaagcaagtagcaatggctaaactttaatctaacaaaacccaagaaaccctgaaggggtacctaactatttatagaggtgggaggacgaccaagagggtccaagggtcgtgctccaccagattggggcgcaccccacatgggcctcacatgggccagggtcccaaacaaagttacaagcccattggcccaatacaggagacgcagcaccttggttttgtgattgcggccaaacgagatagatttccgagatgaggctggatccgttggaaggaggacttcgagagctttccatcaagtactcacgggcccaaaacggagcacgtatgtagatttggcggccgtttgaagtcagcaatgtaacacgtggccgaatcagattgcagcacatggaggacttgatcttgatgtcttcttgttgtttcatgatgtgagcaatggtcgtatccatagtagccatggtcacatcacctcgcggagggagaggctgttcgccagccgttgcgtcgtggcctcggcctcctcgagagctcgctcccgctcagcgagtgcatcctcgcgaaggcggagcgcggactcctcctcggcgcaggcggcctcgtgcgccgccagcgtcgtctcccggagagcagtggcggcctcgcggtccgtgaagcccttctccacggtgccggcgtgttcttccagcgccatggcacgggcctcaagggcctcctcgcgccgcgggacgccg

SEQ ID NO: 68913 - DNA, 2260 bp, Oryza sativa
ggcgaacccgggcggcctcccgggcggcctcttcagcttcccgaaggcgggctgcggcttcacgccggtcagactctcgcctccgctcctctgcggctgctggatcttcggcctcggactggccggacttggggtggcgggaggaatgcgacgggacatcgctgaagcagaagaaaaagccagaagacgaacaaagtgagcaagaaaaaacttctttttggagaaagatggttgcaatgagagtgagacgaacctgcgagggggtcggttgaatgaccaccttggaggggaaatcaggtttccccggcatggttccgtctcccccgtcttacggagccgcttcttcttgcgcaccccctcgggctgcgatgtcggcgcggccccctccgggcgccgactgctggcacgcaccgccccgccccctcggggaggagatggcggaggtgttcctcccagcttcctcttcccctgggcgacggcagggcggctgctccccgagcccccgacgcggggcccagaagcacgaccccctcctggggcaggttgttccccccggcggcgctcgcccgcgccgtcgtggcccttaggggctctctcctctgaggccccgacccccatcataatggttagaatggagacgcggtcgggatcgctgcagagggggaggatctcttgaggaaggcgagacgcctccgcggagctaagattcagcaccctttggactacgatcttgaagtcctcgggagcccaatcccatctggctccctggtgggtccgcatgtagtcttcaggcccagtgtactcccaggcgctccgggcgcgccgttggagcggcgcaatccggcgacggagataatcgccgtacaccatggccccggtgagcccctgggatcgcaggcccgccaggcggtcgaggacggcgtcgtagtcctcccccagatctaccggcgcccgccagctggagacctgcgccgggggctggcttggaagtcggaggcgcgcttcgtcggcaaggggggtgtagaaccggtcgctcttccagtcgtcccacttcttgcggaggacgcaggggatgtagcggttcaacactggcccccgcggctggaagtagcagccgccaaccgctgacggcggtgacaccgactgcacggtgaagaaccaccggaacagctgaagagaggggcgcaccccaatgaacatctcgcacaggtgtgcgaagatggccaatgtcatcaccgcattgggggtgaggtgcgccatctggagatcgtagaactccaggacatccatgaagaaatgagaaaatggcgggaccagcccagccatcgcgaaggggaggaagaagatggaccgccccgggtagtctggtgccgggcgcccctcgcccagcatcactatctcccgaccggtggcggactccggcatgaagcggcgcggcagtccggcgtgcctctcgttcacgatgcgggaaggcggtagtacactgccatcgagcagagcagagccccgtgccatggcggtggaggaagagatgattgggaacgagcgcgtgtggcgaaagtagggcgtagcagagaaagagttagagctcaggcggcaaaggcaagaggaacaatggcgaaaggaagggagcaaatccttttctcgatgcttttatacccttgccatcgctgggcctggctcctcgtttctcgcgcccactacctcgctccctcgtatctcgctatcccgctccctcgtttcctgtgcccacgcttccactaatcccattcgcccgcttacggcgcatgaagtggatatgcggttgtggcaatcgaaacggattgtatcgtgcgcgcgttaattacgctcgccaaccgaagcggcgttaccgtatctccgagcgagacaaatctgctcacccagattcgcgcgctgctcaagtgatgtggcagtcttgaatagaccgcccattatggacaaccaaagttaccaataccaatgtgcatggattgagaccgttgggtattttgcccaactacggagaccggtcccacctgtcaccaggctttaggggtggcgtcacacctgaccgcttcccttgggaagggaaattgctctggcataacgccgggggctactgtcggtgatatgggaccgggagtatcatggccagaggcttgaggcagacacaatcgcccacgtggcctggcaccttcggggacgtcgggcccgagggtgaggtgtccgccctcctcctgattccccccgagggggggtc

SEQ ID NO: 68914 - DNA, 8913 bp, Oryza sativa
gccgttggtttatttgcataaagctagtttcacaattcttttcacaagcttattatctagcatagactagtccagttttaattccagtatttattacacagcaacggttcttttcaccatccattgtcttcccaaagatggcttcccgttactggctgtaatggttttctggggtttactccttctcgtctctcgagaagatgatccaccagtataaaatcatcatgcatatcccatctcattcaatttaagaatttatagtctagccaagtgtaatacatgtcctgatgctcaatatccgcgagcacggctattcgaatagattggttttactcacactgcagtggatgtacactttacccgtactccgcgacttgcccaacacatgagcctacgtcccaacgaatgagacttgccaaggcaaaacctttcaataacctcacgttggcagtacccgctccatgaacttgcatcctcatgcactccatgaacttgcatcctcatgcactctaggtgtcatgagtttctagcagtgagaggagttctggcgctcccgggaagggaagactcacacatgcattaagttttagttaaattaaatttacacatggcagtcctaccgatggcggcaccactataggcactcgcccctcgcggccccaccaatggctgtcccatcgtaggccctgactcccacacaccaagaataaccactatgcagggatactgccttcgctcggctacgtactccgctaggtctatacccatacgagaagtacggttgtacgagggtcgtttcatgcttaactttacggctcggtccttaactgaccagggacggcactagccttttctggacaccacccaagtaccccagccgccccggtcgaaaacagtgtttagttttgtttctcttttcacaattcatgttatccttgtcatggcaatgtggtgcccatgcctccacatgccgcatctcaactaccttccttaaggtagttgcccaagcatatagcacttgataaatatgagaatgcatgattctaattagcatgactaagcatttgttcaatatcgactaagtacacacgttagcagggtttacaatggtcatacagataatcaatatcaaggcatggcatatttaacaagtagggcattcatattcacatatgtatagcatgtaattttatttaaatcaacataattttcgcaataggttcaacatgctcaaagattagtgatgacttgccttgatcgcagtcttgctatccctgctcctcaatcgactcaacaattccctcggaatctaaatttacgtgcgaaagatcggatttgaactcaattagaattcaaataaattcaccaaaattcaaacagtacaaagcatattgagaaaatgttatcaccagatagatcttgattttagatgaatttaggttcaagtttcattcaattccgagttaagatgagtgagttatgcttgtttaaagattcaattttgaattaattcaaacaattgtgaaatggcactgtgcagccgagaggggcattattacagtggctgacatgtgggccatccccctattttatttctggtttttatttttttaaaggaaatcctattgtgtcattgacaggtgggtccggccccctgttgaatctcctgtgggacccgcatgtcattgagacattcacttaaaacctaatttaattagatttctaagcatccgggcctacatgtcataggttcataataatatcattagttttagggattactgtacactaatgaagtggggtccacatgtcataatctctccctctctcgtgccttctctctctcccgtcgtcttcttcctcgtgctcgcgacgaagcagaggagcggcgcgcgacggtacgacggcccgagccggaacggctcggcgcacggtggggctagcggcggcgcatcaccggatgcccgccggcggcggcggcgaagcgcggcgaccgtccggcgcacggcgcgacggcgcgcgacggcgccgagatcccaaaatcggcggcggcacgatgaggaccaatgtgagcgcaaccaacaacgattcaaccatctagggtccacatggagtatatagaagcaaaaatctagcctaggttgtattggaacgaagtccccccacggtgagctcggccatggcgcggcggcggccggagtcggcacggttacggcggcgcacaccccaaatcgagggggccgttggtttctaggtgaccaggcgggactacaggcgcgagggcttaccacgaagtggcggaacggcgaagttcgacggcgagtggcgcggtgcggtcgaaacaggggcagacggcggtcggcgacggtcgcaagtgttcgatgctcgtactccctcgcgtagcggctcccggctccctccaacagcagcaacggcaacgggcacacctcctcaacacaccccgccacccacaccggccgagaggccctgcggcggcggcgcaacccccgcccaccaggtgttcgacacccggcggcggcgcgattttgttttctctgggatggagcaagaactccgggaaaggggagacgaatgagggttcgattttggataaggtcgagctaaaggcgagcttataacagcgagagggagggcgattcctattggataagatcactcgatgactcagccatgtttcgatctctcctaggttcgattcaatgccttgggccggcatgattgcctagacgatagggtcccaggagagggatcattagctgtgggaggaaccccccctattatccagcggtctcggtggggtgcgacaggatggcgacgcgacggtgacaagagcgacggcgacggacagagataacgacttggatagggggcgccgggctatgccctagggtgacgcggggttgtcgtggcggccgttatcactccatcccgagggcgacgtgtgaggggacgggatgacgcgggcacccgtggcggcgcagcctttggcgcgggcttttggcggcttggtcggcggcgggcccacgcggcgtggcatgacgcggtgcggcgcacgggcacgactagtgcggcgcacgagtcggaaagcaggcgcgcggcacggcagcggttggagagggcggcgtcgggtgttcggtcgggttaggcacagatcgaacacctggcgcgcaatgaacagtagcgccaggaaaagaaaaaggaagagaagagaaaggataaggaaaaaggaagggctaatctgcaaaatggcttggaattgagttgtaactctatctattttggattcaagaattcaaacatttgatttgaatatttatttggttattcattagtccccaaatgaatttgcttcccatcatcccaaatacaaatattttaatttgcatttttatttatttattcatatctctaccaaatgatattactctatattggattattccaaaattaacttaaataattggggggttttgatagtcctaaaattaattaaaatattcaatgggtccattattaatacaatagcacattggttgaacttatttgcataacaaggtattcatgtaaattgtaattattatttagatgcgcgtctttactttgatttttccattgagatgatttatagtttggcaagcaatatcaaccataacatccatcatgatgcaaagttttaaaaagtttaaaattttagtgatttttattatcgaggatttttaggatgttacacttaatctcgcgaggactcagtctcctgccacgcgttgcatccgcatctgaagtctacgccgcgtcaccgccgcaatcctttcgccctactccgacgcggtgtccaagtgccgtcctcttccggcctccgatgcggtgtggcggctcctcctttggccgcagcttttcccctcccctcggtcccctcctcccctacgcctctcggctgcccctgtgcggtgcggcagctcgtcctttgtccatggccacaacttgtcccctcccctccgtcccctatgcatctcggctgctggcacctacgcagtctccggcacaggatcacgataccctgagtttctttatggaagatgtatgagagagatgaagtatttctttcctgctggacattgctttgctgctatattcattggaagaatctgctatgttgatgggagaggctgagtttgatttatgttgtgtgccaagttctggacctagttccttgtcttttgatatatgtaatgaacctacttgattttgctgaaagtatgaatgtaataatagtaaaaaagaagtagatgttctgaaagtttgtagtttcttgctctgatgtgtaaactgttctttcgttgtagaccttaaacttactgtttcatcttaaacaaaattaacatcagcggtcattgaacaaattgtcaactatcttgaataaaatggacactattacaactagtgatcccacaaacaaacttctgaaattcttcgatctcttttctttgcttgcccaatttcttcttgcttgtgcgatccatggccaaaagcctttcagccatctcaatatctagcttcgttttttcttctttctgtcccctccttctagggttgctagtgctcgcgatccaatgcataccacagcgatggcgattccacgaacaaaggcttgcgatggcgtcggcggacgagctgccgaggccatattcgccacgctgagctcgtcgccatggtcacctcttcttgttggcgcattgaggttgtcgtcatccagggatagaacgactcccagaagtcggcggcggccagacctggaccggctataggaagggcaagttgggaatgggcaggttggcgacggctggttgcagtgagggaggaagcgaagtccggcgagattggctgcgccgctgctagggatgacggaaggggatcgggaagagacagattaccgggttggggacttgtaccgtctctacaaaaattgactaaccacgcgaaaatccaattctgcccttccaccagttccatacacgtgaacaaagggggaggtaccccgcaccggattcccgtaactcgcggtaccgacaattgtgggtcgtttgatctggctgaatggacggttacgattgcagtaccacgcggtaccaaaaattctgctggacagtaaaaattctcttaatttttataattgtagataagtagagatagagatagagattgaccggtctaacaaaaggtgtagacgtggtacacttgagcgcgtgaaactccatgatgataaggttcgattgttaaaatcctaaggcaaccaagattactatttaatatctattaaaagaaaattacatataaaaattttttgaaaattttatatagatgtagctgtgcaatttctcaattggttagtttctttacagctaatccaggccacccatgttcaagtcctaaacttattagcatttacggctaattattttttcagtcgtagtcctaaacttattagcatttacgggtaattattttttcagtcgtagtggtaggtgatctaccgtcgatagcaagatatccgtggtgacgtcatcaattttaaaatatgttggtccggtatttcggaggtgctcataggggtagggtatatacctgtgtatgtttatagggatgagtatatgtgcctgcatttgtattttgtttcttaaaaacatcatcaatttcgagatatgctggcccgatattttgtagatgctcatgtattcatgcgggtagggtgtatctgtgtatgttcgtatggacgagtatacatatctacgtttttactataccaatcaggttttgccttcaaacctataccaataccaatcagcattggattcgtcagcagatgtgttgatttgcataggtgaccgtctacacggaggagttagcactagtccaataacgaatttcccgtgcggtcgaaagtgattttcgcgtgcggatcttccacccgtctgtaacgaagtgcctgcaaaaattgctatttttgcgtgcgggtggcgcacccgcacacggtggttatgttgcccgcacgtaaaaatgaaaaaccgaaaaaaaatccaaaaaaaaaccctaaccctaaagttgctgccgccaccctcctcgtggtcgtcctcgtcgttgtcgtcatcgctgttgccggatccgccgcctccccaccgtccgagcccgcccacccgccgttaccgccgtgccggccaccactgccgccgcatcctggcaggggacggctaccgccgccagatccgggttgggggcaggtgcctccgccggatccgggcaggggccggtcgctcgccaccgtgcgcacgccatcgagcccgccgctcccggttgcctaccgccaagcccgccgctgccggagccgaaggaggcaaagaggtcggagccagaggagaaggagaaagtggcgctggcgccggtggtgtggcctgcaggatgcgaggtccacgcagccgcgtggtgctagcttagcggaagtgaggagaatattgagcggaggagaggaaagtgtggagaagatggagggggggggagaggagaaaggaaatttgattttttttttgaacaggttcatagggaatgagtatttttccgtgcgggtctattaggaggcccacctgcgaaaattgatttttgcatgtggttttcacacagaaccgcacacaaaaatggaggatgattttcgcagacgcgactagttatctgcaatctaaatgggtccctgtacaagaacattgttttttaagtagtgtagcgaacgtccttctatcaagaagaagtgggaagactataagttacccatctatgctctaaaaatactataagtactccttaatttattacccatcagctaaagatttacgatgttaatagagtcaccaaccatctcgatctagagaactctaaatcaatatggggtttgggataggacaaaggctgtgttcagatgacccttttcccaacccctctccctcattttccacgcgcacgcttttcaaactgctaaccggtgttttttttttacaaaaagtttctatacgaaagttgcttaaaaaatcaaattaatccatttttgtaaaaaaagcaaatacttaattaatcatgcgctaatggattgctctattttccatgatcactgttccggatgggaacttgttctagcgaacacacccaaaatccactaacggagccaatttagagatcagaccaacctctaggtcaatttggattgatttgaagttaaccatctgtctcgtgggcgaatcagaagctttttgagacaaacctatagagcgtatatcacttgtcgacgagctatatctatctatggtatttgtagagtatgaggattgttagtgctagggtatgcacaagattgaggaataagagacagaatatatcgatttttatataggttcggaccccttaactgacaggtaatagctcttctcctgttgaccggagtcattgttgcctttatatattagtctcacacgagtacaacatttgagttgacctaatctagtccctatcgatctagcagcatggagctctcacatgtgatcgacgacttgtgcagtcttattcctcaaacatgaactcgacgaaattgaatatatctctagatccctcatgtccacattgggtttgtctaaatttgtcctcgtgtctctttccttctagggagtcttgtatttatatcattgagtatcctcttatccaagtagaactaggtaactgatacaaacacacccgcaaggggaggctcgatcttcacggtagtaggttttgaaccaaagagcaccggtgtaaaccgtgcacaagaggataactagctttatacctgcaagggttggatgcgaccaagtggtgagggtgagaacgatccgaatcctcttggattccgacccatcaaaccaagcaatcacagaaccataatccaggactaatccacacaagagggggtaagacacttatgcaatcttcaacaatcgtctctcatctatgctttttataaagttaaagcccactaagtataaagctcaacatgcaaacatgctaccttatcattcactagcaacaactaattatcaaatagttcatacaaacatgcaatatcatccatactttatttaattctacaaatcagaatgcaaatagatccaatcatcacctctctcatcatttccataatatttcaacaaatatatccatcattttttataatacttaacatacatacatccatatattctgtatcaaagcgaagatattatttagtttgtttcatgtttactactaataaatcctaacttttcatttctttttcccctgtcttccgcttcttgcgatacaaattttggccaacaacataaatttcatctataatcctctacaaagtctattaaatttatttctcttcaaatatggcttgaaaaaaaatcagttttatttgttgttaataattaacatcatacttacttcttgctcgattgttgaaagatatatatgttagaaattacttagtaattcttgcagtaaagcgcagggaatcacctagtatatctataaagttcatccccactaagtgtagttaatgttatttctctcttctctcttgaagccgcatcatctcaattatttttagccattgtgtcggtgacatgggaccgggagtatcatgactagaggcttgaggcagacacaatcgcccacgtggcctggcaccctcgggggacgtcgggcccgagggtgatgtgtgcgcccacctcttggtctccccgaggggggggggtcggaccactcctgcctcgcccccgagggccgaggcgccccgacccctggcgggttctactccgcgtgcatgggttaggt

SEQ ID NO: 68915 - DNA, 11170 bp, Oryza sativa
tgaagagaagaaaagtccagtttagaaagagaggggtgcatgtggtatccccttgaagtataaaaggaggaccttgcccatagggaagggggatgactttttccagattcagtagctagaagaaaagggagaggttggctcacactttgtagctccttgatacacagatccaccaaaacataggagtagggtgttacgcttctcagcggcccgaacctgtatacatcgcttgtgcttcatgctctttcgataggtcgcgatctttccacatacacagagagcttgggatctcaccctgagcccccggccgaaccggcaaaggggggcccgtgcggtctcccggtgaggagccccgcgctccgtcatctggcgcgccaggtagggggctcagcgtgtgtcttctgagctcttgcgctctttcgtgtgcaccaagcctttcctgttcagcctcatggctgagcaagcaaaggtgcccgacctctctcccagtgtgagtggcgacgacggggagccgaacccacgccgtcgagctcgtactccaccgcctcctccacgccaaagtcctgggcgggagaaggcacccaagagggctgaagggtccgcgacttcggcatccacaggagctgggaaagggcggcgagatggggagcgtcgcctcctcgtctatggtgacggcagcacgccccagggcgcgctccaagctgcgggcgcgctcctacgtcacccgcctgtcgcccatgacccggagtctccagcccaacgatggctggacgacgtggccaaattggtcatgacggcgcggcagcgcctagacgctggtgggcgatcctccgccaccaagacctctggtgctgctaccaccggctccgcgtcgtcaagacggagggcacgacgagcggcagccgctgttcgccgttcggctgccactccttcatcgactccttcgacccgggaagatctgcgtggggagcaggacgcccgcgccagcatcgagcgccggcgtaatgaccgaagtgctgcccacgcaacggaaggcgcttcctcgtccagagtgtcacctcgacacggacgtgggaatcagccctccgtgcccccggttggtggtgtcggctgtagagcctttgtggcgagtcttcggaatgtccgttggcccccaaggttccggcccaccatcgccgaaaaatatgatggcagcgtcaaccccgccgagtttctccaggtctacacgaccgggattgaggccgccgggggtgacgacagggtcatggcgaatttctttcccatggccctgaagggacaggcgcggggttggctaatgaacctgccccccgcgtcggtccactcctgggaggatttgtgccaacagttcaccatgaacttccagggcacatatccgcgccccggtgaggaagcggacttgcacgctgtacagcgaagggacgacgagtcacttcgatcgtacattcagcggttctgtcaagtccgtaataccataccatgcatccctgcacacgcggtaatctacgcgttcagggggggcgtgcggcacaaccgcatgctcgaaaagatcgcctccaaagagccccagactaccgcagagctttttcagctcgcggaccgagtggctcgcaaggaggaggcctggacttggaacccctccggttccggtgtggctgcttcggccgcccccggatccgccgctcagacagggcggcgtgacaggaggaggaagaagaggacagtccgttccgacgacgagggtcatgtcctcgctgtcgagggcgcttcgcgggccacccgaaaggggaggcctgtgagcgacaaaaagaaggaggccagtgctcccagcagggagcgccccaccggcaagtggtgcaccgtccacaatacctccctccatgaccttgcggactgtcgcgcagtcaaaaatttggctgagcggacaagaaagtgggaggaggagaggaggcaggagcgccgggaaggcaagtccccggcggttccttccggccatcggcgaagtgaggctaagcagaaggcccccgccgaggacatcgatgatggcgatgatgacctaggtttccaagagcctggggccaccattgccactgtcaatggaggagcgtgtgctcatgtttctcgccggagcctcaaggctatgaagcgagagcttctggccgcggcccctactcataaggcgacgcgccgggcgcggtggtcggaggttgctctcactttcgaccagaccgaccacccaccgtgcgttgcccgaggagggcagattgcgatggtggtttctcccaccgtttgcaacgtgaagttggggcgtgtcctcattgatggaggagcagccctcaacatcctttcccccgcagcctttgatgccatcaaggccccggggatgatgctccggccgtcccagccaatcatcggtgtgacgccggggcacacttggccgctaggtcatatcgacctcccggtcaccttcggtggacctgccaatttccgcacggagcgggtaaacttcgatgtggcggacctcagtctgccctacaacgtggtcctggggaggcccgcgttggtgaagtttatggcggcggtccactacgcctacctccagatgaagatgccgggccccgatggccccatctctgtccatggcgacctcaaagtcgcgctcgcttgtatggagcagcgcgcggaccgcctcgccgtcgtgtccaagcccgagggtggcgacgagaggcttggctcatctgcccccgccgccccgaggcagcggatagtcacgtgcgatgaggtcccggtcaaggaggttgccctgggcgacggcccgtccaagaccacacggatcggtggtcttctggacggcaaataggaagacgcgctcgtctccttcctgcgggcaaacgctgacgtcttcgcatatagaccggcggatatgctcggggtccccagggaggtgattgagcaccgtctcgccgtgcggccgggcgcaaggccggtccggcagaaagtgcggcggcaggccccggaacgtcaagccttcatccgcgaggaggtggcgcgacttctggaggccggattcatccgtgaggtcatccacccggagtggctggcgaacccggtggtcgttcccaaggcgaacggcaagcttcggatgtgcatcgactacaccgaccttaacaaggcatgtcctaaggatccttaccccctgcctcgcatagatcagattgtcgactccacagcggggtgcgaccttttgtgttttctagatgcatactctggttaccatcagattcgcatggctagggaggatgaggaaaaaactgcgttcattacccccgtaggaacttattgttatacgacaatgcctttcgggttaaagaatgcaggtcctacttttcaacgtactactcgaatttctttgggtagccaattaggacgtaatgttgaggcttatgtcgatgacttggttgtaaagacgcgcaaccaggaaacgttactttcagatttagcggaaacttttgagagcctccgctccgcccgcataaaattgaaccccgataagtgcgtgtttggtgtacctgcgggcaagcttctcgggttcttggtctctgcccgaggcatcgaggccaaccccaagaagatacgagctatagagcggatgcgcccccccagcaagcttagggatgtgcaatgcgttaccggttgcatggccgccctaagtcgtttcatatcgaggctgggagagaaggcgctacccttatttaaactcctcaaacgctccgggccgtttacttggacggaggaggctgaacgtgctctcactcagttgaaagtgtatctcagctctcccccagttctggtcgccccggagccaaacgagcccctgctgctctacttagcggcgaccccccaagtagttagtgcatcgttggttgtggagcgcgatgaggacaatcctcattccgcgcactctcaccctgtgctgactaggcccgggagtgagcagggaggagaggcccccgagccgaatagtggcctaaggcccctaacgaccggagtcggcgctctgcccgctcgtcagacggtgctgggtgcccccgaccctcaggaaggccccgaggccactgcgggaaggccgcacctatcgccctttgaccccgaggctaaccctgtgctgactcgacccgggaaagagcagggagaagaggcccccgagccgaacggtggcctaaggcccctgacgaccggagtcggcccttcgcccgcttgtccgacgacgccaggagcccccgacccacaggacggccccgaggccactgtgggaaggccgcccctgtcatcctccgaccccgaggtcatcggcacagaagacgagtgcgccccgagaggccacttggacgaagagcgccccggggatacggcccctagcaaagaggatcggccccaccgaaaggtgcagcggcctgtctactttgttagtgaggccctccgggacgccaagacccgataccctcaggcccagaaaatgctttacgctgttctgatggcctcgaggaaactgcgccattattttcaagcgcatcgagttacggtggttacgtcataccccctcggccaaatcttgcataatcgagagggtacaggacgggtggtaaaatgggcgatcgaactttctgagttcgatttgcattttgaaccacgccacgctatcaagagccaggccctcgccgattttgtggcagagtggaccccggctccagagcctgtctcaatccccgaggtcaactcggacccctcgcagccgccacacaccggccactgggtgatgcagtttgacggctccctgtctcttcagggcgccggtgcgggggtcacgttgacctccccgactggagacgtcctgaaatacctggtccgcctcgactttcgagcgaccaataatatggcagagtacgagggactccttgccggactcagagtggcagctggactggggatccgccgcctcctggtgttaggcgactcccagctagttgttaaccaagtctgtaaggagtaccggtgctctgacccgcagatggacgcttacgtacgccaagtgcggcgtatggagcgccattttgacgggatagagcttcggcatgtgcccagacgggataacatgattgccgacgaactctcacggctcgcgtcctcgcgagcccagaccccaccgggcgcctttgaagaaaggcttacccagccgtcggcgcgacctgaccccctaggggagacgggtgtgcctgaccggcccccgaggcccgtcggagtccaggcctcgggacccgaagggagcgctccaagctcccttagattgattgcttggatcgctgagatccaagcatacctcacagataagactctacccgaggaccgcgaagggagtgaacgcgtccatcgcatatccaaacgctacgtgctggtagaagggaccctctatcggcgcgcggctaatggaatcctcctgaagtgcattccacgggaacaaggcgttgagcttcttgctgatatccatgaaggcgagtgcggagcccattccgcctcgcgcaccttggttggcaaggcctttcgtcaaggattctattggccgacagctctcaatgacgcggtcgacctggtccggcgatgcagagcgtgtcagttccacgccaagcaaatccatcagccggcccaggccctgcagatcataccactttcatggccatttgctgtctgggggctcgatatcctgggaccgtttaggcgggccccgggcgggtttgagtacctgtatgtcgcgatcgacaagttcactaagtggcccgaggcttatccggtcatcaagatcgataagcactccgcacttaaattcattaagggcatcacggcccggtttggagtgcctaaccgtattattacggataacggcacccaattcactagtgaactcttcggcgactactgcgaagacatgggcatcaagctctgcttcgcctcacctgcccaccccagaagcaatggtcaagtggagcgcgccaatgcagaaatcctcaaaggccttaaaaccaagaccttcaatattctcaagaagcacggcgattcatggatcgaggagttgccagcggtgctctgggcgaaccgaaccacaccaagccgagcaaccggagagacgccttttttcctcgtctacggcgcagaagcggttctcccatccgagctcaccctgaggtctcctcgggccaccatgtactgcgaggctgatcaagatcagcttcgcagagatgacctcggctacttggaagaacgaaggcggcgtgcggccctccgagccgcacgctaccagcagagcctgcggcgctaccatcagcgccacgttcgggcccgatcactctgcgtcgacgacctcgtcttacgccgcgtccaaaggcgtgctggattgagcaagctctcaccaatgtgggagggtccgtatcgagtgatcggcgtcccccggccgggctccatacggctggccacgggcgacggcactgagttgcctaacccatggaacatcgaacaccttcgtcgcttctacccctgaggggggggtcgggcgtcaggtttcgggctcgggccaaccccgcacccccccctcgggagtgcagggttggccgggggctgccacacatgcacattctcttttctcttatttcagtatttcaataaaagcagtttcaatttcctaagggctgtatctgtgccgttttttcctttttgaagaattttgacttgaaataaaatcactcgtgctcaaccttgccctcgggggctcggttcggtcagctaaaatcgccaaacggggcccagaaccgagccgtgccctggggcgtggtgaactccgggggggaatcggcaaaaacccacaatcgggtcacccataaccctcggtcaccacgttcccggcctggccagcctcgacatgtggatctccccaggcactagccccgacccgcgcctttcgagggctgggacttgggcacgagtccttaaatcaagctaagacacaaaagaggaccacggcacagatcatcctcatctcatttgcatagcaaaataaaattaacacaaagaaaattttcatcatttttgattgcagattaagttgatctatacaaaaaagaggcctgaaggccttagaagaaagaaaaggaaaaaaactggagattagcgggggcctgggggctcaatccgatgcgcccgggtcgccggcctcgtcgtcacggtcgtcagcaccgctggcgtcgccctcctcgtcggagttgggggcgaacgcgagctgaggggccgacccctcgaaactgtggacgatgtggtcggcggcatccctgacccgcacgcgcgcgtcgtcctcggtcccgggagggaactcatccagcgccatccacggagagaagttggggtccctggcctggtagctggccaggacaagctccaccgctccttgagcgaggtccctcgaggatgacttgatgatcttctcgagctcctcggggagctgctggagagctccggccatctttgagaggtgctgagcgaggcctcccaagttggtggagtacttcatcgtttggcccttccagaggcccgcctgccgaccggcgcgatccagacgggagactgcatcccaaagcatgccgggccctatctcgcccgccaagcggagggcctcggcttccccggcggatgaatctagcgcgcgctgcatgtcggtgacgatgtgttcggcatctgcgaggcgggcggctaagtcgctttcgcccgcagccgccccgccgatgcgtgccctcgcgtccagctccttttcccgcgcctcgaggtcggcagcccgctgctccagcgtggctctctcggcgcggacggattccaagttgcggcgcgcctgctccgtcagcgctgcctcacggagggacaggctgtccgccaaccgttgcgcctcggcctcggcctcttcgagagctcgctctcgctcggtaagcgcgtcctcgcggaggcggagtgcggactcctcttcggcgcaggcagactcgtgcgccgccagcgttgcctcccgggaggtgacggcggcctcgcggtccgccaggtccttctccgcgacgcaggcgcgctcctccagcgccatggcgcgtgcctcgagggcctcttcacgccgccggagcgccgcttcggtctccgttgctcgctgctctcgggcagcggcggcatcaaggacctcctgggcggcgtcgagctttttctttagctccgcctcccagctcccgtgttgaaggcggagggagtcctgcgcctcgttcatcacagtggtggcgatgagggcagccccccgctcctcctccacctctcgggcgatctccgccagcgccgtcttacgggcttcaagatctgagacgtgccggcggtgtgctttgcggcctgcttccaccatggcctccaccgagcgccggccctcctcgacacgcgcccatgcggcgtcgagctccgcacgctccgcctgcagggcctccacctgggcgcttaatccatccaacaccggggtggcggggctaagctgcaaagggttgcctcacgggcgacggaaggcgtggggaagagctgccttggagaagatgccgcgcggtcggccgcaatggacgtgccggcctcggggatgtcccccggacctgtttggtcctgggcgtcgcccgaaggagtgggcccaagcgatgcgcccgcggcctcgtcgcgagccatcctagaagctgtcgcctgggcatcgcccgaggaggtgggcccaagcgacgcgcccgcggcctcatcgcgagctgcctcggaagtcgccatcgcctcagcctggcgagcccgggcggcctcctcccgagcggcttcttcggcttggcgagcccgggcggcctcctcccgagcggcttgcggttgtggcagccgagatagatcgtatcgtgcgcgcgttaattacgctcgccgaccgaagcgacgttaccatatctccaggcgaagcaaatcggctcgcccagatttgggcgctgctcaggtgaggtgacagtcttgaagagaccgcccattattgacagccaagttaccattaccgatgcgcatggtttgagaccgttgggtttctgcccaaccatggagaccggtcccacctgtcaccaggctttaggagtggcgtcacgcccgaccgcttcccttgagaagggcgatcgccctggcataacgccgggggctactgtcggtgacatgggaccgggagtatcatgactagaggcttgaggcagacacaatcgcccacgtggcctggcaccctcgggggacgtcgggcccgagggtgatgtgtgcgcccacctcttggtctccccgagggggggggtcggaccactcctgcctcgcccccgagggccgaggcgccccgacccctcgcgggttctactccgcgtgcatgggttaggtgagcacagcagggctcacctaaccgcatttattgcggctcggctaaacgtgtcacgccgcacgaaatacagtgcactccactcgtttatccggtctgtgaccagtcacagaccggtcaaatcgcgggttaggtggcgacaggcggtctgacgcacgcttcgccccatcccgtcaagacgagagcttctaggcactcgtccccagctggagttagcgtgttacatcccagagatggcacgttagccccggtcgatatatgccaggcttcatcctaaccattacaggcaagatgttgtgtgaagaagggcaaacatgcacgttgctaagctgacgcgtggtggacaagaatgaccgatttgtgatcggtctgacactgctcatgtcgtcagcacacagccacgttcccacgacgcgcctgcctccggcagaagtggaggtaggtgtgtgccgtcccgtcagaaggatgttcggaggacaaccgtgcaaatctccgtccatttatgaagagaagaaaagtccagtttggaaagagaggggtgcatgtggtatccccttgaagtataaaaggaggaccttgcccatagggaagggggatgactttttccagattcagtagctagaagaaaagggagaggttggctcacactttgtagctccttgatacacagatccaccaaaacacaggagtagggtgttacgcttctcagcggcccgaacctgtatacatcgcttgtgcttcatgctctttcaataggtcgcgatctttccacatacacagagagcttgggatctcaccctgagcccccggccgaaccggcaaaggggggcccgtgcggtctcccggtgaggagccccacgctccgtcacattggatgattcatcaagggtgtaaattgcacctcttcgcattatctaaattgtttttaggctttggatgatttatcaagggtataaattacatctctccccccccaaaaggcataccatacaacccaattatttataacctatggataactgataaaggtaaaaaaataaacacatgaaaaaatcatatagtagggaaaaaagaaaattttagaactcatatatactatattatcacacaattctcctgcagcaacacgtggggtacccatctagtacatgaggttttaattgaacaaaagttgtctaatggataaagtagagtggtatttatactaggaacatccctcctagcttagtgtgaacataagaaaccacatccaagtaatcaaggctaacataaatgagaatgcaaaaagttttctcgggttcgcgcacagcccttcagctcctgcacagccttaagtaaaattactctaacttcttattggaaaatgatattgtaacccttgagaacgttctcaaggtaacctatccttcttggcgtagtgatgatgccttcagatataaaccatagcaatataaaggtagagcatttaggtagtataaaactctcactaaaatttgggttaagttgagcaaagagtgagttcacctcttgttgtattttcctagcattgaggtagtataatttaaaaacataaaaagataaaaaacataaattacatttatcattaaaaaatacatccgcttcggtctccttccctcttttctccctgaatagatgagatcacaa

SEQ ID NO: 68916 - DNA, 1594 bp, Oryza sativa
tttgaaaattttgaaaaatttgagtgattttgtgcattagataccatggtgcccgggcaccatggtgccccatatgagtgtcctatatatatatatatatatatatatatatatatatatatatatatatatatatatatatatatgtatatatatgtgtgtgtaagtataagcatttttagcatagtaacaagtcaaacatttttaactttgactatgttaacgaccaaatttggtaagatatgaattaggttcgacgttggaatcgaagcggattcggcggattcggcaaagagttagatttgaagaacagcgtatgcgtcggctgtgaaggcatcggctggagtctgaatcggctgagatggatcggacagaggataaccgatacagccgatagagttggtatagccgattctgataaagatggcttcgaggctattcctagaatcaattaacgtgcttcataaggattgccacgatggagaaaaagcttttagaaagtcaattgtagctattaataaggatatctcatgtaaattctttagagatatgtttgggcaaaagtctgccgcaaagacttatggtatcttagagtttgttagagataagaatcgtgtccggcaaggacatatcttgtaatctcggatataaatatgacccgagcctatgtaatcaaataacacacattcaataacactttcggcgcatcgccacccttttattctatttcgacgagttcttgctttcgggttgagctgcattgattcgatcttcaactagaggtaaacttgtcaaggcggtttgcgttctcgggattagtgcttccatctttatgacactctaatcttgtttatgtaattcgtcgagttatcatatatactttacaatctttgttagttgtgctatataacttgtcatcggctagttcttgctgttaagaagtaaccgatagggctatgttttgttgttaacttggattgtatcgggtatctaccatctcttagaagttttcatcatcttgtttagatcctacagttatctttatgcttaatgctgcatcggttaagtttgagttcgatctattaagttctatctataattgtgatatctagcctgttttataataattaatagagatagtatcggggtttcagccgatcttacctgatttacctactttatatcctatatgttcgattgatatgctaaatctgccatttatattaagatcttattgcattaaggtatattaggcttcttgtttgatatattctgcttgttctaatatcttagtatagagtggtatcggagtattagctggtacatgctagatctttttgatcggctatgctataaacatctatataattaatactttagtatatatttcgacttaagtgatttatactgtctcggcacagcgaccgatctatcccaatcacttagtttaaatatgtatcgaagtagagattatatgttattaatatctatagccgatcgagtagatttagtcttatttcattcattaatgactgccgatcgagtctcagatatgacatcggctcagagataaatgatatatcatgggcaacta

SEQ ID NO: 68917 - DNA, 1693 bp, Oryza sativa
  unsure (1)..(1693): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctgtgtcccctgcggatggtgtggtgcagcgcgttgcatccttgcttgtcttgcctcaccatcgcctccctcgtatcaagatcgtcatggcggcggcagtagtaactgagaagaaaagaagctaaagcgacattgccgctttttacggtggcgagcaacggcgtctcgccatccgcgtttacagtgcagaggagggacgggttcagcatcaagatatccttgcagaattcctcgtggccatgggccgatgctatgtggaggcaggtgttcccctgcactgtccttccaagcagaaggcttgggtcatgcagagccggcttcacacccgatgtggctgctttcagcagacctctgtccatcactggcgaatctgcggttgctttgctgtctggaatctgcatgcaagtaataaatgaatatgatgctttcctgttaacgacaaaatttggtaggcccatgagagaattatcacatcgtcaacagtcggattactgctatattcggttaaggaaattaatctattaaaggaagcttatgcagaagtagttcaagaggatgcgacatgacaaattatctattaattaggaataatttgttcattaccttttatctttagaaaagtgtgttcagtgtcctataaggattttatattttccttttattttttaggaaagtttttttcttgtcctacaaaggactagtatctccctgttgtcgaagcgacaaccgcgtacgtcgaaggacgtggttactcaacagtgttggaaaaagtaaatgtagtattttgagatttttctttgggatccccacttcacatgtccctacggggctatttataatcctattacaggttcccccattagggtttaggctttacaggggaatttacatggctgcccttatgaaagggacgtttgattgggtatacagtgtaatttggatacatgggcctctaatgggccaattggcgaacaggcctaagcggctgggatggccccttgggcctcttcaaagttgggcttgttatggcgaagcccccatccttcagcatacacccttcgcccaatgatgcatttggtcttgccagataccaacgcgattcttcagccttcgccatctctacttcatagtcttcgccatgggacttcgcccagatgatcttatcgtcatgggcctgaatcctcacaggttgcatggtttcggtaggtctggtcgaagggtctcatgacataccaccaacaagcccctcacgggcaagggtgagttatgagcttcggccgagaccgtgcaaaccatgtggtatggcatgaggcgccccctttcgaccgacgctcctgccgaaacctatactggagtcctgcaagaaatgtgtatactttgtgcatatgtacttttacggttagtaaattttcctatctttcgccttttgcaaacagcgaagccgttctctttttgtgggccgcaatgaacagtgacgggcttccctcatgggcttagcac

SEQ ID NO: 68918 - DNA, 12240 bp, Oryza sativa
  unsure (1)..(12240): unsure at all n locations
ggatcccccggtgtttaaacgaacggccatggtaaatcgtagaagttaagcaaaagtcgatggcatattgtagaacgtgacaaagtcagtggcaaatcgtagacgtgcgacaaagtcagtggcatataatggattatctctttcgcgaacccttgtgacacgtggcggcttacaattgggtgggaaggcgaaccgacgcctgggtgggttatatatccccccaccctttttcaccgccacgcccctgtcattttcaccgcgagcattctctttctccgctctctcacttcacggcgttcttgagtcactaggcctttcgaccgttcctttttttttctccacaagcggcagatttcgccaccgctcgcacttttcgccatggcccctcgcaacccgaacccatcttacgtgacgggccctgatctcggcaggatcgatgatgacgccaccgcctatctcggggtttcgcttgtagacgaggatgagttgatgaagctggtcacctccggcgtgctggcggagaagcaggccttcgccttaggaaaggctgtggtgccgaagcccggcgacaaccggacggtggtcttcgctgtgttcttcgaagcgggccttcggtttccgtgcaacgtgttgttgcctgagattcttcgcttttttcaggtggagctcccccaactgagcccatcggctctcgtccggattgccatcttcgactaggcgtgccggcccgctggtttcgaatcgagcgccgggctcttcggtgctattttttacgccaccataaactcgaagacggtggtcactcccccagggacgaaaaagacggcgttcgagatcatgaacttcaatgttcgccccgagcgctctgatctatgcccgatcaacggcaccatgtccaagtgggatcgccactggatatcgaagtggttttaccaatccatccccttcgaggctgggtccgagtcggcgaaagctctccgatggcgtcgcagggcgatcgcgccgaataggaagcccaaggtcactgtcgatggtgccatggaagcccggttcgccctgcttcgcaaaatctgctcccgccttagctgccgtgacctggtggaagagttctgtatgcttcggatcttccctctctcccagacgtggcaagtcgaggtgagcccagacgaggaggtcgatggcttgccgaagctcgtcatgccagagggggcaaacagtgagtttttgctttcctatatgtgtctgtattttgctctttcctcctattcggcgcctaataagataacacgtttcgtttttgcagtgttaactcttgctcaggccgacaccgaagctcggaagatgatcggtgatgtgtcggtcaccgaatacagccagctacttacacggcaggcggccgaccgggcgaaccgagtgtacgatggcaatcttcctccccgggcgaagccgtataaggccaacggtgatgaagggacttccatgaagcggacacgcaggcaagttaaactggctccccggagcgaagggcccctgccactaccaacttcgacgccgatgatgaggacactgtcgatgaccatgacggcgaagaggaaggggaagaggacgagacggaggttgcggacgagcccgccgacaaccgcaccgagacgcgtgggtacaccccaactccaagcctcgaccatgtcaaaactgggtggagtcgaacagctcccccctccgccgaaaggatttggagggggcgaaggcgctggtttcgtttgtggcgggcaaggtggcgaagaggggtttggttaaaaagacctctaaaaaaatggggctcgtcgatgtcgctcgcgttttcagcgacgacgacgagtcttcggacgagacccctacttcgcctgctggtcagagcctgggttttcgaccgctcctggtgctgcggtcggtgttggcggggtgggagggagtgttgcccttgggacttcagcatctgctgaccgggtcgtgaaggttgcggccaggctcttcggaagccctgtgcgcaaaccggtggcctcgccgctcgccgtccagaagtggaaaaagacggttgccgaaacatcggcttcagagtattcccttgcggcgccacacttcgcccccggtgacttcgagactcgggcggaccttatccccttcgtcaagggggtaagtaatctcgtttctctggctgggagcccgagcctattcttcgagctgaacgagttcgacgagggctgttccgccatcaagagtttagctgttcgggtatgctattcatatttctttccttttagctgttgtttcgggtatgccattcatcttcgccctctttctctttgtcgaaatagattcttgcggctcattgttcgaccgaacgaaccgtgcgggctcgtcttgacggttttaaaggccgttttcgagctaaggacgacgaactgggtcgcaagagccttgaaatggagagcctcgccaacaccctcaaggaggcgaaggctgaaaacaagcggctccaagctgagcttgagaaagggagcgaggcaaaggccgagatcgagcgtctcaaggccgaggttaagaaggagcaagctcattccgccccctgaccgactactataatctcaccgagccgaagatggaggctctttgccaagaggtcagcaaggcagaggaaaccgcttcaacggaggcgcagcggttcacgcaggatatgtcgaaagccactgaatctgccaagaccgtgtgccgtacgcttcgccttgcccttactgacatgggggcgagggtgcgaggagtccctggcgaagatgcttctgccttcaccttctcggagtggacacaacaggctggtggtgcggtctccgattgcgccactgcgtacggcgattgttgtgcgcgtgtgtcggcggcctttacaatgggcctgttgcagtagaacggtagcgaacacatcgtcgagctccccaagtttgtgaagggggattgggaggtcaactctcaggacatttcgctcacacttcgtggctggcgcaaatagttctggcaaaaagaacgccgatccaccgccaaggtgcgcctgctcgaacacttggcaaaggcagaggaggcggagcagggcgaagagccagcggccgaagaaggcggaatggatgtgggcggtggggcggacgtcagccaaaatcaccccgaggtgtgaggctctccacccgttctttagattttttgtagatttctcttggcgcttgccgcggtgggcgaatgatgtaaatttggccggtggccctacccctttcgtattgtagccgaaaatggccctttttaatatatgagatagatgaaccaagtcttagtaaattatcatgtttcttcggctttgatatgtatgctttcattattctgcgcacaaaaaagagacgacgtttttcgcccactttatgtgctccgcctcgtcttaaccatgtgctttgccattggccttcttatgttttcttagcagggttttcgccgaaaggtgtatgttcggcctccttttggggattggcggaacaagaatgtgagaaattcgtcacggttaaaaacctgccgaagattaagtattcctgtcgcgagatgataataaacgccaaaagcgggcacaccccgggtgaaccctggacgactacgatcatgtccatgtggaacgtcaggaggacatggcccgcttttggcgaaatcaccgaaggactgatcgctaggaagcgatcgcccagcgccactatggcttagtttgtgtttcgcccccttctcctcttagggtagtgtataatattagtagtgatgacgaaccaagttcgccaaatcacacctttgggagtggagggtgttttgggggcgaagatataattttcttgtaagctaggctgtaaagcccgttactttctttcacctatagcatgttgtatggcatgtattctttgatattttttgaagttaataaagatgtgtttcatttccttttcgctattgttcgcatagtcacctttcgtgctttcgttaggtcgaaacatgtcggcccccttgcgtatattagcgaaataggtctgctgactttttagctttcgacttccgctttcgatctgtggtattccgcgctaaaagaagcgcttgtgttttcacataactcgagtattgcggtgttcggttacttatttcccgaaacaagctgtcgcggtttcaacgttcggtgagcgatgcttcggccgatttctttcgccccccggtgctttcgctgatcaggcgtttgccttagggtttttccacgatttatcattcacataagtaaaaaggcgaaagacacaaggattttatactggttcaggcctccaggttggataatagccctacatccattttttttgtcattttcctctttttttggtatttttgtgccgaagggcttacataacgagagttgccgaaaggcctatacaatagtatgtacatttttacaagttggcgaatggggtgccaccctttctagatatagaaacgcttaagagaagcagtgttccaggagtggtcgaactcttcgccttccagcatcgccaagcgaaaggagcccgtcctggacctgtgtttgatgaggtatggcccctcccacttcgattcaagctttccgaccaccactgggttcgccttcttccttaggacgagatggccaggcaaaagctgcatcggtcgaactttcttgttgtaagttgccaaggtgcttgtagcgtacttgcacatgtgttctattgcttcgactcttatcccttcaaggagttcgagcaacaactcgtgcgcatcttcgcctccaaagaacatcacccttggcgaattagctcctagttctattagggtcattgcttcgtcgccatagagaagcatgaacgggctgaacttggttggcctagtgggggtcatccgaagggcccagagaacagatagcatttcgtctagccatttaccctttgccgccccctcaagccttttcttgagcgccatttgcacgttcggccgccccatttgactgtgggtgcgcgaccgaagcgaacctgatttccaggtttatcccctcgcacatctctctgaacttgtcagagtcgaattgcttgccattgtcagtgatgaattccttcggcactccgaaatgacaaacaatgttcttccatacaaatttctgtactgctaccaaagtgatcgcaccaagtggttcggcttcgatccaacgggagaaatattcgattgctacaattgcaaacttgtacccatttcgcgctaccgggaaagggccgattatgtttagcccccatatggcggaaggctagaccggagcgataggttgcagctcatactggggtgctgcctggcttcggctatgccgctgacagctttcgcacttcttggcttgctcaacacagactttcagcacagtgggccaatacaccccctggcgaaacactttggaggcgaccgttcttgcggcctggtgcgcaccgcacagcccctggtgtattttcttcgccatttcctcgccttcaacgaaggagatgcagcgaagaaagggttggagcacccctgagcgatacaattgccctgagatcagcttgtatcttgtggctctgagctgtaggagcttcgcttctgcttcgtcctctggagccaaccgttcttaaggtacttcacgaacggtgttcgccagtcctttgggtcctcgcccagttctgcctggtcgattgccatgatgtccaggctctcagtaggcacacttggtgcgtacaaagacctcaaaaaagatgcccggtgaatgtgggcctccacaagcaacagacttcgccagggcgtctgcttcctcgttctggcctctaggtaagtgttcgaccgttatgccggtgaaacacttttccatagatcgacttgcctccagatacctcttcattccttcttcttttgcctcaaaagatttgtcaacgtggcttgccactagtttggagtctattcggatgagcaagcgccgaaccnnnnnnnnnnnnnnnnnnnnnnnnnnnnncagtacgacgtctgccgtgttgttggtcgtgttgaactacagccttatggcataccgaatcggcacgccccttggcaaaatgagtactgccgcggcacccgcccccttttgtgaccacgaaccgtcggagtacattacccaaggttgttcgacaggcttgggttcaggggtgaatgccggcgtccattcggccacgaagtcagctaggacttgggacttgatagcagtgcgggcgacaaaatgcagatcgaagggagataactccgccgcccacttgctgagccgggggaagtcgtctttcgggcacaccttgttgaggtctgtgaaatcaacgcacatgcgctatttgccgtttgacttccgcaccagtaccaggttcgccaactactcagggtggtcgatctcccggatcaccccggccttgagcagcttttgcacttcggcttttgctacttcttggcgatcggcggacatcttgcgcaacttctgtttccttggtttggtgttcggcttgaccgccagatgatgcatgatgagatctgtcgaaacacctcccaccttatcgggtcccaaggcaaagatgtcaatgtttttcttgagcacctccaggatgttttcaacttccctttcgcccatatcgcccccaagcgaaacaaatcttgtgtgattggcatcgtcgatctgcaccttgatcaccttgccatgaggggcgggtgctttgtacggtcatgcggttcggcctgtacattgtgcactgccctgctaattgcggccaaatcgccctatgatgtagccgaaggctgaagcccctgaccacgatgacgcctgccggactaggcatcttgagcttgagatagttgtggtttgagatggctttgaacttgttcaaggttgcacggccgaagatggcgttgtagttgtatgggatgtcgacgacgtcgaagagtatttgctcttcgcgcttgttctcgttcgtgccgaacgccaccgccagttgtacttgtcccaggacttgaactgcttcaccaccgaaaccacgaagccaggctgctgcttgagtgagggctagggtgggcaagcccattatggcgtaagcttcggcgaaaataacatcggccgagcttcctccgtcaaccagaatttgccggacttcgaagcccgctacttcggccaagatcaccaaggggtcttgatgcgggaacaacactccttcggcatcttccggcccgaaagagatttgctgattcaagtaccgtggagccccttcgtcggccgaagcaatgttgtgcaccattcgcagctacatcttcttctgcagttttgacggctaagctggcgagtcagcccttgtaatcacttggattactctgcgcttcatgtcttggcgctattcggccgggggtacttgttcttgagcagcctcgcgaggtgcttcgacagctgctccttgttgaggccttggatcttgagcgttgccacgctgtcgaatgtttcagcattgctcgatggtgtacgaagaacgtccatggtaagcgcagtagaggtcttttccgaccttcttgcgaacaggctgttgatggctgcccgcttgttgggcgtcgaactccttgcggagggcttagacttcttcgacagccatcacggtcttgcctgcgcggtcagttctgaatttcctccaagtcatgggggcttgacttggcctcggcggctgtccttggttcatcagctgaggttggcgaacggtgagaggagccggttcggcgacctgtgcttgtacttgggcttgagcagcagcgatggaggccttatcgtactcggcttggattgcttgccatcgcttagaatcctcttcgccccttgcgtacccatcaatgatacgaagcaggtgctcaagtgtctgcggctccttgttggcgatttttcttttgagttcgccttcgagcagcccggccgaagcagcgttgatgacagacgcttcggttatgtcctgaacttagcatcgggcttacgagaaacaacgcatgtactcccttatcgattcccccggcctctggcgaatgccgagtagatgttgctgcgtcttcggctcctcataggtgccttgaaagttaataacaaaaacatcgcgcaattgctcccatgagtaaatgctattggctggtaaattaaagtaccaagaacgggcgatgccatctagagcgagatggattacctttgccttggtgttttcgtcgccgtgagcggcttcgattgcggactcatagatggacagaaattccttcgggtccgttttgcccgagtaccgcggaacaggtgggaacttaaactggggtgggattggatgaatcttgattcccctgctcagcggtagccccttctcaccccctggcttgttcggcaccagctgcggatatggtgtggtgaagggtgaagtcatgacttgcgcatgaggttgggccatcgtgttcggttgcccggtcccgaacggcgacgcttggggaaccgccatggataggtcgaacgtacgctgtgtccaagccatggcgacctggttcggcgcttgattggttccgaagcttggtgccgtcgcctgtggttggacggtcggtgcttgaatggcagtgttggggtcgaactgcggtccttggctccaaggcgaagcccctggaccaggctggttcgacggtagccaactgggtgcaccctgacttgcattcccttccggtcagatcgaaggggttgtacttgaaatattgtggggttagttgagctggtgaaggaaagcttgaaactgcgcttgccaggctgaaaccccttccaccatcgcctgtgatgtctgtgccagtagcggaggatgcacttgggcagcaaccggccgaacttgtgcttgtacgtgaggggatgggtgtatggttacggctgaaggctgtcaggcgaagcacgctggcgcttgcatgacttgcagcggaaagacctggatcggcgcttgcggatagacttgaggtgggttatagcctgccgagtactagagaatgggtgctgatgcagccttagcttgtcgggccgcttcgtacgcctgctgctgcccttccatctgacgaagcatgtcctgaagtcgtgccatgttctgacgcatggcctccatgtcagcttcggcctgcgcgtcgaggttggggttgacttgtgcagcggcgagcgcggtcgaagtcggagcctgctgtggcgaagcagcttggggcgccacctgttggctcgttgaaaggatctccgccctggtctggagcacccttgctgttgcagccgtgttcggcgcctgccccgtcgaagcggcaggagccgaaggtggtggttgcagcgcaggtgccgaagccgatggtgccacgccagcttcaacgtcgggcgccgaaggctctactacctcttcggcggccatctcgcctcttgcttcacactccattcgcctagcaaccttctcctttgcgacattcttcggtggcattcgctcttagtggtttcactcagaggtccccatggtcggcgccagctgttgtcgaagcgacaaccgcgtacatcgaaggacgtggttactcaacagtgttggaaaaagtacatgtattattttgagatctttctttgggttccccacttcacatgtccctaggggctatttataatcctattaaaggttcccccattaggatttaggctttacaggggaatttacatggctgcccttatgaaagggacgtttgattgggtatacattgtaatttggatacatgggcctctaatgggccaattggcgaacaggcctgagcggctgggatggcccctttggcctcttcaaagttgggcttgttatggcgaagaccccatccttcggcatacacccttcgcccaatgatgcatttggtcttgccggataccagcgcgattcttcggccttcgcgatttctacttcatagtcttcgccatgggacttcgcccaaatgatcttagcgtcctgggcctgaatcctcgctggttgcatggtttcggtaggtctggtcgaagggactcatgacataccgcgaacactccccatgggtataaatatgtacacccaggtcattgtaaattatctccacgatcaataatactactctaagcgcatcgccaccctctttaccgaggtttttacttatcctccagtggaatttggcacctgacacggggctgcattagttcagttcgatctctagcgaagggataagtccaacgttccaccggcctaggcaattgtctcgtctacgtcggcatcgttcaaggctgcatcagtacattcgacctcttgaattgctctagtttggatgatatatttgcctacctatttatcagatgtctctgttaatctagtcttagcatatcaatttagctctattggctgcttctcgttttagggtttctgccggcatcggctaaattgtgttgctagattagattaacttagacatctaccacccttaaaatcagccataggcttgattgtccagatattatgtttcttttcatatttagtgttgcatcaactaaatttgatctattaagtcatgcttagaatcgtaatatctagcatgcttgttgactgccaataagggtttcatcggggctttagccgatgaggtatctggacgttgtatcggcttacaaggattacatacaatttggatttagccgattgcaataaagatttcactgttcaatctaatcttatggattttatgacatcggacctctagccgatgtatgctttatcctttggatcagtacttatcctatcatatcattattagccgattggtttctattggattatatgactgttatactgtattatcatcagccgattgcattatatcattatttactcaagtatcattatctacattggacatatagccgacatctcaaaactctatcgctatcggctagtatcggcatcggctggaatcactccatcggcttgtcaaccgatcagctcattgatcttcaatttgtatgttttgtcagttgcagggtcaaactgactatcacgcccgtatctcaccaagatttagacctgcactagagctaagcagatcttccatacctatattttttcgtgtcaacagtaccatctgggatggctcgtttttccgttccaatccaattcgtatcagtctgggtatcctgaacttttttacacgtactattttgctaaaaagacaaactctgaacacattagatttttttagcaaagtagtactactcaatcacttgtaataattacaagttaaacacttgtaaagttaaaaaatctaatcttaaggatggacgggtatttttttttaccagctgaagttaggattagttttttttttatggaggggtatttttttttttacttcagtttcatgggatggagcggtaggtaggagaaggttttaagagctacttcctccgttaaaaaaaccaacgttttaacatagtgatgggacattatacagtaccatgaatctgggtattctcatgtctagattcattatactgtattatgtcccatcgctacctacgttgggtttttttggacggaggggtataaggcaaggtgataaatgatactccctccatattttaatatatccctccatattttaatatatgacgccgttgactttttgaccaacgtttgaccattcgttttattcaaaatttttatgaaaatctgaaaatatttatgtcatgcttagtgaatatttgatgataaatcaagtcacaataaaataaattataataatgtaaattttttaataaaacgaatggtcaaacgttagacaaaacgttaaaatatggagttagtataaggcaaggtgacaaatgatgagatagctgatcagaagtggcaacgcgagcagtttttttttgtcaggagaggtttggtcgttgtctagccagtcgggtcaagcgcaatgaatgagcacgattgcacgaacgatggatgcgaacgtgcaggaggttggatgtggattagcggtacatgtcagctgggaaaactctaaacttttgtttgggtgtcattaattggttaccactctccccgactaaaaatataagcatttttatatttttgatacagtctttgagatgct

SEQ ID NO: 68919 - DNA, 1054 bp, Oryza sativa
tatgagtttcctaataatatatatgttttgttttatggtggtagtgaaagagattagaatcgatcactatattcctttctcacaaagtaagataaaaaaaccgaacgataatccttaaaacaaatatcatcattgaaatgtattggtaagaataacttggtatatactgtgagatcatagttcaaatcttgaattcactaatttatttttttaattttctataaaagagaaaaaaagaaaaaagggagagggaggaggaagggcatgggagagcagagggaggcgcacaccaggaggagagggggtatatataaagctattataaaaatattataaaaattgaagatgtttctgctaaaattttagtacgtcatccgcattttagttgattttctaatatttatctttatctctaatctatcttaatacctaatacctaataaaaaaataagcaaggattccatgcatttgatttcatatgtcgtctctacgtgtctaaaccattgtcgtgtgcctccagccgccgccgtgccgcccgagccgaaccctaacacagccgccacatcgatctacctccacatgcattttctcctctaattaattaaaaaaatggattctccactcctcaatcatcctttcccccatgatttccccctttcaatttggctttaattcactagatttcaactcagtttaatggtagtgaatgatgctcggccggtgatttttccccggttgtttttatcctctgagttttgtggattcgctgcgtttttaggaaaaattgaaagaagagatcaagttgatcaaaagccctcaatcaatttgggagaccgagaaaggaagatcggcttcggcactgtacaggcacgaaactttcttccggaagttaagacaggcagacagagcgaagaggggtaggaggcagcgcggtttcaattataatatatagcgatactaattcttagtaactattgtatcactggaaaaaaacacatttacccgttgtaacacacgaacatttttttagtgtctatacacatatatacacata

SEQ ID NO: 68920 - DNA, 847 bp, Oryza sativa
aaggaagatatttgtggaacaaggggaaattggctcatgaaattataaaaataatatctcaagaatattattgaccgtcacttacgtgcgggaccaaaggaaatagtctatggaaattttggaataaggaattgatttatggaacaaagaaaaaggatttatggaatttggagtatatgaaattatttattgaatttgtggataagaatattcccaagaatattctttaatctctcattgacatgtgggaccaacaagggggaaagatggacttttgtgtaggggagcggatttgatggtgggaggaaatatggacttgttgcatgtgtgttaggctcggcaaggagggacaacatatgaactcactttgtctcaaaaggccgagggggggacggctagtgggccgagcccatgagctggggagagaaaggaggcggctgaccggctgactgggcggggcgggcccggtcaacgccatgcgggcagccacgttggatggaggaaagggagccgggatccaacggctcgcggcggccgagaggcgccggcgaacggcggcgaaccggagtgaggcgtagacactggaagcgagagggggtcgaggcggttccatccaccagcttggatgatggagaggcggcgcgacggcggctggcgacggcggccgtgcgacggcgggatgggtggcacggcgcgggcgcggccggcgaggcgagcggcaacaacagcgcgccagggatgtttgagggggctcggggatggtggcggcgcccggaatcaatgagaggagggccgacggcggcacgcgactttgcgcggcggcggaggaataggcagcacggcgcgg

SEQ ID NO: 68921 - DNA, 1346 bp, Oryza sativa
ggtgggaatggagaggtgcgccgaccttctccccaccgttccatggcgcgccatcgcctcacgggccgccgaaggcggaggagctcgggcgccgcccggtgacgctgcgtggggcggcggcggccgccgcgtccattggcgtcagcggcggaagggacgaggccctgccggctgcggcccgcgaggcgatggcgctgggcacgctcctccgcccgcgaggcgatgacctgaacgccgcggagggagggggccgtggcggtggcggtggcggtggccggaacagatcgacccgggcgataaaaggggatcggcgataacagggagtcgccgaggatgccgaggtcgacgtcgacgtcgtccgcggcggagggcggtcgccactccctctcccgctggccgccgtcagctgcgcacctctccctccgtccgtcgccatcaagtccccgcccatggctctcggccatcgccggcctccctgcgtcctccctccctgcccgcctcgccggtctttgcgcgttgctccctcctctcttgccgccggccgcgcgtcgccgcgcgccgttgtcttctgtggcgcctggagagagcagagatagggagatgaagagagggaggtggggagagaggaggaagaagagggggtgagttggactgacatgtgggacccacgtgggtcccactatttttttattattttctatgtgagactgacatgtgggtcccatgggtcgaattgctacgtaagcgccacgtcggacaaagaccgagtcaaattagccacgtaggcgccacgtcagccaaaaccgctctcaaaaccgccgagggacctaatctgcaccggttttaatagttgagggacccgttgtgtctggttttccgatcgagggacgaaaatcgaattcggtgtaaagttaagggacctcagattaacttattccacatgagcagagatatgggctgagtttctgcccttctctactcaattgcaggtgggcagtgtttgaattttttttatttataattttttttattaaaagttttacaaaaataattttccattttgaaaattaacggaaatagtcgcctaccgccctctgggagggcgatttttaaaaatcgccctcccagagggcggcgaaaatgacgtggcagacggccgttcgctctcgggcgacggccgtcaacgaaatttgcaggcggcccccttgccgccctccgcgagggcgattttctactgtgcggggggccgcctgcaaatgggcggcgagggggggcatggaattttgcaggcggcccccttgccgccctccgctagggcgattttgcactgtgcggggggccgcctg

SEQ ID NO: 68922 - DNA, 7915 bp, Oryza sativa
  unsure (1)..(7915): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtgagagctcaatcagcagacatggtgaattattggcagtggcttttgggttgacaactttgccatctgttgctcctgtaagagttatgaagaatcagaggatatcctgggaaagccacgaaactctgaagttgctatcagaaggtgaaaatagggaaataactgtcagggatccaactcattttcatcattttactcgaggctcatgctcttgtagaggctactggtaattgaagttgatgcctcatcttgagagtaggagacttacaagggtgagaacatttttaaggtgagctttctactggcagatcatggagttttggacgcaagcaaaccaagccagatgattcagttgtggtcaggataagactaaagtcaattcaactgaagttgcattgttacagcttgtggctgtgcttcatggttaatagcatcacggctcgagatttttactctgatgaaaccaagaaaggagataaagtgcttacttccctgttagttgcatcattttgactagcacacctcaaaggttcttatgcagtattttgtagtctcatgctaggttatacagaattttttcacacaatctagcagtagagtttcctcgttagggactaattgatcactactttagaagcattcacataattagttcaaattgcatcaattttgaactaattgtgataattagttcaagatatgtgataattatcacaattatgtgataattagttcaagatatcattcctctcagcacacaaattgcgatgataaagaaaataaacctagtgctatgccaagaagctcaagcctgtaaatagacacttgttgaacagatatggacaataatatagttaccgttctttgtagattaattgctttgtttgtaattttgcagggaagattaatacttaatcagggcaacatgaagtcatcatatatcatgcagtaaaaataggagaccacaatcgaatgctttattattgagaaaaatggatggtatcatgtttatctattttagctgaatctatttaaccataattaatcagtatgtgttagtagaagtctttatatcgttatgcatcaacatatcatgagattattaagtaatagctgagtacaccggcctaaccatacttaacatatcatgagactatcgggtaatggacaaactcatgtttaactatggtagagaaaaaaaagtaaattataatttgtactatatttttttaaaaaagttttcatattatgtcatcctttaccattctttacatttcaatttggagaaagaatgaacggtggtgactgtgcgtggagcggcgattagtgattgctggtgctatgaggagtttgttgtcgacacaatctctagccgagtttgttaatatttttctaatacatggaccaccactagaaatatgtgctacttaaaaaggggcttttaactatttgccacttttagatttggcaattaactatttgccacacctatctcaatgacatgtgggtccacatgtgtctatgacatgtgggtccagtggcaaatagttaattgccacatataaaagtggcatatagttcaatagtatatagttcaatagtatctcgcttaaaaaaagcgtagtggtgatcttaaatcctcgcctaggcagactcgcggagtgtgaactgttggatcgcgaaatccaacgcctcgatagcctttcttttcttttcctcgcgctctccccctcaaaccccccgatccccctatccgcctcacgccgccgcataccctctcggtcgctcccccgcctcaaccgccgccgcatcccctccaacgccgtcgctctacgccgcagcagcggcctgcgctccatcgacggcgtgactccgcgcgacggctggagaaggcgaggtcgggccgacgctccacgccgccgctgcccgcagccccgtcggccccgtcgctccatcgccgtcccgacctcgaaggtgaaccggcttcgagtccctcgcgccgccaccgatcccaggactcctcgaccctaccagcgaacaaggtaagagtgctgctcgatcccgttcctgtacaggaggaggcatacgaggcagggtatggtagatgcataataatggctttagaaatctcctgtgctgactaaatccccattgttcattattaaccattgttcactgtacatgtatatctgtgatgcaaaactctaatccaaaatctgaagtccttagtggtttactgtacctgacaagcaaacatctcaaattgctactgttaatgtatgctactgaaaattctggagaaaaaatcgcaagtacttttactgatgctaatgtatgctactgttaagctgttatttgatgctactaaaatatgtaacatatggacatgaatgttcttgtatgtaaaatgtgtattacctgattaatatgactgcttccaaggctgacaccatcttaattagaatatttgattatgagaaaacccttacaatttattgtctattctgttcttgagagttaaaaaaatctttcaatacatttcagtagttttcctctattgttcttcaaagttacataaatctttcatatcttacctatttcagtacgtgcaccatgtttttgtcttcattttctgtagtacagtctactcatccactttgctggtagcttttgcatgtcatgatccccacagcatgatgtacggttttcagttatagacgtcggttgtgatatgaggaactaaattgcaaccaaacagtgattttccagagttgcggttaagttctgaacaagtcctcagttaaattggaaacattcctttgttttccttcatgtctaaaacctgaactgaacagagatgagaagactactgcatcccttccaaacataatttctcatgtttgttattcgatggttttttaattatggcagctaaaatcaagattatgtatcttgggtagtctgatacattaaaaaggatcgatgcaatatatttttaatgaatatctgcagagaaattggataaacctttctcactctgctttttgttttcaggctacactttgatcatctcttaattttcttcaattcaatctctcttaaggttgttcaagttcagtatcatgccatctacctctccagtataatatacttcttggtaagttctgctgactgcatatgctgccatgttttctcttcataataacaacagatatattttgtagttttgaaaaccacattctgaacattagtgcaagttcagtttttaattttatgtttcaagtttaagttcagaaatccacattcttgctatgtatcttacctatttcagtacacacaccatgtttttttcttcattttctgcagtacagtctattcatctactttgctggttgcttttgcatgccatgatccccacatcatgatgtacgattttcatttttagatgctggttttggtgtgaggaactaaatttaacattgatcagaacaatttgtatgcaaattatgcaacaaaaattagcatatatttgatacatgtctttaatgtaccgtattttatcatttaaattaagcttctatcattggatttaaaatgtagcatacagtcactcgagatgattttcatttttttaatatatcatgagtttttatgatggctggatgactgttacattgtatatttgatacatataatcattgtctgttcggagtgggatccacttaacgttatgtgtacttaaaaaaaattaggaacttattgttcatgtattcgtactattgtccagctatagaagaagatacatatatgtcatgcttgaactttcttttcaagtattttttattaagcaaattatctgcttatcacttagcttttatggcattagctcaaattttagtcacgtgggatcatgagtgattaaaacatgtgatcttaaattgatatatatttttcctgttgcaacgcacaagcacccaactagttgagataaaaggtggagtagttgtaacgccccgattttcgttcgggattaaaaatcatttaataatacactttctagaaatttaataaaagttaaatcaatttaatcaagtgaactattgagggaattaaaaatttccttttaaaaatcattggccgagaatattttgtaatattctttggccctaaatattctctaaaattttctcgtgaagtttcggagctcaagaagtaattttaaaagtcacaaagttcattaaactcatttaaataaaaagaaaaaccaaattaaaatcctctcctctcctttgggctcggcccaagcctctccttcccctcccgcggcccgcgcgccgtcgccgctcccgtcgcctccttcggcctgcttctcttccccccccccccctcatgggccgttggcccatttgcctcctctcccttgaaagtccacaaaaccccccagctcttctctctctggccgacatgtgggacccgaggccccacatgtcagctccttccccttcctccagcctgggccggcaactgccgaagccgccattgttgccccacgccgctgccaaaaccgccgcctcccacctcgcgcgcgcacgtccgaccgtagtctagtatcttccccttcccatcccttggcgtaaatgcgtaacggcttgtttggcaaccctaaaatctgccgtctcggctcctccgctccttgcgccatctcgcggctgaacaggggaggtggcgagcagagcaggggaggggaggggatcctgcaggtgagcatcctctttctcagaattcatctctctcccaccgggactagttttgtctggaatttgcttgcgttcgttcggtaaccctagcttctcttctagatctggaagaagctcttctcttaatttcagagcctccttaaccttaatacaagtaacaacagtttgttgtttgttcccccaaaatcaactgaacccccatgtcccaagttcgatccacccctgcctgaaaggagttgataaacttgatgagtctagtggcgatatgtggaatagactcggatgaggtattgttgtagatgcatagcttcttctggtgttccgatgtgaattttagcgatgcgatgtgatgagggaggatttttgttagcagccatgattttcttccctcgtggtacatctttatttgtccatttgcagtaccagttaaagcatggaatctaaaatattataccaactgaagtatggttgcagtttagcattaaatttagctagtcatatagtagtatatgttagctctcatttgatcgccatttttgtctctgaccctccaccaggtcaccagtaacatgccatttgatttcaccatattgtcatatactccttcctttagaaaatattataatcaagtattcccttttccttttttttcttttttgcttttgcttgtcagatagcatgttatctattactgtgctccctaaatctgtgatttttttctccagtgacattggcacttaaaaactgtttcttggagttcataacagtggtcatatagcaatgattgatgatgaggctgactttggcaacatcactgatgccacagaagggcaggcagctgcaaagttccgtccgaaggcacgggccaagccccgtaagacatctttgccatccagatccctggcacctcatcctactgtggaatcaacagatgaaaatgtggaaacattaaataaagatagcacctcacaagaacagtctgttgataaaaaagcagcatcattaggatgccatggtagtgagacagatggtaatgcttgtgcttctggcggtatacttgacacaccttctgaagatgtggtgacagtatccctggggcttgtgaataatcctgatgtggcattggattcttcaacagttttcgcttcttctgcacataaagtttcccaaaatgaagagaataatgatgatgtatctcatgtggctacacacaaagaaaacatggtggtttcagatacccaagcaccaccgacctgttgcagtgccaggacaattgatgatttggctgactttgaaggattgtgtgatgatactcatgttgaggaagaaagagttgcaaaattccagccgaagtttcgggtgaaaaccagcaaggccgcatcgaaatctcagaggactaaccaaaaggcaggagtctccactgtagatgtgctctcccaaaacaaagaagatggtaaagatcaggcaggatgcaatgacaagcagctgcactctcctactagacatcaagaaagtgtacagatctcatattctcaagcacacctgggaactcataacagtacaatcgatgacgttgctaactctgatagtattatggaagaaccagctcaagaggaaatggctgcaaaattccaacctagactgcgaccaaaggctggtggagcttcacctggggttgctgagactattgatgctgcttgtgtagctactccagagtttggggtttcctctgtagatgtggtttcccaagatacggaagaagatagccatagagaaggcctcagtgatgattcatgccaaaaatatatagatgaagaggctattacaacttcaggcactgggccaccacaggttagtggatatttcgttgttcagaaaaaaaaaatggtactgctatttcaaataaagactatggctccatgctctgacttttgattgtttttaggatttggatgatactgttgatttagactcgcatgctgaaatggtaaatccacatcctgatggtagtccgttgatcattgaagagctctcaggtgtgcttattttacgtatagatcttctcccttttttttttttcaaacttgtgatgtttcttgtagtccaaaaaaaaattcctgtgatatttttaagcatgttgaaagaagtccttaactaaatgagcctcaagttaagcttaattggaacctatgcttgttactatgtgaatattccatgctgaactcatgtttgagctggcttcaatcatatataataacttttactagtttttctgtacttcttttaagaagctaacatatttcttttacagcgggaactactgttaaatttcaaccttatgttcgaaggaaaaaaggcaaaggaaaatcagtatcttttgttccaccaaatgtttctcatgcgcatgctcctacagacaccaattttgagacaagcaactctagccatttctgtaaagatatagcaactggtgaaagtttaagcaacttgccccagcaagcatctgaaaaggtaattgcatgctgaaattcacacttctggttggagtgtgtactggcatgatatacttgattgagtctctttgcctaaacattgcaattctcttctcttaagctgtccgtttttatcagatctgtattagtggcgaacatcatccagatgatcaagaatgtaatgacccagagaatcaataccatgagggggagccatatgatcatgttattgaacaagagccagaaagggatgccagagaaacaggaacatcaatgaaattacgaaacaggagaaaattacaaaaagatgggatacctgagcataccgctgatgatatcatggatgaagactttggtgaacctccatctgacgaacaagata

SEQ ID NO: 68923 - DNA, 4529 bp, Oryza sativa
aatcataggtatggcacaaaattttagtttagtattattatgcataaatattttctctatgcaaaccagttatgtaggaagagtaggattcaaggatatatgtgtacatattgtagtaccatcccttattaaactagagatactttggcaaaactatcacaaaactacaattttaccattgatttttccacaacactacagatttaaggcatagtttgcaaaggctacagatttagcaataacttaatcgcaaagctacttaacaaatcccttaaggataacgatgatatgaaggaaccactagaatctcttgcttttatgttatgtgctaaatttgttgtttgcaatattgtggcttaaagatgtaggtttgcagttcaacaccttgaatctgtagttttgtgatagttttggcttaaacacagcaaaataaccactcactggtactgttatgggttgtgcgaactttttttcctttctttcttttttttttttttggaaaaaggtccaaataaacttaaacactctgaactattgaatcatgtattgagcaccctctgacttttgggtttgattcaaataacctcctgaggggttttgcctatataataagttgactcaaggtgcaatgactcagtgattttaacatgttggcaagctgcttataccactaacagaataataagaaaaatataccaggagcaaggatgatgcttcatctttgctcaggtcattttttaagctatatatgtttattttatgtttccttgtttgtgtagtggtttcacgtgtgctataacatgacaaatactacagtcagcacgccatgcaggcaaaaccacttgggggttgtttggatcaaacgggaacgttcaggggtaatcgcttaaggtgttagacaggactctcaggttcagtggggtatttggacgttttccttttcttttggtcatgtaaacttttcttgtggagagtctttcctgtttcagacaagttatttccaatatcaaattgatgctgctattgttagcttcatcatctaaattgtttgctattgttagcttcatcatctaaattgtttgctgcaatttgatggtctgctatacagcttcacttgctatctttcagtgatatgtacatacctgatgcaattcttattttagattgaccgcaatcttttttgtggcacttctaataattgtttcattcaattcaatttatttgactattgaacctcttaaagtttcaacagtctcatttgtcttctaacaaaaattctcagtgtcttttatttagacattgttttctttgtaaagcgcaagccattggagcactcttgtttaataatgtctcgaatatatgttcatggggaagttaatcgtccacacgaactacagcttttagctgaaaatgatttaggcgattcaacttatctgaccctatcatgatcttggtttgtcttaccacagcacctcccaatttggagatatggatgatgagtataacgaacaagacaactgggacaacgacaggactgagaatcatgtggtcgaaaatacaaccaaacttaattaccattcatacatgaacagacaaacacgagccaaatggtccaaatctgaaacggacaagttttacgaggtatttgataaatcaaccattttgattgctatttttcattttttattttataccaattttaaaaagatatttttattcctgcgtatttattggtgttacataaatttgtattttcatatttgttctgttcagggtcttcaacaatttggtagcgattttgcaatgatacagcatctcttccctgataagagccgtaatcaggtgcgacaaaaatttaaagctgaggagaaaaaacatccaatgcaagttcatgatgccataatgcatcgctcgagaggtgagattgttctatagaaaataccagcccatatttttgagttgtgatctagattaacttaatccttatgctttacatctgtgcacagataatttgtattttaaagaagtaatcaaaaagctcaacatcgaagatgtccagccagatatcaacaatacacatgaacaggagggtacatcaaatgaagaggaccctggaaataaggtttgttttgaaactagcgtataattttcttatatcaagttcattttattaatcttgtttcttgttttctgtgtattaagaatataccgggtggattaattaatgaggaggaagaaaatggtttagattggtcagataaagagctggacatgcacagatctgaggtcgaagagaaggagcacgtttctacaaatgatgatgatgatgatgatcttggtgatgtttttgattggtactaacgtgattaccatgcgaacattactgacgacctcatgattctatcaatatcatgggcctcttgaaaatttatattctggtgctatgacctttgggctctggaaggccatattctgcatcgaaaataattttgctgacaggattctccagatggcgatgaaagcagtacagttccaaaggctgaagaactgtatttttttttttttggtttgctgcttatttctagtttagttgaaacttagaaccataattctagtgcttagcaacacagggatctcaatatttgttgcttgaatcctagtttcgtagattacttgcagagtagtaatgtatatattgctccatcatcatttgatatatctgtcatttttttttctgtctgctctttcaatattctattctatcaatggcgctggctcggctgccccctcacgtcgtcgtcatattgatctgctcacgtcgccccgaccctacatcggcaaatccgagctcctcttcgatccccttctgctcgtctttcaccaccagcgccggtagctgctcgccaccctaacctcccgctgtgctatcccaacctcctccgtgcacggtgtttgtgattaggagtaaatgcctaattcttttttagaattttcatgatatttgctaattaatatgctcatcatcttcaacacgaaatgtttaactcgcacaatgacaacaaaaaggtgtcgtggtgtagttggttatcacgtcagtctaacacactgaaggtctccggttcgaacccgggcgacgccatcataattttactcattttttccacttcaatcttcaatgcatttactacatttttctgttcacttcattagttcaatctatttattttttccacttcaatgcatttactacatttttccatcataattttactcattttttccacttcaatgcatttactacatttttctgttcacttcattagttcaatctatttactatattgctttttatcttttctttttcacttcaatgtatttactacatttttctgttcacttcattagttcaatctatttactatattgctttttatcttttctttttcacttcaatgtatttactacatttttttcacttcaatagttcaatctatttactatgcaacaatgtaagcataaaactggccaataaaaaaaaactagatatgtagcaattctgatatcgtttgccctgaagatggcatcagtgtacatgatcttattcctggtagattcatgctactacataacagtattatatctacattcatgcactccaatatccatggtttattggcttaattcagcgtgatcagccagtgccatggcttcactcagcagctcttgccatagttgagctcttcaggttgggcagcatcttggatgttgagccagtggcaatcctggaacgcgcacctgcccgaggcttgcagcgtctcgccgacgtctcggggctccaggaagtatggcgtccacgacggcgtgccgtcctcgaacgagttgtgcgtgagccgccggatgttggacccgtcgatgtcgacggtgaagatctcgccgtatggctggtaatggtgagggttggagaccggctcggcggagacggcggcgtagtcggaggtgaagacgaggctcttggagtccgggctgaaccatgggtggttggtccggccgctgccgccgctgtgcaccacccgccgcagcccggtgccattggggtgcaccatgtagatggcgaagctgccgctccccggggcatggcggtcggaggcgaaggcgatccactcgccgtcgggtgaccagttgcacatcgtgtccgaccatggcccctccgtcagccgccggatgccgccggcctcgccgtcctcggcgtcgatgatgtacaggttcttgttcccggatctccccgaccggaacaccacccacttcccgtccggcgacggcgacgggaacgcgttgttctcgcctcccacggtcagcttcttcatcgagatggttgactcgtcgtcgtcgtcgccgagggagatggccaccacgtccacctccgtggtctcgctggcgaaatccggcccgatgctggtgtataccacgcctttcctcttccagtcccacgacgtcgagaaggcgttcccggagaagagggctgcaggaat

SEQ ID NO: 68924 - DNA, 2551 bp, Oryza sativa
ccggagaagatcttgcctgaccaccggagccgtcggagttcaccacgtacatccccggcagcccgacgaacgcgatcttcttgccgtcgtgcgagaaggaggggaacgagccgtcgatcctgaagagcgagaacgtgtccggtgaccctgggctcttgatgttctccagcagcagcggcgagtcgccgttccctctcccccggcaccggtggtacccgacgcgcgcgccgtccggcgagatgaatgggttgaagtggtgcacgcgcggtgccacgggcctggtcacctcgaagtaggcgttcttgccgtcgctgctcacgtcgatcacctcgatgtggcggtagtcggagcccgcccgccgtgtcgccaccgccacgagccccggcgcgccgggcgacgcggccggcgtgaaggcgtggaaccccggcggggtgattcgctccacggacgccgcttcgaccccgtcgccggtgacggagatctcggcgcggtagacgccgtaccaaccgtcgctgtcccggcggtggaagaagacggtggtctcgtcggcccagctcggccagccgccgtcacggatggcgagcgaccggcgcgacccgtcggcggtgcggaagacgtagatgtcagtgcgcaggtcctcgacctcgccgctccaaccggcggcgccgggcgacgcggcggccgtccactcgcccgagggcgacacggcggggctgaagtccgcaacgccaagcggcgtgaggcggcgcgtgcggccggtggacagctcggtggagtacacggcggcccagctgctgcgcggctccgcggcggggacggcggtggagacgtagacgaggcgggagccgtcgggggtgagcgacggccggtccttgagcgcgattggctcccatgggaggagcggcgagatcgtcgccgccgccgaagacgacgacgacgacgccgactcgagcgcctcgcggcgggaggagggaaccggggagaggtagaggttgagggagccgttgcgctcggagacgaagaggatggaatcggaggcgggggcgaagttgccgttgtagttgacggagacgccatcggtgaggcggagctcggcggcggcggcggggttatggggggagggcgcgagggggagggagaagatgtcgaactcgtagcggctgcggccgagggtggtgaagacgatggtgccgccgctggccgacgccgccggcgccgccggcgaggcgagcagcgcggcggcgaggagcgcggcgagcaaaggagtggccatggtcgtcggactgaagcgggctacaggttgttggatttggggatttttttgcctatttttcgcggcttccgttggtgatgggctgatggcacaaacaacttttttttttcttttttttttttgttgttgttgatggctttcaacatgataaaggtccacagaaaaatcgaaccatttctcacgaatcatatgtaaaaaaaattctgtgaatttttatcccattgtttgccgcgtgattttttgcactggttcctggacggttgggtgtcctgctcaggaagaaagacctggtaggtggtagcaacacacccacccaatctctactagacgcacactcgagtactcgacttgtctatgaccatctccgtcgtctgctgcttaaaaaaatatataatatatttataaatataagcacatatataaagtcttatgaataatataaaacttaagctgttaagctacgtttattttattatagcataatagtatgatacaacctttgtgataggacgcaagtcgttctactttttcggtaagaaagcgtaattttatcctgagaaagaacgcacttgttttctacagccatatgagtaggttgcaatatacactggtcgaatgaaggcaatacgccattttgtttggtaggttggggtgtgaaaacgtttgtcgtcatgggccacccccacgaaagatcatccagacgtttccatggccggaggggacatagtacattgaacacctactgctttttggttgagtaattttgagctggtttaatgtttttcttttctgaaatactcctaaaaaggagagagataaatgttactaacgtgtgttattgtggtcactggtggggaaagatgtcgaacttttgcttccggaagcggaatataatcggcacagtaaaacgtgatactgaactactcgaaacggcccaagtattcaatgggccgaatgcttaacatgagcagggaataagttcatttgaggtcccttaacttgtcaacgaatccgattttcgtccctcaaccggaaaaccagacacaacgagtccctcaactatcaaaaccagtgcagattaggtccctcggcggttttgagggcggttttggctgacgtggcgcctacgtggctaatttgactcggtctttatatgacgtggcgcttacgtggcaattcgagccggaaaaataataaaatcctcggggcccacgtggccccacatgtcagtatcacaaataaaataataaaaaaaatagtgggacccacgtgggcccc

SEQ ID NO: 68925 - DNA, 2704 bp, Oryza sativa
tagggcgattttgcactgtgcggggggccgcctgcaaatgggcggcgagggggcatggaattttgcaggcggcccccttgccgccctgggggagggcgattttgtactgtgctctatattttttttatataaatatcaatagttatcaaatctttttatattgaaaactatacaagattaaaatctccaagactggtaaaatacaattttattatttttagggcatatttggaatgttaccgtacaaatattttgttaatgccaaaatataagcaagttttggcactaccaaatatttggtaaggtaaaattgcatttgatcatatttggtttgctgccaaaatgtaaaattgtagtgaagaatgttgtacataatctcaattctagattacgtattaccaattaataggcttccattttcgtgtgtggtgtggtagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtcaacaggcagcgccgaaagttgatagtgataactcgagctgccgcttttcatgtgtgctgttgtggactgtgcgcgctactggatatggcactaccgtgaagcgccgaaagtgtgttgttgtgagcataagttgttcaagcaccatacgaatgaaaagaactacgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccctgggagtacgtgagtcggtccgggggtacggcacggccaacccgtcctgcctgtacaggtgtgacctctggctgctcctgagtgtgcgcctctggagctcctccaagctgagaggagcctagtacgtcctggtggtctgcaccgtgcaagtcgtcgtcgtagaactggctagtaggaccagtcctaccggcgtgagacgaagaggccccagtaccgaagatcccggctgcaaatcctgctggacaaggaccatcagtttcgtacaggtatttaacagtattaataaaaagtaaagtaccgtgtgggcgagggatcgacgctccgtgagaggaagagctggcgaacgcgcccgaagaggtggcgaacgcccctgcggagctcgcggaagcgccggtcgtgcctgcgaacgcgctcgaaggcatacgaggtcctgcgatgaggaaacgtgcagttaaaacatggtgacacattcgtgcaaaagctgaaacaaaaatgaactaatatctgggctgaactgtaccgtgcgaaaccggtgctataggtcgcactgctccgaagctaggggcgctcgaagacaaacgaggtcctgctccgacggtaggaccgcgaggccgtgggtgtaccggaccagctggaggtacgacgtccacggcgctgcgacaggagaagacgcgcatgaccgcacgcatcttctcctgcatccggtcgaaggtcgacctctgctcaacgtcctccgcttgctcattatccgaatcttccctctccatttcatcaacaattataccgactctctccccctcatccgccatgcccatggcctgctcctcccttggttgattttcctcattttgcatcgatggtccaacaacatcccctgcattgctaggaccctccacatcttcggtttgcattgaaacatttgtatctttctcttgtaccgacacaaatataacgaggggccatgaccgttcaaaagccatttccacataccgtctccaagcagcagtgctgtccatcggcattagttcccaaaaataaccttctattgcacgactcactacaacagatactgacattgtgtagacttcttggtctattctaaatcctctcaacaaccaactataaattgactcaaatgttctctccgcaggcctatcgatgcccttagatgtcattacaaaatctgacagatcaacaccatctggaccaaatctaatatttccttcaccgtgaactatctgaaatgtgaccttacttgacattgtgcctgatgaaaacaataactgcgttaacctcgcactacgccctaagttacattctctacaatattgttctctaaatttctaaaagtaggttacattctccagatcaaactaaactacatcttacaattaacactactgtctatgtctcaattcatactattatattctatgctctggatctacacatatgtgctgtgtgctacagatctgctaaaatatatggaactaaaactaaaacgcaacatatgtactcaaacgtaatatattagtacaaatgcaaaagatgtatgggagcatacctgtgatgaagtgagcgaaccagcagggcttcgccgctccccttctgctgccctcccctctctctctctttcgtttttttggatttttagtgaatataatgaaatttcacaggggaggggctgggctttataggggggaggcaaaaatcgccctcccccagggcggcaagggggccgcctgcaaaattccatgccccctcgccgcccatttgcaggcgggcccccggacag

SEQ ID NO: 68926 - DNA, 7857 bp, Oryza sativa
attttcaaaatggaaaattatttttgtaaaacttttaataaaaaaaattataaataaaaaaaattcggcagtgtttgctatgatgcggcccagtggagtaagcaagagatatcttagtgggctctccttcagtccttcccggcctttcatgggctcccgtcccgttagtgcgagatggaccgagttctaatcggtgggctttcctactgctcgtgggcctaaaacgacaagagggagagagcggtacgatgcggagtcgaccaatattttcagtgtattgtaggggggcgcctagctcgcgcatacgcgcttccccacctaaccacctatattagtattatattagtattagttaacactacttaacactaataacagtaattaggaaagattttagagatttttttgagatatttttactaacagattgaaaatttttcaagttagattaagaaactttcgatttaagatttaaattttaaagtcaaattttgaagatatttaactcagatttaaaaactttcaactcagattcgaaaactttcaagtacagatttgaaagttttgaaaagtttcaactcgagatttgaaaacttttaactcgattcgaaaactttcaagtccagatttgaaacttttgaaactttcaacttgagatttgaaaactttcaactcgagatttcaaaactttcaactcgattcgaaaactttcaagtccagatttgaaaattttgaaactttcaacttgagatttgaaaattttcatgtctaaatttgaaaattttaaagttaaaatttaaaaattactagtaaaccaaccactagtaaaaatatgaagctaatctaaactaattatatttttttcttttatccgtacgacaggaacaatatacggcgaaaaaaaagaaacagcggcgtaaaaaaaagaaaaaaaagagagaagcgcaaaagcatgcgcgtgcatgggcctcgtgggccggcgtgcgcgccagcaacgcgcgcgcggattagcctttccgacgcatgaatctgaacttatgctactaccacgaatttagatatagctcatgttcagattcatcgtattaagatatatcttatattctactagatttatttttacggggatattctactttattgttatattataagacggagcgagtattttagattgcattatcgccgtgtgatgacaaatcagggcgttgctcatgtcgactataggaggaccaacacaaccgcacatcaaaaagatcgaccggctagctactgctccctcatgcatgttttttttcaacgcttggaacctacaaactgcctctcttgtggcattgacgtgctaccttatgatagaatattaatttcattgatcaatattggcaaggattaaaatgcattatagggtagcttcgtcttcccatgtactcctttttgtttaaaaatatactccgtaataattttggctagattcatatccaatatttgtatatgtatatgctcgctcgaaaaaggcaaaaagcacgcacacgcgaaaaggtatagacctgcacgtgatgtccagcgagaagcgatcgaattagcgcacgtatgtacgtacgtatacacatacgctggcctgtctttctcctgtctgtcttatactacctactccctccgtcccagaaaaaggcaaaccctgggtttacgtgtccaactttgactgtccgtcttatataaattttttttataattcgtatttttattattgttagatgataaaacatgatcaatattttatgcgtgacttgtctttttaatttttttcataatttttttaaataagacggacggtcaaatattaggcacggaaaccagagtttatcttttttttgacagagggagtacctaccagcctgcacaatcgaaccgtagatgcgtacatatatacgtgtattgtcctggatactatatatactagtgtgcgtatatgtaggcaggccagagaccagagcaggtgcacatcatataatagtacactcatctttagcttcatacagtatttgccaaaacgacaaaaccacacattccgacattatattccacctagtttagtagctcgatacactttattctgttatgttctatactattttgcaaacaatatgtgtttgttagcatatatagatggatacatgttaattattccacttaacaatgtgtgtgtgtgagagagagagagaggggtagcgtactagatgttgtaatcaagttagttggttaaccacttaacaactcaatagatcgccatacacatacccatcgtcacgatcgaattagttggtgtaaatcaatcgatcgatcgaccgagtgagatatatgcatgcatgatgttgaattgttgacgactaccgatcgatcgaccggccaaatgattaattattttctgtgcctatatatctgtctggttgtttttctttaattttactgcattatatgtgtcactctctgcagatcgagctctctagctacacgttacatcctgcaaccgctctccaactaacacactacacctgcatgctgatgctgggttaataattttggcttcttgtcgattactaaatcttaattagtgaccatcgatcacttctaaatcaagcagctatatatctagctacattggattaatattttcgaatgatccatctcacgaatgtacgcccagtgacgaccatgtctattgattttaaaaataataataatagaaactttcattgaattagaataactacatcaagtttaatcacgagtttggtattatatatactgatactacccatcgtttcacttattcaggaaataaaccaaacagcatatttgcaaatggaatataatttatgaataaaacttttatatacgtgcgtgttcttaactagtataaaaaaaaaggatgaaaaataattttcgatgataaaaacctcaaattaactttaaatttaaagttgaaaattcaaattttgttcaaggaaagttccggccgccaagcagaactgaccgacctcctacttgccggctgaaaatttgactttgtacttctcttctatgaccaataattgattaaagagtgagagaaaataaaatggcatactgttccattcaactgggaattaattgtgcagcgattagttgacaggaaaatgacctggcagcacagccatggatgcttaagcttgcatttttaattaattaatgttgcggcatgcatgaagcagctagcgatggatcacgatcacatcgatcgttttgatctactcatcgtggcaacataatggacaggtttttgcttcatctgctgttgctcgaaacttcacaaaaaagagaggtaaaaaggttattcagaaagtgaaaaaagtgacataaagcagagtggaaggaaggtgcagaccgtgttctttacagaagaataattgtaaaggaaaaagtatgaggtaattaagtcacttgacagtgaaattaggagaaatcagcaactagctagctagcatccagctgtacttaacctagatttagctagacctttatatccttttgctttaacagtagatcattaaaagaactccaattgataagttaattctagaagagattttagctttgcgtgatcgatcgatcgatcgatggagagtatagtagattagtagttggtggtcatgcgtgatgcatatatacttgtctgcacatgcttgcccagttgcccctgttcgaatttcatttcatattcgcctctcatcaactgtaaataattcagaagctggttgttcaaaccgtataataatatattctcccaactaattgcacgtatgcgtgctcacgagctgaacaatacgttactgctcagtccatccccttcacagaatggagttgtattttttttattttttttagataatggagaatggagttgtataggactcctaattagtaattaacatatactcctatacatttgttaatttaattatagcaagttgagttatgtttgcatgtgtgtgaactgctcctaactaatcagaccatgttaagctctgcatatgcatatttggtctagcaattagtactcaacatttactacttgagcacgtggaattatgtcatctccatccattccatcactgaggaacaagtcgtgcgttgagcatgcgtttgcactgttgaccgtgctagcttcatgaaatgtctgctaattttttgttaatcagatactaatttttattcctctgaacccaaactataccaaatatggtcatcatttaattagcagaagtacagaaatgaaatgatcagccgctggatctatcgatctcaagctcaatcgttcttaggtctgcacttgtaaagaatcaagaaaggtactattactaccgaactttttcagtaccactccagcgtatgtagacaggaagagtttaattaattaattgattagtcatgtaccatcacccttaatcataaagttgtcagctttacatctgctaagcctagaattatactgaaatgatggaggtttagctttctactcacgtggttaatcatgttgcagcagcagttttctcctcatcttttaatttctggaaggattacgacagtgaaccggacttgttctacaggcctgcagcgatagctctaggattactgattgaggttaggtcggtgaggtgaaccatcatatatccatcgaatacattaattattcagttgattaatctctggtcaaatctgaggatttatttaagactcgagcatatctactgacaaacaagtgaaagaatacatgtatggtatcccaataaaaaataatgcatgtcagggacgatatataatccaaggcagatagctaccggctctttttatttttcttgggtgagattcagaagcatgaagccgtgaactacggtgtctgtctgaacttctgaacagaattcgatccagacgatggagaatcacaattgggaatgattcttgttcttccaaaaggtaaatgaagtgtgaaccttcagaagaataatccaggtcaagttttcctacgagaggagtctgaaactgtgaaaaaaatcaaagcaatcgagaacaaagcagagcagtagaggcagctcgatgctgacgtgcgtgtgtgccaagtaccaacacaaatccaacaggcaaaaagcttcagcctccaggattacaaacacagcaccaaataatgcatatatttttgcattgttcatctctcctgacctcacattggaataagactggattatagtgaggacaaaattaattaaactatcaagcaagggtccactgaatcgacatctttgtatcgttgatgacaggtacatgtattgtgcatttgtgcattgacatggacacgttcagtggagtagtttcacttctccacgttttttactcgtcagcgaacccaggaagaagaagatgaagaacatgctgaccaagctgaccaccaaagtgtgtacacacgtagcatgatgtgtactgcattgattgcatttttcagagctttttttacagctctatttcacagtgtatttggacacatgataattgataaagaatataggagcatttctaacataaaataaatatactataaaaatatatccaacggtggatttaataagtttaattttgtgttgttaattgttgtgtgtttttcaatgaacttgatcgaacctttaaaaattaacttaagacaagccaaaaaaacgctttataatactactactcctactatggaacagagggaataatacattagagttcctatgtcccttctgctgtagtaaaagctgttgcacagatttgggattagttaggtgaaggtgataatgcatttctgtttggtggtggtactaccactaaatacatgaacaagggaagtacagacaatacacatttgctacaattataatcctcctcctactctacagatataatcctgcaatttgctccacatgagatgcgtggagactatacagctaattaagtgccattgcatgatctgctcaggtgaccaactacagctaattgctgcaccttggtttgcaacaactcaggactgcacgaaatgctgtgggctctctcgtataatactgcacattcacaccgacagacaacaggaccagctgctgctactgtactaaatcctgcaaagacgtttttgcaacttaattactccgtgccgtactaattagttttgctatgaaaaaggtgcagcgtagttaacacaactaacctatctcatacgccaatagatttcagatcagcatgagtattttatttagattctaatctgacttactgactacttgctgaaacttgatcaacacaattgtcagccacaagaattgttttgggagcaaacaactttttttcttactatttcatacaggcagtagcattatctatctatttaattatttatttgatcaagcatttcgttggatgagtactttgaaagtctgaaggagtaggagcctaggacgaccgttgtaagcaatttgctccataaatactcgatgcttgattaatgtgacggatgtgcgtgtgcgcaattaacgctaagcttgtacgcaacaattaaacaatcttccttccaagctcgaaacctcactgattgagaactactgctactgttccattagctaattaatacgcatgttaagtgcaccctattagctaattaactgtgcattacccactcgcagacaacacattttatttcctttcgggcgagtaaaacatgccgtgtgtttgtgtgtgttaccattaattatgtagctaaatccacaggccaacaattttctgcttgtcttcatctggtctttaatttgaccttttgttcatatttcaatataggttcacaacttcacatatacgactgtcgtctgattcgtacgtttaaggtcaggccgggtcctaaaagtcatcatctctagaaggaatatgtttttttaaaaaaattaatttgtttgttttgttttatgtaattgtttcgcttgataaaaaaatatgtctttgttgctaagacaatggctgaaacaagtatcttgattaatccagtataaatatgcaatggataatcaccactggacaatccttttgaccagttttggctctttgcagtgttggtcattgggttatcaaatcatgacttgcaagttaaggcttgtcatcacctcatgattctttaactaatgcatgaaagtattatttgttccagaaggttgaatcaaatgtcacctaatgagtacgcctgcagaacaagacaattaggatttgggacaggaaagtatggtcaatacgtttctgacagtttcgtggtagctgaaaaatgcaacaagattaattgaaacagtgaatgtgcatgctaccttaacagctaggagaccagcgatgcagcaagtgaccttgatgctcagttccaacagacaatcatccattaaacaaagccagaactactaattggaagacccagcatagacctgcagcgactcttaattctccccattagtttgggacttggataagtagctgtcagatctgacctaattaatggatggaaaaaggtttggtcatctgacctcccaacagattgaataattggttcctaattgcagtcatatatcttgattcttgcatggagtagtttcattcatgttacttcttccaaaatagaaagagcacagaagaaaatgcaactgcattactggaaaaatcatgtactgtactagtctctcaggcatgtgaagtttggaaaatgaataactaatcatactataatcaacaaagtttaggccacgtttaaaacagattttt

SEQ ID NO: 68927 - DNA, 12604 bp, Oryza sativa
aaggtagtatccaagaagcatcatcagcaaggaggagggacgacgacgatggaggagggcgccatggacggcgctggcggaggagtggcggaggaagggtgctccggggaggagagggagggagtcgccgacgtcgctgttggcggcggcggcggcgagggggagcgggaggggaggacgctggtggtgggcgtgcgggcggacgccgcgagccggacgctgctcacgtggacgttcatcaatgtcgccgcccccggcgaccgcatcgtcgccgtccacgtcgtgctcgcctccgcgcccgtggccgccgccaccaccgccgtcgacttcgacaccatgctcgccgtctacgagggcttctgcaatctcaagcaggtctagctccctctcccctcccttctctcgccctcgacttgccagtttgctcgccactttctaccaaccatgtccatccttctcttctgcttcatcttttttcttctcaattgtttggttgatttcaatctctcctttatttttggctgtttttgaaggattagatttttagcccatatccttacaatttttcacccatcctgcataaattatcccagttgcaacaaatattcagagagtggtttccgctaacttttgcagtaatgcgatttttttacctttatttatggctttccttctgcaattcacatacttcccgctcgttcccctctgcaaatcgcagtattttcgcagtaattgactgcttcagcaagctaactttggggtcttgtgttgtgcagatcaatctaaagctcaagatttgcaaggactcctcggtccgcaaggcgctagttcgtgaggccaacctgtttggggcatccaaggttatcgtcggcatcgccaagaagaagcgcgggatttcgtaagtgacattcgatccgcatccgctatcaaatctcatcaacttttatttttcacccaatgatgatatgattgatggccaactttcgttttttttgggggggattcgtcaggtccctgcactccgtcgccaaatactgctccaagaagctgccggccaagtgcgcggtgctcgccgtggacagcggcaagatcgtgttcaggagagaatccaatgtccactcaggcaaggtctccgcggagattcttgtttgtggtgataatgagttgtattgcgaggtgccgttcctagcccgtcagtgtaaagaggaacctttacctttacatgaaccacccagagatggtggtggtagtgcgggcgaggaagaagaagagcacgatgtcggcacaaaggagaccgagccggtgaatgccgtctccggtgaacagcacgccttccggtgctggactcctgctgagttgctctccggcatcaggttcagggctgactgccgatcccatctgacaagggtgaagagccgactgccgaccagaaagatgagatttctgagcttccgggtgagggtgctagtgttttgtactgtgtgttaccagagaggaatggccattcagctgcaagacgtccagtcggcaatccaatgattcgaccgaccaccgactgaagggaatggggagctgtactgtattttgcccccaagaaatgatcattcaggcaggagtagcggtgattctagccgttcaactgcgagtcggaaacacgatgattctgccagtctgtctgctgaaggagatggtgaactgtactgccgattgccaaggactggccattcaggtagaagttctgggggatcaaagcgttccttcggtgcaaaaggtttgattaggcgcagcagtagtttctccagtgatattcaaaaggatgtctcagtttgcacgactacaactgaacagacttcgtccatggtatctacagaagctgaggattcaccaaagaacgctgcacgtgatgtcgatacaccctccagctctccaatgtctctaagaaggatgatagagggaaggcccgaccgctgtcgacttcgaaggaggatcttcaatcatcaaagaagctcatcttttgaatgggccaaaatttccatggttcagtgggcaatgaggcttccaagccgttatacttcagttgcagacaacaaatcatttaaatcagatgcaagtccaaggttgaattgtgattccgaatgtgaatccacttcagctgttgacacagaatctatgttttcgttctctttatatgatatatcatggcctccaaatgaagtggaatcgcttcaagagaagtactcttcaacgtgtaggctgtttacctatgaagagctgaaacttctacgtcaaacttgtcaccaggtaatgtcatttgggatgtgcattactttgattcacaggctttttggcaaagatgtctgctgattttcttttacaccaatgcagatatgttaattggaaagggaggaacaagccaagtttacaaggcacaactatttgatggcacattatcagctgtaaagattctgaaaccttcagttgatgcaatacaagagtttgttacagaggtggagattgcaaccagcttgcaacatgacaatattgtttcactaagaggattcagttctgataactacagtcttgtgttggtatatgattacatgctccagggaagcttagacaaagcacttcatggtaatccttaaaatgaaatactttgcatatttattccctgaccttattgatagctcatctcttactttgtgattgactggttgtaactgctcttcaggcaagcatgacagcaaggatagccttagctgggagaagagaaacaaaatagcaattggcatagcaaaggcacttgaatatctacatcatggaagtgtcacccaatctgtgattcatggagatgttaagtcttcgaatatcctcctctcagaggattttcaggcacaggtaaataaccataagagatttgcaaatactgaaatacctgaagcaattatagttttttcttcatacagtaaatatttttttcagatcaaagcaagtgctttaatgcgttagcagtgacgaattacattgagtatttggtagccttactagttaattttgattctgcttatgacatcatctcttttgaaatttccagctttgtgattttgggttggcaaagcaagttcagcttcaaccccccacctaacatgtactgacatcacgggaacgtttgggtaagtaccatctctatgctatttttaccagctattgctacttttatcaagtgtgaaatgcctaagcaaactactcctgtgacagatacttggctcccgagtatttttcgcacgggaaggtcaatgagaagattgatgtctatcatttggagttgtaattctggagattatttcaggaagaagacctattagaacaggatgttcaaagggtcaggaaagcctagttggatgggtgagtgatccttaaccccctatatgcctggctggcttgctctgagcagtaacatgccctgagccaagaacaaatggtagttgcacgttcagtcactgttggaattaaagctgtctaggaccattgctgcattttttttgctctgttgaccacacaatcactcctgcacgagcgagttattaattattttttctttttgctaattctttgttgacggattcaggcaaagccattactatcaagtggggaaattaaacaattggttgatccattcttgggaaatgattatgactgtgatgaaatggagaggatgactctcgcagcttcgctgtgcacaaggacatcttctcattcccgacccgaaatgtcacaggtaagaacctgaacaaattacatgtacaaatacttaaaaagtcttgatgattgacctcaacttgctatgttctggcaacacagatgttgaaactgcttgaaggagacgacgagacgatccactgggcaagaacccaggtcaccgcgagcttcgacggatcggacgaggaggctgtggcggctcctgactcaaacatgcagtcacacctgaacctcgcgttgctgggcgtggaggatgacaccctctcgcactgcagcactgaacagaccatggacacttcagctgacgggtactggagccggtcatcgagcttcgactaacctcctgcttttttcttaaccaccatttgttctgattttgagccatgtgaatggggagctgtgtgtatagagtctctcaattctcataactttgctgctgctgttgtgtcgattggttggaatggtgaatgcaaattgaaaggaagtggatgatatgcacattcggatggcagatgtagtagcttaggaattgtggtagatctaaccctgctggcctttggccctacttggtaggagtatgtatcactgatgggcttcatggtgcatcaagatttgattcttttccaagttgcttttgttttgcttttcctctcagatgccatgccatgacaggctgcctgtctcagatgctcatctaacaccaccatttgatgaagaacatactacacatactgtatgtgtgaattggccagccacaccattagtagtaggtttctctctcactgagacatatgatgtaactgatcttgtcagctactgtacagcaaagatctggtttgcagttccaggtgtaaatgtaacatggcatgacgaaacgccgttcttgatgtactgttctcagtacaggaatggctgggccagttcagacaaaaccagagtctcatgaatacaggactgacaccgcatgctccctaccggagctctcttcgcatcaacacatgtgagccttgtctctctgtcaaactctgaagtttcaggacacctccaatacaaaggatgctactggggtaaacctaacacttgcaaattttgcatcattcagatatgactagcctgtggcccgtacgttgcaacggaaaacaaattgagtttctaacttattaaatcaattaataagcacttataagtaatactatgatttctttttattaaacaagtagatgattttaaaattcgggggaactaatagtatagagaggatttgttgaaacgtggtgcaatagtatagatcgtgggggtcagatatttctagtaggagtgctgtgaaaatggacatcatcaaactgagaagagtgttacaagatcatttgggcctcagttcactgggcggttggataacaattgggcctagctatttgcccatcatcaactgcaactgatctggcccaacctagtaaccggcccatgtcctctcaacaagacctccaaaaacaaagtcctcaggaagacaaaaacactagttcatatgattccagatagatatgttccggagtgatctctaggagaagcagcaaataatatgctattacctgttagtatcatgtatgatgtatccatttatttattattaagagttggtgcctagtattcctactatctaagataataagtatgctccagcgaacttgatctgagttatcggagcgatgacatttggagcacaagacaacaagcaaggcagcttgaaatatattcattactactacataaatatactgaatggcaccatcaaacagcttgttcctcgctggattgatcaactgatagcttcctatttgtcctcctctgcatcatgctcgtcattttgcagctaagtcctcacaaaaaagagagaggaactttccatcaaacagcccgtttggagactaaattgcaactctacagaacagttattatcggttgatcgggaatgaaccatatttacccattttaattgttacttcgtcctaaaatataatataagagatgctgtgcacgtaattatatgagaaaatctcttatattttaaaacagaggtaatatttagggctgattataatatatacaatgctaaactaaattttatataggatgagagttagaaacaataccatgttttactgaaacgatgctcggacggttggttgggaatttccgtcaccgttttaatcccgatcgtatatgttcaaatctgcgtatgcatcgaccgatccgcacattaattgtgattgtgtggacattctcaattctgactgccaaaatcacgcagcaccactacagtgaaccttctacttgactacttttatacatgcatggttgctaattgcatggtccgatctgtaagcagctagctgtaaacacgatcgttttatttattcaagagcgattagtgattaccagtactgctaatcactctcatcgactgtactgatgctgtcaacagccactgcaattaattttctcgctggtaattaacttgcatgtgcacgtcgcttgcctgtaaaaaatttccaagaaagcgaggtgccatgtgcaaataatggctttcgctgcacataaaaacgcaagaattaaacgtcgagtgatcaagctctggttggtgacgccaatggcgttggacgagtcgttcaagaggccgggcaccatcccgttcaagtgggagctccagccaggcgtcccgaagcagcaaccacaccacggcggcggcggcgccgccgtcggaagtagcagtgcatcttcttctccggcgccggcgccggcggcagcatcgacgctgctgctcccgccgaggctcctcgcgcctcctcctgcagccgcggcgtcccatggcggctgcgacacgggggcgaacattctcgcttcgacgacgacgccgtcgccttcgtcgtcgtctcaccggcggtccatgtctgcgcggttcacggcatcgctggtgctgccgttcacgcggccgcggcggggacggtcagccaattcaaaggacgaggacgacatagccttcacggtgctctatggcgacaagattgtgtaaatattcatactccctttatcccaaaatgtttgacgccgttgacttttttaaaaatatttgactgttcgtcttatttaaaaaaatttaaataataattaattcttttcctatcatttgatttattgttaaatatacttttatatatacatatagttttacatatttcacaaaagtttttgaataagacaaatggttaaacatactttaaaaagtcaacagcgtcaaacatttagggaagtaaggaatattttgggtctattttcaaaataaattttattaaaggtcgatttgtcagaatttcggctgttttgatgtatatatgtgctttacgtgtctaaattcatagaatagagagtactaaagtaagcactgagcactgaggcatcatttccttcatttcggtttcgaaaggaggttggaaagagacaattggagcattatgcatttaattacaaactctacactgcgtaattgccagagttaaatgagtgtgtagtgtactgtgacaataattgaacttttaaattgcagcactaaatagatcatattagtcattgctttggtgacgctgatgaatcagtagaacatagataatcctcagcacaacatggtagcatggcaatctgtttcaacacagattttcctaccttccccctctccccgcactggcatggtgttttgctaacacggctaagcgcctgaagagttggagtgaccgtcacatcggcagcgtccgtctccaactgcagatggcgaaggagaacgtcttccggtttgacgtcgcgcaagagaaccggtctctctccccctggagacttggttgcagcgggatttgaaactgaagtgccttgggctagcttgcctcgctcgagcccgctagcgttcgcgtctgatctggctcaaggagggtgacagaaacaccatgtttttccacctgcacgctagagcccgaaggcggaagaacttcatcacacgtcttcaagatggggaccaacttgccgtctcccacgatgagcttcaggagcttgcctcttctcactttggcgctatcttggggacgtctgttgagcgcgatttcgcccttgacctccactcccttggtctctgccctgcgcatcttggggggctggacaaccctttctcggaggaggaggtttgggcggtggtcaaggccttaccttctgacaaggcgcccggtccggatgggttcacgggccggttctacaagacttgctggtcggtgatcaagccagaggtcatggcggctctcaactccctctttctcgctaacggtcgggggttctcctccctcaatgataccctcatctcccttctgccaaagaaggacgaggctgttgacgtcaaggatttccgaccgattagccccatccacagctttgggaagttgttctccaagatcccggcttcccgtctctctcctcaccttggcgagcttgtggcgcccaatcagagtgcctcgtcaaaggccgatccctttcatgacaacttccgctatgttcagctcgcggccagggctctccacgccaagcatatcccccgcctccttcttaaggtggacatcgccaaggcttttgacacggtcagctggcagtttctacttgagatgctcgcccacctggggttcagtcagcgctggcgtgattggattttcctcattcttggtgcctcctcttcccgggtgctgatcaatggggtgccggggccttgtttcccggtcttcggcagggagatcctctctctcccatgctcttcattctggtcatggatgtgctcaatacgatgctccgcaaagcctccgagtcaggcgggttccttccgctcaacgaccatgcctccctctacgctgatgacttggttctcttcctctccccggttcgtcaggatctcgaattcatccagggtatcctctctatctttggtgcagcatccgggcttcgcactaactttgccaagtgttcggttactctgatccgctgttcggcggaggacctggacctggtgcagtcctgctttccccgctcaatctcagattttccctaatcctatctcggcattccgttgtccattcgcaaattgccgaaggcggccctgcaacctcttgtggacaaagtttcccatcgtcttccgccctggaagggacaactcaccactctggttagccgctctgtgctggtccagtctgttctctcctccattccggtccatgtgtctatggtgatcggtcttcccgcctggatgatcaaggccattaacaagaagcgccgcgccttcttgtggacgggtacagactcggctcatggagggtagtgccgggtgtcttggacgaatgtctgtcgtcccaaagctttcggtgggttaggaattcctgacctgaagttggcagggtttgccctgtgagttcgttggctttggctccaacactcagggaatccttactgggacggcctgaaagccccagccgagcgagccgtcactgacatgtttcaggcgtccaccttcttcgtgccgggtgatggtgagtcgattctcttctggtctgaccaatggatcggtggccgctctgttgcctccttggctccagatctcctcttcgttgtgcccccgcgtctgcgtggttcgcgcacggtttcttctggcctggcgaacaacgcttggatttctgacatccgcggggccctcactgtcccgggcatctcccagtttcttcttgtctaggacgcggtgcttcacttccaactttcaccgggtgtcggggatctgttgacgtaaaaatacgaggcctgggggatctacttaactccagtgcaggtccaaaactcgccttcgggtatgctagcgtgccagttgatttgatcctgcaatcaacaagaaacaaagacaaagaaaccgcggttaaatccataaacgatagccgatcggctaggtgccgatgacatatcatttatctttgagccgatgtcacatatgcatcgatcggcagtcataaataagtaaggaagaactaaatctactcgatcggctgtagatattaacaatatataatccccgtgtcgatatatacataaatcaagtgattgggatagattggtcgccatgccgagacaatataaatcacttagatcaaaatatatattaacaacaagactatatacgttcatagcatagccgatcagatagatctagcatgtatcggctaatattccgatacaactctatactaggatatcaaagcaaataggatatattaaacaaaggcctaatatacttaaatgcaacaagatcttaatataaatggcagatttaacatatcagcgaagcatatagagtaaatatagttaaatcaggtaagatcggctgaaaccccgatactaccctaatcggcaaccaagaagcaggctagagattgagattctaatcacgacttataagatcaaactcaactgatgcagctataagtatgaaaagaatgacaatatctagacaatcaagccattggaagtttcatagagtggtggatatcctatataatctaagtcaacatcgatatctaacctaatcggctgccctcttccgacagatgttagccgattataggttagatagcgatattgccggagattatgtaagatatatgataactcgacaaattacataaacaagattagagtatcataaagatggaagcactaatcccgagaacgcaagccaccataacaagttttacctcttgttgaagatcgaaaccgatgcagctcaacccgaaagcaagaactcgtcgaaacaagacgaaagtaaaaagggtggcgatgcgccgagattgtattgaacgtgtgttaatttgattacatggggctcggggtctatttatacccgagaattacaaaacatgtccatatcaaacacgactcttatctctaacaaactctaagataccataagtatttgcggcaaacttttgcccacacttatctctaaggaaattacataaaatatcctaattaatagatacaattgccttcttaggactctatccatgtgcggcaatcatcacgaagtgcatcaacctaaaccgacaacgtatgccatgtcatgctgtcagatttggctcaatcggctaacccatctgaccgaactctgccgatttcagtcgtagccgattcagattctagctgatccttactctgtttccggaatgatttcaatcttgattccttctcgatttcttcctcatctctgatccctggattagcaaatttggtcgttaacaggatcgtcttgtctggcgttggacgagtgaccagcgctactcggcgcattcggcgtaccaggcgttcttccttggccagcactcctttgcttgtgtcgatcttctcttgaacgcgaaaggccctgctaaatgcaaattcttcctctggtttgcattccagcagcgctgttggatggctgatctcctccaaaagcgtagcatcgatagccactcgacctgccccttttgcgctcaagagctcgagacagcgaaccacatcctcctcgactacgttttcgctcgtcaggtctggttacgggtgctgtcgcctcctggctggaatgccctctcgccccccgtggcagctggctccaggactggtggccatcttccaaggctggtttacctgatcacctccgtgccagcttcgactccctggtcctcctggtcttgtggcagctatggaaggaacataactccggggtgtttgactctgcgctctcttcggtctcagtggtcctagagtccatcctgtcggagggccggttgtggtcgttagcgggcgttgcttcctttagggacttgttgggagtgtagcatgactctgccccctcccgttgtttagagtagcgttcaagtttttctttttcttttttctcttcgttgttttttgactttgcgttttttccccttccttggcataagccggtctggccaattgcagtgtgtaacaaaaactctattcctctaatatattgacgtgcaatctttttgcgtgttcgcgaaaaaaaatcaacataaagaaaaactgatctgaagataagtcagccaacacattgttggtaacaaataaaatcacaaacgataagcctagatgcctggataggcagcaccagtggcaggtgaggtcttcaaaatagcaattggcatagcaaaggcacttgaatatctacataatggaagtatcacccaatctgtgattcatggagatgttaagtcttcgaatatcctcctctcagaggattttcaggcacaggtaaataatcacaagagatttgcaaatactgaaatacctgaagcaatctcagtacagtaaatatttattttcagatcaaagcaagtgtcttaatgcgttagcagtgacgaattgcattgagtatttggtagccttactagttaattttgattctgcttatgacatcatctcttttgaaatttccagctttgtgattttgggttggcaaagcaagtgtcagcttcaactccccgcctaacatgtactgacatcacgggaacttttgggtaagtaccatctctatgctatttttacctgctattgctacttttgtcaagtgtgaaatgcctaagcaaactactccagtgacagatacttggctcccgagtatttttcgcacgggaaggtcaatgagaaaattgatgtctatgcatttggagttgtaattctggttctggagattatttcaggaagaagacatattagaacagga

SEQ ID NO: 68928 - DNA, 11331 bp, Oryza sativa
ttggaattttttgctgcattttttgctctgttgaccacacaagcactcttgcacgagcaagttattaattattttttctttttgctaattctatgttgacggtttcaggcaaagccattactatcaagtggggaaattaaacaattggttgatccattcttgggaaatgattatgactgtgacgaaatggagaggatgatgttggattaggcctccattctttagctgatgactgactcttgcagccttgctatgcacaaggacatcttctcattcccgaccggaaatgtcacaggtaagaacctgaacaaattacatgtgcaaaatacttaaaaaatgtcttgatgattgacctcaacttgctatgttctggcaacacagattttgaaactgcttgaaggagatgacgaaacgatccactgaccactgggcaaggtcccacgtcaccgcgagcttcgacggatcagacgaggaggctgtggcggctcctgactcaaacatgcagtcacacctgaacctcgcgttgctgggcgtggaggatgacaccctctcgcactgcagcactgaacagaccatggacacttcagctgacgggtactggagccggtcatcgagcttcgactaacctcctgctacttttttcttaaccaccatttgtgatttgttctgattttgagccatgtgaatgggagctgtgtatagagtctctcaattctcatacctttgctactgctgttgttgtgtcgattggttggaatggtgaatggaaagaaagtggattggaggatgatatgcacattcagatggcagaaggcagatgtagtagcttaggaattgtggtagatctaaccctactggcctttggccctacttggtatgtagcactgatgggcttcatggtgcatcaagatttgttttgcagccaaatgaacagactcggcacactattttcgcaaataatttattacttgctgaaaaatccaaaaggtgaggatttgatgtggaaaagaaaaggcaagtttataaatttggctgcaaaagtacaaagtttgtattccaaatggtttactatttttgcagccaaactcgaaatgaagcttagcaatactgcaagtttagatttcatagagtaaatggtttactatttattttgagggatgatggtttactcaggcaccagtaatacaaagtttgtgaattgtgaaggaaatccaagaagaatagggattagggaacttgtctatcccctcaaccagtccctccctgtccctcgtcctattacccaaatgaacatcaccatagttgatacatagttgagaggtgagaacttgtgcgaatggaaatgttggtagttccatactaaagtacagatcaaaatccccattgcatcagttgcatgccaaagatcgatggcggtacttaaaccctaataatcctcctcgagcagactgaatcaccagacaagagagcgataatccactaaaattgccagtttagtagataactgcaagctaggaacggagcacggctacaagaagcaaaatcgatgaagaaaccaagagagcaggcctaaacctagggtggttatgggtagagaagaagaggaaaagggatgaacggtcttggaggcgtcggcgaggacggcggaggtgtccactccgtcgaggttcacgttggtggaacacgttgaggcaaggcatctttccttctccgattccgaatccctcgtcatcgtttccctcctcttaattcctgctgcagaaaaactaacctacggtatcccgtccgggggagtggggacgggatacataatgagctctcatcgtccttatccgtccgcatccttttccaccttactcaatccccaatctccctgtcgcttttctagttgcccatacgcctctcatccaccaccgctcttctccttcctctcctcttcttccggcaccgcccttctccttcctcccctcttcttccttacttggctggaagcctgaaaataggttgtgctcctttctcttgctcacctaccctcctgctctgtcccccctcaccatcaaagagtcaaggagggcgctgccaatatcagatctggagatacctagggcctttccatcattggatccgcttgagccatgtcagtgatgaggtgatggatcgcactagcccccgtggcctccacctcggtgtcatgccgttggggaggatgccgatcgatgcgaatcctcctcccacgctactgttagtggtgatggaggggaaacaaatgaaggtgctagatctgaagtttcgattgacaatcgacgtggtgctgcagacattggctgcttgttgacattgtgcgcaggtatgtcgtgtgtgcggcatatcaccatggcttagctggtacctacaagtaccaggcacggtacctgtggtaatgtggtatcatggttgatacctacacagggctggtacctgtggtatcatggttgatacctacaggtactagacctggtgccaatggtatcatggttgatacctacaggtttcagatctggtacctgtggtatcatggttgatacctacaggtttcagacctggtacctatggtatcatggttgatgtctcgggtaccagctgatacctataggtgctaaccgataacccataggtactaagtacgaggtatcaaggtatcgggagagaacgtacgttgttgcctcttggctgggtggtgagccatctaccaccagcgttttgtctcgtcttctcccttccattcctttcactatcaccatcctttttcttctcaatgtggtgttgatacaagggtcatcatgctattgcagggaccaactttgtcacctaatccactattagtgtcgtgtccttctcctagcgcctcacgcgtgctcttccaccggctgtggcgtgagcgtgtagggcggtgctaagtcgtggactcatgagtggataaagctgaggcggagctgacatcatcaatataaagtatcttgtttggacgggataccgtaccctagcagacctcttactgctgctgctgtgcctctactcccctcccctccgctctatccattccaaccgcgcacagtattattgggcctggcttggagcttattgggcctctagctatgattacaactggcccatagctttcctgtgcaattggtctgcatcttcgtatatgttgatgctggcatgctgccgatccttaccaatatatatatatatatatatatatatatatatatatatatatatatatatatatatatatatatatatatatatatatatgaatcgaatacatataactagatatatactcacaatttgaaaattttgaaaaaattgggcgaatttgtgtattgccccatatgagtgtcctatatatatatatgtaatatatatatatatatatatatatatataactggtgctacatggagtatgggctccaagattcaaattgagtatatacccaatttgaatgagtatgaaatttttttaaatgtttagatatgaacattaacttctttactaacaagtttgaactgagtttgaactttttttttgttagattttggttctaggtatataacatccaaacatataattcgttaggtatataataatgaattgtgaaataaagttgagtttgagttgttttgttgttaggtatttgtatgaatcgaattcatacaaatgaatttgagtttgagttgttttgataccatggtgcccgggcaccatggtgccccatatgggtattatatatatagtagttttgacgaagtcgcggctgacatgagcctgacgaatggcgtgagagctcctcgccctctgcagcatcatcgacgcccctccatcggctgcggtgaagaggatggtacgcctcgccatgaagaccccggtgcaacgcctggccaaggccaaacgaagcatctccttgggcagcaaggccatggcgcgccatggccttgctgcggttgctcgaaggcgcgcgctcgtggcggcggctagggtttaggctcgagggggaggagagcaacgaggaaaaaagagatatcccgtccgtatatatatgggtgccaacttcacgggccagactgggccgtctgtatcttctgtcttcgactgggccgcttttcccagcaaattcccctcgtttcctaaaaggaataagttcactttgactcccttaactagtgacaaaatctgattcataaccttgaaccacaactattaaaagggtgtaacttgactccctcgacggtcttagagagtgattttgcttatgtggcgcctaggtggcggtgttgaccttgtcttagttacacgtggcgttgatgtggcgcttatgtgtcattaaaattaaaaatatatgtgtgggacccatttgtcatcttctctcattcccttcttcctcatccctctctcttccttctccctctcttgtgcttcaatagggaaattttatgctaagctaacgaccttaaccaggtatgagcagggaccggatcgacggcggcggcggcgggttacgaccaccaccaagccgataaggaggaggacgacgactacggttgtgactacctctttaggtcatccgttgcgacaaggatgatctcatctcgcggttcatggacgtcgccatgtgcgacagtcgagacgctgccactatcacctcaactcttgacgacagcctcaacgaagtcgttggcctttacttcgcggccgctgcggagaaactcatccgcccgtccttcgtgaggctgagtggccaccgtcctagacgctgatcgccgccccttgttcgactgcagcccggtgagagctcgccaccatccaccgctgctactaccctcgtcctcctgctgccgtgagcctccatgaggctgagccaccaccgtcctccttggctctgtcgtcctagccgcacgaccgcgacccttggttctgctgtgtcctagtggaagctcgcctccaaccgccgccgctccgctattccttctgctgccattgatctggtccccgctcccccacgtactccctccatcccaaaaaacacaacctaggatgggatgggacatattcatattctagtacaacgtatctggacatagatacgttatactagattatgtcccatcccatcctaggttgtgttttttttaggacggagggagtaggtctgaaggggaagagaaaggggatagaaaaatgaggagagaggagggaagaggaagaaaggaaggagagaggattatatgtgggccccacatgttagtgtgtcccacaatattttgtagtgtgaatgataaatgtgtcacacatatatattttagttctaatgtcatataatcgctacatcaatgccacgtagaacaatgaccaggtcaacaccatcacataggcaccacgtcagcgaaaccatcctccaaaactaccgagagagttatattgcaccgattttaacaattgaggcgtcaacatattcggtattgtggtttaggaatatgaattagatttggccacaagttaagagagtcgaagtgaacttattccttcctaaaataaaacgatcgtcgatttgtatggtttataccttttgctcaagcatcatctacatacagaagtattttttttcttttttttcctttaagttcagtatagtatagtgttgattcagcgttcagttgcatcatttcatttcgctttaccagttaagattgtcgatgcctgttctgcaaatattgagcaaacagtgaaacaaacgccatatttaccatcccacgttctgaggaacgccaacaatacatggaaaagttgctagtacaaatcaaacatcttgcacatattagacgtgcagtgatatactaacaggataattatgcctttgattccacagtagccaaaatggcgagcaccagcaaattaaaaggcagtaaaataaaagagaaaatagtgtgagtagttaaagtggtcctccaagttttatccgagactcagtttaatccttgatgttttaatctatccatattagttcttcaggttttcattttagttcaaacttatccttagacccacttagaagccatatggctaaacataaccaacaactctcttgataaatgacacttatatcccccatttacatatataagagaaaaaattacatgcaatgggtttttttatagataatacatagtaatttatgtaaagcaaaaataaattatgtacttgcaagtgtatatgatagctattgtttaagttttatgtgcacatattgaaataatgggaattacatatgcaatgttgtttattcatcttgattttctctttttctagtgtatacttgtatacaaattaagggcaaaagggacattttctaatataaatattgactagaaatagtcatatagaatattatgttgggccaagatgattttaagccaaaataaatacttaggggatatatgtggacaaaataaaatatagagaaccaaattgtgcctccagtgaaaattgaggactaatctagctattcacccaaaataaaacccaacttttccagtcaaaatacagcagtatctgaaggcactaacattggctagagaacaaggccgtgtttagttccaaaataatttttcaatctttcaacttttccatcacatcaaaacttttctacacatataaactttcaattttttcgtcacgtcgttccaatttcaaccaaacttttttaattttaatgtgaaactaaacacagcccaagaaaattttgaaattgcaagtcaatctgctgcggagagcggggtcgtctcgcctgccatcctggtgtctagctctactggcatcgcgtttctggataagaggccatgtttaattccaaaaaaaaaacttcacgctgacacatcgaatatttgatacatacatgaagtatttaatataggaaaaaaatcaattatacatattgcgtgtaaattgcgagacgaatcttttaagtctaattgcgccatgatttgacaatgtgatgctacaataaatatatgctaatgacgaattaattaggcttaataaactcgtctcatagtttactggcagaatatgtaatttatttttgttattaaactacgtttaatattttaaatatgtatccgtatattcgatatgacaattaaacacgaaaattttctccaactaaacgaggtataaatacacagagcacaatctaccctatgccccttgattttgcttgacggaggtcgccagaatatgttaatgagatcttcaggaccctgttcaggaaaaaaaaaagttctcaactgcaggaaaaacaaagcttcctgtccatactcgaagactcatgaaatgatacatacccgtgcagcggttactacgaaattgaagagaataagggcctcatcgaatggctatatgcagaaaatttggcatattagcaaaataaaataatttgtgattaaaatttttacatttatgtttgtaacgacttaaatcataatattgtaaaagaaaactatgataaaaaaatcaaatataaatttaaaattaagtttaaaaaattaaattttgacattggtatatgttgattgggccaaaagatgagagccttacataggagccaatcaccagaaggaacagcagatcaaaagtaacacttgcaccctgcgaattggagaaacaagtcaaagaatgtatgaggttatttcaatgtgttgatatcttacggaagtccctttgaaatgaattatctcttactggtaagcaattcgtaaaggaatgcattagcagaatattataatatgaaacaagaagtcacaaagcagggcatatgctttccaaaataagcttaggtcctatttagaccctggcaaaatttttcgccttatcacatcaaatgttatgacacataaatagggtattaaatataaaaaaaaactaactaaacagattgcgtgtaaattatgaaatgaatcttttaagcctaattgttctatgatccgacaatgtggtgctacagtaaacatttgctaatgacgaattaattaggcttaataaattcgtctcaaagtttacaggcggattctataatttgatttgttattagtctacgtttaatactttaaatatgtatccgtatattcaatgtgacacgccaaaattttatacctatggatctaaatacagccttattagaccattccgttgtgagatttgattattctacccaaactgaacaaatgacacaaagcttacacgcttacctgatatgggcgacacttcggtgcatagtataatactaccggtagaactaatctgaaccctttatttttatttaaggataggctagcaaaagtgcccgtacgttgcaccgggaagcgcatatatcaaaaaaatatacaattaattaaaatacaaattcactgaaatatttggtatttttaagtaggtatgtgtataattaaataaatttacaagtaaagcaagtgtgagaaataaaatgacattgttaaatttaattttattaaattctcaatgattagttacgctctttgaaattttattagaattttcagagcttaattgctaattttaataatacaaacatcatttaataattatttaattggaaaaagaaagaaaatcctttcttttaggtttgcttagaaataaacacattcaataattgtaaatgcttctgaaggcccgagggacctaatatagacttatttccgtcccttgccggtcggcccacggccttatcaaaacccgaatccaaaaagcagagtcgccgcttcctcatccgcgactccggccaacggttgcgcttgtaggagtatatcgcgttcccttccgccgacggcgaaactctccggcgccccctctccttccgttcctcttcgcctcctccattaatcggcgtcaacccacttctccgccgtgtgtgcgtacgtgcaggagcgactgctgtggagagcgcgactccggccgctggcgttggatgcgcgcgcagtgccttccgcgtgcgcccgatttgcgtcggcagcgcccacttcggaggccgctctgacgaattccggcgccgccttcacgatccccgtccgcgtgcggccgagacctgcggcggcgccaacctcggaggccgattcgttccattcctgtgcaagtctcgtgcgcacgacgagtactgcgaagaacaacccttgccatcacatcctcaggtttgctgtccggttttttattgatttgccttatattcgtttaacattgtttacctgctaagataattgcaaggccaacagtgagttgcttgggattagctctgcatttttaggtgaaggaaatctgtgtttcatttgagaacaattaatcccaaactttggttgcagcatgtagcgatggtagttttatagtatattagttttggcagtctgatcacagtgtgtattgaaaatatttggttaaatttttcaccaattaacgttccatttttttttcacaaattcttattttcaacccaagttcatgttcgaatagcaatgtagtgtgagcataaatccttggtaatgagcagacatttgttttcttcttatgcacgaactgattcagtttctatgcttagatagctctgaaaagacctatatatgatcaattgtgatgtacactgggatattataccttgattcttttattaaccttatttaagaaactatatatgataaagatttagacaggggacactttgtgaaggatgcaatttcagtcatctcaagtattgagcttcagttgtgatgtatcctcaagccataaatgatgttactttgctaacagtatctgggggcggacgctccaggcagtgaagctgggactgggagcagccgccggcgaatgcttctccaagagcaccaagattcacagatcgtagtggttctggaaaaaaaaagtcctatatggcgaatgtctgaagctagtggttgatggaaaacaacagtcctatgtgtgaagctggtgagaatattcagagatgctcgtgtatagattattatcagttagtactctgtttgtgatctatttactccctccgtccaaaaaaaaaaactcaaccaaggaaaggagtgttttttgggatggatggagtattatgcaaggtaagggcttgtttagttggtgaaataaaaatttttggatgtcacatcagacgtttaaccagatgttggaaggggttttcggacacgaatgaaaaaactaatttcataactcgcctggaaaccgcgagatgaatcttttgagcctaattaaaccgttattagcacatgtgggttactatagcatttatagctaattatggactaattaggctcaaaagatttgtctcgtgatttacatgcaaactgtgcaattagttttttatctatatttaatgctctatacatgtgtccaaagattcggtgtgatgttttttacgaaaagtttttagggaactaaacatgtcctaaatggtatgatctgtaattgtaagcgagatgcttgttcatttccacgtttcggcttgcaaaatgagatagtgctgaacatgccctgtggactgtgtttgactgtgattgtcctgcacctgaaaatggtggaacctcccggaatatgcatatttttaactgtacgtggagttctcatatttacacgcccattctttagaacacaggttaataacggcaaggctgctacatgctcaaactgacagcggttgacagatctatcaatactacgtaataagatggctgcgatcctgttcgttcctcttgtcaaaatttgtgtactgcttactgtatcagtataaccaccagaaaagatggtttcatttaagaaacatgagctctgcactctacagctgaacatatcgattccatttaagagcaaggctaataatacaaccgacttgttggctataaggccattcctaacacaatgactaggatagtatccatagcattaaataaattatcacctaggatgaaaaatgatgtggcaagtgaataaatgaggaaagagaaggaaaccatgtcttgtatgagacatggtttctacacaacatccaatacatcatgtgagataagtagtattaaatttaagtatggaatagtggtgtttgtattggaagggtagtgtctagtactagttttttgatgatgtgaagtttatggaaaccatgtctagtgtcttggggttgggaatggcctaaggtttttttcagccttctcttagcccacacatataatagttagctatttacaattaatatatgaccac

SEQ ID NO: 68929 - DNA, 26301 bp, Oryza sativa
aactagcaacataggcggtggaatcgccgaggttaggggaggcggcttaggcgggaagggagggggacaggcgactgaagtgagttggaagcggttcgttttgggcggcggcaaaatccatcgacaaaagtggttgctagggttcatgagcgataaattacgattataccccgtgcatacttttttcttagataatactacccctccacgtttctactactgttaattatggtggtagtagaaataaacctcaaccatttgattaaagaaaaagtacgaattaaccccccagactattacgatagtatgaattatacccttaaaccacaaaaccagacattttataccctgaactatctatactagatgaataacccccttcgatccaatccaaagcagtattgtcctacgtggtatgcaagtggcaatctagttagcatttctttttaaaaaatggtggggccacctgtcatactctccgacctctctctcctcccctcttcctcccaatctctctctctctctctctcttcccctcttcctctcaatctctatgtcacagatgtggagcggcgagttggtggccggcgatgggcgtggcgggggcgcggcgagcgtgatggagaggtgggcgacgtccggcgggcggcggacgccgtcgccctcgcacaccaccgggagcagctccaactccacgcgcggtcgagctcctgctccacgcgcgccacgggcacggtggggcgcgaggcggcgttggcggcatcgtcgtcgcccacctccttgcgcggtcgagctccagctccacgcgtgcgctcgaggactccgtcttgaccacctccagcacgctctccagctccgccacgtcgcccagccgcgcccgccgccgccgcagccgcctccgcgtttttgggattctcagtccacatcatgaagaaagtctgttcactactagaattacattatccattaacttcttcagaataagaaaaaggtgaattgaaggagtaaatcagtgcaaatctgatgccaacaaaatggaaaaatattcagcaaacagtgcaacttttggattcaaatgtgcttttgtttgcacctccactgttctactgttatagagcttttttggctccttgcaaggtgaagctgtgtatcagctgcgtcaggctttcatacgaggagcctcctttctccatggctctgcgagctttctccccgtactccttcgccttcctcctctcgccggcgtgctcgccgccgtccatcagcgccatcaccgcccgcgcgacgtcaccccgggtgacaggtgaccgccatggcctcgtcgccgagcagcagcacgggcgtcgtcacgccgacgccgagcacgtcgacgacgagccgctcgttcaggaactggtcggagaagtgcggccacgccacgaccagcacgccatgggcgatggactctagcatcaagacctccagtggatttatgatgttgtactcgcgagcctgattctcgctgggtctcttctgttctgtagttctgtgaaggactatcaacatacaaatgcacaataatcctggaagctcaaaccggtttggtgaattatgcccatttaatcgacagagtgcatttttaattgcagattttgaccagtggtttgggtgccttaagttccatataactattgttcaatgataatggaaatgcttttaagtattatgtaagatcaagttaagcggtgtctttgtcagttattagttgcttgtgagtgaaactattattcatctaaactaaattatttctgtctgaatggatgcatgctttgtatggtaaaaaacgagcagggttattgagcgggtcttcctgctccttcaatttatttgtcatatgctgagaaatgttcttgttccatcctttatcttccgttgagaaatcatcttgtttcttctgttagaggatgaaaaatattatgtcaacaattttatttgttgattatatgttgacaatgctcttgttttttcattaatcttatttcttgtattcacaaatcctcttgtttcttcagttaaaaagattattaagaattatgtgcaacattgttcataaccatcgtatctcgtcctattgttaaaaaaagggttaattacagtcatgtcattataatttttacagttttgaaacatatcattactattcatctattcggaaccatgccactataacttcacagctattttaaatataggttaattggatccataccatcataaatttgttggtgttaaaaaatatcactactatttatatatttggagccatgccattacaatttcataacttttgaagatataccactacttacccattagatgtgtttataattttctttggaccaaattaccctcgtcttctttcttcatccctctttccctcccctctcaacctctatcctctgtctcactggcggcggaacgatggatggagcagggtgaagctcttggagcgcgacagcacggaaggcatccgccacctagctatgacgcgagaactttcttgtgctcgaagcagcaatagaggcagacacgcctaggaaactgttatcaaggatttttcttctgttttgtccctatgaatttacaggaacatttttggtctataagggtaggggagaggggcacgagagggataaaaagtttggattttgttcacatcgaataccagatttccaatccattccccccactttctcgagcaacagcaatcccgggtgattttcttggatttgtcccctttctcgtgttagcttggcatgagcaagagggagctcggggtgatggattgattgattcgcacctatttgtgccgctgttgctcgcctgcatcgtcctcagctacctactcgacgagaaccgaaggttcgatggttgcacgatttttttttcttttttttttgaaaacttgaacgagttcatcactgttgtgttgggtgttcccatggaaaaagagatggaaaggaagaagataggataatttggtaaaaaaaaatataaacacatccaatagataagtagtggtatatctccaatagttataaaattgtaatggcattgcttcaaatatgtgaacagtaatgatattttttaaaaccaacaaatttgtaatggcatggatccaattaaccctcttaatataccactacttaccttttcattgctttttctaaatcttttggaccatattacccctatcttctccattcatcccatactctcccacccacgttcatgttctccatggagctgcagctctaagcaaaagcagcggcggtggcagggcgccgagcaggtggcatcaagtatccaacattctaacctcgttgcatccatgaggaggacacggctcagagagcaaagaatttccccacgattttttttcctgtttattttttttgttttttctttgaattctttccttacgatttttgctcctgctctagttcttgtttgattaatttggtcaaatctttgtgatgatttttgctcctggtttttatggggttgctctttgattttttttttctcctggttgagttctttgatttgtcgggttaaatcttggtgaggagcgccgcacgggagagtttcctcaagatccagccttcccccctgttgaggttgtcagcaaggcagggactattgtcgccggtgagcttgtggacgacagaggaagttgagcttatggatggcgacaacgatggatggcaccagcccaatgctgtcgatcccatcccattcgtcactacctcgcctcaaggtccctacccctgcccgtcccgcccccatcctcgccacaggaggtggctgctcctcctaccgcccccatcctcgcgtcctggacgacggagttggccgggaggatatgtgcggcgttgttcaggtggtcgtggtctccagatccgccagaacttcattgttcgctgccatgccccatgccgtcgccggtggcctgaccacattgcttgctgctatgacctgagttgctgcttctaggaggataagggtggggagaagatgaacgggagagaggaagaagacaagggcacttcggtcaaaatatttgagaaaataccctgaaggggtaagtagtggcacatattgaaagcggtgaaattataatgtcatggttttaaatagttgaatagtaatggtatatatcaaaaccataaaagttgtaatggcatgtatccaattaaccattaaaaatatattttttttggttatttgatttttattacaaaatatcaccgtagcgtttagcacgagcatattactagtggatctataagttgaaatctggaagtaatagtccttgttttgtgtgtgtgtgtgtgtgtgtgtgttaaaaggtgaatgaaactaggagaagctatcagattctaggatgatgtctggataggggagatgccattaaaaactcaatttccttatatttatagcatctgttctgaccctaacagtattgtaaaacaaatgttgatagagggggaatgggagatcaatctgagaagaactctgggtcaaaatgaattggttgaatggatggagctgcaagagaggcttgctccaatccagttgacaacagaaaaagatagtatggtttggaagctgactcagtcaggacaatttaccacaaagtctccttacagagaaattgtttttgggggagtcaaagatgtttgatcttctgaatttaattcagaaccagaggggagttgaaaacaaaaccttgtggtattattttgctgcaggggcttaggcgatttggcttgtgagaaacgactgggtgttcaattgacttgtgaaaaatattgtatctttgccttataaagctttatcgtttgtgaaagtggaaaagcttgtcaccaattgagttaaggggcgagatagagagagcacagggattgttgtttgccagtatccgcgcgacagaaggttcaagttaggcctctttaatcgcatgattgagaaaacgtaggaataggaaaaacgtaggattttgataagaatgtaagtgtaaaacagaggattgcaaaacgcaggaaaaacacaggaatgaccgtttgattgaaacataggaaaaacacaggaattggatgagagatatagactcaaaggaaagttagcaagaggatgaaactctggctaaatttcctccaaaatccctttaggattgtccattttatagtaatttcaaaggattatatatgattcaattctttatttcaaagagtttcatagaaaattttcctatagaattgaaatcctctaaaatttctatgtttttcctccaaatcaaagggccttaatgtcgccgttctgatcaatcccctttctgacattgcttctcctttttggacttgtatgcttgctgttccctgtgctgtgccagcagcgttagtccttttttctgtctttctagactgtaagcgctggcctgtatagctggtaatcccagcattctgttcgaactcttatgctttgttaaaaagctgggcttatgccttttctccaaaaaaacgatgagcatgtttgtttaacaatttatttagatttgttgcaaaggcacatgcacttcgctagtttcagagaaagaagacattgacaattcgaacatagacgaacaagagaattggttatgacagcaagcgaactcgctaaccattagcactagagaacacatcggtatcgttttcttaaaatatgaaaaaaaaaaaagaggaaaagataacatggtgatatttagcctccgcaccatggggatccacaccgttagataacttattcttcgaacgagcagggcccccatttcagaggtgagatataaaatggccctgagcgacgatgatgataccactcaaaataatggacacaggtaggacgtatcgattggccaagtttttcgtatcagcaccggacctgcagcccacaagatgaacttaatataagataaatataagttcaagcaaaaggtaaatagttcgtagagcctacttacaaggtaccattatctcgcgtctcagcacggaattgccgaagcagcctcagtatggctttgttctcctcggcacttttttcacacgagccattgtgaagatccatctgaagtagcagacggaacagctcgtctttcttctcctgcactagcgtctcaagacttgcaggatctatgttgttatgaaccttggcatctgcggcaggatttgggcaaggcaaacgatgctgaaaatacaaagaacaccgtgaattgcattatgaaaaggaaaccaaatagtaacacaaaacgcatgaggaaacaagtacagtggtaaaactggttggttggataagaagaagctttaaagtttgaacagtgtcaatgtcacttttacatcaagctttaggcagaatttggaaaacaatattgcgtgaaagtacatccaaatatgaacccataataattggaccaattgctggtaaaaatctatggccttcaacttttttcaagataatacatgctctatattatgagggagatttgacacaaatgtgaggtaaaagaaaaccgaattttcaactacatggtctaagggtctcatcggttaccaaagacttattataagccacaacggcttttattagtgataaaaaagtaattttttgtctaaaacatttacaatgtgttcttagcaacttaaaagccaatgctgaaaaagaaactatgttgaaaatatcttaaaatcaacttcaaattgagtttgaaaaattaaaaaaaaaagactttggttgaattctttttaggcctaccaatgggctaaaattgtcgataaagcataacaggttatggtcttgtggttacattgaattattggactggtcttgcccaacggactgtggagacctgtctaagagggacatcaatctattggagcaattttggttgtgtaactattgtagaagtgcctttgtaggctttactgaagccatgcagaaaacaaaatggaaaaatttacattgccgctacactaaatttacatacataaaaaaaaaaaagtggagcctacaggaaaaggggttaacttatagacattagccgaataaagatgcaaagaaaagttttgatacaaaaataattacatcggtgcatttaattaaggaaacctgagtatctcactataaaaaacaatataataaaagaaatgaatttaagtacatgtgctatgcattggaaaactgtaattaattaaagagaggttgatgctttactccagaaatcgatttattattgttggcaaggggtggttgaggagtagcggaggaactgaagtggcgggtatatgagatgtgaggcatctcgccacggataagcatgggcaacagcctccgctccgcctccaaagccggcgatgtgaccgccggatatacaacccgcggtcgctgtagtgcgcgaccgcagatcttccgcgccgcatagcgaagcgcagccatcgacaactacttcgctgacagtatatcggatcggagcggagcgtattttctcctcagaccagacctaatctctcgggaaggggctcccttctcgtcaaaatcgactcaacatatatagtatatacgagtacctaacaatcgaagatcggtattggaaataatcggaaacgggatcggtaggaagaatcggaaacggtttagggcacagttttaccttttctttatatacgaatccaatcgctctacaggcacctccccacctccgccttggcctttgtgtgttcccagcggaggcccttttatttatttagttttttttagtggctaacaccattcctgtccatggcggcggccgaaggtggacacagcacccccacggagaggagaggaaagggattatctcatctcagatgagagaggaggttcctatggagtactaaaagaaaagaggagcagcagctcgtgggcccagtaaagaccaaaatgttggcggaatcagcaacccgggaaagaaatacaagtccactatgactccctcggaatattggctgaatctcatcttttaccacaaaaccaaaaccatctcgctcggttgttttcgagaatggtttgttttttttttttgactgacgtgatgcccaaaaactttccgtaaaaacatcacatcaaatctttggacacatgtatgaagcactaaatatagataaaaaaactaattgcacagtaattagtctatgattagtcccgagacgaatcttttgagcctaattagtctatgattagccataagtgctacagtaactcacatgtgctaatgatggcttaattaggctcaaaagattcgtctcgcggtttccaggcgagttatgaaattagttttttcattcgtgtccaaaaacctcttccgacatccggtcaaacgtccgatgtgacaccaaaaaattttcatttcaccaacaaaacaggcccattaatatgggaacctacttctcctctgccaccttcccctctccgctttctgctcttccttctctctcctctccacaacggcctctgcttggggatgacactgtagggggcggagctttgtggcgcggtggagaagatgggacaatgggggatatcgtgatggcgctcttggcgaggcttagggcctgtttggagaacttaagattctgagaagcagctggttggtaaccatcttctgataatctaggggcctgttcactttgttgcaaaaaaaaaccttactaaattttggcattgccaaaattttggcatagttactaaaagtttggcaacttgccaaaattttggcatgatttcttatatagttagcaaaatttggcagcaaactaaatgtagccacttttttaacaactttaccaaaatttggtaaggttgaaaatagcatcaaagtgaacaggccctagaaaagttgggtttcccagcttctggcttgcttattttctggattctacaagtacagtttctcagaatctggaccaaaagctggactgtttaggggagcttctgatactgtgagaagttgcagcggctagaaactcctccaaacaggcccttaggctgtgttcgctactcctaggaacatatctccagcacacagaaaacggagcggtccattaacgtatgattaattaagtatttccttttttttcaaaaatagatcaatatgatttttaacaactttcgtatagatttttttaaaaaaaacgcatcgtttaatagtttgaaaagcgtgtacgtggaacacaagtgagatgggttgggaaacccatcctgccgaactaagcctaaggccgaggtactcatccttgaagaacatgccaaaggcgcttcatcgaggagagcgccaccctaagagcaagtataatagtgtgctataagtatactactttctccatttcaggttataatactttctagcattgcccatattcatataaatgttaatgaatctaggcacatgctaaaagtcttataacctgaaacggaggtagtacaaatttacgtggaggagagaggtaacaaaaaaaatcaagagtattggctctcatgcaagaactagcttaacacaagctctaaaacaaatacatgttgtttatgatagagaggaaaaaaaattgtagccaatctgatagctaatttattatatatgttggctttaagatgagctaatagtaggaagtgggctctactattatccttgctataaggctgagttcgtttctcaggttcctaaccctccatctcatttttcgcgcgcacgctttttaaactgctaaacatttttttaaaaaagtttctatacgaaggttgtttaaaaaatcatattgatctatttatgaaaaaaaaaaaggaaatgcttaattaatcacgcgctaatggactactccgtttttcccgtgtgcagggcatgggttccaaccgtgggaaacgaacacggcctaagtagggtaatggagaagaaatgagggtggaacaccgagagtgcaggaattaaatttaaaaaatatacctttatttttcataatttgtgtttatatatatgcatggagcggaattgcgaaaatatacctaacccacggtgcggcgatgcgggagcgacgcgtaaccgcagatcgaaggcgcgggaccagtggtcgtatcggtcacgcaggttggatgtgagggaccgacgtggtcccgcatattgcgcatgcggcatcggcgcacttccgctgggtagttcagcggcaccgcggtggtttgcgggaccgagcgacaccggctcggtcccgcggaatagatgtacgggacgggctgccacatattggaaacgcgggagcgctctccttcccggtaaaaccaaatccaatcactcctaaacttttgcaaacagttaaaactaatcaaccactcctatactttatgtccaatcactcctaaattttacacacagttaaagcaaataaacacagattcatgtgagttgggtgggaccccaccggtgcacgcgcgtggttgcgcagactggccaagcgggatcgacgcgctcccgcgcattgggactgtgggaccagtgcctactccctccgtcccaaaaaaaactcaattcttgtgtttttgtgttcaatgtttgactgtccgtcttatatgaaatatttttatgattagtattttcattgttgttagatgataaaacatgaataatactttatgcgtaacttatccttttaaaatttttttatttttttttaaataagacggatgatcaaacgttggacgcggaaacctacgaattgagttattttgggacggaggaagtatacatgaaaagagtgtgatcatgatctagagcagttaaaagaggtgcctatacatacgtggtagtgctttactgctgctgagataagatggttctaaattaatcaccgcaacagtccgtacaggactattattcaggtttattacagaggcacgagccatctgtcaacccaatgtgaagtgtcaattgtgcaactctttacaatgattaatagccctggacacaaattggcatatacgtgcaaccgaagcatcacagaataactgaattgttcagaagtataccgaagcatcggcttggtgccgcagattgaggctgcgggacgtctcggtcccgcgcctccgttctgcgcgatcggcggatcggcctggctgcccatagcacggaaccacctcggtgctgccgattggggctgcgggaccgtttcggtcccgcccgcatagccgcgccgtgggaccgactcggttccacacacccaattcgtgtgaccgagccgatcccacgcccccgctccacgcgaccgcgttcccgcgccaccaacctgcattaccaaatcgctctcgcgtttccagcgtgcggagaaggtatatttgtgccaaactttactgtccaggtatataaatgtaaattattgaaaaaaaaagtatattttcaaatttaattcaagagtgcagagcctcgatgacggtagaccatgcggagctaaccatcacgcgtggaggagataaggacatgggaatccacgggttctggttgatcaactaggggttctgggtgtggtcggtgtgcctaggagtgctcgggagccaagggcacgagtcaagtggtgattgtccgaggttgaagttggatgcaatattgagaggctgacatgtggtgcccacattgctttccacacgaacaagacatgttggctcttcacataggcaaaactgaaaatagttaaaaaaatatctatcttcagtggcaattttgtaaggtcccatttgaatgtgatggaatgatgaagattaagtgcgcacgcaaatgaataagttatttatacataattaattaagatttcattattaaaaacataaaaatggatttatttgatttttttatagttaagttttcgtgtaaaacatatcatttaacagtttgaaaaggaagccaagaaaaaaaattgtatcttgctggagtttagaatctaaaaagtacacgcggataattaccaaatgtagcagtggcaaatactagttaaattcctcgtgttaggtacgcaggcaggctagctaggtcggcctagcccactagggttagtgttgggccctaagagaaaaaagttttttggaaaagattttgctaacgattttgctaaacatcacgcgacagattacctgcagccgagaagcgacgactcgcgacgagcgaacactcgcgaaccagacacacccatcatcttattccacattaagcccagctataattgggctgggcataagcagatgtccaccatgttcgatagcagtgttcagattttacagttcgagcagttgcagaaaactctaagatttttttagtacaaagcacaacttcctgcctggctttagcttctttttgggactgaagtttgctgagctagcgctgcttccttcttaatctctttgttaattacttaatttcatgagaaagtgtagtgtagggcatcacatagtctaggaattggatttcaactctgcgtagtgggagtgccacaatgcaatgcaacctcaaactttgcttcattattatactatccatgcattttgaaactctgcacatcgtggaatttagtgcgcaagtctctgaaggccttctctgcatcttcatgcttcatcatgaaccactatatatatgctttggtggagtatattttaactagttagttaacatctggaactaactgaaagcgaagctgttaggagtagtttaatcttgatccacgtctacatgcacacagttgtgaataattcactattcttatcactgatagtggcgacggttgagtatcttatcatgaattcatgatcagactcaccagtcaccaatgcttgctagcttcaatgctttgcttgtggagatccatggagattttgatcgatcaattagcttttgatttgagaaaaaaaaaaagggctcatgtgtactcatgttattgcaactttacacgcgctggagctagaaatagtgatcaatcaatcaatcgacatctgcttcgatctgcgagagaaagtgcgtcatctgaagaaaagttgaaacttcgtggaggtttcaattagcttgcgcatcttgtggtccatgtgtgcaaacattttgtgagtagtggagatgataattacatgatagatacatttatatatatttattcagcctagctagctgaatgaatggccagaagaaataattaaaccgctaaaaaaagattaatgttaaatgagactaattaatatatttaatggactgtactacctaacgagaggggatatgatcagtctccacccttcagccacacaaccatagcatccaatgaactggtccctgaattgctttctgctgatacatccaaaatttctctcaagttgtcactgatattacgaactagattatctggggctaattataacatggtccactggtccatgcataattcttgtgcataatactgtagactgaatttagatccatttatatgatgatgatgattaatttctactaccattgccagtgctctcatatatatctcctgtccttctcttgtcactctcatatatgtgctctctgtcatacatccactcgattgcatgcactagtagtgttatttcagctagaagagtcaagcaactggacgaactgattgtaacaaaagggactggtcgatctacccatgttgtcaacacaacactactccagttgatagcactagcagcttgcatgcatgtgaaataatgccactgtatagtagctggcatatgcatatatacgcccctgcatcactaaaagctagctagtagctactctctccgtttcacaatgtaagtcattctatcatttcctatattcatattgatgttaatgaatctagacatatatatctatttaaattcattaacatcactatgaatatagaaaatgctagaatgacttacactgtgaaacggaggaagtacgagcctgcatatgcaatctagtacctcccgcaaaaactttattcctagctatgaatgaatttagacaaatatttaaccaattgtaaaatcagaaatgaatctttttgaaacagatgtagcaaatactaggagctagtatttatccagttgtatagtcgatcggaaatgatttcagacttcatcgtttcgcttattgacggaataagcgaaacggcatatttacaaataaaaaataatttataaataaaacttttatatatgtattcttagcaatctaaaaacaaagactaaaaaataaactacgatgaaaaacctcaaaattaactctaaatttaaatttaaaatttaaaattttaatttataagcataagtataaatcaaaagatgaggctagaagtattttgggggacagatcgagtagcagatatatataggtgcgaatgtactggccatttgcactgtactggtgatgcagtggattattttctcaaagatagatatcatgaaatcagggacaatcacttcgaaagctgcctcactatggtcttgtttagatctaaaaaattttcgccaaaaacatcacatcaaatatttgaacacatgtacgagacattaaatatggggaaaaaaccaattacacagtttgcatgtaaattgcgagaagaatcttttgagcctaattacgtcataatttaacaatgtgatgctacagtaaatatttgctaatgacgaattaattagacttaataaatttatctcgtagtttataggcggaatatataatttgttttgttattaatctacatttaatacttcaaatgtgtatccgtatcctttaaaaactttacactcaaaaaactaaaaaactaaagacaccctatacccatatactgcaccagtactgcaagcgcacacacgcagcatattactccctaacaaccctgcaccatcattaggtttttgttactttgtttagctctctgtttgtttgtgagtttgttgcgagactgttagtacacatgatatgatggcaaaacgcactagattaatctctgcttaattagtttgcatcatatatagctgtgaccccatgcatatatatctagatcccgggttgaaatttacagaacatgatcgagctagatgagctagcagcatgatccactatctttcttcttcatctacatgctgttgtgtttggatgtacatgtatgcatgcatgcatgtaggacgtttttagataatgatgcatgtaggggccagattgatttccattatctctcaaaaatctactagtacatgctgaaatgaattaaagttgtgtgtgaaacatggggggatgctgaggtcaagtcatggagaggacccatagtaaagaagagatgacgaatggaagaagaaaggtagctgcagagacgacatacgtacattgcatttgatagctaggcactggtgcagaagacatttgttgtgtgtgcttgtgtgtcattgatatgatacagtacactacttctagtcactactaggtggtatctagggcaggtagtggtggtttgtgcttttactccaaagttgcattgctgcattccactattctatagctgctgtttgtagtggtttacttgagcgcattatctcgtaaaaaaaatctcaaggttttactgcagagagagaacctgtagcagctaccacaattaattttaaacatgctagctgcttagtatgcttagtgaaatatactaaggctgttggtaattaagctacttctgggtcgttgacatgaaaaacgaggcatataggaattgggacaacagaaaaacgtctaagaatctttctgctagattcaaaggtggtggcttagtttgtttgaatttgaagtctcaccattttaattatttgatattagattcattcgtaatatttacgttttttttaattgtgacagcacacagcagacaacgcatagcgcaggactgtgaaaagtgaaccaggcaagacgtggcagtactatgcatactgtacaccaagtactccagctagcgtgcagtacagtggccgtgctgaccgtgcatgcatgcacaggctaaggctagtacagggatcagctggagtctggacgagcatgcaaaagagtgagacaacaagacaagatgatgcatctgtttgcagctgtagcaacagttgcaaccagtactgaggtattactccctcagtcccataatataaaggatattaagtttttgtttgaattatttaaccacctatcttatttaaaaaatttgtgcaaatataaaaaataaaaagttgtgcttaaagtgctttggataataaagtaagtcacaggaaaaaaaataattccaaaaaattttgaataagacaagtggtcaaacagtgcaagtaaaaactcaaaatttcttgcattatcgaacggagggagtagtagctgtgtggcagcgagtagctcacaaaatttaacaatttgacccttttacaaaaactatttttataaataaatcattaccaaaacttatttaaaaaatgactcttttattcagcaccaaatcatctggcgttgaacttagacacctcagcgccacgtcaactggcgctgaatgctgtgccaccgcggatgggaggctaagtcagtgtgccaacgcacattcatcgccatgctatttagcgctgatatgtctaagttcagcatcatacgatttggcgctgaaaaaaaaagatcatttttgaaataagttttggtagcggttcatttataaaaatagattttttttgcaaaggttccaattgtcaaaatttgtggcgagtagctagctgctttggttgcacgcatcgcattgcatggggagcagcgagtttggctgtgcgttggcacgtgaaatctatcggaccgtcaatggcaacaagaccacacatgcacaagacaccattgaattcaaagctgactaggaatacatcattttcggtccttgccattcatttgcatgcgtgcatatgcctcatccgttcatcgctattcacggcatataccctgttcgtttcaaaataaatattttctctattttaaaataaatatccctattaggtttatctattttaaaacgaacattgtatactgtagctatagcaccgacaatcttgtgacgacccgcgttgaatttttagtacatatatctgatattgagaatgaccatgtactagtatatatacaaatgtgtgtagtgtactgttccctctataaagaaaagttaggtgtatcacttttatcattaaaacaaaggagaaattaattcatcttgtgtataataaaaatcaagtagtctttgtatatatgaaactaatgggtatttatatgctttttgggttccaattaaatatttaatttatcttttcattatactaaatctcagatacatgaaactataaacatagctaacggataaaccaaaatataaaataagtttaatatttttggaacgtacgtagctgctccatgttgtccaaaacatgagtcaatcaatcaacacatgctgtacatacgcaacgtagggagggggaggcccttcccttgtcggatccacacacgcatatgcaaatgcatgcacttgtccattttgcagctttgactacttgtgtgtgtgtgtgtaatttgtttgaccgggtgttcagcagctggctgcatgcatggtatgcaggccggagatgtaccaacacgacgccatatattccgggttctcaggatctgcatccatctccagcaaataaagcaacatatagccaaaaggcacgtgctgtcgctgctcatatatgacgattattacttaattaaactgcctcttgcttactcctaagtattcacatacactggtggagaaaccatctttggtcggtcgcccgaaatccacaatagtctcggttccactaaaaaccgggactaaagatgatttttagtcccggttggtggctacagcgggcatatttgatctttagtctcggttggtgttaccaaccgggactaaaaatgatctttagtcccggttctaaatctgtcaggccttatcaggccccccgatatctttagtcccggttgataacaccaaccgggactaaagataggatatttagtcccggtcggtgttaccaaccgggactaaagatcccagggatctttactcccggttgataatatcaaccgggaataaagcgtacgcaccagcccacgcacaagcgcatgcgtatatatatatatatatatatatatgcggtttgccgcttattttttctcatcacatcctccaataaccatgtaattgctccctccgttttatattataaatcgttttggacctttttttatcttaatcgaacttttttatatttaaataaatctatagaaaaatttagcaacgaccaaatcaatttaaatataatataaaatatattttaataatataattgttttgtgtcgaaaatattatatttttctataaactaagtcaaactttttaagtttgactggaaaaaaaatccatgataccagcgaaaatgacagtactctgtctcggagtcatcatgtgccatatctattgatatatttaagaccatgcatatatggccgattgatccaggtcaggtccaattcggtatgatacgatcgatcatctcttgatgatctgattaactcaatcaggggcaatatcgatcgatcgagcaagtggaacatgcagatgcagtgcaccaataatatcgacagcaacagcacctgactatttcttgtcctgtcgagatctgtaatccctcaattccttcgtctctgcatccggttaccctgtccgctagcttccggccggccggacctctctgtctatgtgggcccttgcacttggaaaaagaaaccacacaccgtcacaagtgttcagaaaaaggaaaggtccagcgccatggagcggcgaggctagaaattggtgctcaatttagcaaattaacctttgcatcgctttcgcacgctgtgtgtgttcgtttcagtgtcctgtctcctgtgcccggtcgtcgtctaagctagtactccctccatcccataatataaggaattttgagtttttacttacaacgtttgaccattcgtcttgttcaaaaaaaattttgaaattattatttattttatttgtgacttactttattatctacagtattttaagcacaacttttcgttttttatatttgaaaaaaaaattgaataagacgagtggtcaaacgttgcaatcaaaaactcaaaatcccttatactccctccgtttcgaaatgtttgacaccgttaactttttatcacatgtttgaccgatcgtcttattaaaaaatttaagtaattattaattcttttcctatcatttgattcattgttaaatatatttttatgtaggcatataattttacatatttcacaaaagtttttgaataagacgaatggtcaaacatatgctaaaaagtcaacggtgtcaaatattttgaaacggagggagtattatggaacggagggagtagctagttagctacaagagcttaatttgtactcccttcttccctaaatgtttgacaccgttgactttttaaacatatttgaccgttcgttttattcaaaaacttttgtgatatgtgtaaaactagatgtatacataaaagtatatttaacaataaatcaaatgatagaaaagaattaacaattacttaaattttttaataagacgaacggtcaaacattttttaaaaaaatcaacggcgtcaaacattttgagatgaaggtagtacaagctagccacagatcacgcgtcctaatcacgatcttgctggttaatttgacagcactagctaggacatgctgatctactttatattcaatcatggaggttcatcgaattgaatcgcaacaacaattttgtggtgaaaaagaaaacgtactttaagtttagtttatagatggattaattacatcgctgtacgatgcctatctacgctggaagtcaaaagatcagatttactctctaacattatttgataattggccattgaataatacacgttgagattcatgctgaccgttagagacaagcgccgagattcgtaccatgctgggaaacaaaaatcatgtgtgtgttcatatatctactgagctgccgcgggtttatatagttgcttataacttatgctattataattatatactacgtactagttatattgtaattatacttgatatttttaggatttttatgtcaatgttagttaggctatcccaagaaaaaaaatgataatattaagcatgactttatgttcgctcaatcgtgaatgcgtcaggcatcatggtgttcgacacaaactaatcaccgtccaattttagtggtgtgatttttcaaaacaaaagttgctttcccttttgatcccaatcaagccgttaacctgattggcactgcctgctcttttttttgccctttctgttagctggtaggcctctgatatggccgcatgcgcaaaaaggttcagatatactccctccatttcaaaatgtttgacaccgtttcactttttagtacgtgtttgaccatttgttttattgaaaaaattcaagtaattatttattcttttcatatcatttgattcattgttaaatatactttcatgtacacatatagttttacatatttcataaattttttttaataagacgaacggtcaaatatgtgctaaaaagtcaatggtgtcaaacattttgaaatggagggagtatttttcttagcatttttaaggctgtaaattaaaacaagctcggcccatccaatgtgtgatcatcagagtgagcatgcatttctgtcctcctcgattggccaccgtaccagcagcagtccatcatatacgtgcaacatatatatatatatatatatatatatatatatatatatattcccctcccttcccaaatataagtgccatctttgctaaaacataaacctttttaattaaattatttagtataaatattaaagttgaaaataaaaaaaagactttgacgacccatcccattaaacgaggatggttaagacaaaaaggtgattgatttacgaaatttaaatggaaactgattagtggaaaaagtggtattctgaacaatgctagacgtgaaaaactgcttatattttgatataaatttcaaatgctagacgtggtacattgtattttttaaaaaaataaagggagtatttccaggttgcttagtactccattcgtcctattttaagtgcaaccatgagattctatgtccaactttaaataattagtatttttaatgttataggatgatgaaacataaaacgtactttacgcgtgacttatgttttcaaatttttttcaaaaaatttaaataagacggacaatcaaaattaagcacgaaaaatcatggctgcacttaaaatgagacggagaaagtagagattacaatgaggagaaaagactatggtgtcgatcagtcgtccgtcattgattccgacattccgtgtgtttcattcgtcgagttgtcgtacagggtctagctagctgcatgtagaataagggctcactcggcttctacatgggaaaaaaaagaaagaggcgtgagctaagtgtttaggggatgtttagatcaaggggtgtaaagttttggcgtgtgtcacatcggctattatataggatattcgggaagtaataaaactaattgcataatccgacagtagacaacgagacgaatttattaattaagcctaattaatccatcattagcaaatattttctgtagcaccacattatcaaatcatggagcaattaggcttaaaagattcgtctcgcaaaggagtatttaatattttatgcagatattcaaacgttcgatgtgacatggtgtaaaatttttatgtgggaactaaacatggctttagtctgatacgaaattggtgtatataggaactcaatccaccagtccataggatttgatgttccaaatgccaatggtatgtatagaattacaatcctctatttttcctagggtgcaaattaaaggaggcctaaacgtacgtacgcaagcacggagggtggatatagtgatgtagacctgtaacgacgagtgcaacagatacgcatggttcgcacgcacgtacgcagccgatgatgaattcagggagggagagacaggagaagcacatacgcacgcatgaacatatcggccggtaaccaagacgtcgacatacacagagcacgtgcattacagataggcattaccgtcctaaaatataacaacttttaattagacgagacatataatctattttagcaggatatgttctgtccatcaaaaagttgctatatgagcactgcagtctgcaaaactaaaatggagctgaatttgtttgaaaactacaccctctactatattttctttagctcattttatttatcctaaataagttttttaagtaaccaatgtatttaagtttataaaagtgtaaaataattatattaggagtaaataaagtaagaaataattatagtgagatttgataaagtagagatatttttttttgtgttgtattgatatctgtaagataatgaaaaataaacttatttgaaacggagagagatggataaagtggtggggaggtgaaagaaatatagtgggaaaaataagaaagattcgcggagtgaaagcaaagcgaggcaaggcaagagggcggcgacaagacaagcaggggaattgaagaggagggaaggggagggacaggcggcggaccggcggtgaaaggcgaaagcgaaggtggtgggattctgtcctccccaaagggggaagaatatcatcatccatcgcaaaaaagccactttcccacaaaaataaaaaagcccactcacactcacgtccatcgtcgtccctaccctagctatgacatctctcatctcatcccatctcatctctctcatccccaggcccccacactatccatcatctactcgatcgtgtactcgtaacagcattgtattgtatgccaggttctcctaaattcgatccatcgctttctactctacgctcctaccatagtgctagtaggcaataaaatggcagtttcatgcaatatcatactccatgatcatcattcaggcaggcctagctagctcctgatcatctagcagtacacgttgcatgttccatcgccatcgatctcaacttgtcaacactcacacaaacacgcacatgtacacacaaaacaaacccacctcaccagtgcttgtagctatatatagcttgttgatcctgatattgctagcccacttaatctaattcagcccctgtcattttccaaccacgcacgcacgcagcttcagccactgacgccccaacttgcagcgcgtagcgtatgatcagcagcatatagctaggccaattcggtccgtacgatcaacgatcgatcgatgcatgtgtccgcgccatgcgtcgccgtgtacccaaaaccaaaagcgtacgtgcacgatcgtaaacgacgtcgtcctacacgacgtcgacggcgacatcgtgaccatcgggcggcggcagcggcgcgatgaggcgcttgcactcgtcgtcgtcgccttcggcggcggcggcgatcatctcgaggccggtgagcttcttggcgcggagggcctcgaggtgccagtcggtgcgccacacgacggcgaggaggaccagcgcgacgcaggcggcctgcgcggagaggaggccgtaccagaggccgccgaagccgacgcgggcgccgaacgccagggtgacggcgacgggggtgccgacgaggtagaaggagagcaggttgatgcgcgcgccgacggccggcctcgccgtgccgcgcagcacgccgcagcccgtggtctgcgggcagttgcccagctcgcacagccccaggatgggcatcgccgccgccgccagcctcaccaccgccgcctcccgcgtgaacagctccacccactcccggctgaacgccgccgtccacgccacgtgcaccaccccgatcaccaccgcgcaccccagcgccaccatcgccgccatcctcgccctcctcggcttccctccccccagttcattccccacctgcatcatcaccaatcaaacaaaattgaaagtttaattgaaattagaacgataaaagttgaaagtttatgcgtgtaggaaagtttcgatgtgataaaaaagttgaaagtttgaagaaaaagttgggaagtaaaccagatcaacattgcaactcctgattcaattctgcactgtacaacgcatgacaaattgacaattcacaaacagtggatgaacagcgacatcgcggtgtgcaaattctgtcttttctccgaacacctacagtgcagctgtgagcttcactggcacccagaggaagcactgttcgtgtgcactgtgctgacatgcacgagcaatgacaagaccaaccaccaatggccagaggaagaaacaaaccaaaaaaaaaaacccacaagctttgtcccgtttcgcatgcagtaaatagtgctactaaaatcgattctctgatagaaatggtatccggcaaccagcctttaaaagaagggggtgattctgtacaaaatcagcaaaaattcagaattttgtcgcttctctcgcttgctttgcccgttgattgatgtgtgtagggaagatgatgaacatgttcaagatttggttatatatccatgctataaaaaaaaagagagatgaatctgttgctacaatgttggtatctgttactactatacatcgaaaattcagtcttaggagtatctagctcatcaacacacacttagccacatgatttcgcgattgacgagtgtgtggcaggaagcaattaggataaacttgttgtgctaaggttgcacttatcttcttgtgccaagattgggacacaaatctgttcacgaagatatatatatctatcttgatagattcagtcgtttcgcttgtttgtatctgaacttgagctattctataagttcagataacagtgacaccagcaaacaagaaggaggattaaaaacatctagctcggcgcaaattatgctatatgcctagtactatatgatgatgttgcccagcactagctcataacaaactcgctcactgaattttctcgaaagtataacaaccctacccgttgacgaattaactccggcgatgtgaactcaaagcaaaatctcagcctgagctgttgacattcggattggcacgaatcaaaataaaagtggcaatgtgccaaatattcgtgtgtaaagatgttggcaagctgaccatggttgtggctttttagagcaaggttagtatagccaactactaactccaattcacctatagccatctaatagttaattcatacaatggttgcttactatattattagtatatggtttcactgttatacacacattgtcttttagagttcgtgctgcagctgacctaataatctgctattgtagctagaggattttagtttcgttttcacgaatcttgatgcaatacctttatttttttcccgttgggatgcagtgactgatatgagtgattagtgcaaattaagttggtgagtgatgagaggcgtacccgagtagagacacaggcggcgagcgccatgggcacggtgtacatgaggctcgtggtctggatgagcacgccggcggcgccgaccgcggcggcggggtccggcaggtacccggcgagcacggtgaccacctcgtaccaccaccactcgaggcagacgccgacgcagctgggcacggcgaggcggacgaggccggcgaggccgctcgccacggcggcggggcgcgcccagcccttccacgtggcgtcgcaggcgcgcgaccagcggatgtaggcgaggaggaagaggaccatgttggtgttggtgagcgcctgcgcggccgcgacgccgcgcacgccgaagccgaggccgaacacgaggagcacgttgagcgggacgtggagcgcgacggcgatggcggagcaggcggccatgggcttggtgatcccctgcgagcggaggtagacgcgcagcggctggagcacggcgctggcggcgaggtccgggagcgcgtaggcggcgtacgcggcggcggaggcggagatggtggggtcctggccgagcgcgacgaggatggggccgacgtgaagccagagcagcgcgatgggcagcgcggcgagggtgagcagcaggacggcgcgctgga

SEQ ID NO: 68930 - DNA, 22396 bp, Oryza sativa
aaaatccctccaaatacgaatggccgtgcataacgcataacgcgtaacttgccattagcacattaaggctgtgtgcttagatcaaggcgtaaaaagttttaacttgtcatattagatatatggacacatatttaaagtattaaacgtagattaataacaaaaataaattatagattccgcttataaactacgagacgaatttactaaacctaattaatctgttatttacaaatatttaatgtattaccactttgttgtcccgctctcgacgcttgggattcactctaaattctcgtggatttattatacgcttcttccaaacacgaggagattatggcctttttcagtgtcgcaacaagtcaatggaacactccctccggtctcattttaattaacgttttagacaatgacacggtctacaaaatatatatttgaccttatttttctattataatatatacaataaatatatgtatgtttacttttattatagtgatttgaaatacaaatctatatatgttgttatagttcctttaaactaaatatttttaaagtttttgatggtcaaaattataaaagtttgatcttaatcttgtctaaaacgtcaattaatatggtaccggagggtcaagattcttctttaattcttcggtctacaaaaattttacatcccttcacatcaaacgtttaaacatctgcatgaagtattaaatataggctaaaaaaaactaattatacagattgtgactaatttgcgagacaaatcttttgagcctatttgctccatgatttgacaatatggtgctacattaaacatttgctaatgacagattaattagacttaataaattcatctcgcggtttactgatggattttgtaattagttttttttattagtgcctgaacacctcatgcaacaccctatataatatctaatgtgacatgccaaactttatacccctggatctaaacactcccttcatccagagatagattaagttcattctagatctcttaaatttgacatcaaatctgaaattcattcttgaactgaaataccatatataacacgttcttcaacttctaaaaccgatacaaacatggtcccaccgtcttttacgattgcaagtgccacgttaacaccacgtgagacgaggacctaattaaaccagccacgtaaccgaaaaccgccatcaaaaccatcaattaccccggtttaggagttgaagaacgctttatatatggtatttcgattctactagtcaaataaaaggacctaaagtgaacttattccccgagaggttactaattacggcctgcttgcatttggaaggccagatcgaggcctaaaattggtacgtataagttacaaggccgaaaagttttcacattgggctgcttggtgggttggttgggcccaatccacgacgaaagaaaagtccaagtccgggcccagtgcgcttgcctgctttctgcggacgtgtcgcggagtcggccacaaactcgcaaaccaaacccggcgacggcacacaggttttagcaccggacgggagctctccgccgtcgccgacgacgccgccgccgccgccgccgccgccatctccggcatgctctccagaggaaggtgcgccgcgcgatctctccgattgagccttactgcctcctcctcccccctcccctgctcgttgcgcttgaatttggattattccttactcattccgtgggttttccctctccccccttccaaaccagatgtttcccggcggcgagtcggatccggccgctggtcagggccttctgcgacgtgccgccttcgctccaggatgcggccgccggggtgcccagctcgcaggtacttttaccactggagcgtgccgattttgttgtttagggtgttgtgaactgctctgtgtggaactgaactgaggagttgatgtggaacaagcgtatactggtgttgactctggctgtaaacttgtaggatcacacagagaaggttgatgatgtgaaagctagacccgacgagctcgacattgctatcgttggtggaggcatggtgggattggctgttgcttgtgcattgtgtaggtattttctgttcatgttgtgcttccttgttttttgttggctctgcttactgtcagtcgttttcggctgtaaagaagacttctcccttattgttgtaggctatgatattgtctagaaaaaagtttttaacccagatgaaaatagttctcaacgatcctcaccgacctattagtgcaatttgaagtgctattaatgattcttttttttcattggtattggtatgagtagcttttcatgctatagttgaatcgcaccttagacatgtgaaaatgacgattggatgtttcaaatcagaaacacctgtcatttaaggatcaagtttttcacatgcttatttatccacatgcagccaatatgccattgactaaacatctgagggttggcatcattgatagcaatcctgcattgaagtcaagaaattatctgaagaaagatggtgtacctgattcaagggtcagtactattactcccgcgaccatatccttcttcagaggtacagtttttaatcgaacatgcgttgatattatctgtacgtgttcagaatttttcaggcgcttgtactttgaattaagtttttcttaacatggttgggtactttgttgatgacgttttatgttggttttgagcagatatataaacataatgctataatcgtttttgtattacttctatgtctccatcattttgtaaagttatctagttacatcattagtagtttattttattatcttcctttttactcttgtggatatctgcttcattatataaattagttgatagcctaccgcctacctgggatgatcactatgcaatattcggctgaactttctttcttttggagtacgtactacagtaccgtatagtgataagctgaagcgacttgtgaactccattgatctatatgctcaccatttccgttgcagtacagttgcatcatattatatatcctttctcatgtgtgatcttcacaattttttgctaaggtttcagccctatttttgcacattaaggctgggaaattgcatgcttgcacagtacagcttgagaattgctgtatctgtatttctcccttcaaacgtgcaaataagctacttttacctactagtgatggtagcgtaccattcaacaatttcttcatacttgtaccatgttatattgcagatattggtgcatgggatcatgttcaacagcaaagacacgctttctttggtaaaatgcaggtgatataccttgcttgtcctgatgaaatgatttgttctgtatgtatagtgaatatccttttattttcaatttcacctttactctatttttgtccaacacatttaactctatttcctctttgagcccacttatttctttaaagttcaaaattctgaacatgttgattcttattggactaggcggctttgttcttgcctttatatcaatatcaatgaaaaactaagtcagcctctgaattcatctactgcaggttccacatcaggctagcaataaaagatcattgtacttagaattttaaaatactcgtaatcagttctcaattggaacatagaatagttgtatacctatattatgcttctgtttgcatacccatatttttagtagtctggacccatacatgcaagtattagaacttggatcctttaccttttgtattttcttctttgatgttgaacttgcacaaaataagagcagtttcttcctccagatagtgggcgcttcagtttaagcactaactgcaattctggatgtgctcatgtgctatttgctaacaggtatgggattacactggactgggttacacaaggtatagtgcaagggatgtgggaaaagaatatctcgggtatgctctatgaaagcagctgtgatttatgactaatttctgtcaccaactcattactaacttcttatttattaattcaatgtttagatgcgtggtggagaacaaggtgctttgcaactcactgttgttacgattacaggtttgtcttcaattgacatatttgattttttttagtatctgcatggagcgtgatgtttgaactcgtctaataccactttaatctgtaaatggaattgtatgcttccttgcatatatttggaatagaacattcttaccatctatgcattcaagacagctaaatttatgaggcctttataaacacacacacacacacacacacaccattttatggttcctttcctcttggttaaccaatatagtttattagcagtaaaggttttgtgataataatagagtaaattgcattagcggtacatgaacttgtcaggtgggtgcactttagtgtatgaacttataaaatgctcgttttggtgcatgaacttgtttgatacatgcaaactaaggctaaaatgacacgacaagaccgatttttctatgctgaacattataaattataaattagtagatgatgtgcgtgcacatagtagaaatgttatatttgtaaacttactttccactttatctttctttgtttctatctcttacatcattactcggttttttattttatgcaatcgttatgcctatatgtttatccttcttagacacatgtttacatagagtttaaatcaacaagattaaccttgatgtgcgattttgaccttgttcgcacgcaccaaacaagtttgtgcaccaaaacaagcgttttacaagttcatgtactagatgcacccatctgacaagttcgtgtacctctgatacaatttactcataataatactcccacccatgtgtaggacagagtaaacctacatagaagttgatggtcgggttatttgcagccagataatcttacctttatttttagtaaggctaatgcttaaagatttttgcttgatcaggaggaaaatggagacattgaaaagatgatctaccctactagactgatttctcttgctttgccatcaaagagcagacaagcaccaacaagggaagcaatatccagtggttaccctccagaagaattaaatcgcagcaatttagttaaacttgagctaagtgatggacaaactttatattcaaaactagtggtaattgcctaccatcttcttttgcatttgttcaaacttctgtctttgtccattgccttcagttgcctacttaaatgtatggttgcaggtgggagctgacggttccaagtccaatgtaaggcaaacagcaggcataaaaacaacagggtggaattatcctcaaagtgcaattatttgtacagtggagcatattaccgaaaacgattgtgcatggcagaggtttctcccttctgggccaattgctctacttccaataggtgacaactacagcaatattgtgtggacaatgagcccagaggagtcattgcgccataagtcaatgagtcctgaagattttgtgaagtctgtgaacaatgcattggattttggttacggtccacatccacactctggtagtcttgactattacatggaaaagttattttctgacattggaagtactgctgcatctacaaaggaatgctttgaagtacctccaaaagcaatcggggtagtctgtgagagaatggcatttccattgtcgctgaagcattcacatgattatatttcaaaaaggttagcactagtcggtgatgcagctcatacagtccatcccttagctggccaaggtgtcaacttaggttttggagatgcagctgctttagcaaaagttatcgctgaaggagtttctgtgggtgctgattttggggatgtaagtacctcttgctgcaatcttttggttaacattttattcaaatactaacacaacctggattctattagcaaatatatcatcatcttgaaagttgaaacttaagtacttgactagatacaagtgaaagaaccgatcatgctgcatctgaaatattgtaattcatttcccctttagtgtagtgtaattcttgttggagtgcactataaacatcatatttatcatcacatcaaactaacatgataaatgattttatttgacagatttccttgctcaaaaggtatgagaataatcgcaaagcagccaatgttgcaatggcagcgctgctagatggtttccagaagatgtactctgttgattttggacccctcaatgtgcttagggctgcagcgtttcacggtgcccagtacatatcaccactgaagaagaacataatctcgtatgcaatgggcgacgcgaaatggccgctgttttcatagacagtagatccggaaactttaaatttgttagttgttactgcagtgtcgatgtgttattctaaattagtatagtgtactttgtctccagtgttctcatccagagtagtaatgcatcacaggcacacgttgcagagaagaaatgtagctagaaagaaataaattggatctcctggtgatctaggattaccttgaatgtactcctcttgcactccagtaactcgcttctgttttgacccacaaagttcagatctgtgcaaggcaagatgatattgaagtgttgactgttgacgaagatcagtcaatctgtgcaggttgcagtctagcacctcctttgcacgtagatattctttttctcgatttctacgggtactatatcaatcaactcgtgtgaaagttctataaatatttgggtggggttactgaattttaaagaacgattgttcagctgttttttttttgtgtgggtttctagattttagattttcgtttgtatgctttattaagtttgtttcgtgtaaatttttttttcttagaatatctttctaaatcattttttttactttgtgttaggtaatccatttgtctgtaccctcatatagctatcatggaaatcatataatctatcaattcgagcgaaatggggctataggtaattatgcttagaagtccggttcatcgaactttcctaggcataattgcaaaaccagtctgagccatgtgggtcctagcggctaatgtttccgatgataacatcacaccaccattttccgatgataacatcacaccaccattttacctgctgttaaaatgacaaaaaaaatgaaaaaaaaaacagaaaataagcaagaacttttacctgctgttaaaatgacaaaaactaaaaaaacacagaaaaaaaaccagaattttacctgctgttaaaatgacaaaaaaatgaaaaagaaaagaaaaacacagaaataaaaccagagtataaactcctactagcttccttggtggcgggggtgtcaaatcggatcgtggccgtggctgaagaaagcaactcaaccagctgccctcccaaatttctctcctcttgccgacgactcggaaaaaaaccgcggacaccgcgtccgctcgacggagggaaggggatgagctcctcgtcggcgtcggctgtgccgccggaggacgacgtctgctcggtctgccacgaccgcttccggatcccctgccaggccaactgctcccattggttctgcggttcgtctcccaatcttccctcgcccttaccccccccccccccccccccgcgcgcttcctggaacctcgatccacctgtttccaccgattaggttgggagattatgcgaaactgtaggttttcatttgattccggtcgtttttttttggcttccgctggatatagaaatggtttgtattggctagaattgacaaggatgttgtagattacgcggtttttgagttggctgcatgatgagaaggctctaatttgccggtttaggataatttgtgtatgtgtgtgtcgatgccaaatgagggtttatggtggttttttggtaggttggttgaaattttggaactcatgtagctggaagactgggagtagtgtgtaatacattctacatgaactgatggaaaaccaggtcagatctaagattgtgccatacacttgaataccaatgaacaccacaattgctcatcgagcaactatgtggaaaagtcaacttcatccctaaagccaatcaaacaccatctcagtgcttgtgcgcattcatatttataggactgaattaggtttatacattaggattatttgggataaccaaatggctcttacccccttagttcaatggtattacttgtcatgttatgaaatggtagcattaattttattcactccaaaagagcaatatcttctatgatgcatgaatcaggctcaacactatgaaatcagtatgatatgatatattatactaccactttgtcttttacaacagagctacccactgcatcagttattctttttatttcagtttggccataagacctggtagcgcatatgctttttgagcatgtatttcctacccaactatacttccttcactacttctctagtattactgaaagtattagtagtaactatgctaattttgttgcaggagagtgcattatccgtgtttggaatcatggaccttctgtacagccttgcaagtgtcccatttgccgtcgccttattaatcttctggtaccagcaaatgtatcaatagataatgatgatgatccgcaaattcagcatgttctaggagaggttcagcattacaaccgcatatttggtggaacaccccgcaacctgactcaggtttatacattgttcacgaaagcttacttattttgtcttcagatttggaaatttgaatgtacataggactaatcaacatcaataaatgttgtatttgcaaacacacacacacacacacatcaataaatgttctccaaggggatatgtttcattttctcataattagctcattgttccttgcttgcatgctccccaaattcttttataggattcatagtgtagttttgattcctgcacaggttatgattgagaaatcatctgtcttctaactcctacaatgcatgcacatttcagatactggcatgcaaatgggcctctgcaccgttgagttctaaaaaatggtagcatgcatttaatattgttgctagataatctctattaggtcaggtttcataacacctagcattttatgcctttctgttggttcagtatctttagctttctatttctttgtgattgtgtatccctatacagagtaacatccatttttacataatcaaaccaacgctaatagtagcttctactcttgctctgaaaggcagtacttcaacattaatcagggtaaaatggaaacatgaacacggttactctgttatgttggaaagattatagataatagtgtgacatacccttattcatcattactctatttgtacatattgactagagttgtcatagttgttgtacgaggaatgtgactaaggtgtaacatgttgtcatatttaactatcttagatataacaaatatgagcatatctagttgactaactgcagtagctttggtagctaattacttgatgttttcacgatcttttttcagaggttgcaagacctaccctttttcatcagaagactgttcagggaactactggatccccagaggaccctcccacttgtcttcagggcgaggatggtcatgatggtaaggttttatgccattaaagtgccttttgttatctgtaaagctactatatgtttgtggaagtaaacattgtttctcactgattaaaatttgcaggtagccctgagtgcaatttatgtcctgagccccatcgacattcttcctgaaagtaagttcgatattcttctccgcgatctgaattccagtaccactgggcatacgattgttaaatgttaatgttttgaatatattatagacgtgctggggctgtttggattcttcgatgacttcctcgtgctgctgatcgtgttcctccaccttgctgctgtctaccgttctctgctgctctaccgccacggaggccactgaattgctgctgcacattacgtgatggcagatggagtacttgcgtccctggctgacgttctgagacaagagatatttcatttgtgctggaagagattgctagctaaagtcgatgatgattgatggtacgaatgatggcggcagtagtttctctccccctgtgtattctatttcgctatgctatgccttgtttggtgatattcacatggtggatttaatgagaccgattgctttttctttagtttgatatatatactcacacgagattagcaaatagcaacaacagtgagcacttgttcatccttgatgagccccaatggcattgctgctccaacaactatggatgggcctatggcctctgccagagaaagttttcttttcttttctctttattttttcttccttttctgaggagtggaaagaaacatacactactccctccgtcccaaaaaaactcaatttttaggtttttgtgtctagcgtttgaccgtccgtcttatatgaaatttttttgtgattagtattttcattactgttagatgataaaccataaataatattttgtgcatgacttatctctttaaattttttcataattttttaaaataagacggacgttagacacgaaaactcagaaattaagtttccaaacggcaaatacacttttttcttttattttcctttttttcaaatacacgtatttagaaaattctcctcatcaaataatagtgtatacattctaaaatctgtcgaaattctatagctcgtcacattccgggggaaaaaaaattgttcgtagtcgtggcgtggctcttgctgatgccaagtactccagctccccagtagtgtgaagggctaggctacggctcgcctcccatcttgtctctctctctctcccctctcccaccggcagagacgcgctcctgtggcggggagggagcagattcattcagccacacagacacaactcgtcttctcctcgaggagctagcaaccggctagcggagcaagagcaaagccttcaggaatcaggaggcggccagattcgcgcgcggttcctccctcctgtgcgtgcgtgcgtgctctctctctctctctctctctcgtcctcgaatttatctgttgttttttactactagtgtctagtacttgtgatttcaatcggctgctatgctcgttacttgcttcttcattcatagaccatatagtccctacctctctggatggatgaaattgtgtgagtaattgcttgtgctctggtgtcaaagggaaaggaattcagtcgcgtgctacagactacagagagctcttttgatcggaagccaatgaagtaatggagggtatataacctggggggggggggggggttgtgcgagagttcatctagattgaaatctgactcagaatttgcggccccatttatctccttaggaaatttctgagcaccaagaccatcaaattcccccttctgtcacctgtatataagtgtctgcctttcctccatgccattaactgttttagccatttgattgatatgcaggatgttggcgaaatccccatcattgcctttcttaactgctactgaaactgctgcgatcagcctctctccaagcgtaagatgctccactttgtccggtgatggccattcatgttgtgtttttccagagattctcaccttcatttcctgccatgctgaatcgacaaattatatagttttgcactgttaatattgagcatgtgcgcctttcagtgtcggactatatttattggcactctttatatgaacgtgcgccccacataaggattaaatgtcttgttcagtgaaaaaaaaatattgtgccagctgactacttatgtatcatatactatgacaccatatgaatttgatgaaatggcctctcaaatgcgtttaatgaaacagatgtgcgtggggttcttcagtcatccagtggttagatacttagatatacctttacacctcgacacgttcagcaaattcagactgcatttaagtatttattttggttaggtccctggcagcattctcattgatttgatgttcaatactagatgcttttctcaaacatcatttaccaattctccatttgttcaaaaatctatgttttcagtgaagggccatgtactgtgtttctgcacttggagttatgtaataagttatgcggtgttttatacttttattatgttacctctagtttgtaacaagcttgatatctccattaggagttctctatttctatatgtctatcttttttttccttgaaaaaactggttcactatatcacattcagttccagcttgcttcagattgatttaatgtattttgatgaattttgagtgattcatgttttgtgtagtgtgatctctttagttcaccaaatgcgagattttccaagaagaaatatggaggaagattaactatccagccaaacattgaatttggaaaaactcaaaatagtaggactcagagaaaatggaggacattctccgctgatcaagctcaagctaccgttgtcgatgctggtgacaacaaaacatgggaagaagccaaacagatactaacatcactggattactccattgaagacgccgacaaaatgctgaagaaggcatttggatggattcattcaccatactggagtgaagagagaaagaaggaggttccaaatgctgaggtggttagtggagtactgaactacattagaactcttgggctctccgatgatgaccttcgcaaattgctgaagaaattcccagaagtacttggatgtgatcttgacagcgaggtgaaactgaatgtaggcaagctggacagtgactggggaataaatggaaaaacactccggagtcttcttttaaggaatccaaaagttttggggtacaatgtggactgccgaggggactgcatggcgcagtgcacccgttgctgggttaggttctagttctgctctacgttaatgtgcagaacttacagttgaattataggttcccagctatttgtctatttctatatcggttactcaaaacctctcttaacataaacaaaacacatttatagtagatggattagcctcagcatgttagttttgtttacatcttgaacagcaccttttccatactatctgtatcagggatgtaaaaacaaatatatcagatacctgaatttctgtgagtgcttcaacgtttaattgttcttttcttttggtctgttgaggcaatgagagtacttgaattgtgctgttctgccattcttgtcattgtgcttgatatataatcagtatctcatatttgtgtattaaaaaaaatcagtttctcatttgcatctgattacctgatatatgtatgatgaacaagtgtttcacggttctgagtaatgaaatgcaatatgatatgtcagtatctgcagatggaaggggtctcagattccccaatctcttgggttgtttcaacatgtgcaggattaaggtatgtccagtctaatgccctcttctgatttcccctttttagagagaaaaaaaatgtttctaacatgtttcctaagtgttgtacatgctagtgtcaattgattaagcttaagctttgacattattcatcaggtttgagagacagttcaaagtttgaaaccatcctctgttctcaaaaatcgaatgctgctgctgcaaagagatcaattccatcgaattcacagtaatcgagccccatcggcgagaggcttcctcgctcatcctccatgctgcctttgatcatcaatccatcggagaagaagcggttcgtgtccaccgttctgcccactgcctcgccggcggcgtgcggcagctgaccggaggcggcgtcgtcgtcgtagtcctcgggcggcagcgccggcgagtggccgtcgaagatggcgacgtgggcgaagagcttgtccttgcgggagaaggaggtgccgcaggagcagacccagcggtcgcggccgcagtgcttctcgtgggtgcggaggtcggcgacgacggagaacctcttgacgttgcagcggcggcaggtgaagctcttgtcgcagtggctccgccggtaatggttcttgacgcaggtgggcgtcttgagcggctggaagctcttgtgctccctgttcctcttgcaccccacgtacgggcaggagtagaagcgcctcctcgccgccgcgtccgccgccgccggcgaacgcgacggcgaaccgccgggcttggccagcgcggccgccgacttgtactcctcgccgtgtccgcgcatgtgcatccgcaggttggcgtcgcgcttgaagcccttgccgcacacgccgcagaagtggacgtgcggcgccaggatctcctccttctcgatctggaccacctcgtaggagccccgcggcggggcgcgctcgccgtcgccatcggcgccctcgtcggcgtcgctgctgccgtcgtgcttggcgtccgcgtccgcgtcgtcgccgccgcggcgcgccgcggcgaggttcttggagatggagacgagctgcacgacgatgcagctgagctcggcggcgacgatctgcggcggcgggttcggcgtcgacgagattatgccgcggaggtggccgatcttctgctccagaaatgtcaggtacgtcagcaccgccctcgcgttcccagctgctgctgctgctgcttcgccgccatggcgagcttgcgtcgtgctactcgcatcaaaatcacacagctccatgatcatctgggagaaatcttcatcttgctccaagtacatcgcctgattattattattgttgctgaaatgatcggcactactactcatcatcatcgtcgacaacaacgatgaatatgatccttcccctgaaatacatgccaacaaaaattgaatcaatgatcaagaacccaaatggacatgttcagagtggcattggcaatggcataacacttaccctgagatgatgagaatgacaatgctgatcaaagaaaggtaaaaattcgatcgagtgtcagatgattttttttgtgctcctgatcagatcacttctgcttgtcggtgatgaaatgtgagtcgagctgacagctgagctaatcaaggcagtaatatatactccaattgataaggtgtgtgggctccacggcggcggcgactaggtcgacggcatggtaagctcttgcgtcactaaagccgaagcattggcatggaaatgtaatgtgcacgagttggttgactggtttcttcttcaggatctcgtgctttttcttcctggctcttggtgctctgctttggtcaggaaagccaccaaattttgcccttttgaacaacagaaagcttacatattataatcacttttttctaattaaacttctttaatattttttacacaaaacaaacatattatcaaaaaaatctatcaacagatgaatagcaattccgtatatttaatgttagaaaatatattcaatgttagatttaatgaaattaatttgatttttaagatgttactaatttttatgtaaatctagctaaacttaataaaatttgactagaaaaaaagttaacgacttataatataaaggggatggagtattttataattttactgggtacacgttgcgttaaaaggccccatggatgtgttgacctcacttgccgatcaccattccttcactgatcatttttttgcctttcctctgaaagagaacagcaaggtcaccttccttccacagcataagtaacaaggtaagcatgatgcatatgcttgggaagttgggttgatgtcaccgggtattaccgtattgtgttcctcttgagtatctgtgagtgttcacaccaaccgattttattaagagcgggctaaccgcatatttgtgctgtaacagaagtgtttacacacgatacgtatgctccacagtccacatacgctactggtacttattttgttttggagatctctaggctttagataacttaaaattgtgagaaatttcgctcacctccaacctctaaatcaagggaaataggagaaaagagagagggaaattaatggcaaaggactcaatggcggctgcgatactaagttagaggttagggggttgaaggcagaagaaacagggggattccatgaacttggaaggatgacgggaagcgctgaggacatgcgatcggccgtggacgtgggcaggtggcttgaggggttggaggagccacggtggacgaggtcgacaatgggtgcttccgatctggagtacttcctccgttttatattataaaactttttaatattacctatatttatatatatgttaacgaatctagacatatatatgggtttagattcattaacatttatatgaatgtggacaatactagaaaatcttataatatgaaacggaggaggtagttagaaagatgagggtggcagtggtggcggtgtctcatagcacaagccgtcgggaaaaaaaacaagcagggtgggggtactttaccgccgcttgggctttaggaggagcaagaggaggggaagggagaaggccggtagggcaagccttgttgacaatacgcaaggggtaggaaaaagcacaaattataacgcatgtggctcaatcagatctggagtcaggggaagatgtccgttactgtagtagcacacacaaatattgatgcaatctagccatgcataacacaacttaaaattatgggtagttttaggtgactgaaaattacacaaccacatttcttttatttcttttatttgagattagtcttaaatgtatcacacttctctcgcatgttgtgtgcgaggacaaggagacactaaaactaagtttttctctaccaactaatttgttgcatcaatagtgaagattaaaagtaaagtaatatttcttttttttaagaccaagagcttgagttttgtttaccagaaaaaagatacaatcatatgcgaaatcgtcaacatatataaagctagaccaacggctataacactctagataattctcgctaaaaacatgatggaaaaaactgcatagttggattatacattatcggttagtattgtgtaaacgaaccacggaacaaggtgtgtagaaattagtaagtcgagaggggcgaccaagtcaaaacgaagagcgaaatggcagcatgcagtgcaccgtattcggacatgcatgtaacagcgtccagattaagtgacagtgtgccacgtatgtccacgtacagttgcgctctgcttagaagcaaaaggcaaattttactacatgacatcacgactttgtggttttagttgtaaaacactgcacaaactcatttttggggggaaacactatctaacactgcacaaactcatttttggggggaaacactatctaacactacacaaactcacttttggggggaaacactatctaaacgtggttatttgtttgctgctggacaccgcgcgcattaaaatattaatttctagttgagtaggagagataaagagtgtgaaatgtcaaaaataccccttgccccacttgtcatattcttcctcttcctccttattttccctttctaatgtcacggcagcgctccaccgcgtcgtgggtgcactctggcacggcggcattcggcggagacagcgctttggcagtatctgtgagtggtggcgcctgcatgaggagatggaggcggactcgtggcgcgtcatcgagctccgaaacgatgggaaggcggcgctcgacgacgggcggcatctgccgaagttgaggaagagagagagggaagcggcagtgcgaaaagagaaggcttcggcctcggagcggccggagctcaccggcggcggcagcggcacgggaatgacgtggcagtgacgatgtcgcagctcgaggcgacggcatgaagtagcggcggcgtggcttgggccggctcggagttctccccctctttgtgctaatccacaagcaaccaacatcacggagtcaaatctctcgtctccaatttcttcctttttccattgagccaaattgcaacactcaaacaccaaatcgtacagtagcaagccacacacaagcatagctgctgctgccccccatcgaaccgttgtagagtgctcaggcaccactggctagagtgctcaggcaccgttggcggcagcttagccgtggtatctggacgcggcgcacctagcaagaggtctcgcccgacgaccacggcccccggcggttgggactctctcgcccccgtgcttgccatcttgagccgtgggcgcatcacctgtgagacgccgtggtgggagatagaggaagagctaaaggaagaagagaggaagaggaaaagaaaggaggggcaatttggtcacttcgtgtaaaattttgagccctctattgactcgtcaacacgaatacactattttaatggacgaatactctattgactctggcaaataaccacgtttagatagtatttttttcccccaaaagtaaatttgtgcggtgtcctacagctaaaaccacaagtcgcgatgtcttgtagcaaaatttgccaaagccaaattaacacggttagtcctgtcgatgttattggcttacggctccatgcacctactgacacaaagggtttattgaagtttctgatagctattagaagcgatcatgtaaacattctaaattttcattttatttttttttaaaaaaatatagttgtagaattaaaaaataattaaaagtcggaagctaattataaactactatgagtttcttcatattctaataagaatcttaagttcttaaacaaggacaagaaagctagtgtaacttgtttgccctttcatgtaactaaccgaccctatgcttgctgccgttgaactgtcaccgactgcacgtgtctgattactattcttgcctatattttgaaacagcttatccaaacttagtagcttacgtggcagaatcttgaagctttcacaacacacaacgcagctctcaccagacaccagccatgccttggtcgatcagctgtactagggagtatatccttcaacaaacactgttgttgatggttgttcttgaaaaaatcgaacacaccggtctaggagatctgcttagctcctgtgcaggtttaaagattaatgagatgcgggcgtaccagttagtttaatcctacaactgacaagatttacaaataatagatcaaacagccgatcggctgacaagccgatagagtagttccagccgatagtcgataatagccgatgccgataccagccgatagcgataggtttaagcaatcggctatatgtccaatgtagataatgatataaagacaatcggctgatgataatataatatagcaatataatccagtagaaaccaatcggctaacaatatgaaatagtagaacaaatattgatccgaaggttaaagcacgcatcggctggaggtccgatgtcataagatccacaagattatattaaacagtgaaacctttgttgccatcagctaaatccaacttatatgtatatacaatccctacaagccgatgcaacgtccagataacttatcggctagcaccccgataaaatattagcatgaacctatcggcttaacaagacttatattatcaactacaatctagtagatcgaacctaaccgatgcagcacgagattgtatatgataatctaatactcgatgagccgatagatctgtctaatgtgatggatataacaaatctatttagaacaacattatgattgtagagatatatcggctaagataggggatcagacctaaccgagatagtcccaactaaaccgatgcgtctctaaacacaatgcaattagagatagatttgagatatcagataggcaaatatatcaaccaaaccagagtgatccaagagatcgaatcgatgcagccttgaacaacaccaacatagccgacagattcaccagggcccaacagaacgtaggacttaccccttcgttggagatcgaaagtcgatgcagccctgcgtcaggtgcccaagttccgccggaagataagtgaaaacctcagggaagagggtggcgatgtgccgagagtattattgatcgatagattgatagattacaatgaccccgggtgtacatatttatacccatagggagatactagtccttgtcggacaagaaagaaactaaaaaggaaaagataaagttcttatcggacactaaacacactttcctaaagataaaaggaaactaacaaactatacctaattaatagataataagcttcctttaattgatccgactccaccaagaacacgacatcgtggcgacttgactcccatcggctgattctagaactttgaagccgatactgactctaaaccgatggtaactttgggcttaccaaatttcactgttaacaatggtatccgacatggaatactattattagagcaaatttaatagtatagtcaactactaactccaaattatctagagctaatgtaatagtcaatttatacaatagttgcttactatactattaatacccgattccacctgtcatacactcgttacgttgtgaagtctgtgctgcagttggctacatatctgtagtccgctgctcttctctctctttatttgtctatttaaaatatatttatagctggcttatagcccgctattatacatgctcttatcatattaagagtggcttcgcagaagctgcggaaaacaacaaaagcggatctctatgattgcgaaacgtaactatgaccgttcgtgcgggaaagagtgttgtctttgtacagggccccacccccacgggacacgcaccagctgacagtccaatgacggtgagggctatgggccttgggccgcacgcatggcatggcccaattgctggccgcggccggacaacgaagccgtgagccgtggcccattaacaacaagtgggccgaactaagttgttgggccgtagccaagttacagggaagagagacaaacaaaaactaacggaaaacggaacacgtaaaattgcacaccatcagcaacatgatctgacatctcccagatatatgggcatgcatttacctcgaattatccattcacgtcaactatatgtactactattatataatatataatataataatcgcttactattaatatacggtacctacatatatattttctccgtctcaaagtgtagccatgagcattatgcgtgaatttacacgagccagtgatttctttctttccttgttttttaccgtccatcactccatcaggtgaggtaagtagcaaattatcgaaaaagtagtgcacgagtattcgccattagttgatccggcgaatcggtcgacggaaggagaaatcggataaacgtcattttcttccgttttcaattttctttttccttctttttacgagattcttctgtaatatgttgcaagtatcaagcatttctgttttttttttcacttctatttatttctcagattttttttgttatatatagtttttgggatttgctataaaaaaatttctagtttttttatctttttaacggaaattttctatataaaaagttttcgtgaaaacttcctatatatgtagggagattttttatacatatatatatatagactttgtatatgtaaactttatatagaaattacatcatacttacaaagtttagtgcagaaataacaaaatgctaaaggaatgttttttaaatgaataatatccttagaaaatttctataaatagactttttatatagaaagaatatatgtaaactttatgtatatggactttgactacgtacacttcatatgggccgaagaagttgtagggtcgtatccacgtagtagtaaagtatatttgtacaagaaaaagtacaccggaggtccctcaacttgtcatcgagtttcaaaattgtcccctaaccacgatacgagatatccggcgtcccccaacttacgaaaccagtgcaacctaggtcctcggcggttttgagtccggttttgtccgatgtggcagctgactcagcgtgggacccacgtgggccccacgcgtcagcctcttcttcccctcccctcacctctcttcctctctcctcttcacggcgccggcggagggagaagccacgcgcgggcagcaggcgatggagtggcgcgtgggcggacggtgggcggagggcggacagcggagcggcgctcaggcggacacaaggcagaagggaagggcggtggcggcgggagcacgggggagatcgaagaggacgacctcaagcacggcggcaagcatagtggggcgacgacgaggcgaagcggagcggcggcgcggcagtgaggcggcggcgggcagagaaggcaggtggaatggggcgagggcggcggagcaaccaggcggagtgggacgacgggtactggagctcgcagatggccggcggcacaagactgcggcgacaacggtgaacggcgccgcgacggcgag

SEQ ID NO: 68931 - DNA, 7045 bp, Oryza sativa
gcccgcgcgccgctccgcccgccgtccgccgcccaccgctcgcgcgccactccgccgcctgccgcccgagcgccgctccgcccgccgtctgcccgtgcgccactccgccgcccgctgcccgcgcgtggcttctccccccgccggtgccatgaagaggagagaggaagagaggtgaggggagaggaagaagaggctgacgcgtggggcccacgtggggtgccacgctgagtcagctgccacatcagataaaacaagactcaaaaccaccgagggatctagtttgcactggttttataagttgggggacgccgaatatctggtattgtggttgggggatgattttgtaacttgatgacaaagttgagggacctccggtgtactatttcctatttgtacaccaccagcaacatgatctgacatctagctccaaaacatatgtgcattcgtctataattatccattcacataaatagacaagtatttgtacagcgtagaattgcatagtacagagataagcacacgtcggcagtttaaacaagattaattaaggagaaaaaaaagctgaatcagtgtgctacacaatcacccaaagcacacgcctacacgcagcaaaagaacatgaaagcacgagaaattaaaattaaaaacaccgagcggatctcccagcgaaatcgttcgttttgatctcatcagctgatgccgtcgaagttgctgctcatgagcgacaatgtcgcgctcggtagcacccggttcacctgaggttgctctgcgaattgattaaaccaaacacaccattgcgttcagttcgcatcatcaggatctgacaaaactgtagctaaaatcaccaattaattaatttgattagactactcactcttaaccgcctccagctccgacggagtgagcctcgccgagaacccgctcacgacgttcttgtagttgtatatgattgcccccttcgccttctcctcgctgaattcatttccagattccaaatcatttatcagaagttgcattaattcagaattgttaatttggatcggttgattttgatcgatgcagcggcgaggatggtatactattacctgccgagcgcggcggcgaggatggagagctggtaggcggtgcagacgacgccggagggcggggggtcgacgaagacgaggtaattagctgcgccgccttctccggcggcgacagccgcggccatggcgacggcggcggcgaggaggagggagacggtggcggtccaaggtttcatggcgagattggcgaaggatctcagcggtgcctctcctctatcggattgctgtttatgagcagcgaacgagaggtccgtattaagctgcgggatgcattagcattagctcctataatagaatgtgaatgtatagctaatctgcattttggaaaaaatggagcttaattaacaaaatacaatattacacttgtgttcattcagatcaagtaaggatacaaaactacgtatgtatttttacaaactaacaaaaatacagaaccggactcccctgaatctgcaaagtgcaatacctaaaaactccacacgcgcgctgttaaatacacgtaaaacttgaacatagattttcataattaacgagtagaagcaaacacgtagtattaatttctgtgtgtatgaatttcttgaggttttcatcaggtgacagcacatgcaatgtcatcgatcatacgacgacgggcgcaacggcggcgtcggagccgtgcttggtgacgtcgtacatctcgccgtcgccccagagcgcgtaggcctcctcgccgtggacggcgtcgtcgccgacctcgagcttgtcgtcgggcatgcggagcgggacgaggaggttgatggcgaggcagatgagggaggtgacggcgacgttccaggcgacgacgaagaggccaccggcgatctgcttgccgaactgggcgccgccggcgccgccgtagaaggcgccccgggagtcggcgacggggaggaagaggttgcagagggtgggctcggcgaagaggccggtgaggaggccgccgaggaggccggcgacgccgtgggtgtggaagacgccgagggtgtcgtcgacgcgctgcaggatcttggagcgcttgtggaggatcatcatggtgtaccacgggatgctgccggcgagcacccccatcaccagcgccgcccacccctgcaccacccctgcaataccaatccatacaacgtttgattcttcgtcttatttacttttttaatgataaatattcttattgttattagatgataaaacatgaataatactttatatatgtctatttcattaaaaaaattataaattttttaaataaaacagatggtcaaacgttggatacagaaatacaaaaatgaacttaatttagaacggaggcagtaattcagtactaagttgctatgttttgatacgaaaagagtactttctccgttttacaatgtaagtcattctaacattttccacatttatattgatgttatttgttagaatgacttacattgtaaaacagaggtagtatatgttttattgacattcatgtatatattgtatggaaaagaaaaatcataatattatgctctattgaaatctgtattatacgcacgaatctaaaaacaaatataacgataagggggtgtaggtgtgtgtcgtaaataaggacacggatcctttgcaatagcagtgacggtggctgatgtcatcgattgctatggagtactgtagtccatcttcgccgcgtaaatagactttgaacgaagtcaccgacggaatgggaggctgtaaaatattctacttttattttcagtgtgcttttcttggctgcttgcgtacaagaaaaactcagaaaaaacaaattggcagtgtcagacgactttgactttactagtactacgagttagtgataggtattgacataagcacgaacgacaaataagattcctggtttccgacgaaatatgtactacctccgcccaactttaatcattcgttttatttaaaatttttttataattagcaattttgtagttataagatgataaaacataaatattactttactcgtgaattatgtttttaatttttttcaaaaaattttcaaataagacgagttgtcaaagttgaatgcggaaaaccatagctgcacttattttgggacgaagtgattatgtatcaaccaacctagattccgatgaacgttttgtatttgttcacattaggtactgtagtgaccagtgaccggaaattgagtatgaaaaatttacgactcttcgactacaagagagagagagagagagagacatgatgaatcagttgcgtgtgcgtgtttaattagttgccacaaaatggtaaacggcgtaatctacggggaaaatgcagattatttggcaggcaaggtaacgaacctcctgtattgttggcaacgcagacagtttagaattcaaagtcaaaacaacctgggcgtgaaggatcattaatctgcaaaccgggataatctaatctaattaagaatcgatccgagctcgtcacgcgcgccatcacgttatagttcatcgatcccaaagttaattagagtactagacaacaatttgattaatataaggctatgttaggtactcagtttttccaatttcaactcctttgttttgcatacacgtgtcttcccaaactactaaatggtacattttcgtaaaagttttgtatagaaagattgtttttttaaaaaaaataacaataatttacttttaagttattttagctaacacttaagtaataaggtttcgttttctgtgtagtgtgatgaatgacgtacctgcagcgggggtgatgcagacgaggccggtgatcatgccctggacggcgccgacgacggagggcttcttgaagaagatgacgtcgaggcatgtccagacgatgaggctcatggcggtgcagatgttggtgttgaggacggccatggaggcgacggagttggcggcgtacggaccaccgccgttgaaccctgcccaccccatccatagtaaccctgcccccgtcagcgtgaacagtatgttgttcggcgggaacctctccctgtccttctgtgcccttggccccacctgccagccacacattgatatatatgtacacttgtcagagccacttcgacgtcggcggcggcggagtactattgtttagcttattcgtgaacgataagtaattcgtgaataaaacttttatatatatgttcttagcgaacttaaaaaaggctgaaaaataaacttcgatgaaaaagctccaaaatcagctttaaattaatataaggttaaaaattttaatattggcttatgagtataagcataagcgaaaagatgagactggtggtacggacccagtaggcggcggtgaagccggcgatgccggcggagacgtggatgacgtagccgccgcagtagtcgatgacgccccagtggaagaggaagccgccgccccagagggagaaggcgccgacggtgtaggagaaggtgagccagagcgggacgaagatcatccaggcgaggaagctcatgcggccgaggagggagccggcgacgaggatgagggtgatggcggcgaacacgcactggaagtacaccaccgtcgccatcgggtacagcggctccaccgccgccgtctccacgctgccgtcggcgcggtagtggaccgtcgccggcagcgcggcgcggccgacgaggaggccctggtccagcgccggccgcgccttcccccagatcgggaggagcttctccccgaacgacatgttgtacgcccaggtgacccagcagatccacacggcggcgaaggcgtagagcgccatgaacgccgagttcaccgcccacttcttcttcaccacgccgccgtacagcaccaccaagcccggcacgctctgcagccccaccaccgtcgccgccaccagctgccacgcgttgtcgcccttgttcagccagtccgccaccgacgccgacgtgttcccctggtacgccagcggcaccaccgtcgccgacgacgacatcttcgtcgccgattcaacacacactaagcttagtatgctttctttaatttggtatcctagttagtgttagttaggcagcttatatagagatagagagaggatgcatggtccaggtggcgatcgattaaccattttgactcgctagctaggactgtacgtactagcggttaagataaatttaagagaggttaaattcgtttgtttaattagggaaggaatcatcaacgaccagcatgtacaccacaaactcgtttgaagtagccatgagcacatgactttggctgcatgtagtacagatcatcatccacatcaactaattaatatatttttctcatttttacccagcagcagattcctggctacaagcctactacaaccctagctttgtccatcaagattcaataatgattaagaaatgatcaagtatacttgctgttttgactaaagaaatctgtacttgcactaagtttacaaatactgtatattttggtctgttagtagtgtgcagagaagtgcagcttagcatgatcaagcaatctaattggaggttgtgtcgtgctggtcatatacatgaactttctgcataataatctatgctgcgcaaagattcttccggtacatcataagttctagtaaatgtagttttctgtttcaatgatgcaacctacgatgcaatggctattccaatcgggaacatgcagtacaagtgcgatcttcatgttttcttcttctacgtgactactgatgaaaaaaaaactaaaaatatacgctaagttgcaaaatgagtactcaaacctatatcatactagtaatactgatgaaattaataccgaaaaatacattaagttttagcagacgtactactggcatgagcatgacaatgctagcaaggacatgcatctagaaatctatggcatgatatctttgactaaacgctagcaccagtgttattgacctcaccaacaaatctgacagtgcatagagattcttgtagctctgacctcagttaacacaggcccatgtatacatttctactgaacactagtactccgtactacttttcaccaaacatatatattcgatcatgtgtgcaaatactgggattgctacaagtgtgtttcatatataaggcaggtgctaggcgcacgcgtgtattcttatgtgagcacatccaaaaactagaccaatataccttaagattattaaagttaatataaacatattgctattaacgggtacatcacttaattaccaccaaaagaatagttaataaaaaatacgagcaattaaacgtgttgagtctaatatttaaatatggctggttatatcagtgggtaggttccactacagaaaacctagcgagctaagctatgctaagtttgtttcctccatttttaaatattcaatggttgatttttcgacataatgtttaactatttatcttaatataaaatactatgaatttaataaaaagactaattcctaaaatacatcgcaacaaaacaaaataaatggttctctaaataaagaaaatgatcaaatattatgtctaaaagttaacgtcttatatttaaagtggaggcagtattatcgcagaacattttgaccgtccctttccatgtatagtgctacaatgaccacttaagttatactcataagttctcaaaacaaaaaaagtcatattcataatactctcgagcatccctctcctattagttttaggagcttcgtatgcatgacctcacgcatacgacccgaataacatttatttaaattagtattcttaattatagagtactcttgcatttagattattgcgctggtatgcttttttttttaccttgatccatcgatataggcttcgtaactgggcgtacattagaatcttagaaactaggtgattttctgtgctttacagcgggaattactaagcaattctcaatatatattttttttcgacaatcaagttaggagtaaaaagcaaaaatataat

SEQ ID NO: 68932 - DNA, 22984 bp, Oryza sativa
  unsure (1)..(22984): unsure at all n locations
aaaactcaaaatcccttatattatgggacggagggagtaaatcgtagatgatgctgtatgtttgcatgagtttaaatatataattattactagtaggtaatgatgtggcatggttatattttgagctttagatttggtggactataactttatataaagtatatattaaagccctgacttaacaaatgctaagaagtgaaaatagtacattttaatttggagtactatgtatattcatcgaagttacacaataaactagatggactcatttttttcatttaacaacaaaaaaaattgtatcctggtgtagtgatttgttttatattaaacgtaaaaaaaattgtataccttcacatcgttgctataagctatagttctttgaggtggccatgattaccattgaacatttatcggagctaaagaaaataagctcgttctaggattaggtaaaggataatagaatgttattatgattcgtttcgatgtgcatgaaaacacgctgattttactctgtacatgcatgttatacgtggctaggggactgtcaggacgactgagagacagcaaacagaatccaaacatgtgacttcgcttgagtaaggaagtaaggggttaagcttaattactctgcaagttaacgtgcgtaagttgtaaccaattattccgcacgttgcccatggtttcttgttactactatagctagctagctttctttgatgagtgcatatgcctagtttgtctcatcatgtggcaaactcaatcaacgacaggcatgcatgctccattgcttgttcttccagccaggattagaaggacaaggactactacaacaaattaatttagattacttaaccttcaatttatcaccaaagtctgcaagtatgcatttgaattgtatacatacaaaatctcttgtgctcttcaagtaattacatgattcaactatgtgttgttcttttttagttcatatacaatatattgtcatcaattatcacatccacacatcattgcaaattctgacagaaaacacaagtgcaatcaagcaggtccccaacaacgagcggacatcattaagcatagtacaagaagatctgctagataaacactgaaaaatcaggtttgagtacacaccaaatcaaccagtagacttttattttgttttatgtgtaatctgtcctgcttacttgtgttctaatttctatatatatgtatatatcgagggaaacagctgtgtaattgcacatcatcatgccaccagtttgagtacaaataaattagacctgtcatcataatggcatatttacattaattaattagttagtgtaagagacagccataagctaacttttgtggattatgacagtactccctcaattctaaattggtctacatatttcatatatacactaagatcaagaaaagctaataactctctcatactatatttactctaacaacaaactcgatgcatgcaccatccatactattttctagccaatagcaaatcaagatattacatgtgtgttataaatatttatgtgcatgaatgtatgcatcaatatccatttacttcaatacacaaataacgaatagacttaatgaatgaacaaatatgtagatcgatttggaatggaggaagtactttttaatcacaagaatactcccttaaaccgttgggcgcggcaaccaaaaatacacgttgtgcaccaatgtcaaccagagtttcatacgacgtactaggaattaatagcctaaactttttaattcctctttttttcagggcaaagtgatagcgtatgtaaattcaggaaagggatcggacaacgctttgtgacaggaatcagaagtttcagaacaatcaatccgtcctcggatccatccagcaggagaaacaggtactgtatgcctgaacaatcataacttgttaatgtgtcacattctagtaccagttcagttttgtaggatggagagagtatattctgaatgatctgatgactaacctaagaacacaatattaaggaaatctagtagccagtatgaacacccaatgtgtgctgtcatgcgtcatgcggcgcatcatcacttcatcagtcagtattattattattattattattattggttcagagtagtgagctccagaataatggcagctgataggctcatcttcagataactacataattaagcaatgctgtctcaagaaccgttgacatcgcaaaacaataatcaatgaacgatgatgacaatgatgatgctggccttggggggtgatgtgagactcctgaaaagttaagcaatgaactgcatgctactggagtagtagctagccctagctggccgatggtgataaacttgatcttggaatattctgatagggttggtgctctgtaaaatatacttcactagtcggtggacgaggtattagctgactggagtatatgcaaatttgcatgcccttgaagagttgacgtagatttatttcaaaagaaaaaggacgaagaagtagtagtagcttgtaaacttgggaaaacccaaggaaacgtaacgcaacgcccttgttgtttcttcgggactgttcaaattactaccaaaatgaacattttaaaatttggtcatacccaaattttggcaagttggtaacattgctaaattttggtaggatatattaaatatgttattgtcaaattctttaagcagtaccaatatgtgataacaaactaaatgcatccatatatttattatttgttttaagaaatggtatggttcaagttcatgttatttctgagtgttttgagctcagcccacgttctcatgccctagagctcacattgggccagattttgaagcccagccccagcatagccgagcgaagcctatgggccgttttcctgtcagcccagataagtatgaggctcatatactacagcccaaagaagaagcccatgaaaaatctcggtggaaagcccagctacctcgcgaattcgtcgttttcggcggctcgagctcgaagcctcgaacggagtagttgcacgatgaatttttttcgtttttagattttttttaatatttacagaaataatctatcgaccaaaataattgcagaaatagcccctgccgccctaatggtgggcggcaagctgacgtggcagacggtgggtcgaccgcgccgtctgccgccgtcggccaaaattgcgattaggcccttgccgcccatacagagggcggcaaggggctaattgcaattttggctgcccataaagagcttgcggccgtactttttcatctggatcccttgccgccccaatagagggcggcaagggacccagatgaaaaaagtacggccaaaagatttttctatgttatgttaataataaataaagaagtatttattggtaaaacttgttaatattgttataaaaatgtattgaagttggttgttgcgcaatttcatatgttaagtgaggtattattttgtaccttattcgacgtattagtactcggataatttatataggcctatcgcagtctgggacgtagaaacattatatggacttaaacaaggagaattatgtaacatgaagaaatagtagtacaatttgaacatgatacgactatttgcattgcggttacatagatgatattagattcgaactagaagggaggtagtgcaatagttgaacacaacgacgatgtagtaatgggacaaggaagcatgacagtagaaatttcaatatgccaagttgtccgataatagctaacccctacgtgaggatccctctcctctctcaaaccgtgctttagtaaccctgtattgctctggtagttcaagctgcacaacacggctaggtggagttagaacccttctggtgtctatctattctctgtattgacatctccttggtggttcctgggaggaaagaatagatgtaaagcaagcaaagttagtaaatgttgtgagaaaataaggattcatgtaatcaaaatattcttaccatgaaatcgtcgtcaagaatatttggacaaacaaagaaccttcgacccaatgttgtaggatttatggaacgaagaacctgacaacgatcaccacacctgcatcttggacgggcttcccatggagggagtgccgtagttagcacccgccagtcgctctgttgttcacgacattgtcgttcataagccgcttttctctgtaagtattgctcagtactttcggatgcgaaataccagcgaccttcttgtaaacaagtggttagatcgagaatgggattttctgtatcgacccactcgatgtatgcgcaagccgtagtgcgggtctgccgaatagagtagtgttacgaagaataaagcgattgcccatacggaatgaataagcatatgcagataataaaatacctcacggtcatagttagggcacctaaaaaagcgccttcctcgaatatcaggattcctcgaagctattagttggcatcgatcaccgcataggcagcgaggacgctggcaccaaggtggtagtaggtatacacaaggatcgctacgccagtttggatcctcaacaccccggcgtctagccattgacgaaagccggtcggatttgtaatgaagcaagtggggaagagagtactgaatgtgactgagttctgaaagattgtgaggcctcactcgttaaggcgacttatataggcgcaaaaaatcgagtgatacccctgacatgtgaacgtggtggggtatggtgggtacacctgattggcgccgaaagatacatgcatgatcggcgccgaaagttacattggtcgtatgcgccaaatggcgggcaaatactcgtatcacacgcgaataaaggaggctgcatcggtgcggcagaaagtagtcgtgcatgcgccgaaaggtatcgtgcatgcgccgaaaggtatcgtgcatatataacaacaacgtagtcattacacaagcatacagtactggaaagtgaagcaagtaaacaaagagaagactgctctactggccctgccccgcgccgcgaccacgcttggtcctccgggcctgtgctcgcacgtggtcctgggagtaggtgaaacgatccggtggcatagcacgggtagcacgagtgtcccgcggaggagtggcctgcgcctggtcctgcgtctgcaccggcggtgcgcctcccagctgtgaggggccgatgatgtcctctgtcgagcctgaagcgaagtcgaagtcagtgatgtcgaagagcaaggtggaaggcagcaagcggtccgacgaggtcccagcatggtccagtggtggaccctgactcgacgtgccggctgcctgtgacgaagtcccggtgtactgccagaactgcgctgagtgcgaggtcgacacagctgcctgagacgctgaccctgcagcctgggagaagtgggcagcctgcgtcatagcgaactgggcgaaacctacacatcgacaacgggacccttgtaagctaagacataaaatgtatgtaaattgattgtcgaagtaatgttgtttttttaagtacctgtggggggcacaacagaaggcctagccgaggaaggcggggtgttgaacggtgcacgaaaccctgaagcaatcggcaagtgaaacggctcacttatatgtgcgaggcatgtacagaaatagtaataaaaatacttacctccgtgcggagggggagtcggcctaggaacgtgagcagctggatggggactagtcggtacgggtggccgctgtacagctacgtctgcccgagcaatgtcgtctgcacgacaggtgagcactcggagaatcgagcgcatcgactccaccatccgcgtgtacgtcgtcaggtgctcctctacgggtaccggaatccccgcgcctaaacgttggatcgtcgttgaaccgtcaacgacgacccggttgatgtcgtcgacctgcatggttaatttgttcgtaaatatttgtaaaatttgacgaagagaaagacatgaaaacataaaggaatggtgcgatgcagggtactcacagcacgagcgaagtcctggtcgcggtgcctggcatagaggtctctagtgctcgcaacgtggggctgctgctccaagggagcgaaggtgaccctagtacgggtgcgtggctggtaccagcgtaggtaggcctggtacgactcctcagtgtgtggctctccctcgtggtccatgacctcctcggttgcgagcaaccagtcctcaacaaaagtcgccaacttggcgggccagtcgccagctgactgctgacccttgcgcgagtacctgcgaattaatgtgtaatattagtgtgaaacgacagatgttacaaattattgtgaacaggcagattttaatgcaacaacggaaagcgtagtgcaagatcttaccggtgaacagcagctgggacggtggtcggaaacggtactggaaagggctgacggaagccgaactgccgcattacgcggaaaggggcgtgaggctcaacgcagatgtcgaagaccatcggaactgtagtcatccagtacgcctggtccctggtgcagagtgtggacagacccaacggcgcatgagcctgggtagccgcggcactgtagggctcccacacgacgtcagtcggcagaaggcggtcgaactccataacaaactcaggatacgaccgcctaacctggacgtgagcccatcggcgctgcaatacgagacgatcgatgtgatgtacaatgaacttagcaattaacttaacaatacgataagatcgatgcaacgtacctgacgacggcaccacagagtacccatcgtaggatagtcgacctctggtcgctcctcgtacagtgactcctcgtacgcgtgctggtccacctcagggcggccgatcgcaatcctctcagctgcccagatagaaagaaagagagggcacccaccaaaggtcgcgctgggatccgtcttcgtgcaagactcacaaagtgcacggtacagagccgccaacaacgcggaaccccagctccactgaggcacctcgcctaccgcggcgtcggcgatgctcctggcgtagtgcacgagtcccttgtcgaccgcgtgcccgtgaccgccacagaacatcacccagccaaaaagccagagcaagtacgcctccaaacatcggctgtaggagtactcgtcggcctccgcctatagctgctcaacctgcaagccgtcgataaaatgttaggcaccttaactacggactaaatatgtaatacgattgtcatttcggtacaaaaacactctcggtgaactgaagcagccacctcttcgtaggtccggtgttgcggtggtgtgccaacggctcgagcgggaggtgcggtgcgcgctgtactagtgcgaaacgtgccgtcagatcgtcctgccagtccacagccatggtcactggcccaacagcgtctcccgcgagcggtagccctaacaagtacgatacgtcctgtagggtaggggctacctcaccgcacggcaagtgaaaagtgtgcgtctttggcctccatcgatcgaccaaagctgctaggagggacctgtccacagtccatcgtctggctgggtccgcgtcgccggccgcagcctccaccagccgacgcatcggtaggaggccggcctcacgtagcctgcaataacaaattaatatgtcattataaaaaatattacagtgcaactaacttatagtaaaacactgttcgtacctctcgacaaaggagtcatgaaccgtgagtagctcaccgcacgtccgtgcccggaacgtcccaagctgagccccctgcaccgtagtaaggtgagaccggtgtcggtgatctatcgccgggtccaacaactgaggtgtatcctgacgtgccatctctgaaaaatatagtgtttcgtgttagaacaattcaaaaaatagtaatgtaaaacaaaagataacttgcaaaattataaaatagtaataaaatcatgagattaattatgtacaacaagagtacaggctatttaaatatagcaaacgttactaatggtacataacgatgacgtgcaatttaacatatatgtagagttcaataatataacataacattacgtgtcgaagtccgacatacatcagcatacctaagacgttaggcgccttagtccgacgttacatcacgagacctaaagacatgacatgccgaagtctgacattacacgacgaaacataaacacatcgataagttcgaaacgaattacaagcaaatccacatgccgacatagaacataagaactacaccacgtagccagacgtggcacgacgacgcctaggacgtggtcgagtggaggtagtgccttcacccgtagggcgagctccatctgctgctgatcctgatagtcctgcctccgtcgcacttggtttctccttgtctttaggacaatgcttgtaggtgtgcccatgttcatcgcatttgctgcaacgcttcaccatgccagcctccgactcgtccatatcgttgcggatgcgacgagtcctcctccttccagccttgcctcggagcttcgatgggtcaggaatattgagtacttcatcgttagtctctgtgaactccccagctatgccgaacccataaatctcgccgctccatgtatgatatattgcttgcttactgaagtactgtgacacatatactgcatctggtatgccacactccgctgcggcagcaatgacatgggtgcatggcctgtggagcagcttcggctttgcacaagagcaatgacatgtgccgtcggctttgagaacacactcctacttcactctcttgcggtagatacccctgcctgccttatcttgacatagtatctcaaacctgtgctgttgggtaccttgcactagagctcgatgtttcatggcctttttacgcaactcctctagctttttctgcatgaaagctccaaacaaaatgctgttgttcggcatagagggaagaactgcctggaaccgatccctaaaatacctgcatgtcccatgtaaaatgaactccactatgccaactagtggcagtccacggacaccgcgcatcacccagttgtaaacttctgccaaatttgttgtcattattccatatctagcaccacctgtgtcatacgccttggcccatttctcttttggttcatgcagaatccactgagaaaatttccgaatctccaatccagttcttctaaccaatgttggactatccgttgggagaggtccaagagcttgaggagggtcagcaacggcggtcgatggagctgctgcacgctgatcactgcatttggctgtcaactcatctaatctcttccaaagctcattgaattttttctcctggttctgattgcacagcctcttgaacatgttcatgagctccttgttcttgaattgcttgaagaaattagctcccatatgacgcatgcaccacctactctgtacatcttcccaaacaccggggtatcctcgttccatactcccaaactgcaactcttctatcactcgcagaatgccagcgtgcctatcatgtatcaggcacacatttggcctcataccaacaacttttgttttaaccaatttcaggaaccagtaccagctgtcggtattctcactctcaacaaaagcaaatgccaagggcaatacctgattgttcccatctacccctattgctgttagtatctggccccgatactttcctgtcaagaatgtcccatcaatacagagaacaggacgacagttcacgaatgccatcttgcatacatgtagagctaagaacgccctttgcagcacactcttgctaggatattcaattgaggggaatttcttcacttcgtaagagctcccagggtttctttcctcgataacaccaagcaggcgtggcaaattgtcatacgaggcttcgtaagttccaaatctcatctctattattttctgtttggccctccaggccttggcatagctaatagtatacttgtatgtctcttcgatgtgtcggattattgaccttggttcatatgtgagattatcgatgacatgcgcatacatctcagatgcaacaaatgcacaagtaatgttcctgtggtatttctaaacaccaggtagaaaacatgtatgcttggtaacgactgacactgtccaataatccttccatttccccttatacgcgtgcactctctagggacaaccatctttttccttaacacaccgaacttcatattgcgaccggttcgacttggcaacccaaaactctctatgaagtgacactgcaaaatgttttaccgcctccttcatatcttctgctctactataaatcgctccctgaataacctcattttctttgtactcccatctcacactatcctcttcagagacgatcagcccagaaaaatcctcactagcccattctgctggattaatatccgtctcatcatctaacgaatcaccttcctctacacgctcgttgtcagaattctccctctctatttcatccacaatggcaccgacagtctccccctcgtcggccactccacctggttgaataccaactggagctactacgcccccgtcctctcgtgcgttgacctcctccacagaagtctcgtttacttcagcacttggtccctcgccatcatccatgttcatctgcacacctggatccttcgggtgaacaaacggaaccaaagctagaggccacccgcgttgcaatgcattttccaaataccatctccacactcgagagttttgaactggcattagttcccaataaaaaccctcagttgcccgacttactataacattgattgttatgtcacttgtctgtggatcaactctcaagcccttcattaaccatccttttatagaaggtacactcctctcagccggtctatcaattcccctttctgatacaataaaatctgacagatctaccccagttggcccgtaacggacgtttcctggtccatggtaaacttggaatatttgtttgttcgacatatctgtcaacgaaataactagatcatattactctttcatgcaataaacatctacaacgtaatatcttcttgtgtaagccaatgcaacggtaatgtattgattccaaactagcatatctacgtagttactaatatctacaatacgcacttctagattagtacaactaaaaccctaaaaatataatgcattttttcaaacaaatttttaaagaatacacactatttaactcaatagtcacatataggatctatgaatattacctgaaattggcgtctgaatccggcagggcttcgccccttcttctcttctcctcccctctcttcttttttttttcactggaattgaggagagaagaatgagggctgggggctgggcagcaggccttttataggcagcgaggcctgccgcccggccaaagggcggcaaggggccgcctgcaaaatagccggccccgactggctttttttgcattcgggccccttgccgccccaccagagggcggcaagggttttcctgcaaaaaaccctccctccgtcaccgcccgttcctcccccgtttgccacgtcagcttgccgccccagagatggggcggcagggtctatttttgtaattttttttggccgatagattatttctgtaaatatttttaaaaaaaatctaaaaccgaaaaaaatccattgcacgatgatgagtcgatgagatgacaaattcacaaatgctccactcaaggaagagcgccaccgttcacaaacctatctttctgctttcctaacctgacatgtattattgtgtagtactccctccgtcacataatataagagattttgagtttttgtttgcattgtttgaccactcgttttatttaaaaaatttgtgcaaatataaaaaacgaaaagttgtgcttaaaatactttagataataaagtaagtcaaaaaaataaataataattctaatattttttaaataagatgagtgaacaaatagtgtaagtaaaaactcaaaatcccttgtattatggaatggagtaatacgtactactttcgtgttgtctgacttgttgtctgcctgtaatttactatttacccagggtcaacaatcagtttgacattttgtaaattgtgatccctcttgcgttgatcttccgttgtcacagattttaattttcatacaagtactaatacatgtatttcagccgtcaaaaccttccagatatcgcacaactcgctagcaatacagaagtagtaatactgtaacttccaagaaggattaaggaataatcttctctgaaaggtcaaatatcaaattctgtcccaaaattcagtagcacaaaagacagtcgtacaagaaagggagaaggaaaagaaacattcgtaattaattctgaattttaatctcactgcttatgttaattactaaaccgagtgacacactgacacctgaagaagatgaatcattaacgaccatggagagaaccacaacgaaaacagcaaacgataatgtggtctgaggatgatgagccgcccatgttgaccaacctactccactaggctgaccaccactgcaaccatcagctcatcaggagcacgagcacgaggactcatcaaggccgtccatggtccattggacgcctgtgattgcttcctgagggagactgtcattcgtgaacgtccacataccgtgttgcaacagcaaagtcgatgtccatcctgactcggtctatttatgctcataaaccatggtctcttgtttttctctctttctttcgatgcttcgacgaacttgactatttgcttcttttacttcttaatttaaaaaaaaagattatttgcttcttttcttaccaggaacagaaacaattgattagtacaaaatggtacttcctccgtttcacaatataagactttctagcattgttcacattcatatagatgttaatgaatctaaacacatataaatatttagaatcatttatatctttatgaatgtaaacaatgctaaaaaaaattttacattgtgaaacggaaggttgtacaaaacaaaatacatcttaaaaaaaatcacttggggttacatctgagaaaaaaaaatcttaaggattaacaaaccagctatgctctcattggatgtactagtatcatgtatgatatggaagcattttatgtaaactaattgagcacttgaggtgttgaagtggcgttaattagtccaataagcagacgatttgaccctaatagagtcattacaaggagcagcccggtcggtcagtgtgtgtcactgtctctcaccctcccaacgcttagacatttcaacgttctcctccacagcaacagcagcagcagcagcatctcctcttcttcaccgcatctgccagcctagcgagcctaatcaggtcttcgtcttcttcttcctcatccccgtgccaataccgatttcgcgagctccgatggattccgcgagagaggagacgtcgccatgagaggggaagccgagctgtgcgtgtagctcgctgcaatcgctgcgccggtcaagaaaccagccggaatcggcggctgattccggtggaggaagatgcggcggaaggcggccggagatgctgctctggtaggcggctgcttcttgctgctcctccaccctctcctctcccatggcgcggacatgccgttgggctcctccctctcgccggcgaaccaggcgttgtggtcgtctcccaacaacaccttctccctctccttcacggcgtccccgacctcgccgtccctcttcgtcgccgccatcacctacgccggcggggtgcccgtgtggacggccggcaacggcgcgaccgttgactccggtggcgcgctccgcctctcgtccagcggcgacctccagctcgtcaacggctccggcgccgtggtctggtcatcgaacaccggcgggcagggggtcaccaccgccgcgctgcaggagagcggcaacctcctgctcaggaactcgtcggcgacgttgtggcaatcgttcgaacaccccacggacacggtggtgatggggcagaacttcacctccggcatgaacctcacctcggcgagctaccaattctccctcgaccggaacaccggcaacctcaccctcaagtggaccggcggcggcacggtcacctacttcaacaaggggtacaacaccaccttcacggcgaacaagacgctgagctcgccgacgctggcgatgcaaaccaacggtatcgtctccctcaccgacggctcgctcacctctcccgtcgtcgtcgcgtacagcagcaactacggcgagagcggcgacatgctgaggttcgtgcgcctagacacggacggcaacttccgcgcctacagcgcggcgcgcggcagcaacgcgccgacggagcagtggtcggcggtggcggaccagtgccaggtgttcggctactgcggcaacatgggcgtgtgcggctacaacggcacgtcgccggtgtgccggtgcccgtcggagaacttccagctgagcaacccggccgacccgcgcggcggctgccggcgcaagatcgagctccagaactgcccgggcaactccaccatgctccagctcgacaacacgcagttcctgacctacccgccggagatcacgacggagcagttcttcgtcggcatcaccgcctgccgcctcaactgcctctccggcagctcgtgcgtcgcctccacggcgctctccgacggctcgggcctctgcttcctcaaggtgtccaacttcgtcagcgggtaccagtccgcggcgctgcccagcacgtcgttcgtcaaggtctgcttcccggggatccccaacccgcccctcggcggcggcgggtcgccgtcgggcagggcgtcgggcgtccgcgggtgggtggtcgcggtggtggtgctcggcgcggtgtccgggctggtgctgtgcgagtgggcgctgtggtgggtgttctgccggcacagccccaagtacggcgcggcgtcggcgcagtacgcgctgctggagtacgcgtccggcgcgccggtgcagttctcgtaccgggagctgcagcgatcgaccaaggggttcaaggagaagctgggcgccggcgggttcggcgccgtgtaccgcggcgtgctggcgaaccggacggtggtggcggtgaagcagctggaggggatcgagcagggggagaagcagttcaggatggaggtggccaccatcagcagcacgcaccacctcaacctcgtccgcctcatcggcttctgctccgaggggcgccaccgcctgctcgtctacgagttcatgaagaacggctccctcgacgccttcctcttcgccgacgcgccgggcggcaggatgccgtggccgacgcggttcgccgtcgccgtcggcaccgcccgcggcatcacctacctccacgaggagtgccgcgactgcatcgtccactgcgacatcaagcccgagaacatcctcctcgacgagcaccacaacgccaaggtctccgacttcggcctcgccaagctcgtcaaccccaaggatcaccgccaccggacgctcaccagcgtgcgcgggacgaggggctacctcgcgccggagtggctcgccaacctccccatcacggccaagtccgacgtctacagctacggcatggtgctgctcgagctcgtcagcggccaccgcaacttcgacgtgtcggaggagaccggccggaagaagtactccgtgtgggcgtacgaggagtacgagaaggggaacatcgccgccattgtcgacaagaagctccccggggaggacatcgacatggtccaggtggagcgcgcgctgcaggtgagcttctggtgcatccaggagcagccggcgcagcggccgtcgatggggaaggtggtgcagatgctggaagggatcatggatctcgagaggccgccgccgcccaagtcgtcggacagcttcttgagcctgacgtcggcgaccaccgccaccggtgtcagcggcagcggcagcaccagcatggtctccacgtttacttcctcggcggcgccgccggcgcccacgccgtcgccgaacgtcgacgaggtccagcaggagatggccgtgggacgctcggcgtcggccaggatccgcgaccgggcgtctcgttcgctgctggggcaggagccatacatgacaatgtaaaacttcatcttctcatgaggtgaatagcaaaatgattttgctttttttttttgctccagtaaatgggaaaattgctctggttagtgagcaattagggagttgatctggttgattttgttttggtggaacatagaagcagctgtcggtggaagagaagtgcttttcactgatggtgagcaatttcgtacttctacttgagaggatatctatgtgcctgatgagctgaattctgcaatttgtaagtacagattagatcaaactcaatggtatattcgcgttgtaacttgtacaaataattcaaatgaggcgatgcattgataaatggagtgcaaacatagatgcaatagcttgtctgattgtagattatggttttggggaagctaaagcaaaggcagagataagcagatcaataaaaattcagctacttcagtttgttcagtactgagaagcagcttgcctcacactcacatgcatactactggtaagagattgttttggcatttggggcaaggcatgagcaatctggcagattgatagtacacaaaaacatgtgcaggaactttcaacaaacttctctatcaacctttattccattaaattaaatgcatgggacccatgacaaccctttccaaagatcaaattgcctgcatcatgtgtcatcactggcaattgcatctccatgtccatggagagcttgcaattgcgtagtagctgaggaaacatgtgattaaggcttatactgggtcttatttaatgctagatttatgagcacacagctgttcttgagtcttggccccttgttcagctattcattcagaagcagtcactgaagaatgttgttgagcttagactcactgatttataagcttcctgtttagcaagcagactcatcggtgttacattcagaaaataccggcacattccaacttgaacctagatttattggccaattgctttagttaagaaaatgaagtaaaatggttccatagtgtagtggttagcactccagactttgaatctggcgacctgggttcgaatcccggtgggacctttttttttagttttactaatctttttgcatcactgcatttaacatcatcactgtctaaacaacttcttgacgcaaactgcatatcctttccttttcttaggtgcatttatgcgaagttactgatgattatgatgttggagccataagtttccaaaacaataacaaccttaccgacagaattcctcctaccctcaaactgttgaagtcattttcttgatcaaaacgaactaagtgtcatgtccttttattgttggaccacttatcgtccttatcttagcttctcgtagtttaacatgtgacaccgaagaaacattcagccatgataagagcagtccgaactaagatattcgccagtctcacccaccaccaattgaactgtcatatacggtctttctccaggtctcctgcctcccggtcagccaatgcccaagaacaattagtgtaaccacacaagtaatcatcctcagcttttccaatgtttgtgagcttggacaggatgaacaaaaggcggggttcaaatgtcaatgaataactttgaacatgccctgngtttaaaataattccattcttaccagttctgcacttcaattcggttgcaacaacaaagttggcagttctagaaagtcattcagaaagacccaagcacttcaaattttcttttgaagaaaaaggacagataacgaagaaaagctgtggaatactttacagagcggggagttttgcgtggaaaacttacagtgttgtaatccagtattgtaggcaagaaacttgcccacctttatctgtacatgattatcagatccttcttcattgaagtcagatgataaatttgaaggaccgtattagtgaagtcctcctagttagtactcaatccaattagcatccagatccttcagcttcaggagccatttctgtttgtccggagaaacgcttggtttgtttggcttgcttgcgtgtttatttgttatggcatatgaggatccagccttactctcatcatcagagttggctcgccttctaggtcgtctgagttcaagagaaagaaggcgagaaacctcgtgtactccaccccatttttccaacgcccgagcaatgtcataacgtcctatcattaacaacaaagtacgagcattattcataaagaaagattgtgagttcttgacaaaagagagaactggtaaaactagcatgataggaacccaggcaataaggttgttacaaacatcagtctgacataaaggaatggcatccatgaatgctatgttgctatgtagtcaactcctcaattcaccgctctaaaaaaactactgaattcaccaatcttaacatgtatatatatctggcctgacgatcgagaattgacggaagtgttaaaaatgggaacatggtgaactttgggtgctattaaagtgaaccggtaactttcggtgctataaaaccaaaaacgtgaactttcgatgctatataaccaaatttgccaaaattttaatatgattagaggaaactgaacatattttcatgccccagagaaaaaaaagggtccaaggtttccaggtaccttaagcaagcatgggaaaaattttgttcaaaacacctcagtcaaacatggcttcaataattttgaccagaaaaaagtcagaatgactttgtataactctataaggtttatcaactgccagataaactacactaagaaaatatagataataaattgaccatagcaaatatttagacaaaaataatcaaatacctgctctctcaaaggactttctacttggcatataagcagggtccatcccccaattcttctggaatcgcctgatctgtatataatggttactgttaataacatgtcaagaatgaaaggagtgctcattatcactcctcatgctggaaatctcagctcacaatttttagcattctgaactactaaagccctgtagaacacagtgggaggaggggtatatacttttcattacctcttcttgcaagttctccagattatcccaataacctcttggtttccggtttttataagaaagtgaaagattcattatgctggcaatcttcctgaacccacccatgcgtgttattgccttctcgatatccacccttccatgcaaacgaaggtgttttctcttaggcatgaagccatcctgaccatattttgcaataaatttctcaagttcagatttgaggacctcaatgtccttttgaaggcctgggacttttggtctctgcttcacaggactcgaagaacatgacgtggatgcttgttctgattgcctaccttctgcataatcaatagcaatagtatctgcatttgatgctacaatagagctacttgtggagttaccgctctcagcttctgccttttcaatataatcacggattgcacataagtttgatggaagatcttcatatatgacctgaggtacgtaatcaaaatgtttgttttcttttagcaaaaaaaaatcattaacatgtttatcaaagcaccatgaccatgcataaatcagcttttgataagaagaaagagtggcaaaaaatcataaagctgcattcattcccctacataccccccctccccccccccccaaatagcatcaagtcataagattagatatccttaaagaatgtgacggtacaactaagtttaataaagcgcaatgtctgcgtcatgaggatatcttataaaaagctgtttaaacaagtttttggtactgacgagagggggaaaaaatccatgtgaggttatccagagataataaaatatggaactattattcttgcactaaccaaatgaagcaacgcaggataatacagatagaggatgtgtgcttatacctattcagaatttagagattcattcatttttcaggaaggtgtttatttttactgaatttctggtgaacataaagactaaaagttttcgcatgagcacaatagcacgatgttatgctcaactagatgatacatccatcagaaagttgctttgaaaacttaatcaccaagcatcaaaaccaactattatgaacatatacccctggattaaatagtattagtacaattggtcctcagtgaaccacaattgaaattcaggggcacaacaaagcgtattttaattaccatttttccacttcataacattaacgtgttctctatatttattgataaactacatgcatataaatttcttatacctcttcaaggatagactctgagagaaaggtatctttatgcatcttagtctcaaccatatacttcaataaggtgtgctgatcaccaagttgttctaggcgccattttcctttaaatgagtagaaatcaccttcaacttgctcaaagcttatctcacgttcaagtttctcgcgaagatccataacaacacgggcatgaagcaccatataaagtagacccttgcaaccctcctataaaagatatgagatgttgcagttcttgcaaagctcatgaaacaaccaaattgaattaaattcttccagaaaaagtatcttttgggaggagaaggtgatctttcttcccatttttaggacaaaagctaaattccatttgtttagtattctggagtgataggtgcataaaagcatgaagttgcaagacttggtaaaaatgatagatcacttggtagcttggactaaaagtgaaaacctaagctagctatcaaccagaaagtgaaattgaggattgacgctttctatagaaaaggagcaatcccacctctagacttaagatgctaattcagtaacgtatgagataagtatttagcaaagctcccacctgcagtatgcgaaccttgttattatcccgacgaataatcctactgatagccagattcggcacaaatctgacagataactttgttagctcatacttgtataacaagatatctgaactgtaaaaactgaaggaagatagaactactaactcaggcaacttctcatatgcagtgagaatattccatacttctcgcactggcgctttcacagtgatactagcaaacacaaacctgtgagccccttcatgttccttcaatcaaatcatttcacgaggggaagacaaatctgtcagtgtgcttcccatcaaaatataagaacccaatgataattcttagatgcatacaaatttagtaagttaccaggagaccatcaaatcttcgaagatggatctcatctaccacacacggcctatcaagtctgcagacatttccatatactccccatttgctgttcaactcagaaggaggtgaagcaagcacaccaccaagaccagaaggaggtgtttctttgaacttactaggagcaatggcatcattctcagtggttgcattacggaagttatgaaacctggagcctgcaccactaaattttgcagttccatgtctttggtttcctaaatatatgttttcagctctacaggccaacgctccaagattcacaggaagatccgaccttatgatcctctcaagaaatattgctgggaaattaaatcttggaatcacattaacttcatacaacaaaattgcactagatgacctgtcataaaacgaaacaaaatgtcatatgagacctctaaactggcattacttttttgctagctaaaacatgaagatgtttaaggatccacgaattctagatcagagcatcatgtggctgccaaaaatgtaagtaactggtaactcagtaagcaaacagtctggacgatcatcaaaggcatatgcaataaacaagacaagacgatgaccatgaaatccccaccttggaccagatctgatggaccatttcccttcgaacttcttaaagtcaccatcaaccatggagaagtggagctctcgtccattaacctggatgttgactgtttaataaggaagaatagcttgatataataactaggaaattaggagaatcattcaatagtcaacacctctttaaattcgctatctaaaatttatacaactaaacgccaaatatggtgtaacatcaagatagtttcaccacaagaatcaacgcattcagaaaggttaacagtagaagatgacggctaggttcgttcatgccatgggttgtcaggaacaaatctacaaatattctcatgcattcagctcaaatgttcacctaacctaaccatctatatgtttcaattgcatcttaattacctcgtgaaaaacgaaaatcacgactaatttagttgcaacataacaaaaacgaggttagggtgatcacttcacgtacagcatccggaacctccttgagatccaacacgacgcgtgcctcgatatgccagtaaagcgcttgctgcagccccctctgctcgagccatactcggccctgatgcgggcatggaatcctcccactgcgttgccgaacgacgcacaaatttcccccaattagaccctcaatgagcatgcgagaatttgcaatgacacacgagaaggagagatggaatgtggacctgtgaacgaggttggggatgaattcggcgagccgctcgtagtcggtgatgacgcgccacacggtgtcgacgtcggcggccaccgccacggacgcgaacacccgccgctcgcgccacgacaccacgtccacgtcgcactgcacgccggggcccgcggcgctcttcccgccgcgcccgcctccgccgccgtggtactcagcgccccagtggtcgccggtggcggcggcggccgcggccgtggtgaccgcacggccagaatggtgccgccagagcgccgccccgcaaggaggcgcgccgcggtggctagggttcgcgcaggggttcggaattcgcggcaggaatgc

SEQ ID NO: 68933 - DNA, 4400 bp, Oryza sativa
  unsure (1)..(4400): unsure at all n locations
tgcagtcactgacatggggggacacgaacgtgggtcccacttgtcagtggcgtggttctggacgacggagacgtcgggattgtttctgccgcgatggggatagccgaggtgagatgtgtggcgggaaggggaaggggcgcagccatggcgcgtggtacaatgaatctggtgtgggcccggttgtcagcgtggggttgtggtgaccgggctctgggccgacgtggcccgtcctgcgcctcccatgagaaaaatcgggttgggcagtgggccaaatctcgttccaccatctgtttgagcttattttcaacttgtaaaaaaaattgcagagttcggagtttgcacagtgtaatttgagggtctgtttggcacagctccagctccaactccacccctcctagagttagagctcagccaaacagtttcagctctatcaaaactgggagtggagttgggtagagctctctcacaaaatatactagagttgtgaagctgggtttaggcagctccacaactccactccagactcaactcctggagttatatttaggagttaaagctgtaccaaacagaccttgaatctttatttttaattaaaatataaataagatagatagtccaaaatgacagtctacacctagatgcatcacatttcacatgagatttatcacatgtgaagaaaaggggaaattatgtttttttggaaagtccctcctatatccaaagttccacattaccggtgatatatgatcattgtattgccattatgtacttcagatgatgaacatgttgattttgtttatcttccttgcgagttgacatcaagtgattttgcaactgacatttgccgatgaccacgaatgcctagaagctactaggctttatttgaggcaaattccgacctttgaagtataaactttgtccttttggagaaagctctgtgagtgccgattttttacacacgcatcagtgtcaccatcgctatccaagtaggttgttccaacataacccaacgagaagtggtctgaaacgaccgtggtgtacttggttagaccaaatgctagatttttcttgtaaaatcccgatttggagaaaaaaaacagatagtatattgttctaacaaatttataattaaatcaagtttcaatattcaataatttctcaaatgcttatttcaaaataaaaatgtcatacatataaatttgttctaaaaaaatacaatcattatctagactttataaacttatgctaacataaagttgattatttgaaattttaactgaatattatctaaacttcaaatatgactggaatgagtagatcagtgcagtattttaggcctacatcaacatgctgggtcggtaccagagtactggacgaggcccaagcccatgtgtccgtacgtgacagctggaattcaaaacccgcgagcccaaaacggcctcgtctcaccttctctctcgcacccgcaaaagctcaaacccctacactcgcacaccgcaccagcgatgtcggcggcggcgaaggcgaaggcgagcggcggcgggaggcggggaggagccaaggacccaaccgacgcgctccgctccgacaagaagcgccgcgacatggacgactccgacgacgccgagctcgacaggtgcctagctagcagcgccccccccccccctcgcctccccttccccctcctccccggggtccccgcgctatgttcggatcgaactcgaagcgagggtttcctggttgctctcccgcttgccgcgattttgtcttaattttgcgccggatttttgtgcgattaaccgattttctgcgtatgcatttcgtgattcgtgacgtgcttcggtggggatcgggggaggcagtgacatgaaggagatcgtgttgctgctgcgccagatcaaggacaaggctcacaaggatggccagaagaagaccgagcaaaccctctccaggtgattccgagtcccaccctttttacggcggctttattaccatgccaattggtattgtagattacacgcgtgaaattgtttctaagttttctattagtgctaattgagagataatttaacgtgcttactgttagatatcaacagatggtgctcactagtcactatgcaccacacttgcttaatttctgcagaattgtgctcaagtctctatacaccaatgatctgttatgagttccgttgtgttgaccagcagtagttggtccacgtcactttaatttctgtggaattgtgaacagatcaccgtttaggtctcctatcttttatgaaccaatgatatagtaggatgtaccagtgtgccaactgcttattgttcaacttatctcctgaatccgatttttttttactgtataagtctgtgtgagccttggagctcctgtaggctatactcaatgtagcagatgtgaggcgtagagtgcgttaattgaatcgctcccaaagcatggaaaatgagttgagactagtgatgtggaagaatagcttcatctaacatggttttcatatccacatgacaaaattaatatggtgtctcaatgtggtctgtttctgaagttatctaccacgtgcataatattagattacatgactaactgttctgctcaattttcagtgttgctacagaaattcagactatcgtacaggatgccaagggcaagtttgagaaggaaaggtaaaggaccaattcattttacttgcctgtgaacttctacttgtatgaatgcagttcttttttgttgtacatctgtggtgagatttaaagtggtttttgattcattcctataacatgattatcatatgaagctttcttggaaatgattacggtgcatcattcaaatatactatgaattctgacaactgttttttatttgcattagcaggcaaaattatctgaaagttctatcaaagacttcaaaagaggttaccgacctgtatccaatgcagtgatgctcatctggtaacaatcccctcatagtttgtgctaatgtcagcttcatttgtatttgatgtagtgtgaaggtttactgaagaacgagtacaccaagtttcaagcaacacatgataaattctgcaaagaaaaagctgcacacatgcaaactctcaaaggtatgtcaaatgagctacctgcaaacacatttacttagaagtgagttttgctgtttgtttcctgtgctattaggtgaattatataggtgaactttgtgcaaggaaaaactgtcatattttatcttgagatttggtaccaggattattgtactagttaaccttgacctttgttttcttttgtacaaaaatggagcgatatcattaaataatactcataatgagcaatgtgcatgcaccttggcagtttcctgacttcattagttcctgccacatagatatcatcagttgtcacctgttatcaacctatttacacatgcatatactgtgttctgcagaccttttctcaaagttcgaagatgcaaaggagaaattacttatccagtatgaactgcaaagtaaggatatatcattttctatctcattgtaaatgttctttattcttaaccagtgtctcttaaacagttaccatgtgtgaaagacatttgttctgatcttgtctaacagggaagaaggagaaggctactctgtctgaactcgagaaaacattttcagagaagataactaatgcagaagaatctctgaagaagatgaagcaggttccgtcatttaatggcttacatgatctactataatttcttgtttctgttgatacttgataccatgtctcatagtccaagttagaattgatgtgtcctgattttcttactcgcaagtacttctctttgtgtgtttgcaggatgacaaatccattgtcaaccttcgcaagtccattggctcattcctggacccggatgatgagtttggagcagacgatgactgaaactgctgttgccaaaatggtccttttagaacgccgtggatagtatttgagaatatcgatagtatatatatgaacagaagttacaaagttctgtagagatttggtagcatcatacagttaggtaccacatcatccgttattttgttttaagttcattgggttaggcggttccatcatctgttttaaatgcatcttggtcgattcaacagcaagaggctcaagattgtttaacctctttggcctgattttccttcttatataggagtaagtcataaccagtagctcgctaaacttacttgtcaatatatttgtatatttgcaacaaattattcatatacagtatcagatttgtatatcaacagcatagaattgcaatgaatcttccttctaatttacaaatctgnnnnnnnnnnnnnnnnnnnnnnnnnnnnnnnnnnnnnnnnnnnnnnnnnnnnnnnnnnnnnnnn

SEQ ID NO: 68934 - DNA, 3149 bp, Oryza sativa
attcctgcagcccactgttggacgtgactcaataagccaatgcgtgtcaacctgcgaaaattattttggacacgtgccctggtagcactggtgctatctccagggtatggcttgctattagcatatttgctcaggtttatcaccagaatagtccacagacaaaaccaaaccataaacaagccaagcttcagttgatttctcaaaagaaactggtttttttgggaatgtcataatgacaaataatattcaagggcagaaggaatgctgcattcaggaagtatggatttctccagaaaaggagttcattgattctctccaaactgtttggattgtaaaatgacctagttgtgccagagaaaagaatagaagaagcatctaactctttcatgctacatgtcccttaacccaagtacaagataactcatcatacatgatgtggaactatacactattgtgtcaattactaacacaaactaatcttaagcttgaattaacttcatcagacaacaaaggggcatattctaataaaagcgtacctttgcgagccaatattgtttcccacaaacgagttgccttagacaccaaatgggaattctgtccagatgaacttgagatacgttcatcccaaagttccccttccagtttggatttgtttcgcatgtcttgcagcttctctaactcctgctgtaggtaggcctgaaaattccagatgaagtgataataagaacaggatgcaacacaactatctgaatgaacatcacagaagtttctgtgacctcttcagcacaaagacttcggaattcagctgtcatttcatgggctaaatttgaccaggttgtttgcctttgaacagcaatatttgcattttttagaaatttacgcctctcaagagctatccttgcctgtttggaatagcacaaggagaacataatttacagtttaaaaatctcaaataactaaatctggattgctatacaaatgtataaggagaaatatgctcgtgtatcatgggaagtttctgctacaaggaggaacaacagacacattttgttccccactaatagaaatggtgctcctcatattcagacaagttatcctaccaactatggacataagaaatatttgattgcctaccacagtatattacaatcatcacacactattaggctgcctcttactcaaatccatatttgtcttatgtattcatggtctctgtatgaacattatgttttatagcatacaaacatcaaccataatcaaccttccttatagacaagtaaacaagtcatcaagaacacccatttcaaaaaaaaaaaaatcaagagcaactaagaattggacttgatatggggcctactggatcaccattctcaagaaatgaagcaatagaatcttgcttcagctattgcacacatatcaataaactgagactaaggtgttattttgttttcataatgtaacacctaacaaaataacacctcagtctcagttatgttctctacaaataatctatgctaggtgtcaaatgtcttgagcattgcaggagtatacaagtatgctcacagggataaaaagcctcaaaccaagtatatcctctatgaaattatgttctctacgaataacctattttaagactgatgaacatctgcggcagggtcatcttaagacagactaaacaaccaaccagttttcagaaaattgaagagtcagccatccttgccttagtcacagggagtaatgcagcggcatgtagataagagacgtctgtgagtgctgcaggcagcgggcttgatgcaacatcagcagcaaatgttctcctgtggacttctctcaaggcatgcacagagagttgccacaatagctcaacaaatctgcaccgatatagggtagcattacatcgacgatgatgaaaatgttccaatttatatgatatactggagcagaaaaaaaaactattgaatagaactgcagtcacttttcgggtacattgcagattattacagagatctggacttagaatgtggaatcacaaaacagaatctaataaagagacaaagagaatgctacgaatgtggaatcacaaaacagaatctaataaagagacaaagagaatgctaccatatagtattaggttgtgctcttccccatgggttcccaacccacctccctcattttccgcgtgcatgcgtttcaaaccgctaaatggtgcacgttttgtaaaaagtttatataggaaagttgctttaaaaaattatattaatccattttcatttttttatagctaattcttaattaatcacatgttaatctatcgctccgttttctgtgtggaggggaggggttcccaacccctccaaaagaacacagccttcggccattagctatcattttttctgataaaacacccaattttccaaggttaaatcaagattattattttttgaagccacatcagcttcactaatgttaactaactactattgaatttcatgtgttgattgcgaaaatgcattacacatcaaatatgatctctgcccttgtttggtgaaacaaagaaacactaaggatataacaacctgaaacacttgatattaggaatggcaatggcaccccctacccaggtacaagacatagaattcccgtactagggggtgagggcaaggaaaatctattcctacaggagcaaaaaatgggtggacacaatccccaacagtcctatgctatgtggtttcctatctcaaatgtctcatttgactttactgctacactctacatgctccattctgacccacctaaaatgttcccacccagcaattctagcataaccctagatcaatacctcatgccaccaggaccaaccatcgattcaagcaactgcaggagtgacgccacatttatcttcttgtgacaatggtatgccccttctccattactcgaattcagggggtgagggcgggaaattttcttcctacagtggcagtaaataggcgctatgtgttgtcctacctcctatgtgtcatttcaatttaatgctctccatggtccgaaacaacccatttcaaatgtagaatatcctaggtcaataccccaaaccaccaggactgatcaaccgactcaaggcgttgcagcacagataacacactaagctt

SEQ ID NO: 68935 - DNA, 15224 bp, Oryza sativa
tagtactaaaaggtggttcaacccaagaaaatgcagctgtgtgcttggtactaacctcggcccacagcaggtggcgagtgaagataccctggagttgctccgtggcagagctccctgctgctccagctcgctgatgattccttgcacgatctaaacaaccaacagatgtcaaggtcaaagcatcaatatgcttctgcacgtagtaaattatccgagaagcaaactagatctgcaaaatcttaccttcctaaactctctggattgtgcggagtcgaagatcggccacaccttatcaaagtcctgagagtccaacgaaataaatcaaatacgatttacagaaaacctagaaacaaaatcaaaaaagaagaagaagagggcatcagtgcacgtgccttggcggactgcgcgggcccgcggagcgaagagaggaggaagtagaggagctgttcaccgaggcggggattggagtggcggaagaggccgacgcgagggccggcggcgggggacgagggggaaccgaggacggcgagatcgaggccgaggaggaggcagttggtgtacatggcgctctccagctccgcttcccgctccttctcccgatccgtcgccatggccgcgcactcccgccgctgctagtctcgcgcgggggtggatgcgctgcggctaggtttagggggcggctggcgtaatcggagtcggagatctcagtgaggccgaggtggtgggatgggagagaaacaaaactccaaaaagcattgcgagccgagaggagcgggtccagtcgcgaatatcagatctatgcgagggggacgcgataactttggatagctccgcctccgcgcgggggcgggcacgacgcgagacggcaacgggagcccgtgaaggcgaaagcgcgctgtgtgcccggcgcgcggcggccgtcgcgggcggcagcggtgaacctagcggcctggaatgggggtatgaccggctgcgcggaggtgggagaaagctgcggatgggttgggttgggtgcgcagagggaaggaggggagggaggggaaaggagtccaaattttattacaagtataatatgtgcgtatttcgaaacgacctttttgagcggcatggcggcagatcaaaaattcgtcccgttcccaaagggaatttcatataagagtaaatttcctacgtaccctaaaaactcactcaatccctttcatacctctgaaatttacccgatctcttctatacccctgaaatttcaatttgatcccttccatgcccctaccgttacattttccatcatttcactgttacatttggttgcaaatgtcctttttgcccttgatgctttgggttcaaatataagcttaaaaaataattaaaaattttgtttgagtgtacagtatgtgcattttataaatataaagagactaaataattagtgcaaaaaattttgacataaattttgaaaataaaataaatgtaataaattaaaatttttatttgaaattttaatagtacaatggattttttttatcgggagcattcattaaaagaatgttgtgaacattggtagttctatttttatatgaatgctcctcatttttatgacttttttttaaaaaaataaatatgtatttttatttcattatctaacaatattttttgggataaataatgcatcgaataacaaactcataactataatagtctcatgcgagaagcttttatatttttaataatgtaactcatgaatttctttgttcatccaagggtaaaatggtcatttttatggaaaatagacggtcaactaacggtcaactgacgggaggggtatggaagggatcaaaatcaaattttaggggtatacaaggaagtaagcaaaatttaggggtatagaagcgattaggtaaaatttgagggtatacaagggattttctcttcatataaatatgtcgatatttttaaataggtccacccagatttatagcacatgattcttatttttaagaagtcattttaagatattttatgaaccgtgaaatttattgatcatattagtttttcaaaataatgaagattttaaccaacaactttaatcaagaaatccacgattaaaaaatttcttctacactccatattttaaaattttaagtaaatatgcgctgaacatttgcaaatttataaggatggggatttataaaactttataatcataatgtccttttaccactgtcccatctatactcatttctctgttgccattatcatcagctaacgttagttggttgttgacgatccttaaatcataatatatgaccgtcaattcctacatataatagaataaaatatggtattcaacttagtggtagggtttattactaatcatttccactagtgtggattaaaatatgtgtatacaggtattttaaagagaaaacacacctgtcatgcgacaaaatgcaacttcggacaattaggacgcgtttgcatgaattggagggcccatatgtcaataaaaccacttagaattgggccaaatcataatacatgatgttggggggccattaagctacctcccagccaaagggagggtttttgggtttggccgaacacatccggaggccgctgatcgccatcttccacatgtacgctcctgatttcatcccaataggtgtaaccatcatttggagcctataaaaggaggagctcacttcattccaacacccacaactttgagctgaattacaagagactctattgtatcttttgtatgttataaaataggtagagtgaagggaagctttggaggagtgaccggaaggttggcgctctctctgacttctacctcggctagtgtagctttctaagaggaattctagaggagtaccggagttgtcgatacactctactctgggttcggagaaacttcttctataaagtaagcattcgggatcatttctgatgttatttaattactagaaaatatgtccgtgcgttgcaacgagtgaagtctattttaatcttattattgttatatggtttggttaagatgaaattcactgtgggagttcgcttggatatatctatttttagaaaatcatgagctgcagttaggagtccgatcgtctcaagttagtatgcgagtttttttaaacagatttcttatatgattccttctgtattgctaaaagtgaacgatcttaaaaaccgactcaaatacagatatatatttccaaaagcaaacgaacttaaaaaccgactcatacacggatgacgtaccaaaataccgacaaaacatctccaatttttgtaacagtagagatttagtctaagtaagatagatttccatatttatgggttcattgtttagtattcatactaagtactctagtactaggactccggataaagaaggaagttcctaggcaagtattagagtagtaattaataacttaaatgtggtgtctaagttacctttatttgttgtgtatcccatgaatttgtcagaggtaaacgacaggtggtgacaaccatgaatcccgtcctagtaaccctccacgttagggtacatcatagagctatagcggaaccacgctggcagaccagataggaatttacctttaacttaggttggataactaaaacacatagaaagtcatctctagcctagctagcctaccaatagttgttgtccttggatagtcttagccttaagtagattacacatgttccctgagtttgatatccttttggggtcacccgaaggtgaagtgctacatcggtattccgtgcgcttgcggatttatcaatggtcgtaagaaataccaacaagcatctctagcgtcgttgccggggaacggttgctaatttatctgagtctaggtcatcctcgtatctttattttttatttcttcttcttttattcctttccttgatgaagcaacccacaatttaaaacctttctgctcctcaggttgatctttgtgagctgtcctgttcttcaaaaccaatcatttcggatggctacgaaatcagtcctagctttatagccatgattcaagagcaaaacttcgctggtagtcagggttggcaacggggcagggtgggggcgggttggacaagaatgcccccacccccgatcgctagctcttccacccagccccggccccgaagcagaaatcgaagccaaagttgccctcgtccgtagccccgtcgggcccccgaaacttggtcgggggcccgaaggtagggagcctgatgaccggcgacgtgttgaggaggggagaggctagcgaggtgcgaagagagaaaagaccgcaagtaagggagagggccaacatggtgtggaaggaaagaagttgtcgatgagctttggacggagaagaagctggagcgtggagcggaagcgagacctgctctcgtcatcatgccgtgggagagagactacaaaaataccgtgggagagaggccacgccagcagcggcgcaggcgcgcgatgctgccgagatgggaagtcggcgacggtgcagaggtggatgggacgcgatgatgcagatgttgatgggatatgacgacgcggacgcatggagcaccgagtagtccggagtccctcgatagaagatctgcacgagtggataaggtcggtgatgtcaagggatttcttcacagttgtatacatgttcaccaatttgggcctattgggttttattttgattgggccatataatgggatatacactttcggggccccatagggtcacccgtgggttaattttcacaacccgcccccacccccgacccctagtaacaatcggagccctgacccgactcacccatggggcaaaaaacagcctcatccccggccccatatgtgggtgttggcatatattaaatgccgattctatactgccaacatctatataaagtcccgataataaagcatcaaacatagtgataggtgttaaaatctcacatattccacaagtgttggtgtatatttgtatgtaggtgatgaaccccgaagttgggaggaaaatcacactaaagtgagagaaaatatgtatccatacaaggatagattgtggacttcatcaaaatacccgagagtcagcccaaaacttcgagaaatggataaaggagggccagaagaggagctaggccaaaggccaggccaaggggtcccagcccaggttcggcctaaccccctggtttgggcgaaccctggtgatcgccgttgatcccaggttttggcgtggacgctccagatcaccccctgatgacggttgcggggcagttcggacaattccccttcctataaccgtcatacctatcctataaatagacatcactttattcactctcacaaacactttcaagcttgagctgaattataagaggctctatcgtactatattgtatactagaataggaagagagtagagtagaagaagtcgaatgaattccggagttgtcggtaatcttctctcatttcttttattttgtttattactctaatttcaatataatattcttcctgagtaatttagatttatcttgtgagaattatctcttggttagttcctaaatagcatacgggattattgttcactataatcaactaaaatatagtgattgctttggtgagttataaacactaaagtagatattaattacttagacgtggtgtttaggtaattgttatccagtaattgctgcgtatcccacagtacgtttaaggtaggtgtagaggtggtgacagccatcgagatcacttaagtcctccctgtccgagtacgtagtagagcaatatctgggaacaacaggttgtcaatgcctgaagtattgcgttaggattaaacttaagctttcactagacactatttctcaccagtaaatcatctatatcctaggctatcctttgcttggtgtccttggatgaaccggaggaaaatctgaccacacacgttcccttggattcgataccctttggaatactccgtagggaagtgctacatcggtatatctgtgcgcttgcggattttatctgcgaccgtaagaattaccaacagtgggattctagaggcatttcataaaggatttctccaaaattgctagacccctaattgccttgctagctaaggatgttgttggtatttcttaacgacattactagaaatataattcccagcaatggcgcagaaatacttatggtatattatggttacagagttcatccgcaagcgcacggatataccattatagcatttcacccgagagtattccaagggtatcgtatttattttatcccgtggaaagatcatgtagagagaactcaactaataatttatatattacttgtgacaatcatattctaagcatgggttaagataatccaagggtagagtgacacataagcattaactactcatcctcataatatatcatctaagctaagtggaaagaaaagagaaaggaaatctattcctatatttctagtatacatagtatacatacattctagctaactgatatactagctaataccctctatccgatgccctcctggtacttcgagaagccaccctgactgccgagttccttacgacagcccgtcatgaccatacaaccggggctaaatacggaggaataccctccctaggaaattaacttaggattatatataggcgcggaggaatacccatactgagctgtcaccatcagcggcccacctctcgaccgcaatatataaccccaaataatgatatcacgtaatctagacaccacgtctaaactaccagatactactctaatatcatcgtcatgacatagagtaattgcataagcaaacactatacccgcaccaaagcatctcccagataagctagccgtatattcagtataacatgaacataatataaagtaggtacttatatactcggaaagtatttcaataccataaatgtatatagaagagtattctaataaaagtacaaggcttacaaaagaggaaaggaaagctgctagagccatacccgaactcttccgaagacttctggactcctgattcctattctaattctattccaccagctagatactactaaactaaacttgagagaaatgagagatctcttgcttgaggtgtgttgaagtgaagagagtgagctccttatatagaggtagttatgacggttgtggaaggggaattgtccgaagtgcccttcaaccgtcattgggatgcaatcctggacgtccatgccaaaacctggatccaatggcgctaggattggttcagccgaacctggggatggcccaatccagcccaatttcagctggtggcctcctctattgctcccctccgcagaccaattctaagttcttggcctattcacacacaagtctggttctcgacatcgtccgattgatttatcgtctgaattgatgtcgattctcctctattttatgatcattctctgcaaaaggttagtatacctaatactagtggaatattattattctaacaaatatatgtattgctagcatcactaattctcccctattttggtaatattgatggtcgaaactgatcgataacgaccgtcaacagatgccccgtttgactttgatgatgagtgtctaaaatcatttaaaatctttaaggaatcactcatctcagcactaatcatctgaccccctgattggtcgccgccatttgaaatcatgtgcgatcctagtgattttgcagtgggtactgtccttgggcaaactaaggataggaaacacaaagctatcgcatatgctagtaaaactttgactggagctcagcttaattatgccacaacttaaaaagagctcctagccgtagtgtttgccattgataagttcatgtcatatttagtgggagctaaggtaatagtttacattgaccatgctgcactaaaatacctgctcactaaaaaaatatgcttctactccaaaaattaggagctaccgataaatgactatctgcgtgacggcatgctgttgaaagtcacagactctgacccgtggtatgcaaccatcgtcaacttcatggtcgcgtgccatgtaccaccaggagaaaataagaagagggtgatctacgagagccgcatgcacttgtgggatttaccttacctttacagagtctgttcagacgttctactacggagatgcgttccagtagccgaaggcataaagatcactgagaagtgtcatgttgccccatatggagatcactatggagcattcaagacacacgcaaagatctggcagagtggattcttttggccaacaatgtatgatgcaaaggaattcattcggagatgcacaaggtgccagaagcatggagggatcactgctcgggatgcgatgccactaacatataaccttcaagtcgagctatttgatgtattgggcatcgacttcatgcgacctttcccaaagtcctttgagtgcgaatataacctggtggccgttgactatgtgtccaagtgggtagaggcaataccatgcaaggccgctgacgccaagcacgcccgctggatgttccacgagattaccttccctcattttggaactccgcggatggtgataagtgacggagggtctcatttcatcgataagaccttctaaagctttttgcaagagcttggggctcaatacatcattgccactccattatcattcccaaacaagtggacagacagaaacgagcaacaaacaaatcaagaatattctgtagaagacggtcaacgagatggggaaggcatggaagaacaagttacctgatgcactttgggcatataggactgcttgtaagacacccatcggtatgtcaccgtaccaacttgtctacgggaattctaatatatattaaattctaatatatattttttcagcccaaaagaagtttaatgtaattcctataataatattaggtgcaattatgaagtaggaacacatatacaaagaaaggttattctaattctttaaaataatctatgcaagatgaaatcatggaaaaatttatgtaaactatgtttagcataagcaattcactataatattggtacaagttaataactaagtttaataccacaaattaatcagtcaaagcagaaaactaaaagaaatcaaattaaattttaatcggctaaagccatacttcatccaaaaagtacatttaactgcacataagtgaacatggaaaataatttattcaaatactagattatttatcatgcctaaatataatttttctagaattttcctcctctgtttaggcttcctaaaaattcaatctacctttctaatagcccatctttgtttaatttctgtgagcagtctacccattatttttgagtgaaaccaaagaaaatggaatctaggttaatcatttacctccagaaaaatcaacactaattaatttgttccacacattaagttatgaatctacaaagttaggggaaagaaaataatctaaaaattcgtctaaaaccgtgttcacctagaatcttacccacacctctctcttccacctagagcacttcgtcctgggcccacttggcagcctctccagctcgccctttctctgtgcctcaccctcagccgaccaagaacacagagagggagagatcgagcgaaccgacgcgtggccacaacgtgtcgacgacctcgggctttccttttctcgctctcttctcctccagtctgagtcgccattcctcactcatcactcagagccgaagaagccgaggggagcaggtcctctgcctctccgtcaccagcgacctcaccactggccatggaggtgacgaccatcgccatctccgtttgagtcaaggtcacatctatctctttcgcgtttccatctcttcacacaatgccgaacctcttctctgttgaccacctcccattttgtgcatcacagccaccggaatgtgaccacgccaacgatgccctagagcacgcaccggagcgccgccgcttcgacatcgttgtcgtccggccattctcgtccatcccgaagcaagccgttgtgccaagaatctcgcgtcgaccacctcttcaagacgcctcaagaaacatcaagaacacggagaacacatccttttcttcctcgacgccgatccgaactcgcctccgcagtcatcgtcgattaccactgcctcagtgagccattgttcgatttctcgcgcatacaccatctccttgacctcacaaccctcgtgcatgccttcctttagcagctcgtcgtcccgttcgagccgtcgccgttcacccgaggaggagcaccgccgttgaaccgttccaaccgaagccgctgctatccaagcttcggcgatttcttcctacagcttggtgagcctcctgacctcttaggaaacacatgcatggatgcatctagcaaaatcaaagcccctaggcaacatgcagtaacagctcatgtataccttccgctcaccctcaccatcggcgctactccgatgtctcctagccacgaaaactagaggaatggaatcgtgagagcattctcttcattttatcttttgacctcattcccaatcgagccaccaatcgtcgccgacgagctcgccaaagccatggccaagctcccagtccatcgggctgctggaggttgaagatgaggactttgtcctgtaaatgatcaaaaaaatagggttcaaactataaaacttcagagattacatgtggacccacggacctaaatgcagttcatataaagcctagggatctttttgtatattggttcagccaccgatcagtggacccatgtgtataaaaatctgaaaatgcaaaggaaaaataactaaaacattaaatgtttaacaggaaaacacccaaacttgtaaaatccatataaaatcaaatgtaactcattttgagatgattccagttgctgtagattcttaaagttatgaactctattttagaaacataaaacttgacactcactgtacaaaactacaaataatgtctctaaaatttatctaagataggtcatacataaaacatgtacaaacttataaaatacatagaaaattcatctcaactcattttgaaacaaaatcaaattctacagattcatcatcatgactctctgattaggtgaaataaaagtaattacttactttgcatcaaatgcctctaaaactattatctctagaatgattagtttatataagctaaactttagaaattcatgtagaacccaatttagcttaaatttgagtaaacttaagttctataggatcacaaaaacatgtatttccatgttatgaaataagattatatacttactgtgtagtaaaagtctctaaatattcatataaggatttactaacatagagcagcctttaatttgtaaaacttgtagaaaattcatttttagtccaaatgaaatgaacaaagtttctatagaaccagcaaatagttagcttcaacatagtaaaataaaatttggcaccttttgtagagaacatagatcaaaaccttaatctagtgaaataagaatttaaacacagtgttgtttaagtaatacataaacatgtataagtatatatacactttaggtctaattaaacctaaataaaaacttgattgaccagtgaagccatagttccatcctcatccactaaaacttagaagaacttagttcatataacaatttctaggttaatataatatattgttagtttagattagagcatctctagtttataaaatatgaaccatagtagtaaagaccataaacatgtgaactaaaaatgttttagttaaccaaactacttcttttgctcaacttaaacatactgtagcatattgtagcatattctgaacctacaactaaaaagtcatgaacatatgaaacactatatgcctaaaacacgttgtaacttgtaaaatctataagaaaatcattataactccaaaaattgtgaaaccaaatgagttattcttataaaacacacctctacaccctgtgaagtctaatataataaaaatcactttacaaaagtattttataacactacctaagactatactactataaaccgataaaacttctaaaatttataactccctaatggaacaagataaaataaaaattctttcacctaaattcattttagaccagtacctaatcactgtgcataaatcatgcattttagagcattttagattttcagctctttcggtgtttaattgcataacgtgtcctttatctagataactagacgaaacccagcgtattgctgcggaaaactaaggataatccatagaaatagcaagcaaagatatatcccacaatcaatatagtattttgtcaattcatgcaaagaatgggccaatgtatgtacaatgaacaaatttgagcgggcactgactggatccatgggatagaggaatgagtggataaaatttcctccctaaaacaccatgggatcatccaagatttctaagggtgtatttgcactgacaataagtaaatgcatgtgcgtccggtttataaaagttaaagcctacgaaaaccttttaatatcttttttgatttatgacaggttctataacagaacttgggcaaaaagtatatcaaatagcaatcaaaagaatggaatgtatcaggacatatataatacccatattaacctgattataagcataagtgaaaatatatgcatgatgataacttttgtaacaacgtcgtcagatatctgtaggctcgtaaacttaacttgtttaaatcctgtgtaacataaatctgatagagataataacaaaaaagataaccactattctgtactaactctataaagaattggagtaaacacaaattctggagtataaggagaggcaaacccatatccagatcagcacgaacagggcagttgcaacaatccagcgaccaagcagtaaacaacacagggcgaatgcagaagctaaaaattattgcagaaatgctgaaattttttggtatacatacctcagtttttcaatacgcttgaatgacgcctagtagagttcagaaattaactcaattttcaatattgtcatgtggatgaatgggaactaaatggatttcttgacactgtcatcaaattggatgtgaataaagtagcgcgtagtgttaaaaataaagcaatagccctgtaaaacaattttagtcaaagaaaaccacttatcatcaggactaaaaataaaaatggataatgaattagattaacccatgatgcttaagagcagggagaacctacgctgcgtagtgtttgaacagtagtatacagctcctatactgcaatggcaacagtaagatcagtagtagcatcgtctcctcttactggagtagttgtagcagcagcagcaatattagcgtggtttctggatgaggttacggaggtcaagaacatagtgcatcatacctgtagggaggatcggaccatagtgattccaccagcttccgccccgcttggttggtataaccaataggctctggcgcttctccattggtgtccagtgcggatgatcaccctgctggcattggggatgaatcgagagtcctgaaagtttacgacggagtgtggtttttagaggaactgaaagagggaaataaatggaattaatcgcaactaatggaccactcattgttggtgaccgttcctggtgataaatgctcttgctcctagagggagatgatgggtagctcaacagccgatcagaaggtgaatagatcaactctggctattgaagtcggagatcaacatggagagcgcacatctgatatcggatggttaggactaaaagagatgacgtggtttactcacaaagcagcaaattagctagtggggatgactcctataggtatataggattgcataatcggtgaaggagtggattaggtgctaacatttctctgatcaaggcaagttttctcctccctcctttgaacacattgaatcccatgatttgaggaatgaaaatatttgtttgtaaagttgcatgtgaacttagactatatcggtatttaaaattgggttaaggtagttgtgacatatttgctgcataccccaccttgaataattgatcctcttgctgtttgaacccctagaaatggttagagtacactctttgtgctcaaatgggtttatatatgctctatgtgcaactacttgcttagccatgcttagaaatatgcaaatgctcattccatctataattaaaatgtggttttgatacttgaacctttgctggaataaaatgaatatgatgggtatttgcgaattaaaatgtgtaaaatgtgattttatacttgggcggcaagtggtgtgcatatggtgttagttgcataccgataggggggagtgtttgcccaagtccataaggaccgaacttgtgtcacccatttaaagttattcgtacatccacatgtgctagtatgggatggcctaagctgattaatctatttaggactagccttgcattctgttaggccggtatgtatgagttagtcgataattctgaggaattagtcgatgattcagaggaacttcctatttgcgccgacgtggtagtttaggtgactaagtctgtccaatacaacggtattgtgccacgtgggtgggttctcgttgtgtccgccaccacggcgttaagtttaaggcgtgggcccgccacttaacggttctaggcatattccaagtatgcctaggatggaggaacacgtatcgtgctagtgcaaggctaggctctaagtagtgtaaaggctacgttatgacctctagatcacattcaacatgaagagtgtggtggagtcttgcaaactcaaaacaaactagagcgttcatatcatgtgggtaaagctgtacaaactttgcagagttctttaaactaatcgattagccgtgctcacggtcatgagcgctttggtgatgtgtcatgagtatagactttatgttttaaaatgtgatcatgtgacattggtttgaaattgataaatgtgttaagttgtgtgtgtgaggtgatatattatgacttgttgtcaaaggatgacaacaagagattgattatgatggaattatgatgaacttaatattgaaacttaaaatttgttttgttaattgaagcatcaactcctttacaaaagaattgcgaaacaaaacttgctttatgctgaaattgaagtacatatggggctgcag

SEQ ID NO: 68936 - DNA, 13156 bp, Oryza sativa
tttgcaggtttagatttagtcttttgagtgatgtgggttccgattgcttcttctaggatgagaacttaatggggtaaacccctagtcggtgtgcttgtgattgggtagtcaagcttccgctgttctctaatatgtctatttggccggtcggcctatgtagttattaagttgttgtaagtcttaagtttctttaatcttagttgtgtttgctatgtataatcatgcttaagatgaaagtgtggatctagtgcacatcctgggaactagattcacatgagtatgagttaggaatatttgagaggttgtagatctttagccatttttgtcaagtctcctgaatgtgtaacacatctggtcaccaccttcgagtggtttgatgggcacatctcaggctgaagttgactggcaggctaagggctcagcaatgtctccaatattcctctctcgaggcgtcggatgtttcattatgcttgtttgatgacttaaattattcacttcatctctcaaatataatggaaggtccgaagtgcctacgacaacgcactaggctatccggacttggaacatggacctaaagggagacggacatcacaggaagatgcagctctctgagctggaggaatggagggacaaggcctatcacaatgccaagatctgtatggacagaaccaaaagatggcatgatagacagatcaagcacaaggagttcaaagcaggggataaggtgctgctgttcaactcacgggtgaagctattcggacatggaaaacttcgaaataaatggatgggcccatatatcgccgtcgacacttcatcacatggagccgtcatacaataaaagtaatatctttaagataaatggctatcattaaaaagtttttcttgatccgttagaagttgatcgtgttagacgtagtgaatttagtcgcttctagcttctacccggagtccttaggcccccctgatccgttagttttcaatgccctgagtccttaggtccccctcttgttatcttaggtctaggttctaataggtgcacttaggtctaggttgtttagcttatttttatttcatttcattcttgtaatgtgcctatcattgacgaccgtatttgccggccgaaagaccattatgcacttgtacaactaaaatggtataagaaattcataaaatcaaacttttaaaggttgtaaaagaatgttctcgaaacttttcaattagtcgagggggcatatttagaggaggtttagatttcgagaagagctggttggaatccaactagtgaaaatctagaaaagctgggaaaaccactttctgtcttctagttcattttcaagattccgcaactacaactttatagaatctacaaaaaggtggatattttaggggagctttcaattctaggagaaactgtagctattagaaccttccctaaacatgttttagaatgtttctacatgtagctcaaatgaaatattgaaatgaaaaaaaatattttatgactcacaaaattagaaaaaaaatacaaaatatccttgtgtatattgactcgacataaattattttgtgaaacatttaaggattaaatcattcccacgatgcaatttagaaaaaccacacataattcacttattttatgttcccaggaaaagttaatatctttaaatgaaaattgcttccttcatattatgtggcatttgttaaaaaaagtgttatttcattacaaaacatatgctagggcataaatggtccttacaagcaaacttaatggtcaattgtattgtggtatcattggaattaagatgtttattgtaccgtttgttagttgacggataacaatatcatctctgttctttcttttcctccacaccttaaaaaatgttaaatgacatcttatcaatagacaacacctcctatggccatatgaagtgttgtcgcttcttgatatggttacaagtgatatttgctatccaaattgaaagggagcataatttgaggatcatagatctcgcctagatggagatgaataggtgtttcctgcaattacaaacacttgcagcgaaaattagtattgaccggttaatcaggtatcattgcggataatctaacaatacacagtgtcagaaaatctaatcacaactagacagtgcaaccaaacacagagaatataggaattcgcctatgcacaatatagacccgtacaatccaactaagagtggacaaccttggccttataaagagagtgaaaaccgtagggagatggagcactttgcacactagatatgagcaagaccaagaggcatcaacaagagataagcatgcaacaatatgatcaccaaatagctcaacaagaaagcggtaagtgcagagtaatgagagataggagacattgcagttcaagtcagtcgatcctacgtctccgttgagggccccgaaaggccaagtctctcttaaccaactgcaaccaatcatgcattggtctcttaaagcaaccaccaagagcaagctcatgctccaagcgacccccaccggtccaagctcgaatgtcacacaactttcgttcgacaaggcgaagctcgatttccactatttaccttttctcttcttgaggtaaggtgtcaaccttcgcaatcttctcccaaatacacaccacaccctcacgagattctctttctcctcttacaattaagagtggcaatttccccgttggatctgggtccccgcagggggctgccacaacgagggtgtggacggatgcagattttctcccacgggtctgtcgggcggggccctgactttagacatgggcgggggtcacgcccggaaatatacaccatttccaaacgctcagtgcattaatcctcgtcccaggaggcgaggtacacatagacatttttgattattacaagccacacttgcagaaacgtaaaggaaatactccatctatctacttttgatagttatatttcatcttgacacacagaccaaggataaataattctacttattatccatttaaacatgctactagttattcctcgtaaacaagcaattcattaatatttacatttctcgatgcccatgcagccaatcttatgtggaagaatggaaagtcacgtattaaatccgagaaagtcattaagagggtaggttgttggattaaaatatgcctatcaaaaataaattttttagatttggaaatatgcctatcaaaagtagatggagggagtactttattacatgggcgactctaggccctcacactcaaagataaacaaataaaacagcagaagactacggaacagcagcagccacaagcactcgacaacggagcgaactagagatccaagccttcatcttcttcaggtccatcctctggattatttttgtgagcaagagtgagtaccaccaccgtacttagcaagtcacaccggaaatgcaacaataatgcatagggaaatcaaggaaatggcctaatagggtttattttgcataaaaccatagtttaaacattttaatcaggttaaagctcattttaaaacacgatcctgttctaagccaatattttaatcaccaaggtcgcatgagcctgcgaacctgccttagcccaggctaatctccacatgactacaccatcatgatttcaccctcccaaggttttataaaacaaaactaacttttggtacattactcagcttgcccataaccgagggcgcggctattcgaatagtttttaactctaatcagaggtgtacaactttacccacaagacacaacctcaacacgcgttgccacgcgccgggtaccaccacggtactcggataaaggtcgtgacaagactatccatctaggtctacccaaaacatgagaacccgctgaggtttcaccgcccgctggtccctgacaaggtaaaggttgccggatcttacagagaatcaacaatgtccaccccccttacagagaatcttgttctcgagattcgaagacgcttccgatgaggtgaggatgggtggacttcagttcgtcttctctttcccatgttgcttcctcttctaaataattgctccattgaaccttacaaaaacggatcactcggcttcgggtatgtctttcagatgtttctaagatccttataggcttctccacataagtcaggtcttcctgaatctcaatctgttctggatctgcttgctctatcgggactcggaggcatttcatgaagttgtgacacgtggaatacttcatgaactcctcccagagatgccagtagttccaattgataagcaactttccctcttctaccaagaactttgtaaggtcccacaaaacatggtgccaactttcccttggtgtggaaacgacgaactccatgaagcggtgtaactctgagatacacaaagtctccttcttcaaaggctaactcccttcgacgcgtatctgcgtagcttttctgtcgggactgggcaactttcaggttcgcttggataaccttgaccttctcctctgcttcttttagaatgtcagtcccaaaaacttgacgttctccggtctggtcccaaaggagtggagttcgacattttcggccatagagagcttcaacaggtgccatttgaagactggcttggtagctattgttgtacgaaaattcagcatatgggagactcttatcccaacttttgccaaagtccagggcacatgccctgagcatatcctcaagaatctgattaactcgctctgtctggccgtccgtttgagggtgataagcagtgctgaagttcaaacgagttcccatttcttcctgcaatttctaccagaacttagaagtgaattggctgccccgatcggaaacgattctctttggtaccccatgaagacaaactatcctggcaaagtataattcggccaacttactaccaggataagtggttttgactactatgaaatgtgcaactttggttaggcggtcgataacaacccaaatagagtcatatccagattgggtccttggaagaccggtgatgaaatccatcccaatctcttcccacttccattttgggatcttgagtggttgtagcaatccggttggcctttggtgttgggctttaacccgttgacataaatcacagagtgtcacaaactctgctacttcacgtttcatactgacccactaatatttcattttcaagtcttgatacatctttgtactgccggggtgtattgagtattgactctcgtgagcctcttgcagaataagcttcttgatctcaggatcattgggaacacaaacacgtccgccgtaccagatggtcccatgttcatcttcagaaaacccaattgcttttcccctcatcatattcttcttgatctcttggataccataatcacctttttgggcttctcgaatttggtaaaggagtagaggtttcgcccctaaggtcactatttagccataactaactattcccaaattcaaggctcaagctctcagcacaatccaggaggacactgttcatagatgatagcattgcagtaactcttccgactcaaagcatcaaccacaacgttaactttccccggatgatagtggattcccacatcgtagtctttaatgagctctaaccatcttctctgacggagatttagatctggttgagtgaatatatacttcaaacttttatggcccgtatatatctcacaacggttaccgataagatagtgccgccagatctttaaagcatgcaccacggcagctagttccaagtcgtgcgttgggtagttactctcatgaggatgaagttggcgggaagcataggctaccacttgtccgtcttgcattaagacacaccctagtccttgtttagaggcatcacaatacacctggaaatccttgtggatatttcgcaataccagcactggggcagatactagcttctttttgagcaattgaaatgcctcttcacactgcgaggtctatatgaatttcacttctttctttagtagctgagtcattggccttgttattcttgagaagttttcgatgaacctgcgataatagcctgcaagtccaaggaaactgcgaacttgggtcactgatttgggttgattccaattggtcactaattcgacgttagttggatccactgccactccttgagctgaaattacgtgtccaagaaatttcacttctgaaagccaaaattcacatttattgaacttgcatacaattgatgttctctaagcttctctagcgctaggcgaaggtgttgctcatgctcttctgctgtcttggaatagatcaagatgtcatcgatgaagaccatgacaaacctgtctaaatattccatgaacactttattcatcagattcataaagaagactggtgcattcgtcagtccgaacgacataaccttgcattcatataacccatatctggtcgtgaatgccgttttagggatgtcttcctctcggatccttagctgatggtagccggatcgaagatcaatcttcgagaacacggttgctcctttcaattgatcaaagaggtcatctatcctcggaagaggatatttattcttgatggtgacctcgttgagtgcacggtaatccacacacattctcttagttttgtccttcttttccacgaagataactggagctccccagggtgaagtgcttggtcggatgtggcctttttctttgagttcttccaactgctttttaacttcagctagctctttggcagccatgtggtacggtctcttggagattggcgctgtctcgggcactaagtcattcgaaactcgatgtccctcttgggcggcatgcctggtagttcctccggaaaaacatctagatactctttcacgatgggtgatgaggacataactagctcggatataaccattgaaagtgcattgatccccctagtgggttttggtgattaatgacaaatgtggttaagggactaatgagttcattgagttactttcaggtgcattagcccaaggtgtggaagatggatgcttggagacccccccaaaagtataaaatcaaagcggaccggaactcgagaagtgcatgggatagtttatttattgcaatcgagtttttaggaaaaaccgtactattaagagggctccaggtgatgctctgagatatgtcaagtactcttagtgtgaaccaagtgtcaagtttccctaggagttatttttacaaatactccatctgtccaaaaatgcaagtccggaacttcctgtcttctaggtccggaagttccagtttggtgaaaaagattttcctaagtgtagtctagaagttcctgtcttctaggtctggaacttcctgtctagtttccagttcaaattgtgagtaacggttagatgacgtcacctcatccagtccgaatctgattttgagttttgggccttgtaattgtgtcgtgggcttagcccaaaggggtgtgcgccctagggcaaccctaggatgtccccaatcacttttattcaatagccgtcatcgtttagagtcgggttttgcttagattattctgttgagaacagtttcgctgctagatcggtttgtggaaccctaaattcgtgtgcttaatcattcatatgcaatttgcttgcaatctatcttgttcttgcttgtgttcttcgattcacatgcagggattagccttctcggcgaggtcaaccaggtttcgacacggttgataaccagagggacgtggtgctgcgattgcggggctcagtagcgtgttcgttcagaagccggattaagttgtaacaggaccatgcactagggttcatatacttctggtcagcaccgctttgatccttgcaatcgccacatcacgtccttcaaggtgtcacgaaccagccaccggttggaccgtccttagcattgctggtaagacacttgtaagagcttggtaagatgctccattgggctgagttgttgaggggcaccactacaccgcgtagcagattattagggataaccttcattgtttgttttttttgtgtttgcaatgacaggtatgagtggcactcgaaatcagcgataccaacaagatgcacgtaatgacagtactttggtgtaacaagtgctaagctctcaaatggagaaagcagagcaatggcagtaccacgaattatttgaaacaaagtttatggttaaggatagagcatgtcgtactataatcgatagtgagagttgcaataacatggtgagttcagatttggttgagaaacttgagttgcctacacaaccgcatcctcatccatattacatcaaatggttcaactcttgtggtaagtttaaggtaaatagaattgtgaagctaaacttttcgattagaaattaccatgatactgccaattttgatcttgtccctatgcaagcatgttctttgttgtttggtcaaccatgggtatatgataataatggatcgcataattttgttgctaatacatacacatttagacataatggtcggaaaatgaaattggtacccatgagttttattgaaattttcgaagataatcttgaaaggatgaagaatggaatcgaggaaaatttcaaagatagtattgaaaggacgaaaaatagaatcgatgagattttcagagataccaggaaagatactatctttgaaagataccagggctcagtagcgtgttcgttcagaagccggatcgagttgtatcgcgactccgcccaaatcgactgtttgtcaatacctatcggaagatcgggacctacattcctcatcagtttcagaagaatatatatggagcttgggaggcacaatatatagtagcaaaggaacgtaattgtactaatcagaaaatgcaaagttgaataatagttcaaagtattagtcaatgtgctggcctagtctagactcaactctagctcaagcaagcacccgacaacactaaggactagatatgaatcaatgcacaactctgcactctgaaaacatactccaaggatgaatggtttttctttcttggtgtggcttttttaagcacctttctgccttttttttcttttttttgtgcggctttttctttcttttttttctttgcacctttccgcccttttctttctttatttatttttttactttttattcaacaagaaccgaccactgacctcgaacatggactcaaaatataaatatcaatattacagggactcaaatgtaaaatgcaaaactaaaattagatcatcttaaaaatggaatgctcacatcatgtaggttccgtttttataaaaatatctcaaatccactacttaacaattctagacagagaaaaatatagatagtcacagatagatctgatctgatccctcccctcaggcgcacagtactcccctcacgcgcgcgcacagtggtacaggagctctagaaatcgagtaactcccaaaccgttggataaaaatttctccaaaatacaaaaacggaaacccgacgacgaaacgattcaatttttcaaggtcccggcaagaaccgacaagatgcaaaactggacctaaaattgacgtacaactcacacgtgataaatcctagacccaaagtgatgaacagatgcaatactcaaaactaaaaattaaatctaaaactaaaccagcactcaacatgacgatgcaatctagaattcaacaaagcaaaatctaatagaacaatgcaacggctcaaattgtctaggtaaagaataaatatttttatgtggcaattttctgattatgggaagataaattacctaatgggcaaccgcgctatgataccaactgatgagggatgtaggtcccgatcttccgatagatattgacaaacagtcgatttgggcggagtcgcgacacaactcgatccggcttctgaacgaacacgctactgagccccaaaatcgcagcaccacgtctcctctggttatcaaccgtgccgaaacccggttgacctcgccgagaaggctaatccttacatgcgaatcgaagaacacaagcaagaacaagatagattgcaaccaaattgcatatgaatgattaagcacacgaatttgagattccacaaaccgatctagcggcgaaactgttctcaacagaataatctaagacgatgatggctactgaataaatgtgattagagacgtcctagggttgccctagggagcacacccctttggcctaagcccacgacacaattacaaggcccaaaactcaaaatcagattcggactggatgaggtgcgtggcttgttttgcagattcccggcaactcggtaggagttttgacgtgggaccaaaaccatctgaaagtagacttcataagctttccaagaagtacttatgggccccgaaattccttctagatcagtgagtaggtccgtttgaagttgatgctgtcaggaggcccgaatccgaatccaaaacgtgtagaactttatctcttgtcttctatggaccaaaagtgacgtggtgatatgaaagaagacttaaagaaggtcttggtttggtccccaatcaacttcttcaatcatccatgtattccttacgctcggtctcttttctttcgcccaagcaagtacctctgcaaacaaaaacacacaaaactcattgtgtcgcaacgtttgttgaaatatataacaagtaaatctaatatagaacataagcacctttatttgattaatacataaggtagtcatggttatatccgagctagttatgtcctcatcaatgggtatttcatccatactgacgtggttcagaacttgcttacaaggaaatacaggcttggcatggaaagtgactcgctggccagtacccctagtcatagatgtggatcagctggcacaatctataataccactgtgcttggtcaaccagttcatgccaagaatgacatccagattcttagagcttagaaggatgagattagccagaaaagtgactccttggatctcaatggttaccaatgggctaaagagcttagcaggtagttggcttcctggggttgatactatcataggtttgctaagatcttctacccttatttggtgttttgccacaaaatctcttgatataaaggaatgcgtagctcctgaattaaaaagtacacatgcatgaacagaattaatcaggaacgtaccaagtatgacttctggcgcagcctgtgcctcctcagccgagacatgattcacacgtcccctcaccaggttgttgttgttgcagttgccattgttgttctagttggcattgcatgcagatgcaggagcttgcggacgctttggctttgggcacttgtcggcgaagtgtccaggctcatagctgttgtagcacacaagtatcttcccagagctatctctgcgtgtcgatccaacctgggcaggggcagaacgctgattgttgttccatcctgagttctgcagcttgttgttcatctgtggacggggtgcacgctgtgctaccgatgaagaccaacttgagggggaaacgcataacgtggtttctgacttggtccttgaaacatcctagcattggccaacttacgcttcttgctttcaatctttcggtgcttgtcctcctggcggatcgccttgtcgactagcatttggaaatcttcgcagtcaccagagatgagctggactaacaactcgtcattcaacccttcaagaaatttctcctgctactcttcattggtgcgaacgtcctcaggagcatatcgagccaacatgttgaagtcgtgcaaaaattcagttacggtcctgccatcttgcttgagttcacgaaattctttctttttctgtgctacaactccaacaggtacgtgagctctacgaaaagcagtagagaaacgagcccaagtaataacttgtccaactggctgggtggcctggaagtggtcccaccactcggaagcaggtccatgcagttggtgagcggcgaaaggactttctcctcatcagtacactggatgaggtccaacttcttattgaccgcgtgcaaccagtcatttgcttcgacagggttggttgtgcttgaaaaactaggaggtcggactcggaggaattccgacagctttgactgcggtggagcgtgtacgtgagcttgagcagcgggtgcttgcgggttttgcatttggtggagcaaagctgcgatgaattggttttggttggcgagcacttgtgctaagttggggtgatcatggattggcggaggtggcggcggtggtggtggaggggcgtggccttggtcctaattctggttctggttctgattctgattctgagctgaattcctagcacgagcattgttagcagcagtactccttgtgttcaccatctgtagtaaccaagataagagggaaaagaagaagggagagatcaggacaagaacacgagctattaaaccaacttatttaaattttattaatgtgatgttggttacatagagttcaagttgcttaagcaccacaaaggtatagctatatcacaacgggccgatatagtccataccaaaaagcacacaaggcaacaaactccagcagaagataaacgataaaaacatacgcgcactaagacttcgcgtctactcttgagaacgactcctagaggggctacggtccacaaatggctcatccacgttgctgatgccgtggcgaggacaggcgcttgatccaacaggtggtagggtcttgacgacggttccaggcatcccactcttcaagtccttcagctccttgcgtagagcgcgaagctcattctccttgtcacgattcttctgaagcactgcctcgaacatcctctccgtcatcctgtagtagaccatacggtacttgtccatcgcggccatcatcttggacatgtgcacaatggtggtgtccccttcattgcgggcatcgcggaagtcagcatcttctgcgaaacccaagcgagcagggtggtagtggaacagagtggtcttcaactggtcggagtgactctggcaaagggccccaatggcatggaatgcagcttcttggcaggcagattcacggctgtcaccttctcctgtgaaccagcaactttctagcatcatccggttggagatgatcatcaccttggcactccaaagtggttcaagtacaccctcgttttaaaaaattgggggat

SEQ ID NO: 68937 - DNA, 10908 bp, Oryza sativa
ccggccaagttgaagcagcgggtagtctcgaactcaggcatctacaacattttgaaataagagtcaatgaccagttttgtaaagagtggacaggtgaagatagaataacgaaggttttcacaattaaagaactagtttctaaaaaaaatatcatcctaaggcttagaccactggctcgtcctacggtcaaggtggctctgataccaacttgtcacgcccggaaatatacaccattgccaaacgctcagtgcattaatcctcgtcccaggaggcgaggtacacatagacattgttgattattacaagccacactagcggaaacgtaaaggaagaactttattacatgggcgactctaggccctcacactcaaagataaacaaataaaacagcggaagactacggaacaacagcagccacaggcactcgacggtggagtaaattagagatccaagccttcatcttcttcaggtccatcctctggattatttttgtgagcaagagtgagtaccaccaccatactcagcaagtcacaccggaaatgcaacaataatgcatagggaaaacatggaaatggcctaataggatttattttgcctaaagtcatagtttaaacattttaatcaggttaaagctcattttaaaacacgatcctgttctaagccaatattttaatatcaccaaggtcgcatgagcctgcgaacctgccttagcccaggctaatctccacatgactacaccatcatgatttcaccctcccaaggttttataaaacaaaactaactttgggtacattgctcagcttgcatataaccgagggcgcgactattcaaatagtttttaattctcatcagaggtgtacaactttacccagaagacacaacgtcaacacatgttgccacgcgccgggtaccaccacggtactcggatagaggtcgtgacaagactatccatctaggtctacccaaaacaggagaacccgctgaggtttcaccgcccgccggtccccgacaaggtaaaggttgccggatccccctggacgagacaggctccccttgcgccgggtaaaagaaacggcattaatcctggccccacacccttccaaccaatggtctttgttttgagaagatctaaactttcagtcgggccttacccactagacttgtggttgcacaaagaccggtccttatattagccggggtgcgactaccaaagtaactagcttgcaccctgagcccagcccaaaaatatattttagttgcacaaagcattttatcacccatccattgacaaaccagtcaatagtccataactaatcaagttttagttgttaaccaccatagtctagtttatccaaaagttctaggttggaactaagcaggactatgcatttacctaaagcaactagtcagtccatcatgtagggtactagactagtcaagttataattttactagggttcacaaagattatggatatcaaatcaacataatggccataaccaagagcataggaataaataataaaacaatattaataatgaacggtataatttataaagcaatgcaatataagtaaaacaacataattttcacaatatgggattcaacatgtttaaggtagatatgacttgccttgatcgctcacaaagtcttcaatgtcaatgacgatgaagagctgatcttccggaacggcacgatctacacgaccattgcgaagaaatacaaaaaggctaataaaatccatatgaacagaagcaataaagcacataaatgggttctactcattttaaggagaaattagagatttgaacggatcgataccgagttcaaacggtcaagatatggccatttgaagtttaggtgttgtttaaacggaaatttgtaattttgtgaattatttttctaaaggaaaacttgaattattgagagagagcgcacgcggactgggtccacgagcgggtcccacttgccagccgctcggtccactgtgagccgagcacaccgacgcacaggcacggcagcaaccgagccaggcggctcgccggcgacggccaatggcgtggcggcggtgcgacagagcacgggaagggaaaaacggaaagaggaggagacgacggttctcaccgagcagacgcggcagcgagaggttgacggtgttgccggcggtgaggaagaaacggaggggtcgttgtcattcccgccgtcttcgtgctcgacggaggggtggacggggaagaggaggaagcggcgaagcggatggtggcgactccgggctccgacgaggtcccaaccaccagcgaggggcggccggagttgcaacggcggcggcacaagaagagagcggcgcggcggctatggagagaggagggagagggcggcggtgtgtggggagagaggagggagtcggggtcccttttataggccggaggggagggagagagacgccggggagggagatcgatgccggccatggtggagctcaccattaaagaacatcatcgaaatccaccgcgaataatgctggatcgagtgggaaattatgggggaattggagaggatgaggtgggaattaattcccctcaattaatttgatgaaacggcgagtggaggaggcgaatcggaggttgccgtcgcttggaattcggacgaagagagagaggatggctggaggttagggatgacgagtgggacccacctatcatcgagaaggagcacacctgtctctgactgggcgcgcagagaaggcaaaacagacttcggtctgtgggagggggaatgagctgggctggcccaaggagagggagggggtggggagagaggaggaaaaagtacaccgaaggtccctcaacttgtcgtcgggatataaaatcgtactcgaaccacaaaagcagacatgcaagatcccttaactatacaaaaccgatcaccccaaatcctttgtgattttgaccccggttttagtctacgtggtggctgagtaaatgtgagacccacgtgggccccacatgtcaggtgtccacatcaccctctctctttcccctcttctctcccttccttatctctctctcacttctctacaagctagccggggcgaggcgggagggcggcgccgcgacggccgccggtggaggcggcgggcgaggggcgagctggagcggtgtcgcacatggagatggccgccagggtggatctgctcaaggcatggcttccagcaatcttcaaggtacaagaccccggatgcagaccagggcagccgcgcatcctcactgtccccgccgccatcgccattgccatcctgcgagctcggtccctcgtacttccagatcaagaagcatgccaggaccatgcaggagtagacccagaccgcgcagagcatgaacctccagttcagccaatactcaggagcagtggtgtcgacggccatggctgatgatggcattgctgcagtgacgaggcgttatgcagccagattcataatacaggatattactactcaaaccatgtctgttcttcaactgcaaattagattcttgcgccaagataaagagaggaattattattgccgacgaagggagaaatgatcagtactacgattcttatcatttcaagacacacaaaagaaaaagaaaatcgacgctagccagatgctatatatcctgataccctgcaacctggatccccacgcatgcagatggtaaagatgcaaatctttatttccatttccatgattccatgcacacaaaaaagaaacgaacaaatgccccacgcatgcagatggtaaagatgcaaatctttatttccatttccatgattccatccacacaaaaaagaaacgaacaatatagagaagaataccaagaaacacgcattggcgcagaggagggtggaaaactaacccaatctcaacggtgattgggttcttgtttcttgacttctccaatgcctccccttctccaaccttttctgccgccgcctctctctctccatcgattcctctccctctcgcgacctcgaacaaaccgagaagaagccaacgaaccaaccaaccacgtacgtgctgcaacgccgccgtgttaggagaccacggccggtacatctccgcgagcacccggcaccccaccaccgcgtcccaccgcgcgtacgcgtcgccggcgccgctgccagtgccgacgcgttcgccggcgcgcgcgacgacacgagcgcgcccacgtcggccgagcgggacgaggaggcggagaagccgcagcgctcgcacgccccctccgccggcggccgtcgcggcgccgccctcccgcctcaccccggccagcttgcagagaagtgagagagagattaggaagggagtgaagaggggaaagagtgagggtgacgtggacacctgacatgtggggctcacgcgggtcctacgctgactcagccaccacgtagatcaaaaccggagtcaaaaccaccgaaagattctagtgaccggttttgtatagataaaggaccccgtatatctagttttgtagttgaaggactttttttatcccgacgacaagttgagggaccttgggtgtactttttccgagagaagagaggggtggccgggctgggccaagagagggagagatgggctggaagcagcccaacaggaggaagatgatttcttttagcttttcctttttataaaattctttaattgtttttgttgccctaaaattatttaaaattcaagtaaaaattggttaaatatttttaagcatggggaatttattaaaaatgtccacaagccaattttatataaatcttggtgagttttaattgttggaggctcttttaggcttttaaaatttctagaaatacattaaagcacgatttaaatttagggcgattttcagggcgttacagtggggatggggacaggttgagatctccacccgcgggtccccgtggggccctggaagtactaaaatcgatgttgagttccattggtgagctctagcctcgactctagcatgtctgcctcctcttcttctccaaacatgtgggtcctcgacttgtaactaaccccagcccaagtagggtctatgtggggtgcaccctaatctggtggagcacggtcttagggacctcttggtcgtcctcccatctctttaaatagctaggtaccacttcaaggttccttagatttcattagattaatgttttagccattgctactttaccttgtagttacatgtgtcggctagaccacctaattactcgtctttagaaccccaacttattgtgagatttaattccttttcacaatttagattacttttatcttgttcttgcttatttctttgatttacttgtaaaaataagattgatctgcaccgatttgatcaacaacccacggagaggtatatcgatcgctaaggtgcaacacaataatggcctgtacggttatagtccgaccgtcaacttctcttccaaatcatagttatctcaactcactgaaagatcgagccaatcaaaaccgtgatcgtatcaaatggatctcaaggtttatcaataacactacctatttatagccccaactcctccatctttggtaccgttccttgagtctaccaaaagttgtatagggtcaaagaaaatctggtatcacactgaattgtctaactctttatgctttttgaacggtaaccgagcaactagctattatggtataaagaggtggacaatctagttgctactccctccgtatcttaatgtataacgccgttgacttttcgatcaacgttggaccattgttttattcaaaattttcgttcaaatatgaaaatatttatatcatgcttaaagaacatttgatgatgaatcaagtcacaataaaataaatgataattgtataaattttttgaataagacgaatggtcaaacgttggataaaaagtcaacagtgtcatacattaaaatatagagatagtgaggtagtatgtgattgtccaattgtgcttctcagaaacaatttggaatacggcagaggaccctaagcctaagggttttctttttatggcttggggttcatcttccaatccaaccatacaaaaaaaatttgacactaccaataagacggtttcatctagtttgtaggaggaacaaaaagtagtattgccaaaaaatttcaaaccaattctaataaaatcgcacattttttttaaaaaataaatggctaaaattttgttaaggttacattgttaacgaacaaaggacaaaccattagaatatactagagattggggcgcgcctttgcgcgccgcctgttcacacagtgtgctcgctatgcaagaattttttagggtgctgcatacacataaagataaaggtgaaacagaatatgatagcatggttgttcatacaggacagggtgaattgtctttggttgcatataagtacaagcaaaacaaccaaagacagtacgtaaggtaccgtcagctcctgttctgtaacagcacgctggcataatagtttgggcgtgatttttacatggaaattgagtacccatgcaaagcatacaaagaatgatactaacagctatagaagtagcagagtgaaaatatagcctacgatattaaaaggataacagcttgtgttgcatgagcatcttgctcacagcacatctattgttgcttgcagctgattagtctggtggaagtgaaagatgcagattgttccaacttgtatgccgttgcttgttggaaaatgggtccatcctgatttcaggttaaagcgcttttctgtggagtggtgaagaaccatggtggttgaggagtgccctggaatccgtacttcgatctgcgatgtcttcttccgcacgattagtgcaatgtatgtcatagagaattgctttgaaaagtgctgcatgataagtatatgttagtttttaaggtaagaggtatataaaggggtagtggtgcagttatcttaccaccttatcctgcttcatgaaagttggatttatggttgtgacatagaattcgtttgaggggtgcagaaattgcgcaatatctttgaagtagtctttgagttcagttgatagattgatgtccctccccggtgcagaagcacatttcattgatagtgcgtttggtgttgcctttcgaaagaggagtgaatgaatacatcaatgcacattaaaagagacgcaaatcaatggaactgaaaatagaaagagaagtatctgtacctgtacaagctgaccctatatcggcttttaatttctgttgcatggggtgttgcatgtgtggcttagtcttggttctttttttctgcaggtgaattggcgttgcaagcattaacggaaatcaaaagtagagagtggaatcagtaatgtaatagtttcagatatggtgccatagatgaaaatgatttgttgtcttgataggagacggaaagtgggttgaagatcatttacctggtggttttggtttctgaagcgcgtttttctttagctgtgagttgcttggtttgcttggcactggacatctaagataaccactcttggcttatatgatgacatgcatcttggagcgtgataagactttgaaaaccacatattctttaagctgcaaaccagtggcttctatgaactggggccatcctgtagtgatgtatattttgccagatgctctctttagttcaatgtagaccattaggttatgggttgttactaatttgagtctctggccatcctccagctgatatccttgtgcgattgcagctggtctgcgctgcagaattgaaatgatgtattaagactggcgtgtattaagctagactgtatatgttatatctgttggtaaggttaccacatagcgctggtttgctgtggttagtctaaccgtgaaaaacctaggtggattcatggctgtatctgcaaaaaaaaaaaggtagttaaaagaaatttataagtgcaaatttaacagtggtagggaagttgcaatgtacacagtgataaacaaagggacagataacagagctgagattgcagaggagagtgttaggtgcttgttatagtgtagtggtaatgagcactgatctttgttcttcggtggatttattcagatactaaacatgagttgtatattgtgatgtataatgggtcaaataggggatgagtaaaattatacagcagtcttcttattgttgaaaaaggctctgttttaagggctgctatatggctaataccatttttatttgttgccgaagtattattttctttcggtttgtatttgaaggaatggcaggttaccaatgatttaagggctgatatggttaggtttaaccagggcatgagccatgcgcaaagaatgttggagtttgcatggacatgtagtttgagctacagtgatctgtaaggtaggaggttatttatctggaaaacaaactttagcattgaaattaatccttgattatcctttagcgtatcatctctatgcatagcatatttatatgaacacacgaatggtgtttcttcatagcgcttatatattctgaagggtataaggcacggcctacattcgaaattgttactcaggctagctaacaatattttcaggtccatttggcacatatgacatcgcaccccaccagcatgtgtgaaatagaacaataatttacctccctggaagtatcagcaccaaaattcatctttgtggatcaggccatcgtcgatgatggagcagctgatcttctactccaactccaataccgtaaagtcagtgacctgcactgaaaaacaaataaatctagaagatgtaaaacagcatgctaaaatgtttaccagaaagagttgtgacttgttaggtacaaacgcagcagtacaattttattaattgcaacctaaatcctcctttacatcacagcagaataaataatcaatggcaatatattttgtccctctgaatcagaatgtgggtaaatgcactacccggtaataacccacacatatttactaacccacatatcatggttactgaaacatctagcattaatgttctgaattagatgaccatcctaaagatttcctatttttttttttggacaggctcccagtttgccccaaggactgcccaaactaaactgaaataccatcacatattctcaatttaaaatcagttccattcaatcatggacctagagctaaatctttcgaacttaaatatatttaaaactgaccttcgcgtgaacaagaatcacagaacaagagcagagcacataactaaggacttgattcaaacgcgtccattgcctgtaacacacagagagatgtagggttacatatatttaataaaaagctgtcaattgaacaccatagctaagaaaatgcaagagagcacagaccagtgaagaccgatggcgtgaaatgtagcttctatttcatataggaagctcttgtcctctgagcaccagcaggattgacggtgctacgaaataaaaaaaataaatgcggtgagcaaagcacactaacggtaatgtgactgaaaagaatacgtagataagaagtctataaagcatggcatcaagaatgctgtaccccttttttttcccatcaatggaggctaattctgcaccctgagaataacagcacaaaagttgttatatctatcaatgcttagtcaatagccgacgataaatagtatatttcatgtgcaggtaaggaagcactgcatagcggaaaaacataaaccacataagccctgcatacatatattaatgcagcaaagaaatacaaaatcacctttctgaaacaacagctgtatctatatcctttccttcggacgcgcccacctcaaaagttagcttcttcgatgcacctagaggctgccacaataatgtataaatcagaaccttgaccgaataacaaaaaaaaaacaaatggtctgtctttcctaaggtaggagcagaacatacaaggcgcataatggggcgtcgtttcctgctatcagcatgggctttctccatatcacccacaggggtattagaagaagcaggcggtgtcgaagtatgatcaggacactcactttctctacatatacttgaaccaccagcaaaaggtgaaatgacagatgatgtgagttgcaatgtctgatccctaacctgtggaatagtgccttgtctgccaaagaagtttcaatgctattgacttgaaacgcgatgttcctctgcatcaagctcctttcggtgacagaaacgcagaaagtgaatttttgggacacaacactcgcaatctctcgaggaatattgtctgatcctcgttccaacctgacaagattcattccttgctattgttgcacagatcttccaattcttactcgtgggagatatatcacagaacagatcaaaaggcatctgaaaaaacaggaagaaacaattcgatgtacataaaacgggaaagtattaaacaaggaagtaaatgcgatgaattacctatgggagcactgcaacacaagacaggagaggaatcacagtatagctaactaagggttgctaattttaaaacagctgtacgactccaaaaatgtgaacaggacaatgatatctgtacagaacagctatagtataggcaaaaacatatattattactatctaacagcagaaaatatctcgcggtacacgatgttccaagtgcgagtagtgcaattgccattgtcatcttcaattaacacctttaagcctgcgcgagaagtgactcgggaaagagcaacgtataactggccatgacaaaaaacagggtttttcaagtaaataccaactgaacgtaacctttgtccttgacttttattttagtcatagcgtagcagacacggacagggaactgccgacgttctaatgtcaagggccattttttgctggtcgcagataaggttattcttggga

SEQ ID NO: 68938 - DNA, 4061 bp, Oryza sativa
agttaatagcagcacacacatcattcgtaggagaaacaatagcacggtcttgcagatatactggatcattgtactgttcagcaaagttggtgtaaactgcagctacaatagctccaatcttttcatcattattcatgaccaaaagatcatgagggatttcaatccaagttggttcaacatcgctgccgtaactacacgctgctgctgtgccatcaccgatagaaaggatccaatcactgaattcagcgacttcgcgttgcatatcagaatctagagaggaacaacgtaaacgcatgttgatcgatagctctaaaacacatacatatgaccaaagaggagattttgatattgtagcatcaattgttttcgatctaacgcctccttcaacaacaggcaagatctggcgaaaatccccacccagcacaactaccataccaccaaaaggaattgatgcagctgaatgatcatcttcagaaagaatatcacgcaatgttctatctaaagcctcaaaacatcgccggtgcgtcattagagcctcatcccatataataagagaagtggatttaataaggtctgctaacattgtaccacgctttatatggcaaattgttgtttcatcaatttctatcgggattttgaatcgtgaatgagcagtcctaccacccggcaaaagcaaagaggcaactccagatgatgcaacagcaagaacaagctttttttcagacctaaggtaggtaacaatacaattccagagaaatgttttcccagtaccaccaaagccagacacaaagtagaaagcaggtgattttgtcatgacactctgcacaatgcgttcatatgcatttcgctggtcagtattaagcttgctacataataacggagcattagcacacaaatcatctatatcataagacatttcatcatcgatcaatctatttgctgatccaaaggaaccatcgcaattcacagtaggtaaattaaaagatgacatagcaacaccattgcgaagaaaagcatgtgtaattcttgcagaaccatatttctaagttcattatcagggacagaatatgcagcattatttaagctttgttgcaaatcaaagagaatatcatcagacatcgcatgccaatgtttattgaaaaatgcagctccatcagcaataccacaatgaacaaccatgagcacaaagagcgatctgagttgcggcccggtcccccagctcacagcctcatcaaatgcaaatgaccactctctgtcatcaccaagcaaccctctagcagcacaagcctccttaaatgtatcgtatacgacatcattgtatgttctaatatctgcatagctcctagcgcctctcacatacataagcagcattctcatgaaatacccttcacctgcagaaggatggacatagtacattcggccgattttataaccatgccggctttctttccagctccttgaattttcttcccaagtcaatcgagtaggatactcgcagtatgttaagtcacgtccttttgggaacaaatcattagcaacaaaccattcagttaatgttgttttttttgtaagaatgcatttgaaaccaccgatgccaggtttgcgtctgatctaaagctaaccgtgttcatgtttggtaaatggcatgctaaacgctcaacaggagggttcctaaagtgaataacataccaaacaatctccaaatacattggttggcacataaatatcgacactcaatgaagtcagctatttcatctatcggtgctggcacagtaaaatcagaaccacgcatcttttttctagaacctgatgaaccagtatcatcaatcgcaacgactcagctttctttttttgatcctagaaaattttatattggcatgatcgggtccttttgttacatacttaaatagatacttgatcatctttgatttgttgcaccattcaacatttatatgagcctcaaatttacgcagcaatgacacattgtatggcacgaccgaacgattatcaagcttgataccatttttaagcacatgcgaaccattgtcacgccgcctataaacaacaaatcccttgtcatctactgatgtttcagagttaaaatcctttgggtattttttaaacaggatccatttctcatgcaagggcattttctattgctatcaccgcatgggccatgcatcataaattctttgaccaacaaataatcaagttcgttttcgttaggatcagggagttcagcactgatgtatgtgtcgacgatagatggtgttgcatcggtgcttggcgcatcacgccacaccagtatatggacgtgcgggaggcctctcttctgaaactccacgctgtaaagcactacaccatatggtaggaaaaccaaccgaacaaaattttttttcacaacaaaaaatgcaaaccaaagaaatagcaaaaaagggaactaaccagcacgcacacgcccaagggaacaccagacataatgtcagaaaccatttcatcaagtttcattttaaaaaccctggcctggttcgaactgcaacgcatcttcaatttcttgccactttggattgcaggtaaaagttgtaaaaatatcaggtgcgccataggcacggcaaatagccactacatcctgataattctggtacatgtatcgcctaccaccagtgaagcttgcaggaagtattcgttgcttacctacgctcgcaccatctaaggaacccttagcaactgcatctgtaattccttgcatgtgttcgcatctaagttcacgttgctggtcagctatgaatgttaatctaccctcttcaacacaagcataaccatctacttggccttgagaggataaacgaccgcaacataaataaggattaaattgatctcgacgataatggcagcagtaacagtaatgctcttgcatagaagcctttgttcgtatatcggtacgattcaagtctacccctcttaaatttataaccaagctgaaagccacgctcaccataaggaaacagaagtggatactgcaaggccatataagcaggatgtaagctagaaacatggagtgggccaggaatgctttggacaattatatcgcgctttgcattctccaacgaaaaatcacctacaattaacccagcaagttcatcggctgttggcaattcgtactgaacaggcccattctcatctgaaccgactattctaattgcgaactgctcatcaccattatcagctaaacgatctctagcaatcctgaattgcttaaccaaaggattacaattgtccagcatatctagcaattcagcagcaatctgaggatctaaatcacagtcttcgacttcttcattaagaagagcacgcatcctattctcgatctcgttttgagtgtcataataaatatatagttgagcaaactttagtggggtttcttcgctaggtaaaagtgagcctatacgatgatgtacttgaccatttattttaaagacataaggaccgccaccgcgatttaagctatcgtcaatatttgcacccattgaagtgaaagcaaacagcgaattgtactgccttatgtgctgcaaacaatgcctgcttcgagcatccccatcgaacttcaaaagcgaatttaaaggttctggtggttgtgcaaatggaggaacaaaaattttgccgcctttgcaacaaagactataagacatacggcgctgagttatagctgaatctctcttgcatcgttcttggtaccagaactgagcaccacacatgcggcactgagttatatccttcgacgtctctatatgcacatgcaggtcaaaaacatatctatatttagatataatgtcggtgcacgataaactaaggcatggaaaggggtaaaataaagtggaaataactttttaaaaatttgccgtaatcactatcaaacctattggaagacagggacgatatacgagaaagccttttacctacaggaaaaatcaacagacaacctgcaaataagagaggctgacagggacatatgaagggaagtaaaaaaaataccaagcataaagacctgcagccaccagtcg

SEQ ID NO: 68939 - DNA, 1532 bp, Oryza sativa
taaacataatggatgaacaattgattaacacacaaaataacagagagtaatgtatatacctccgttgatcaaataggatagcagagagtaatgtatatacaaaagaatgctgggagatataattaatatgctaataatcagacattttcaaggctagctttttacctgtactcttgccacgtgaacttgctgtgcaagctggcttagcctaatcctacttgacttcaactgttgaatgtaagcctgaacaataaagcagtgtatatatatactcatcaaacaaatagtatataaagccacattaaattttagcagaacttatcaacttgtgctcgtatgtgtccataaaacaaacatatgaaatgaaataatatataattcatgtttcaaatagccagcaccctaataatataagactcaccgcataatacataagacccatgtttcaaatagccagtaccatcataagataagactcatgtttcaaatagccaggaccatcataatatataattcacacctgagaccataaagaaattggaaatgcacatatgaaaagtgataatgtttcttgcattggtaggccggtcaaattcacaataaagccagtaaaaataactatgtccttcagcacataagtcccaaagaaagagccaaaaacaaccgcatcacaaagtcggtcagcacatttaatcgcgagctagcactccatgcatgcatgtagcaaaacaaataaagttgataacaaaagcacatatgacagcacttgcgtgaacaacatgtacatgtcatatacactaacattattgttaggatatatgtttgtacttttcgtaaagtattgtacgtttctgcaagcacatatatatacaaaaacacacacacacagtacatgcaggagagattcctttctgctagcttgaattaataagctgttgagtttcttggttgaccgactaaccttcttactaaggctacttttccttggtgcctctctattctgtgcaagcctcctcagtgtctgcagaatgtgcatatatatacacacacatattcacacaatcaagctgtcagtctcaaaaaaaaagtcataaaatatgcaggttatttcctgcagacagggatcgttcaacctcctaattacttttttatgcacttttgtgtgctgttgaagtgctgcggagggagatcatcaaatgtatcaaaggtatggctggatggatgattgactcactaaccttagggtctagtgtcctccttccttctctttctagatcattagatgttgctgcacccttcccactgttgcttccttccttctgcaaggcacatttttttggccccttcagaagacacacagaggaaaaaatatatatacatatatacagcatatatagccggatttctatccactgtctaaaaaatataatatgagagagagagagagagagagagatgaataccttaatgaggctattattcttgttatccttgacagagttaggcaagggaacaatcgatcaaataggatc

SEQ ID NO: 68940 - DNA, 9936 bp, Oryza sativa
ccagagaatcacatgcaaaaaggaacagaacacatttaatttgtctaggacagtaaactatacgaaggattgaattagacagtttcatttatataaactcgcatgtaacaggaataagggccaccataaatcaactcaagtggtggttttcaacatgaaacagtgggagaattaactatcaaatctgtagttcagtgacctaatgatcaggaatacccacctcttgatgcatgaaaagcccaatagtacaaccttatacttccctttggcttcttgcatttaccatcctgctgtaatgatagaaggggaaacattcagaacaacagtaaagcatatataccgtctttcatagtagtcatcatgtaacaatctacctctaataaatcaatttcctggtgaatacattcagataacaagtgcatcccctaaatcaaaagaaggattggaggataagatagttaagcaaaacaaatctgcaatcacaaggatttttttcacacctacataactattctaatctaatagttaattaaaataaataagcaagctgatgaggaaaccaagataattaactgtagaattcccagaggataatctagcatgttatggcaactctatgctgtacatgtgaccacactgaagcactacatgcactgatgatcttgcataatgcagtatcattttattaagtatgcacctgccctcagcgacctgatcactaacccaaaaaaataaaaagtaaggtggtaacaatattcaatatatcactgcttatttttcttgtcaaatatctgataactgctcagtaacatgacataggaatagctcaaatgttttagtgatcatattcctcatgcagagcgcccaaaatagatattttgagctgtgtactgaccctgaagctatataatctgcagatataactgtgcctcaatgccacttgttgcaactaaatgggcacccacatgattggaagtaatcagtgcctatcaacaaagataatgcaggtatgaggtgaatttacagttgtggttggcgagggcacccattgcggaagacaaagggaaaaaaattagactatctagggtagcaaaaatctagctaatgagaatctgattttcctaacctctgacttttaatttattttattgatttaacaactacaacttcttgaaatctgaataaaaaaactaaattatttaagagaacttcaaattctaggaaaagttgtagctgacaaaaatttccccaagcatgacaacctcatgaatctactccaaaatctctatgtagaattgtcatttaatatcagaagtttcaaaatagaaaataatatgtaatcttatgtttcaaagtgatctatagaatattcttttctaatgggttggaatcatataaaactcctataatttccataaaaatcggaatgggcataaatttttactcgctctgatctaaaatgtagttaatcttatcaaatttatggtactacgcatcaatattctacgacgaaggcagcatagttttacttctgtataaatattcaggagtatcgtgcccgcactctacttttcaatgtaatatcttcgataagctgacccatttcaactaccacctttattaaaacctaataaaataaacatttcacacaatgtggtgcatacttgcttcatacattgacttgtacttgtactgtctacaatatagttcatattagcccttaaaatgtaaccaatgaatccgaaaaccagaagttccagaagggtatacaagcgcacaatatcagactatcaactggaaaatagcaacgccatatttaaatataatcaaatataattgccctgaatccacaagatgctgtcagaaatcacaaataggataatatgacatgaatatgccaacatggcaacaactaaaaaagaaatggtagtttagtgctaccagccctctggacaaacgcattgtgtttagtgtttactcataagtccggaagataaacgaaagaacgagggcaacctgctcatcaccgggaatgtccgtgccaccatctcgtccctgcctcccttgacctccacatctcgcacaccgccgtcaccttgacaccgcaaagccacacgagtcaacaagccaaaacgtgattcgaacaccaaggaaaacgaccaatggggttgcagggagatgcgcttacggattcgaagaggctgggatcggaggcggggttggcggcggcggcggagtccctggatgcggcggagagggcgctgaggtagaagtcggacggagacctacctcgaacggcctcggaacttagggcggcgaagcggatcggatcggcggcgcacgccctcgccctcccccgggacgcccccgcggcgctcgctcgcacgcacgcactgctaggctaggatagggttcccctcgagctccagcagcaagcaagggcgagatgggagggagagagagcagctagcgcaagcgaggagagagaaggaggtggacgcggcggcggcggagctggacggggccgccggggcggaggccaacgcggccgccgcaacggtggtggacgcggcggaacaagggcgagatgggagggagagagagcagcgagcgcggccgcgccggagcgagaaggaggcggccgccgcggcgggggagctggatgcggccgccgcggcggaggtgaacgcggcggcggacgcggcggcgcgagggggaggcggcggcaacggcggcgtgagagggagagtgacggcgcaggacgagagggaggagtcgaggagaggcgggggaggtggctagggctggggttagtgcgcggaactttttcgaaaaagaccctcgactttctatttttacagaacgctcctatttcgcgtttgtcccctcctgcgcatgtaatatccggattttagaagggcccttacgcacaatatcgcctcaggggcaccgttcggcagggacctactcggaattacgaacaaaccgaagggctttctcgcaaaaaaaccaacccgggcactgtaggactagcttttcgctgacgtggcacgccccctcgctcgccactcatgccccgcataatatttcccgatatggaaaaatgatagcaaaatgttggttgtgccgtgcgcttcctcgtgcaggaaaatatcatatatccatttcggccgagattaaggagtttagcagatcgtttgtcttttgatattaattttgttagtcaccatcattttttttcttttgatattaattttgttagtcaccattgtatacttaggctcatccttgtgcaaagcaggtttcacaaggtttgattgagtgcgcgcgccaagaaacaccgtagttgagattttgctcaaagacctactttaattaagttagtaaaatctccttttgctctaaatcccaatgaacaaggaactcaacaacttgtaatttggtgcaaagaattctttatgtggaaacccatactcactcaggccacgcagcatcacacggtgagagggatgaactggacctgatgcattggagtgcaatcagggcagcagccatgttcgagtgacctatcacaaaggaggctggatcgtacgaggatgcaatggtgctagtaacaggatactgggatagaactgattgcggcgtaaccgtaaatccatgagtattttggatacgtgattacacgaacatgtggccctgcttgtgattggagggctcgtagcatcgactactccaaaaatcatacaattgttgtaaaatatatacccgaaccattatgtcgaggggattcctccggatcgatctcacattgataacgcgcccttttccacctatcggtagtttgagagaagtttcctagctacattctcatcagccaaatagtaattagtagctacaaatcaaatactccccaaacaagcaaagtctacatatgtcccaaaatataaaggattttaatccattatagaagggaggtagtaaaaactgaaacaaacacagttgtccttgtccatgaggctatgtgaaccactcattttgatgcggacatcactccttcgggaattgaccgaacaatttgacgtttagaatctgttccggcgctacgacgtcgtatttgggcttgtgggccgtgtatcatgttggaacccattagggttgcatcaagggttgtttgcacaaccctaaactctatatatcaatacccgtcgtcatctctagggtttgggtttagcaatttgattgtaattcaattcatgatgatcataagtagaaagttcatgttcttcagtcattgataaacaggacagtactcaacacaattaccacaaaatatacaaactccgaaatcaatactataattaagcaattgtttccttttaatatccttttcaaatctccaatccacaagaggtagatctatagggcatacgcgaacacatacttcacaagcaatacatttatcaaattcaaagtggattcgcccccagaaacgctccgatgtaattgatttttcataggggtagtgaatcgttataggtaaacgatttgtgtgggataaggtaattatgaaactttgaccaatgtaccttgctgtgcgtattgtttgttgaccataactcatgaacccagttaccatagggaacatattcgaaatatctatgaaaaaggtatgtttctttctcttgtttgagagaacttttgtgttgaaaatattcttactgttattgtattatcttattttatagtgaaacaagttgggaagaagttgttaataagagattgcccagggaaataggtaaaagaaatttccatccaagatttaataactaatccattctcatcctgggtaaagtccatcttattgtgatagaaatgaagagaaataaataagctttagttaatgtaataaagatactcattgtcatttctaaaattccaaccattttattcatttggaaaaatccaaaaaaggatatatagggaatagacaaattccacccgcctaagcagagaactgttacaaataaagaggaaactaataaatttaggtaagaaacaagataaaataaaccatatttgatagcagaatattcggtttgataacctgctactaattcttcctccgattctggtaaatcaaagggtaatctttcacattccgccaaagaagaaattagaaaaatcagaaaacctataggctgacgccaaagattccatcaaaaaaaccatattttgactgtgcttcaactatatcaactgtacttgaactgttggataatcatagtcgacgataacatcccagttcccaccgctattccaaaaccgtacatgaaaccttagtttcatacagctcctctatgatcaggaaaaaaggaaagtattgtttcatttcgttattatcttcttgggcgtagttagaattatctaagataaaatcgatttcaacgtcctaaattagaccaaaggaattctatctgctagaataataaaaaacgcttcggaattcatctcatcctttataatataatggtactttttctttgttcaacaataacttaatcttggaataaaacactcgttataacaattaataaacgaaaagagttgggtattagttcatgaagaattctgtatgaatatggataaacgatggaaagaataaataaagatcttttttttattgcattccatatcttttgtcctattcttctttccccgaggagtatttaaaaagaaaaaaggaataaagggttaattcgttcttgatagccatttccttaacaagtgaatgggaacatactctggatcggaatccgaagaaagtactacttgctcatttccaccaatttcaagtccttattatgattccttttatgaggaaaaatatctaatgctttagattccctcattactaatcctttatgtactttagtgtttctaatccctcactaacttttgatggattcccttatgattacaactttctgtatcaggaatctctattattgcccgcttcaagatatgatgactaatcaaaaaatctcaaccttggggtaaagaatttacaccgcttatgtttacttccattttttcttgtacataggaaatgagattttttctttttactacaaattaataagcagttttgtttcactcatatagctatctagtttaacttactaacctgaatatagaataagaaaaggaggataaatattcaatgaatttcagaggaaaaacatcctattttaacgaatcgcacgtagagatattgctagtacacaaaaagttaatgggatttcataactaatagattgagcggcagctcgtagaccacctgaaaaagaatatttattatttgagctatatcctgccataagaagaccaataggagcaatacttgaaatggcaatccataaaaaaacaccaatactaagatccgctaaaacaaagcgatatcccaaaggaataactaaaaaacttaataaaattgatatgactgctatagacggtccaatgctaaataagggaatatcccctcgggatggcaagatatcctctttaaaaagtagcttagttccatctgctatagcttgaagcagtcccagggggccagcatattcaggaccaatacgttgttgtatcgatgcggatatttctctttctaaccacacaattacgagtactattctattgtgattcccagtaagagggtcaaaatgggtagaatccatatcagtccatagacttcttttaataattccaagttcgaaaaagaattgatagcttctacatgtaccctgtctattatcatttcaacgatcaacttctcccataatgatatctatactacctaatatcgtcatgatatcagccaatttcattttttttactagctgaggaagaatttgcaaattaataaaaccgggtggacgaattttccatctccaggggaaaagactatcatctcctaccagataaattcctaattcaccttttagattaatctatcaagaatagtttcgccgctagatcggtttgtaagaccccaacttgtgagcttaatcattcatctgcaattttggttgtattctttcttgttcttgtttttgttcttcaattcataagcagggattagccttctcggcgaggtcaaccgggtttcggcactgttgataaccagaggagacgtggtgctgcgattgcggggctcaagaacgtgctcgttcaagaagccggatcgatttgtgtcatgactccaccaaatcgttgattatccgaacctttcgaaaaatcgggaacccttgtccacatcacatttcctcgtgaaaatcctgccaatctaagtacatatttatcgtgtagctacaaaagttgacatatcatctgttctagtaatataaacataaattgtaaggtatagatgccacactattaatatctagcacaccactctcccacaacttgttagggctcgtgttaagttgggctacaatttcactgttttaccatgccatctgaggtagggagacaaatctatactcaactctcctccctttgctagctgagcacaaatctaatgcgatattaatggtccgcttacatcgtcttactgtattcgctctaatacaactaagaatgatccgatagttgtatttttatatcggtaactggcaatggctattaccctgttgaagtcgctcaatgaggttagtcatgttctcttgccaataatacaagagccgaaatttagggcttagaaatatgatgattgctgtcatatttatgtaatattatgttgctgtactgtttttgatttcatataagagaaaatgttggaaaatagagaggaggatcaaaattagagaacttaggagtgaaagactattccagcttattcgtgagagtgatattgcttgtataagcgagctccgaatggacaggaggacatttcacattctatgtgacatgcttagagacgtcggagggatcggtagcttcattcttatatatactatctcaccatttaaagaatagaacaataggaaagttttttttaccgaaatggagagactgtaagtaggcatttcaatttatgactgctagctgttctgaagcttcatcaacttctacttaggccttgtttagttcgctaaaagaaaatttttggatgtcatatcggacgtttgaccgaatattggaaggggttttcggacacgaatgaaaaaactaatttcataactcgcctggaaaccgcgagacaaatttattaagcctaattaatccatcattagcacatgtaaattattgtggcactaatggctaataatggactaattaggctcaaaagatttgtctcgcgattttcatgcaaactatgcaattagtttttcattttatctatatttaatgctccatgcatatgtccaaagattcgatgtgacgtgtttgggaaaaaaaattggaaactaaacaaggccttaagaagccagaacctatacctgaggacaccaccgacgatagatggaagtatttcaatgcaacccattctaaaaaataaatcacatttcctttcaaaaaaaatcacatctcaccactattaattgtaccatattttattgatgtggtgttctagattgtagaattgcctaggtgcattggatggtacacacataaaagtaactgtcccaaccaggataaaaggaagatataggtcaagaaaaggagacattgttgcaaatgtattaggtgtttgtgcacccgatatgcagttcatttacttactacccagttgggagggttctgaacatgatggctgtgtccttcatgatgcaattcacaggtcggatgggcttcgtgtccctcaaggcgagttttttttccaataaatttattttgaagtgtgacactccacagcctgaattatactgatatttctttttttttaattttaaaggttgctatttttttagggaaacactgtaggggaagcccccatagtaaaattaattaaaatataaagaaatatttacaacaagttcaaccaacccaagagcagatgtctctctattacattcaatctatgaactaacaaagagagatcacttttaaaggttgctattactttgttgatgctggttatataaatgcaaatggttttttagccccttacggaggccaaagatatcatttaggtcgtttcacagcacttgaccgaccatgtagtgcagaggagtactttaacatgaggcacacaagtgctagaaatattatagagaggtcttttggaagactaaagggtcgttgagcgattttgaggtctccatcctattttcctatcaaaactcagtgttgaattataatggcatgtgctttattgcacaacttaattttgcaaaagatgtctagtgatccatttgaggatgaggatgagatactgtcggatatacttaagggagaactcgctgaacctgagtttatctcagctatttcgacatctgatgattggacgaattttcgcaacactcttgctcaagggatgtataatagctatagggctcattgaggtttgtgttttaaatggaatttctaattgattgcaaatcagaactaaaaacaaatgttggtacaactatggacgctcactgatgttagttttctgttgaatttctaatattgcagttatggagcatcttggaagctcaagcattgtgcgtgggagaggcaataacaagaggatttggacgtacttcgaggatgaggaactgatcaaggcactgttcgagattgctttagatccaagctggaaatcagaagggggtttcaaaaatggatactgccaagttctagagaacgtgcttgctaagaagttgccaaattctggccttactgctgttccgcacatcgagtcgagagtaagacactttaggaccaagt

SEQ ID NO: 68941 - DNA, 4042 bp, Oryza sativa
gcggatcatcgattcagctgcacctcggcggagcatcgattcaactgcttcaagctctaagaagcggaagaaagacagcaacaaactgaaacataccttgtcaagtgacccttttatggatgtctttgccaatgttcaaggtgatctgagggatgttacaaagcatgtgggagcaatggtggcatctatgcaacatgaagctgagatccaagagaaggcaatggttgaggaggacccactacaaaaaattcagaatgaagctattcttgagtgtcaaaagcttggattgactggtactgaagttgtcaatgatgcagctgcttttgtaaaagtgccggctcaaatgagtatgcttcttgctcttccagaatctctcaggagggagtacgtcctgaaaatacttgctggtaattccctatacacatttgcatgttgtattacatactttattttgaggtcattaattgtaagcatattgcattttactactttagcatttcatatatgcattcactgtgaacaaattcgcatcaaataccttttattgccttatatactatttgtctgaaaccatgaacaattataatgcatgtatgggtccagctgtccagctcaatgccataggaattaacctaaggaggcataattcactccaaactactcctagctggagtatgtgcctatgcctttcttgcttgcttgcacctataaaaaagtggttcaagaaaacaaagcttttctaccaattccttgtacatattctgtgatcaaagtactgtcctatttttaagacaaaagtactaccctagcttatttgttaactaatctggtagtttcactcatgtcaattgttcatccaatcctttatcgattgaattttgaaggtgtgccattgattatattttgcaaaatattatctcttgtcttgaattcttgctgtcaaaatttgcatccaaatagaagtgacagtgttgtgcttgtcactgcatttgcatccaaacagaagtctccatattatgtattttctcgttgtgtatcagtttcagaatttgatttctcaaccgacacatgttttgcttgcacctgttagtctgttacctggctgcctaaccaaacagcgcgaatgaattggtatccgttacagcaactatccagacaaagcacgtaatcggttaccggcggaagcattcccaattacgtttacgttaacattattgaaccaaacaccaccatgttctcttgccaataatacaagagccgaagagttgccaaatgttactctgctatttgcaagttccgcaagggaccgcataactgcaaataagcctggagctcaatgcttacatggcctgaaaaggtggccatactctgaagaatgattataatgtatacatatctatgtgctgagaaatataaaaaactataggacgagaacagctaaaatacaacagaaaaaagaacatcttgaggccaaaggaagcactgagctttacaggaggctcgccatccttgctaatagttggtcaagattttatctggtgatacaccatctgctacaagggctgatgtgatctcctgtgaagcagaatacatcatcatcatcatatacaattaatgaacgggaataatggaactcatcagattttagttaacgatagaacttaatgagataactcgtaccaaactgccatccaaaagaacaagacaacaaagaccgataaattcatctgtacaatcgaaaatccgtacagtgcacgggcaaaccgcaaactaatttgtaactttgcaccacttgcacccatgtattggtagccaagagcaggctggccagtgttgtgtgttgaaccaaacaaactcatcgacaatgaaatcgacatcgcagtgctggccatcgtgttgaaacaccatggtggtttgagcctaccacagctgctgcaatctccaccagaaacttatcatgctattgaagatggccacaacccaagcaaaaccagcttcatagacatgaaggactagcaggtccttaccatagatgacccgaaatggagtggaatgcttagctgtctagaaatgagttgcaacgaatcttagcacagggcattcagtgaactcactgtgggccgatcatcagcgacgcagtaaaggtacatctgccaatgggattggggataaaaggcaaagctcatgtgtagcatgacatataccaactggaagagatcctcttaaaaggcactggtgaagatgggatcccttttgctcataatagataacgggatactctgtagctggacgatcgcattggacaaggcccttgcgatggagcttgctatattgggatggtcaagggcgatgaatcgctactgtgtagtttggatgatgttgtacaagaaagcacttggggcggagctatattaggacgttcaagggcaatgatgtgagcgcacttcaagaaccagtccttgacggtaggacggcatacataacattcacctttcggagaacctcaaaaaggggatatgcacctacattagagatgactcctgaaggggttgcatgagactaaaggggtggaggtgttctatattattgttttgccacatgatattcgcctatacaaaagtcctataacaaatgtcgcatgctggcagtggcgtatctaggtttttctatgggtggtccaaccaatatatatttttttaaaaaaccctaaatataacgaagctaggagtataaattgatcaaatgtgcatcaaaatgcattaataagggtgctttttttctttttcccccaaaaaaattcatttttgtatatatatgcattgggctaggattttttttaggtggtcccgggaccacccttggatctgcctgtgcatggtggacacatgcaaaagtgcaactgtagttggtgcaaggtcttttgggtgtcctcgtcataccatggtgtcggccaacaagttagcgaaattatcaatcgactggcacatggaactttccacggtgccgtaggagaccatcgaccgtgctctaatattacatgttccttgtatcacaatattgcatcgaggcctgcctatactctaccctaaaagcataacagcttacctaattatttggtgggatcgtggagaggcattgatcctagatgtacttcaagctaagaggtaggtgaaaactatggaaaacatcattgttgcttgatgtgtgacaattctcacatcataggtcaacgaggagacatcgagatcaagtcacacaacaatgctagattcaaacagttaccaaatgtgcatacgggctccttttcaggcccataagtacttggtggaaagctcttggagtcctctttccaacagatttaacatcatctctatattccatcaaagttggccacaattaaagaaagatggtgttgtgccacctgtcatgagcctttatgcttataattttgtgtggagactaggacctcggtccaagtggggcccatgtggagtgcccctcaatcatgtggagcacaaccctacacaccccaaggtcatcctcccatctccttaaatagctaggtaaccttcagtatttctcaggttttcttatattaaagttagtcattgctactttgccttgcagttgcacgtgtctgccagaccgcctaattactcgtcttcggaaccacaccttatcgagtgttcgatttatcgtgagcttgaattcctatttgtattatcaaattactttaatcttgttcttccttgtttcttcgatttacttgcagaaataaggttgatctgaccaggtaagatcaacaacagatggagaggtgtatagatcgctaaggtgcaatacaacgtctagtacaattgtagtcgggtcatcaacttctctcccaaattataggatcatcaactaacaaaaaaattggaccatccttgctcatatcgattggaattacagagttgtgagcgtttcactactaaagacaaccttaataagttggatcaactctcactcttaggacaataactttgggttaaggtatgtctgc

SEQ ID NO: 68942 - DNA, 13915 bp, Oryza sativa
  unsure (1)..(13915): unsure at all n locations
atacatgtgccacattttaaacaactatacattgacgatgtcgcatcctacaagaggaattgtcacccttttgctaagccaggtgcttgtcacccaattgttattagtgatgccaagcttacacgcattgtctcatgcacatagttgtgtgagttgtagaccatgagtgcaacacattggaggtgcccttgatagagactagcaactattctacttgtgtggatgatgataacattaagtgatacctagatgtcctcggttggcttacaaggctcttccaactctctatagtacagcaccatgggcgatgtagtggtggatgagaccaaaattcctaggcaattctaacatagccgcctgggttcgattggtcattttcttgggttaattagatccatgccatcacaaatttcacgatttagaaaaataccattactattcacctatttttaactatgccactgcaatacatctgaaatcggatccatgccactctatacaactcaaacatgtttgaaacgtatttttgctactgtattttcgtagggaccaaaatacccctcgtcctatccccataggacccacctgtcaagttcatcttcctccacccttcccaatcttcctcttcccactctctccacaagctcttccgatggtttgcagggacggctcctgatagtggaggcagtgacaatagtagcatccgacgaagccgcgacctgaattgtgctctccgccaggctcgaggtgcagtggaaacgaagctccaaccagcggtatcttctgaagaaaacttaaaaaataataacggtagcttctgaagaaaactagaaaactgaaaaaatattaaggggaaagggacaaatcagatgacgggagctagcaaatctcctctcctgtccagggtgcttctgcaaaggcagacctcctcccatagcggccaggtcggtcagcttgtcggcctgatcctgctactactctcagccatggctccggcagcgcgcgcggacaagcctgcgaggggctggctggcagtgacggtcgaggtggacgagtcctccgctgtgtactacccccatgggtatggcttatccaaagaagagaggcagagtggaggaagatgatggatctgacatgtgggtcccatgtgagaaatgggaccaggggtattttggtcactatgaaaatacaatagcaaaagaacatttcaaaacgggcctgaagtgtacaaagtggcatgaatccaattttatatgtattgcaatggtatggctataaataggtaaatagtagtggtatttttccaaaccgtgaaatttgctatggcatgaatttaattaaccccattttctttgggtgagttgattggaccaagacataaggccttacattgggggtgagggtcgctagcgccctgttagggcattgctgtaagcattgaaggtggctcattggacgcagttggcttggcaactggtttggctgtgatgtcctctatcaaacgccattggaaagtgtgagtgaggcacatggccacatggaggttgtttggcatattcctccttaaacctcttaggtggagtaattccaatttgccaacagattgttacacattcgtggtccatgtgcatattatctaaaaagtgaggtcatgaaggactcctcatcacgctcaagcatatggtaacattattgtgctactccggagaagtggtgcaccgtggtgcaaccaaccacaaccctactctgaaaacaaatgttcacatcattaacacaggagaaggtcgtacttacgttagaaacttaagctatctgcgtagtgctgctttcttaaccaacaatactaacttgaactagatagaactaagggtggtagtttctccattgggtctagggcctaggcaattttctcacccacgagttgatcggggtgaggcacttactgcttccgaggggcggaggcgggttatatgtttcatccacggtgatcggcaaggccccgtatacataggagatgagaaaatacatactccacaaaagcccatcaagaaaaccctatcccgttatgtcaatctctcggtccccacaaatccatcccacaccaccatcgcagacctccccttcgacatcgtgtcccttgatctgcactagaacgcatgtagccaaaccactatgctacgttcgtcgttgcggacctatcccttgaccttgactctgcatcccgatgaagtagcggccagggctcctacgacactgcagctggcctcaacctcatattcctctatcctaaagcgtggtggtcgacggtggctgatggctggccttgacctcctattcctctgatgtgtcgcttcatcttccacttccgtcctcagagtggccagggactgatttcgccccactcttcaccctggggctggggttgttcttgtccaatccacacccgccccactccgttgccaacccctagttacatctattgtcaccaaagaagatgacatcaacttaccacaaatcgttttggacaatgacatggtctccaaaaaataactttaaccattgttttctattataatatatataaaaatatcaacaaatatttagctttgcttctcaataaataatattataattattatagttgaactaaattcaatcttcttaaaattttacttaccacatgcacattgatggtataatacttcctctatttcacaatataagacattttgggttttgaatagattcatgcatggatctaagtatgtgcttcatatatgtctaaattcataaggatgttagtaaatatagacgagtgatggagagaccaaaacatcttacattgtggaatggagagtagcattttgtacccaaatctgaattttatattgattaaacgtatgtattggacacttcatgatgtggattatactccaattcataagtgtgcaaactaacattactagctcctgactgcaacttgcagagttcaataaaatttcagggtgaatcaaattagctttatctcaagatgtaatacagatctgagcacacaaaataaagtgcaagagctagtggtggtttgatatagctatatttcttgcaacagacagcattgggtttatcacaattatgataagaatctaggaactacactaagcgcagggcaacatttgattgctacaaagtgcagggcaacatttgattgctacagtaagtgtaaattatttttctttttttgggaacaaatagctatcggcctagaaaaaaaaggttcacttttggagtatttactgcacagtattgaattatatccttaaggtttcagctctttggccagaagaaccaaacataatatttgtaacctgtagcacacataacaataggaatgtgcaaaagtaaaaaaaaaaaagagaggataaacatgcctcagacatttgtttttgtccacagagcactgccccagtagaaaaatgatttgctatgttctgggctttcaagaaagcatcctggaaaatgaaaatgatatgatataaggttgtatgtacctatgaacatataacaagattatagtaatgttggagttttcatatattacctgaacatatccccgttctcctttccaactatcatctgctcgtgacaataccggtattattttaagcccagttgactcccagtttgtaaacctatcctgccagagagaaaaggtttatgtgaagatattgtttacatagagcagaatgaaggaaagttccaagtctcaacctgatatgccattgtttggagatttctggcaccgtaataaagtcgtacatcagctctttgatccgcagcaaaaccaaactcaataagtgaccgaaccggactgcatgattaacatacaaattaacctgggtaggattccatcaaaaggatgccagactatacttgatcaccaaaaccagacagtcagcaacaatatggaatcagactaaattatcgtaaaagatgtatcagcattcaagacatatttagccctgtctttcctatccagcaaataagataacagcatgctgatctcccttagaagcaaggaaaccttttcctgctcttgggtagttacaaacaaaatacacgtccttgacaaacgccaactaacatcatgtacatgttagtgaaactatcatgaaactccaacatctttttttcgattgccctattgctaggttgatctggaacattgtcatgtgtgcttttaatttgggacctatcctgaacagtaatcagttatttggcacatggctttctgcgtttgggaaaaaacttaaaaatctggtagtcactggggtggctgcagtgttttgggctatttggaaaacaaggaacaaaaagcttgttttgacaaaaaatttcctaatgatccaactgatgtagttttctttgtttgccattggattgaatcttgggttcctttgcagaaagtggaggtagatcaaagaaggctgctattgggggccaaactcataagacaggtagcaaatgagatcttcaattccaagtatggattgagaggaggcgcaagaaggattggactgtgaagtcagcttagatttgaagacctgtggtggctgctgccttgctatggtctttggattcttaggtgtcttagctttactttaaaactgcagggagttgagtcctttgtgtcataggggagattttggttggagtcttctggaaaaccgtattttggatgtagtttcctcagaaaactagcttgctggtagtccttgtttcctttgtatgaaagaactctgtagtatgctcatttctagtaatggaaatgggggcttcatacccttggtcaaaaaaaaaaataaaatcatgtacatgtccttgccaaacgctaactaagtttgctttgatggtgaggaaagggaactaaacattctcacaatattctaacaaatgtgaagcaatagttcattttaggtccagtaaattggtacaaccattcaaaaacatataggagcagaaagagaaagcagaacccttactactatagtacaaatgcatttatctatttaactttatgcattgttctctttactactacagtacaaatgcatttttctatttaatctctactattataaaaattgaagatgtttatgccggtcctttggtatgtcatccgtgtttgagtcggtttttaagttcgttcgcttttagaaatacagaaggagtcgtataagaaatctctttaaaaaaactcgcatgctaactaagacgatcgaactcctaattgcagctcatgattttgtaaaacaatatccaagcgaattcccacaggcagctatgagacattaacattggcatctactccctccttcccaaattgatcatcacataatggaattcaaaatttctcaaattgatcatcatataaccgcatgacacagatttcatcagaatacaattaatacaacatgggagaatgtgtgcatgctaaggtgtaagagcaggtacaataacaggctataagccagctataaacatattttaatgagataaaggaagagagagaagagcagcgggctacagatctgtagccagctgcagcacagactccaagacatacagtgtgtaggatcatgtattaatagtgttgtaagcaactattgtatgaattggctattacattggctataaatgatatggagctagtagttagctatactattaaacttgctctaactggaatgatgttttaatcgatgcatgcattgtgggagaatgtgttcatgatgacttgattgatgtgatttaaattatcattggtcttgatgcataaaatatgatgatcaatttgggaaggagggagtaatgtttttctttaattttctttttctttgctttactttatgtttgcctctatggcttcttacgaataagagactactttgaatcttcaatactcttaaaatttcacatgaacagatattaaactggcaaattagtttaatgttcggttttacatgctttatatgtaaaaactattttttttttacttttcctaatcaatttcgagtagtgacatatgatataagttttcccttgaagaaaaagtattgctatattataagcttagctttcacagaatacgatatcttccatgataactgccatcgccattttgggcccatgggccatgagacaaagacatgaaaatcatgattcttttaaacccttgattacatgatattaagttagcttaagtcctactttcttacatgtttccctacaagaatatttggggctaaatggggggtgatggccaagcagatcaacaaaaccaagagtgctgattaacctatacaaatttcgtactaaaaattgagaaagccaaaggaaattgcccactatttggcttattaaaaaaattggcatgcgaaaggaaattagtaatactaagccaaaactagccaatctgcagaccattcgatgggaaacaaacagctcacaatcttttgctgcccaatcagcatgctggggcagctgggctgacatggaaggtggtgattggatgcatgaaatatgctattggtttatttagtactaatgcttaaaagatcatatattctaaactaaaagtatttattttgtaatccatttaggaaaaatctatttctcataacttagcccagtcagtccagtcatagaaaattcacttttttttacatagagagtaatagaaggaaggtagaaccaccaattcgtcatagtcatatacatattggcattttaccttgctcaagccaaaggctacccgctaccctacctatttgccaaaacagcatgctatctacccaatccttcaatgccaaacattttgtcatgcccagatatcggttgtaaccaaatcttgatatggtttatcaaggctagcaatcaaacagtcaacacaactaaggtttggctatttcttccgcctagccaccgctgcaaattttggcatgactactgaccagggatggtggccagagggtgtgtgccccaacaggcccaggatcacatgctgtttaacaagccatctcaacttgtgtcacattgcatatgctgtaaggcaaagtgcgttgcctcaccatactgctgtagtaaacatgccatttaaataaaagtatgtaatgcagtatagcgtaattgctaatcttcgtacacataccatccatttctcatgttaatttttcatataggtaattcttttgtgatctatttcatctgtaaggaatgtttgatccttagcaaaacaaaaacaaaaggcatttttttaggaaagaaccaaaggtgaggtactaattttctaggcttgatttatatgcataagtaatagataacacaattatgtcagcacctacggttattattagagatactgttgctcgacgatactgttattttctcatcttgcattcttccgctaagtcagcctttatttattttagcaaactggattatagtaagtaaatgagtcgtccgattaatgagatacatcaaaagaaacaagttgcattacagtgacaacatgttcaaaattactgaagaacattgcgatatctctaagcttatacatatgaaatttgttatagctcagaactattttaaaagcttcactatgtgtaaactgcaaaatgctactaataaagcaatatgtgtgacaactgactattgcagtgttaaccacattaaactcagctcagcatatatacaaaaacaagcattcatcagagagagaagcaatcacctgatcccggtccctgtagcaaagaggagcacagtttgcgcctcatcgggcggatttatcctgctgatggggaacccattacccattatcgcgccaagctccagcacgtccccgtcgcggagcccacacagcttctccgccgtggtaccaggtacggtcttgaccaagaactcgaacgcggcacccccaggcggcgaggcgatggccatgaacgccggtttgagctcatcctcgccggggacgcggattaggagatactgccccggcgtggtgtaggatgcggcgaggtcggtagcgtcggagaggtccacggagaagtggacgagcgagccgtcggcggtggctgggccgaaggaggagacgggggcgggggtccagacggccgcatcctgctggacagcggcgaggcgacgggagcgcattcggcgccggaggaagggcagcgagcccattgcgggcacggcgaaggcatgaggggagggaggagggggagggttgtgacggtgttggcgaccgcagccatggcgaccggtggcggtgggattcttgttgggagcaccctggtcgactggggatttgaggcgccgataaatctggaggggatagaatcatagaaatatagaatgatgaggtggggttcactggatggaaacacaaagataacgggtaggagccaattggttgtttggaacacgtggattatggggggggggggggggggggtctatttgaaaccgaattttttggtacagtgtttcaggttacagtacgttttgaatttggtcaaagtcaaactattttaaattttactacttttatagaaaaaaaatagtaatatttttaactcaagataaatttattataaaaatttattcaattgtatatttaataaaactatattgatgttataaatatataacatcccgaaaattaattattttctaattatgcatcatgttgattcttatattcttaataacctcctaaaccaaggacattataattataattagagggaactcctaaaactaagtcgcataaaacctctccttttatttaatttctttcgtatttttcatttaactagcaaaaatacccgtgcgttgcaatgggtaaaaacattctaatgaaaatatacgtttttcatgcataatcatgtcaatgacaatgttttattttaatgagcggcttgttttttataaacaatgtttttttcttgcgagattttctcaaaccatttttcagaaatggcgtatttctttctaacagttttttcctagcattttttttgctttttttactgacaaagaaaaccatatttttctcctttttttgcttttcttttctcgtttgtttttttgcctgttttctcgcacgtttttttgcttgttttttttcgaatgttctttttttcttttttctaatacaggagaatatatgacaaaataaaagccgtgtagtagatggcaaaaaatcgatgaatcctatccgactcaagtgtccatcaatttagcttttttctgatagtttttttagagcgatttattttttaatagacggtattttttcttgcgtggttttttaaaaccattttttagaaatggcatgttttttctgacagtttttcctcgcatgtttttttaaaatttttttaccgacgatggaaataatttttctcgcgtgtttttttatttttttattgaagatggaaaacctttttagcgtgtttttttgagctttttctgacttttgcctcacgcgtttttttaacctttttttctcgtgtattttctctttttttaatagttagattagattagagatagagaagagatatatacttgttagaaataggattttttccgccctttccaaattttttttcgcgtgcattttttattttatatgaaccagttttttattttttaagaaccatttttttcgccactttcttagggaatcggacgaacttttttagatgttttttcggatttttttcgcctttataggaattagacttttttttcctgtttttaaaggaatcggttctagccttttttttcaccacttttttttgccttttatatgaatcagatttttttttatttggatctacagtttttttggccacttaggggaaaaaaacttttgttatcgttgtttttctttattttcttttttgtgcggcttttctttttctttttatgcacctttctgcctttattttctctcttttattatttttttaacaaaaacgacctcaaataccttattgcaagattatagggactcaaatgtaaatataaaaattatagagactcaaatgcaaaagtacaaacccaaaaattaaaatcatataaaaatgaaatgatctcgacctgtaggttctattttttaaacagattttcagttcggctcatcaatttttttcaccaatccagagtcggactttttttcgtttctaaaagggaatggatataggagtcggacttttttattttttatttttcgctattgtttttgttttgacgggagtcggactttttttattttttttcgctattatttttgtttcgacgatgaagaaagcatctcttattttttttaagcagtagagaaatatatttggttaaattgaggtatttcttgatggaatcctacattaaaccttctttcgactaaaattcttttattgaaatttagtttgaaaaccctttctacttttatgaattatggtccaagaaaatcctccaattccaattttgaattaattgttgacccatcctttgattctaaacctatccttatccaaattcctcctttttatctagtcgccaatttaatttatgtggcttaatttcctcctcggttcaagaataacagtattataaatatcagaatgatttctcttgtgctaagaagaatagatttttattttattcctctcttccaaattaattccctattagccacaaatatttcttcaaatattcatactaccagtttccatctctcaaaattattgcactcaaataattaggaaatctctcttttgaaaactatttctaaaaataagttcatctcaaaagttagccacctaaatttcttccaaatattaatttggattcaaatttcatccttcaaatctaattcgaaaatacaaaaagattttttattcactgtgggccaaaaaatttcaatctagcccattccttttccccttcgcttggcccagagggcccaagaggcaggcgcctctctccctcctttgtgagcgcgcgtggtgcatgcaaacacgccgctgccttttcgccgagccgacgcgccatcgctgtgcggccttgttgctccttctccaccgctactgccaccgacgtcagccgccacctcacctcgctgacgtcaaccgctagccgaaccgactccatcgtccaatcggagacagagccgccgccgtgctcctcttctccacgccgccgtcgccatgtcgtccttctcctcctcctttacgaaccaacctctcgctgcctataaatagaaggcgagccctccccttttctccacacatcaacaaagcctcaagctcttcctctctctctctccccaccatggcaaccaccaccggccgccgtcgatctccttcaccagagacacgccggccaaaccctcgcgccataagctttgcctcgacgaggcaaatccattccccaaattcatctaaattcaaaatctacattttgatactaaatttactattttaatattttatttgaatatccaatttaaacatatatttacctttcaaatatttccctttatcccaaaatacctattagctactaaaaagccgccggttggaactttacgtcttccatggggacgttcatgcggtctacgggtcccgatgtcagatcattggttgtaaagcccggtagaaccaaacccaaggtttaagtgctgctcttggcaccccacgccttgatgcgtacagcggtcagagcttcactattcccttgacctccaccgcacgctgcacagttagctctcgggctctgtgtgatcctagccactccgccgccacccacggttgtcggagtaacacttccgccccgctaaacctgcaccaacctcctattcctctagccgatatgctatctgttgacaccaactagagaaaataccaaacctagtcgttatactgcccaactctagcaacgactagtaaacaaccaaaccctagccgatatgcttccctactccacaatcggcttaaatataaccaaaccccagacactatactacctaaacctatcaccagctaatactagccatatgcctacttagccagttcaattacctaatatactctgtatctccaaacaaccaaagcccatacataaaatgtaagcaacaatagttgcttaatcctctatccaacctagcctacaaccctttagaacctacatatgaaatataatccctatatcctatagaagagatagattataccctaaaccctagccctcctagttgtttatcgttctcttgttattttatggcttttattgaatttggttcttcctcttctttagtagaatctattatattttggatgacaacctgtgatatttcgaggatcggataatcaggttgcttatctcggatttatttgcgttggagcaaggcaagttattattccccccctttgagcataattgttgtcgtgacctaagggcatggacaaagttgggagatagaagggaaaatgtaatttcccgtctatcctaagagtgagctcaaaagacaaataccaaagtgaatgaatgtgctttttctatattcatctcctcccgtgcttacaggatcttggttggcttaaatagtgctcaaccgcatgtccaagatttacaagtttgtcattacaggcttacatgaagttaccattttacccctataaagtttatgacctataggggcattttggtacattctggtggtccctaaatgacatctggtgctagctggtgagagtggttgaggtggtccccatggtactttcccaaattagaccatttgctcaatggcacttttcctcaacttcatatgctcgagtgagatcacccgtgctaaggctcgaacacattctcccacctttcaggctccttgtcaccttaacctgcctgaaacacagcttcattaattagtgatgttagtttgagcaagtaactttactcgaatgctttttccttgggacagatcctttagggtgaatacatatatattcccatacctaaaactactttttgggtggaaacttcattcgagtcaataaataactcgaacacattttccttcttgacatatgttttcggccgggcatgggggatggtgtttaccacctgctacaacaagcccctcacgggtaagggcgaagtgttttcggccgaaaccgtgctagatcaaaaatgcaggggagtaaccgccgtccccctgttcggtcgaaaacatcattgagatagctgcggtggaactccgcatggcggggaatttgcatatttccatatcgctcggcactacacaaagcagaattctcagtttgaatgcatcaacttcatcgtcgcaattactttttagttttcgagctcgaatttgggtaaatgctttagagctttttttatgtcgtgttttcgagctaaggcaaaaaattgctcgaaaaccgccgtccccctaacgtttcaaaggagtgacgaggtcgaacgtgtttccctcgtcgcaattactttttagttttctagctcgaatttgggtaaatgctttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 68943 - DNA, 17985 bp, Oryza sativa
  unsure (1)..(17985): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgttttgcttatccatgaaggtctgcctgatgaattcaaatccatgtttgtggaacgaaagaggatttgtgaagatctcatgatctaggggatattgatcagtaaggctgctttcatgtacaccaatgctatactgcttgtaacgcaggcccatttgttccgctgggttgccgaaatcaattcttgatatccagtctagtccaccccatggcacaatctgaatcaatgtagcgttttgtggcaagaacacacagttggtgagtccagcaccatggacacccatcatcacatcaacagagttgacaaccttgccaaaatgggagagatcagagctcacattggcctcttcaaccaccacctcgtaacctatctcctcagccatcgccactatctcgttaagattgagaaacattcttgtcctctgcctggatataatgagcagtcttggcttggctttgggaatctcaccaagcgcagttacaaaatccctaggcagtgagtaggtcctgcgcatgaacctattaaaatccaccattgagtagttatgtggagcttttgatgagtcaattgtgaactccatgtaagcatgaaggccaacaattgcatgcttgaagcaatgcacttgatcgtcattgttgaagtcaatcaaggggtacttggatagcttatcaaacaccaccttatacttccttgtccaccaaatagccatgtctgtgattaggaattgaacttcgccattgaattcgcttgcggttgtgaaaagagggacaagcacgtcggtgaagtcatggaatagatttccagtgtatccagtcagagcaaagaccactgcaggcacattgtgatacttgctacactcaggtgccactttgcttgatttcacggttatctctgtaatatggccgaggcagagctcgtcacctttacgagggtaaggcttaactttccatatctcctctctctttgaactggcaggttccatgtacatgacagaacttgcattgggatgaatcctaatgttgccccgcatctcacagacatttgctctgaagtttgagaaatcacatagtggtttcttgttccactcctcattatcagtttctgcaatagagtatcatcaatgaaagagcagaaacaaaagactgaatgaagcataatcagtctaatttaaggttcaatctagtagttaggaatctgaagtgtatgatgccattggtctaggataccaaaatagggttttgcatctatggccaaaatcactaaattcagatggtccattttcctgtcggcatttattgaaatctaaaatcctaacctggttccacattgtctcccttgtccgcgtccatctcaaattcatatttttcattcggtttgccatctgcagacaaagtagggccatcatacccaccaagaacttgtaagcaccagcttaacaagtaccaaaacagctagtactacaagtaaagtccaagaaacacaagaagaaacagcatctactaccttcttgcttgccattgtcagtgtcttcagcatcacggatggtataattggaaacagtcgggagggtcaccttgctatgctgtgtgtgcccctcttcctcgccgttcttattatcctcttcgcctccaccacctgcacatcccaccaccaaagtactcatacataaagcaagcatcaattgatggcgcccaaatctctcttgacctctcaagaccccgtgaatcaaagcatccagagacagagctagacaaggaaattattgacggattggaaggtgacggctcacctaacacctcagatgcagtggccgcctcctcgttcttgccttgctcgggctcactactgagtagcctcttctcctcctcactagtccctatcatcatatataacgaaaaggtcagtacgctaggcccaagatttgctgactgcagcaaggcggcaattagctctggagcttttcacctttggcggtggcgtcctcggcgccttcgtcttcgtccaccaccttgggatcctcggcggcggggaaggtatcggcggatctcctggagtcggcgtggatccgctggcggatcaggagcgagcgcggcgcatgatccaccgacagccggccgttcactgcgaactcaaagaaacgagtgaggcgcttggtgttaccatcgatccaaggatccaagaagaaaaagaagaagaagatgatgaagaagcggcgacggcatggcgtacggttgaagaggagggcgtcgggcttggagatgacgacgaaggtgagtgtgacgaggaagaagccgatgacgaggacgagcaggcgcagccgccgcgactcctgccggaggctccgcaccagcttggcgcgctcgacgggcttcatctccccctcctaaatctcctcgctcttcttgccggccgctccactcgaccgacctcgcgcccgccgctgactttctcctatcccgcgaggagagaccggccgagagaggcggaatggggtttgggatcagcgtggttgcgagaataagagggatagcaatctgcaatcctgggctggctggatatgtgcgtgctagcttccttcctttccttgcctctttcgtcagctttccagtattcctcttcctctgcgctctcctcccagtcccagcactagcggtctctcagtatgtgtttggcactttgggttaaaacagtgatgatgggaggtggggttttattcttgcatagtttacccgttccaaacaaacggcggcttaggctcagttttacataacttttttccaactcacctcttgcatttttagcgcacacttcccaagctatttttctaaaataaattcctataaaaaattgcttaaaaattatattaatatatttttaagttttgttagctaatacttaatttatcacatgttaatccatccgtatataggggagctccaaaataatagccttaatcagtgtgaacactctcgttgcaggagaccggaaagcagctgagaggacatccattgataaggcaagacattactacaggagtatcatgatatcatgtatgataaagtcataggtctcaaatcagtttttttcatagtgttcagtagttctaaagctgtttcagtttttgcatgtcaacccatattatttcctattttagtcctcatattttacatcaaacatcccgaaaattagaaaaagaaatataaatacaccctcccatcctcgtccggtcatccccgtcacgctttctccaaatgtcggcacgtagctctctctctccccctccgccgctctcctcctaccaccagcacaactctccctttcctcctccgccgttctcctcccaccgttggtgcaaccctccctcttcccttccaccgctctccctccaccttcctcgtcggaatgctagcgccgcctcatccttgccagatctagcccgtggttcgtcgagtctggcctcggacggcggcgatggctgcgactccactccactaagctcgccagatccaacctggggctcgccggatctggccttgggaggcagcgacgacggctcgacgacatcggtgcagcaacttgactacggcggcagaggcaatgggacctcccttcacccgcttcctctacctcgccgaattcggctgaatctcgacagtgaaggcgaggatgttataaaactggcctgaaatcaccatcaacaaccaaacgcggaagaaacgccataggagatccaaacacgatgatgacacgaggcacgatatttgttaacgaggttcagctgaagcctacatacccgggacactgattgtgggtgctcatctgcgatccagcatactacaatgtatcagagttacaatgactcacgcccggacgtcgccggcagccacaccatctcgctgtgctaagtcaccatatgcggttacaacaggttcgtccctctatttaagagagatcctatgataaagtccgactctcactctatttctaatacctattacaactccaattcctaaactgtaatcgacattgtacacatattcaacataaactctaacaaactccacgttgccctccatgctgcttgcctgaccccaaccccgatgcaccccatctccgggagccacatcgtagtgcctggtaacacctctaaccgccaagagctcgaaatctctgctacgactcctgaagaaatcctactcgatctcctccctagccgcacgccaacgagtgtcaacgtggaaaacacgcgctggcctgagagacttgctttactctagtgtaggtccaaagagatcgctttcgggttcagggtgtgccagttggtttgatcctgcaaccaacaagaaacaaagaaaacaaccaacaagaaacaaagaaaacaaagttaaatccgtaaacgataaccgatcggctgggttgccgatggcgtgtcgtttataccgggctgatgcgatacagatcataccggccatgtagtatatggagaagggataattggacgtgctctgtcggctgtagatgtcaataatatataatctatgctttgaagtactcttgaaccaagtgattaggatagatcggtcagcgcgccgagatagtataaaccacttgagtccatgaacactttaaggcagggattatatacgctcacagcatagctgacaggcaaacccaacgtgtatcggctagtaatccgataccactttataccaagatttcggtatagatcaaatatgctaaacaggaatcaatctagtgtcagggtaacctgacagactgatggcaagcttagtatatttggtccaaacgagatcttaaagtaaagggcaggcttagcatatcaagtaaacatatatgaaacgagataactaagtcaggtaagaccggctaaaaccccgatgctatctctattaacaaccatagaacatgctacttaacagatcaaactaaactgatgcaacattaagcacatggagaaacataggatctaaacaagtctaagaaagccttttcgagatggtagatatgctatataatctaatccgacacagctatctagccctatcggctattttcgatgatagagactagccgacacggtaatatagcaagatcgatctagattatatagcatatatgataactcagcggtttgtatagacagggctagagtgtcatgaagatataagcactagccccgagaacgcaagccgccgtaacaagctttacctcttcatcgaagatcaaaaccgatgcagcccaactcgaaagcaagaactcgttgaaaacaaagaaaaggaaaaaagggtggcgatgcgccgagagtgtattgaacttgatgttgtttgtttacatggtctcgggtcatatttatacccaaaatacatgatatgtctttgccagacacgactctatctctattacaactcaaaaatatgaacaagtcccttaggtggactcttaccgaaaatatctataaggaaactatgaaaatatcctaattaatagatacaattgtcttctccgagctccatccacatttggcaatacttgtgtagcacctcaacagatcctgacaacgatcccatgattgtcttgccgggattggctacattggcttctccctatcaggttcagtaccagccgatgcagacgacagccgatgcaacccatagctgatgcgggttctgtttccatgattattgatttcctccaaatccgcctcggttctgacttcggatccaatatacgatttaccaattttagccgttaacacatgctccccaagtccgcgatatttgggatgttgcggatttgatcgatcctgtttccactggtatctagggttcattttccatttcggccataccgcacccttttaaaatagtgatcaccatcctcggatcccacttacaccgtatcgcttccgtttttaccactttcgctcattattccccacgcagcctctactgtagcaatccctaatctcttggcgatctttccagcgatcgcccctcaatcggcaaactcctccgctccgtcaactttgttcggacctatggcgatagtgcacgtggctgagatccccgaggtaagctccttgttactttttagcaattccctcagtcatctttggctctttggtgatccgattccttcttcccttctgccagcattctagggatcatcttttgattcccacctcccagaactccacatgctttttccttgggccgatgggtgatccggatcccaccgagtttatcaatgtgaaacagagaggatccctttcaagtagatcaaactagacttagctcaatggaaatcgactttcaggtcttggctgtctaggttgaaagggtacaagtcatggtacaagaggatggtggctgctaagcgatctcattgggaggaagtaggaatagcgcaatgcctggctttatctatagcaaacctgaaaaaggatgagcccctactttctgctatcggctacttctggtctgatacactgaatgctttcatcttgaggcagggacctatggctcccactttgcttgatgtgaagatgttaataggcctagacatcctttcatccattaatccttttgacgtggacattaaatgctcttatcaactgaacacgaagaagaagaacaatggctggtgaggcttcatcgtcgaccatcggaaaactggtccaatttcggatgaggaacatgctgccttcctctccctatggctcgagaggtttgctttctgtgggtctacttgagcactgactgcgaacttccttcattttgctgaagccctggtgagaaaggaaaaagttcctcttggccgatacctcctaggggcagcttattggatgttacatgtttccttagccaatattcttatagacaagccggtcagttacggggcccttggtggttggttcattcagctgtggttgacaattcacaccaacaccgtggccaacagaccttctctgcttgaatcggccttccccacatatgactccattgatgatcaatcagattcccagccgtgcaagtcttatggggaagcagctttagtttaccctggtgtcaagccatctattgaaggctttaagacatggttcgacatattttacaacaacgatgctgccgatgttctctttgcctatgacgcctacaccgagtttgatcttccaatggatttagatctgagcaagctaaatgatgaagaagacctgttattgaggggcaattacttggcagcaatctctccttgcgttcttcctacagatgtgtctcagggaagaaaatctttctcttatgagttttatcacccaacatcggctgcaagacaactggggcttggccagcttcccatcaatcttcccttactaaaagttgtagactcaagatgtgaagtatcatcagtcgataccatgaagaaattgttagaatgcaaattcccagtctcagccgatatcggcgacttcaccctttatcagtttaagcatgtcaccttctacagttgatagtcggattggtcaaaacatctcttctctgctccatccgactattgtcttaccaagattgataaccgcatcaaggtaggccgcaatttacttctaactagattatgcccccctccccacgacctaacttgttttgctcccttttttctctctgcagatcttaaaaccactggcaccgaaacacagcctgagtgatcggccaatttgctatgcccaggttctcaagcattccagagggactaccaagatattgccctccccgatcatttcttctgctccgtcaattgaaacattcatgaagactcctactggggttttggctaccgatcgcctagattttggcaaacacaaggatccctcttcaggaattaccgggtcatcacccaagagggccaaggctgatggttttgctgggataagtgccgaagcgttagttgacaatattccgccttctctctcgttgtctccaccaaccagagttcattacgccattcgcaaggttgcattgcatattcgcaaaaaaacgtttatctccctcatggcctttttgtaatccgtctctttcccttttgtggtgaaagcgtcatcgttgatagacctatcggcctcagcagcgcaagagctgtccccatcggctcgagctgctccgtctgtcgaagccgttaccgaggaaattgcgtctacttcctctaaggctaaggctaagctgcttccccacttctaagcttgatcatcggctaatctttatccgtgcctaatccatcccttcctacaggacctgtccaacatgttttcctttgacgtcaaataatttttgaatgaagatgaaggaaatagccccggggcaggatgaagttagggccctatcagtggagatcgccgatccgcttaatgcctcttaggacacccttgtaaccaactgtgggccaatcaaacaagcgggctttaggggggaaagcagtttcattcttctctctcaccctcttcccctcaatcccaaaggggtggccagagttgagatcaatgatcgactgtcagggcttggttttgggcggtttcggttgtaacttaaaaaaaaccgtctagtagtagccagtcatatttagcggtgaccgtagaggtggcaatttccccattagggccgggatttggggaaaattctcatgcgtgggtgagcggggtgagggcagggatgggagttgaccgcgggtgacccatggggccctgaaggtattagttataagttaaaagacccatttgacccattaagtgaaggactatataagcgaaaccttaatttttcccaaatccatacctagccgccctctctcctgtctgagtcccacgtctctccaacctagcaccccccagccaacctacctctttgtgcgctatccccagctgtcaccaccccgagccggcgctgctagacggtggtgcatctttgctgccatgcccagctggcgtctcgttttcgccgccgccctcaagcgatgccgcctcactgcagcgcgtcgcccccaaccgccaccgcttcctcacagtccaccgcccctagctggtctcgcctcctcacagcgcgctagccctacccgatgtagcctcttcgttgccacccctggacggtgctgcctcatcaccaccgtcctcagccgtagacaccttgtcgccgcccccaaccgtcaccacgttgcggtgcgccgcctcttgctgccacaataggtgccctgcagttgctatccattcgggtagtggaggaccccgctcacccgttgggtcctctgtgggggtgagggcaagtgaggttttccacccggtggccaatgcggggccgtggacagggaaaaagggaaaaagcaaggagcggtggctggccgggggcattcttgtccaacccaaccccgccccgctgccacccctatgtggtggatttggtgctggcctcttcttggctctgtgtaggtggtgttgttgtgtggtggtggtgccacccctatatgaccgattcggtgctagccttttttttcttggctttgtgtaagtgttgttgttgtgtggcggtggtttttttttctggctattgactttcggggttttagcgttgtagtttttttctgttatattaaataaattatcgcgttgtctggtgctgatggttcagaaggaatcattaaaattgtagtggtcgtgtgacagtataaaataaataagctataccactgcattggcgtaattttattgttgggttggggggttgaggacactgtatttgcgtcaaagctgagctacttcctccgtttcataatgtaggtcattttagtattttctacattcattaacatcaatataaaatgtgagaaatgttagaatgatttgtgaaacggagggagtagatgttaccgacgcaaaggtttgccggaagagacggttgccagcgctacaagaaattaatcggagatgaaacagacaaaaatgtcagcgtgtgttttgtcggtgtgttccgatctgggcaacgggcctacacggtcccatgtttgacgggaggaggatgatagaaaaaggcactgcatgcaaacctgattttgtttgactcttttcttggcttttgctctctttgtttacgtatacgttgcttcacaaatcaagtaggcagactggtcatatttcagttctcatcacaggatcgtttggtaatataaatatatataaataaataaataaataaataaatatatatatatatatatatatatatatatatatatatatatatatatatatatatatatatatacgtcctgcctaactttagtagatctgtaatacataaatgtaatttgttaggctggttatttagctgatgatcaatgtggcatggactcatgtctaagatcgaagtcacaatgctgatgttagggcatgtacaatggtctttattagcggttactttttattgtcatgcaagaatatttggtgacgtgaaagagagaaaaagaaagaaagagaaatatggttgctacgcatgacaacagcatagagttgactcttagcatttattaggaaattttttgttgcattgagtctagtaaaggaaagatgactagtaagaaagtggagtattttggtatattaatggttagagaccgtattgtcttaactattataacgtgatagcctttaattaatgtagaaaccataccgatctctacctttgtacttgcacttactagctggcgaacagcgcggaagaaggaaggaaagttgctttgcctcctagccaagatggaaaaggttggcacatgggaacatcgggacagcgtgaaccgggcggtgcggcggtggttgggtcctctgtcgatcgaggtggtgctgttctcatcatgcgttcttgcatgcatccaagggattagcaggattaggcctgtgggataactaattaacatttctccgtgaattaaatttgcaccctcgatttcgtctctcggggcagacgattgaggagccgtatagccggtccatatgcgttgcaatgtcacctcaggtaatgtttgtccgcgtcgaacttcgctggtgtggacgtgtggtgccatgcggctgaactcgttcaattcggttgcactttagagttggaacaggtagattggatgtttctcaaatctcaacgttgtcccaatgccacaggtgcaagcacagtattacctctatcccattaatctagtacgggatatatataacatataactagtactagattaacttattttaggcagaattagtatgtaaggaatgtattttcattccctgattggcaatcaacggctcaccttatttcttatatattatgtaaataattataaaaatgttaaaaaataaaacggtactactccatgaaaatgcaaattcaaatttgactctataaattataaaagataataaatataagcatgaatgcacatgctagtttgagtataatttgtttttttaattaacttatagaaggtgaatttgactttgcatattctttttaagttactcgtcattttagctttgttttagtcaaacatttttaacttggaccctcaatttcttaaattttatatattttcacatcataatatttgtgtttttaaattcaccatgagaaaaactttcataatatgtaattcacatgtaattaaactatatgtataaagttaataatgtttgagttcaaacaaaactaaaacgataaagtaatttgaaacggatgatgtacactctttgtcactacataactactgtagcatcgatggcaaagggcaccctttcctttcctttctttctttctctttttttcttcctttctataaaggaaaaagtacgaattacccttcgaactatgacgatagtatgaattacccctctgaaccataaaaccggacattttataccctgaactatctataccggacgaataaccccctcgacccaatccaaagcggtattgtcctacgtggcaatgtagtcagcattttttttaaaaatggtggggcccacctttcatactctcccacctctctctctcttcctctcaatctctctgtctcatatgtggagccgcgagttggtggccggcgatgggcgtggcgggggcgcagtgggcgtggtggagagtcgggcggcgtccggcggccggcggccagaaagccactgcgggcggcgggcgccatcgccctcgctcaccactgggagcagctccagctccacgcgccgtcgtgctccagctctacgcgtgccacgggcaccatgggcacggcggggcgcgaggcagcgttggcagcgtcgtcgtccacctccttgcgtggtcgagctccagctccatgcgcgccctcgcggacaccgtctcgaccacctccagcgcgctctccagctccgccacgtcgcccagccgcgcccgccgccgccgctgcagccgcctccgattctcagtccacattatgaagaaagtctgttcactactagaattacattatccattaacttcttcagaatacgaaacacaggtgatttgaagaagtaaatcagtgcaaatctgaagccaataaaatggaaaaacattcagcaaacagtgcaacttttggattcaaatgtgcttttgtttgcacctccactattctactgttctacagcgtttttggctccttgcagggtgaagctgtgtatcagctgcgtcaggctttcatacgaggagcctcctttctccatggctctgcaagctttctccccgtactccttcgccttcctcctcctctcgccgccgtccatcagttgtatcaccacccacgcgacgtcaccccgggtgaccgccatggcctcgtcgccgaacaacagcacaggcgtcatcacgccgacgccgagcacgtcgacggcgaaccgctcgttcaggaactggtcggagaagtgtggccacgtcacgaccagcacgccatgggcgatggactccagcatcgagttccagctgcagtgggtgacgaagcctagccgcgcccgcctccgctcgcctagccacgcccgcagccgcctccactcgcttgagtgagagagagaggaggaagaggagaaataggaggggagagagtaagtgggccccaccattaaaaaaatgctaactagagtgccacgcatacgccgccacgtaggataaaactgccatgtattgagttgagggggggtaattcgtccggtattgaaagtttaggtgagcgatgtctggttttcaggtttagggataattcggtcgaccgcgataatttgaagggtaattcgtactttttccaactttaaaggtggggaagtgcactcaatgttgaacgctcccatggcaattacagaacactagtggttgggctattttattttcaggggcagaaccagacctgattgggctatagcccagaggactataatttctatagtacatggtttatccagcacagcagacttgagctgtttcctggcccatagtaggccgtagctcaagttccccgcgaccagcgtatatgttaggcccaagggcaaggagtcatctactccttctatttcaggatataaaacgttttgactttattcaaggtcaagctattctaagtttgactaattttatagaaaaaaatagtaatatttttaaccaagattattatattataaaaatttattcaattatagatttaatgaaactatgctggtgttgtgaatattaatatttttttctatagagttagtcaaacatagagtagtttgactttggcgaaagtcaaaacgtcttgtaacctgaaacggagagagtagacaaaaggaccctgtcaagccgcaggtaccagataagacaaccgcagcacaagactaaggccctgtttgttgcaagtaaggattattgatttagattacttaaactggattataataagctatagtagaataagctattagttgtttttttctctcgattattagagtatggattattcggtttgaaaagctaatgtttataatggcccagttattgtagaatgggaggaggataagacggcggtggcggcttggggaaggatccggggtatagggtgtgggcttggggaagggtttgcgtgcggctagggagagaggaagcgaatgcacgcgctgccgggggaggcgctggattcacgtacgacctgggagagaggaagcggatgcacgcgcgatcaggggaggcgccggattcacgcgcggctagggagtgaggaaggagatgcgctggatctgttgggtttgatggcagtggtaggtaatttacatacaatttataaaagtagtgggtctttagccacccaataatccttaaaaaacaagtttagaggatattaccagattatattattcttacttatagattataataatatatcataataatctgtctgtttgtttcagattagtaattaaccaaattaaaataattctaagctaaaacaaacatgacctaaatcatctcactagttgcaacaaggtaataaataacgggaaatgaaaatcgagagcgctcccggttttgtgttatcatacgacgtgttcgacagccatccatccatgtcttcgttctatgggagcaacaggcttgactctacagcaatggcattaaagcgagaaacctgcacaccaccaaccatcaaaactaaagattttggtttcactggcctattctttttttaagcaatagaattgatgacttatatattttaaaccactagaaaaaatacccgtgcgttacaacgggtgaagtttattttaatcttattatttttatatggtttagttaagatgaaattcatcgtgggaggtcgcttggatatatatatttttagaaaatcatgagatgcagttaggagtccgatcatcttaagttagcatgcgagcttttttaaataaatttcttatatggttccttctgtattaccaaatgtgaacgatcttaaaaccgactcaaatatggatatgcattttcaaaagtaaacgaacttaaaaaccgactcatacacagataacgtaccaaaataccggtaaaaatattttcaatttttataatagtagagatacgaaatttattgtgagaattcgcttggatatatatttttttgaaaaatcatttaggaatccgatcatctcaagttagcaggcgagtttttttaaaagagatttcttatacgactcatgtatttttaaaagcagacgaacttaaaacctatctcaaatacggatatgtatttccaaaagcaaacgaacttaaaaactgaatcatacactgatgacgtaccaaaataccagcaaaaacatctttaatttttataatagtagagatatattatttctcactttcctttttaccatcaagctgtactcaaaatacacgataaaacgagtccaatattgaatatattcaaacatttaaagtaattaacttaatctaaaagtaatttgcttaaatcgtagaagtaacttagctctgcaatagaagtaactacctatgtagcattggaagtagttatcctatgtagcattggaagtagttatcctgaccaatcagttgatgatgactgagatacgaaaacgtggatattgtacttaccaagatacagagaaacgataccacttgcccttgcccaggaaaagaggaccacatgatttgtagttgtcatctcgattcatgtgcatgttactgaggctaacaacactagtatattttcttttctatagaatctttgatgacctatatattttagacgtatattatttttaagatccatttgaaccgtcagactctacttaaaatatgtgacaaaatgagtcaaatattgaatatattcaaattatattttttctcaactcctccagaagtgtagttacttatagaagtgtagttactactaatgccgtgacgagttaattctccttagctgtacagtcacttctaatacctttaagagttatttctatttttttcatagttacttgtctataggattttatttacttctaatattacgaagagttacttatatttctttaaaagttactttgctccagtaatggagttacttttaatatcgcaaagagttactttctatatgacgcaatattttatttaaaaaacatagtgattactttaaataaagaatatatgtatttacttgaaaatcttctctacactttgcttttcctgtcgatttactccacatagctttcttatttcaattcactcataatgtaactacttctaatgctataaagagttacatctattgcatagctacttttgcaatttaaataaattacttttagattaataaaaattttaaatatattcaacaatgaattcgtttcatcacatattttgagcggagtacaatggtgcaaaaagatcttaaaaataatatacggtttaaaagatataagtcatcgaagaggtttaaaagaaagatacgctagtgaccaatctatataaatggttgttgccatttttagatggtaaaggaggatttatatgtcacatgggataaactggtcgctggtttggatcaaccagcgaccgtgcattgtgtagtcatgtccaataaataagtaaattatccttataccttgaaagctcacacaatatctctcatacctttaaaatttacccgattccttctatactcatgaaatttcaacttatccattccatactccatccatcagttaactgtctaatttgtataaaaatgaccattctacccttacacttgggtgaacaaagaaatttatgaattacattattgaaaatataaaattttttcgcatgagactattatatttatgatttcctgtgcaacacattattttaatttattgcatttggtttatttaaaaaaattatgttaaatttttttattaattatttaatcttattagtttcataaaatgcacatactgtgcacccaaagaattttttttagttttccaagcctatattgaaatttacatcatcaagggcattaaagacatttgtaatcaaatagtgaaatgaaggaaaatgtaacggcaggggcatggaatggatcaaattgaaatttcgggggtatagaagggatcggttaaatttcacgggtatgagacggattgagtgagttttcaaggatatagaaggaatttacttggggtgattatacctgttagtaccagattctaaaaatttgtgcaccaaatgtttttttaagatgattagtaaatagtaagatgaagaaaaaatcgatatactaggtgcaatagtacctaagagtcccgaatgataaccagattcagtattcttcaatgaaacattctatgattgtgattgattgtggttatggtacaaagatactggatatttgcttgaaatacaaggatgagtcttcttacgagatgagtatctggtaccgttcctataaaagtgccagtactaactgacctacatgttttatgattcaagttgtagaaaaccatacatattttcacacttgacacttaagtacatatatattttggtagtttagntnnacaaaaccacactatcnaataatggatttacccgtgtgatgacgtgattgttccatctaggatgatgacgtggcatatcctattaattccgtgcgatggctgataataggatc

SEQ ID NO: 68944 - DNA, 9555 bp, Oryza sativa
tacaccgtttagtatttcgggaagcgtgcgcgcggaaaacgaagcaaaactcactaacaatcacccagatcacctaggaaagaacacagccttagcgactgctattttaacttagccggttgctatcgcatctgcagttcaatttagcaggctgttatagcatgagcctattttgttagttgattttctgccaaaacattatatgatgtaacatccaatgactagaacatcatgtctgcttttaatttaagttggaacaagacatcaactcttcgagtgctactaaatctcaacttatcttcataggttatacatatattgatctatcattaatttatttctcagttgctttgttaatattttataaagtcattactcataattagggctagacaaaaagctcgtgactcattagctcgctcatctcgtcactagcttggcatgactctgttaacagtgaaatttggtaagcccggactagtcattggcttagagccagcatcggctttgaagtcctgagattagccgatgagagttatcaagtcgtcagttgtcggattcttgctatattcggttaaggaaattgatctactaaaggaagcttatccagaagagaccgagttcaaagagaatgcggcatggcaagttatctattaattaggaatagtttgttagtttccttttatctttaggaaagtgtgtttagtgtcctataaggactttttcttttccttttatctttagaaaagtttctttcttgtccgacaaggacttgtatcaacccatgggtataaatatgtacactcggggtctatgtaatctatcgctacgatcaatacaattcgatgcatcgccaccccttttacttctacttttgtttttacgttccggcggaacttggcatccgacgcggggttgcatcgtcttcgatctccggcgaagggataagtccaatgttccgccggtccaagcaattgtatcgtctacatcagcgtcgttcaaggctgcatcagtacattcgacctcttggattgctctggtttggatgatatatttgcctacctatttatcataagtctatgttaatctagtcctagcatctcaatttagctctatcagctgtctctcgctttagggtttctactggtatcagctaaatcgccttgctagattagattagcctaggcatctaccaccctaaaaatcagtcaacggcttgattgtctagatattgtgtttcttttcatacttagtgttgcatcagttaagtttgatctactaagttgtgcttagaaccataatctctggtctgcttttgactgccaataagggtttcatcggggtttcagccgatgagttatctagacgttgcatcggcttacaaggattgtatacatattggaattagccgatcgcaacatagattttactgtttatctaatcctgtgaatttaatggcatcggacctccagccgatgtatgctttaaccttcggatcagtgcttattatatcttgtttctagccgattggtttctactcggttatattgttatgttattacatcatcaatagccgattgcctttatatcattatctatattggacatatagccgattgcttaaaccctatcgctatcggctggtatcggcatcggctattatcggctatcggctggaactactccatcggcttgtcagccgatcggctgcattgatttactatttgcatatcttgtcatttgcaagatcaaactgactggcacgcccgcatctcatcaagatttggacctgcacaggagctaagcagatctcccaggctggtgtgttcgattttttcgtcaatagactcgactcagctcgttacgttttcctaacgagccgagctaccgttttagctcgttagctataacgagtcagctcgagctggctcgcgagctgctcgtgagcttaacgagctggggcatatgatataccaaatagcaagcatcagcccatcattaggacacacggcccactaaatgaccccgaccttccgttggcccagataagaacagttgaaaagacttggatcgtgctgacactttttcgtggtccacacgagatcacctaacgatttgcgatgtaatcaacagagtcgccaaaatcgatagattaaaactggctagcagccgatttcaagattaattcactttctcggaatcacacgactaatttacaagaaaattagcaaagaagataaatatcgtacttacgtgatgatgaacgactagtttccaagcaaactaccaaaggataatcttctcgctttcgtggaaaagcaggactgtttttcagcgcaaaacggcaaagattaaccaaattatagggttgctagaactcagccctgaaaacaaaatagaaaacaacaagaaagtaaaaaaggggaaaatagtagatttataattttgttcggggtttcttctgaccgtacacccgtgtatatatacaggtgacatggtcaaacacaaaaatatcaaggttcagccgaaaaggaaacaaattgataaactaggaaaaatatatgtccatcttcctagtaaccgcacgcgctaactaattagcctcatcagatagaaaccaatgccgatgcttcaggtcttgacggtcgttacagacaaattttgaccgtcaattaactaaaataatagagaattagctatgcttgcaatgtatatttatttcagaataatatagtaccaattgtacttggagaataatatgttgcaggaatttagcaaataaaataaagagaatgtgaagaaacctcactcctaagcaagcaaatagataaggagggcccacatgataggtgtaaccgctggaaaccgtcttaactgccacaactgtcattgggacccacctgtcagtcaccctggcaaacttggaggcctgctgggctggcccaggttcagccgaaccctagcaactgtggctccagctggcctttacatgaggatgtccaggatgagctgctgatgacggttacaggggtaaaattgacattgcgcatcagagtaaccgtcataccgaccctataaaaggaggagctcacttcacttcacaacacactcaagcaagctcaacattcatcttcatactttatttagtagtttagtgctaagtggaagtagtatagagtagttctctggattcctcggagctttcggaggagtttcggtatggctctagtagcttttctatcctctcctgtaatactttccgaattaatgaaatactcttctttttatattctcggtactttacttagtatgagtattgcttttactttatacttgtgttggtataaatgagtgggtagcctaccagcgaggtgcaatggtgtgggtttattgtccgatttatcgattgctctatatcatctgcatagatgtagaatagtatttattaatgtaagcatggtgcttagattagtaagtatcatcatttgggcatatatgctgcgggacagtagaggtgggccgctgatggtgacagctcagtacgggtattcctccatgttagtatatattcctaagacaaattcctggggagggtactcctccgtatttaaccccggttggacggccatgacaggttgtcgtcgtaagaaactcggtaactcggggtggtctctcaaagcaccaggatggcactgttaggtggtattggccacatgattgtatactagcaagtgtagagtaaagtttagtgtatattagaagtataggaaatgagttctctctatcttttcttccacttagttaggattatttatctgaggaaatctactaaatgctgagctttccaatgtggaaacaaaagatggttgtggcggcaacaatggcattgcataatttcattcatgaccatgacacgcctaataggcatttccataggtttgagaggaatccagattatgtgccaaccattccatctatattttggagatatgtgatttctcaagatgcatcgaatacatccactgaggggtcaaagtgataatccatggatgcatttcgagatgacctagccggtcgtattgtaggttgacggaaatatatcatattttgtgtagttttgtagtattttgctctatctttcgatgatactatttatttttactaaacatttatattgctaaatatatgtcatgcaacaacttgaacttatacttttttttagtaccaatttttgaattatgtttatcaccttatatacttaacatgttgaaattattaaggaaaaataataataatcacagtgctgaaattattaaggaaagtatctattattaatcctacataaagttaacagtgaaaaaaacagaagggtagtattgtctcttgcaggatttctagagctgagtaagttagccaaatactttcagagcacctacatcttttagaggagctggcttccattggagttagagtttggagttgagagatagaagctggagctataccaaacggtgccttactgcgacagtgttatagcccttgcccgaagcggtcgtgaccgaacaatactgtttggcccgattttggcccacctatgtaattgacgacgatcgaatggcaacaaccaatggcaggatatatgtgtctttgattggctagattggtgtaatcgatgacgatcgaacggcaacaactaaaggcaagatatatgcgtctttgattggctagattggaaagtaatgctcttattagtttccttaattgacgaaaattagacacggtgcaggtcagttttgccgcaaagaagcagcagcggcagcagatgccgaggttaatgtcggcctaattgcaaagccaaaatttatcgtccccagtggagtcgtcaattcatgttagtgtctttttaccctaacacgaggctcatctaaatatttgcggtgttaatggagtcaccaatcacctcgatctagacaacattaaatgatgtgaccatgactactattgatacaatcgtcgctcacatgaaaatcaagttgaccaagtgttggaatctgattcggccaccgttgacattgctgaattcaaacggccgccaaatctctatacgaacttcgttttaggaccgtcagtacttgatagaaagctcttagagtcctctttccaacggatccagcctcattgcgaaattacttcccagagggccgcaattgcagaaacaaggtattgcgtcacctatattgggccagtgggcttgtaacttcgtttgggaccccggcccatgtggggtgcgccccaactacgtggagcacgaccctagggactcctaggttgccctcccaccgttataaatagataggtaccccttcaaggtttcttgggttttgtttagatgaaagtttagccattgctatttccttgcagcgcgtgtgtcggctagatcatcgtcttcttgtattcgaaacccgaacttatcatatgtattcattcctatttgcaattcagattgcttttatcttgttcatgcttgtttcttcgatttgcttgcaggaataagattgatctgcaccggcaagatcaacaatccatggagaggtgtatcgatcgcaaaggtgcaacacaacgtctcgtacggttgtagtcgggtcatcaacgtttctcctaaatcgtagttatctgaactcactgaaagatcgggccaagaacagccttgagtttcgagtggaattcagggttcatcaggtggtattagagcattcgttgcttggtgagtttttatcaacctatcaccagaaaaagctaaacaaaaagttgcatccttcacctagccatatttgtgcctctgtattgttcttttcagtttttgctttgttgagttttctgttgcatggttagtcgtgttgctggtcttagcgtctagtccatctagagtttcgagttctggtcacgttagtaccactgtcatcgcgtgcttgttgtcgtcaggacctacgaaaatggaatcggctctgacggagcgtggggctcctcaccgggagactgcgcaggcccccctttgccggttcggccgggggcgctaagtgaggttcttcgccctcgatcgatctggagaatgttcgcgagagagcaagtgcacgagacacgggtgatgtagacaggttcgggccgctgagaagcgtaataccctactcctgtgttctggtggatctgtgtgtaaaagatctacagagagccggagagccagagagttcaggctccagaacccctctcgcccccccttttcttttcttctttctttttcttttggtgggcaaggtcctccttttatatctcaaggggatactacatgcaccacttctacctacttttcttctaggtggggacctaccctatcttgaccaaaacttggcttgcaccttcgcctggaagctaaatcacaacttgtccttgagtgaggctcagcgccgtctctcgcctgacaccggggatctccctgttactccctcattaatgggcggagatttgccatggctgctttccaaatgaccatccgacgagatgggtcatacctacctccactccaccggaggcagatgcatcgtgggagcacggttgtctgccgatgacgcgaccggcgtcagaccagtcacagaccggtcattcttgtccaccacgtgtcagttcagcatgctacacgtctgcccttcttcatacaatgatttccttgcaatggttgcgatgaagcctggaatgtatctggccggggctgacgtgccaactccaggagttcccacgccggctccggctagggacgagcgcctggaggctctcatcattccgacgggacggggcgaggcgtgtgtcaggccgcctgttgccacctaacccgcgatctgaccggtctgtgaccggtcacacactgtgacctgtcacggaccgaacgagtgtgctgcgctgcattaaatgcggcgtggggcgctcgtccaacccgcaataaacgcggttaggtgagcgccgttgtgctcacctaacccacacacgtggcgccaaacccacagggggtcggggcgccccagccctcggggccgaaacgggagcggcccgacccctcgggaagacagagggaggggcggccacatcaccctcggtcccgaccctccccccccccgagggggccaggccacgtgggtgactgcagctgccccaaacctctagtcaagatacccccggtcccatgtcaccgacaggctcactgccacggttctatttttgtacttttcagaagtttatgtcggttagttttgaagttgttgagttgcatctagtgtttgctgatcctacccgtgtgtttgcttttgccgtgcttgtgtccggcgctgagaggaggaagaaggaaatgggagagagttctgtagattagactagaaaatcaggcgcgccctgtcaaaagtatatcctgtctaatgagaaaatgaaacccagcatctcaattctgacctccccagataatacaaacacgacataaacatgatatgataataccatcgaagcgctctccgtctcgttgcagcaggtggatgcgacctcagattgagatgcaagaaatggaggagatgtaagcagaggggaggtagtacctcattacatggcctcaaagaggcggagggagcttgtatccggcaccgtacgtcggcaagcttcgaccaggcctccagatgcagtcaatttggagaagaagaaaacgatgaaagctgggtttggggtgtttgtgatttgtgaaggttgaaatggaagtgcaaaggtttcagctaaagccatactgagtgcttgtgtagagaggactcagttgcatacttgcatgggaaactgaaaagctcatttcttagctcttccaaattttttcttcaaacttttaacttttccatcacatcgaaactttcctacacacacaaacttctaacttttccatcacatcgttccaatttcaactaaaattttaattttgacgtgaactaaacacgcccttattcagtattaattcagtattaatatattggaatgttccccttcccaagggctccacaaatttctggattattccattttttatttaactttttacatgcatgttgactgaactaataccagtactactttccacacttatctagagccttaaataacatatatgcaatccaacggtgaataatctgccacagttatcatccaacggttccttttttatctaatgacgtggcctagcctcttttcagcaaaagatcctgaattagtgtgtagattggtttggtttccgtttggtggccaacacagagaagagaaaaaggaagggagagatctatttctgtttttacgtggggcctttcgatcctaaggtcgacgggagtcaatctccacctagtgagtcgtgtccgagacctcctagatccacggtctcctctcctcacggtttcaatccatactgtgagttgcccatatagcttgatgaaaaaattttagtatcggattggagatctgtttgcaaatacagaatctatgagcattttatttttgtatatctaattttgggtttggacttttacagttgagtccctataatttttatatttacatttgagtccctttaatcttgcattgaggcccttgagttggttttttttaaaaaatcaaaaaaaagaagagaaaaaaaaggcagaaaggtgcataaaacaaagaaagaaaagctgtacccaaaaaaaagaagggaaaaaagaaatttacttgtttcgtttgagattgctttcatatatcattatgtgcctgagttgtttgtggtgctaacttgtggtatcgtttgtgtctaggctcgcatctctagtacgtcctagcctaggaccagcacggtacttgactttgaacgatcattcaactttgcattctctgatttgagcatttgctatttctttgccacatatttaagtatacccagagctccacagatttgattgcagccgtacaacaagtgtttgccaaggcatcgatacatccaacctccattggagtgcttggttgagtcgttgtatgttgccattcttcttgcattggtaagaacttgtcagagctcggtgaaaagcttgagtgtgtgtgatatttgggctgccactacctagtagttgataggagcgtgcacattcttgtatgtctttcttgtttgctactaaccatgacaagatcgcacaagggaatacgagaacattgacttcttcaccttcgatgagatatgacgacttctccacgcaatgcatatgaggtacctgcctataattttgcacgagttgaatctaagttaccattctacgatgagaagtatgattctgttgcatatattgattgggagctagcagtagataatgaatttgatgagtatgatttttctgatgctcaaatgattaaggctgttagtaataagtttacctcttccgctctcttttggtggagttatgttactccctccgtttcataatgtaagtcattctagcatttcccacatccatatggatg

SEQ ID NO: 68945 - DNA, 14365 bp, Oryza sativa
gaccctccccccccccgagagggccaggccacgtgggtgactgcagctgccccaaacctctagtcaagatacccccggtcccatgtcaccgacagtagcccccggcgttacgctagggcgatcgcccccccccccccctctccgagggaagcgcttgggcatgacgccactccttagacctggtgacaggtggggccggtctccacaggcggcagaaacccagcggtcgcaaatcgcgcacatcgtcaaggaaaaaaccgaccaacaataatgagcggcttccttcaagaccgctacattacttaagtagcgcgcgaaccgagacaagccggttcgtttcgcctggagatgtgatgacggtgcatcggtcggcgagcgtagttaacgcgcgcacgatatgtcccatctcgactgccacggccgcacatccgcctcgtgcgctgcaaacgggcgagcgggattagtggaggcgtgggcgcgagagacgagggggcgaggtagtgggcgtggggatcgaggagctgggcatagcgttggcaagggtactaagacatcaaggaagggatttgtttccttcctctcgtcactcttccctttgcctttgccacttgtgctctgactctccgtttccggcgccctacccttgccatactcgctcgctctcaagctcctcctccgccggcgtcatggcacggggctccgcaccgctcgagggtagcgtgctgccgccttcccgcatcgtgagcgagaggcaggccgggctgccgcgccgattcatgccggaatctgccactggccgggaggtggtcgcgctgggcgagggacgcccggcgccgcattacccggggtggtccgtcttcttcctctcttttgcaatggcagggctggtcccgccattctcttgtttcttcatggatgttctggagctttatgatctccagatggcgcacctcacccccaacgcggtaatgacgttggccatcttatcgcacctatgcgagatgttcatcggggtgcgcccatctctccggctgttccggtggttcttcaccgtacagccggtgtcgccaccgtcggtagtcggtggctgctacttccagccgcgagggccggtgttgaaccgctacattccctgcgtccttcgcaagaagtgggacgactggaagagcgactggttctacacccctctcgccgacgaagcgcgcctccgacttccgagccagcccccggcgcaggtctccagctggcgggcgccggtagatctaggagatggctacgacgccattcttgaccgcctggcgggtctgcgatcccaggggctcacgggggccatggtgttcggcgactaccttcgtcgccggatcgcgccactccagcggcgcgccaggggcgcctgggagtacaccgggtccgaggactacatgaggacccaccaggggggcagatgggactgggcccctgaggatttcaagatggtggtcccaacgggtgctgaatctcagctccgtggaggcatccctcatcccccaaggtgtcctccccctctgcagcgatccagagcgcgccaacatcctgaccatcatgcaggcggtcggggcgtcaggggagcgggctcctcgaggccacgatggcgcgggcgggagccgcagaggggaacaatctaccccgggagggggtcgtgcttctgggccccgtgacgggggcccggggggcagccgccctgccgacgcccgggggaagaggaaacaggaggataccccctccccatctcctccccgagggggcggggcagtgcgtgccagcagcaggcgcccggagggtgctgtgccgacgtcgcagcccgagggggagcgaaaaaagaagcggctccgcaagatgggggggaccgaaccatgccggggaaacctcatctcccccccaaggtggtcatttagccgacctcctcgcaggttcgtccccgcgcccactgcggccgtattcattctcccaaggcgagttttcacttacccgtttctttttgtcttctggtttttcttccgctttcagcgagattccgtcacgcccccctcgccattccatgtccggccggtctgaggccgaggagacagcgaccgcggaggcccggaggcgggaagctgtccggcgagaagccgcggaccgcctccgggaagctgaggaggctgcccaggaagccgtccgggttcgccaggctgaggaggccgctcgggaggaggccagactccaccgggccgggaagtcagcccgggaggcagaggcgacgcgcgcacgccaggcggcctgccaagcccccgacccgactccgcccgaggcgacgacgacttccgaggccacccacgacgaggccgcgggcgcaccgctcggacccgacccttcgggcgacgttcgggacgagccagcctcgggggacgcccctgagtccggcacgtcgattggcgggccgagccgcacagcgcccacaccgaggcggctctcccctctgccttccgccgccccactaaacacagagcccctcctgcaggccctggccgccgcgaacacgacggtgctggacgggttaggtgcccagatggaggtcctgcaagcagagcgggcggagctcgacgcggtgtgggcgcgcgtcgaagaggggcggcgctcggtggaggccatggtggaggcgggccgcaaggcataccgccggcacgcctcagagctcgaggcccgtcggagggagctggcggagatcgccagggaggtggaggaggagcgggagactgccctcatcgccaccgccgtgctcaacgaggcgcgggacgatctccgccttcaatacgggagccgggtggcggagctagagaagaaactcgacgccgcccgggtagtccttgacgccgccactgcacgggaacggcgggcgacggagaacgaggcggcgtcccggcggcgcgaagtggcccttgaggctcgcgccatggcgctggaagagcgcgcccgcgcgagggagagggacctggcggaccgcgagactgccgtcgctatccgggaggcaacgctggcggcgcacgaggccgcctgcgccgaagaggagtccgcactccgcctccgcgaggatgcgctcaccgagcgggagcgagctctcgaggaggccgaggccgcggcgcagcggctggcggacagcctgtccctccgcgaggcagcgcgggaggagcaggcgcgccgtaatctggaaggcgcacgcgccgagagggccgcactggatcagcgagccgctgagctcgaggcgcgggcgaaggagctggacgcgaggacgcgcagcggcggggcggccgcgggcgacggcgatctagccgcccgcctcgcagctgcggaacacaccatcgccgatctgcagggcgcgctagactcgtccgccggggaggtcgaggccctccgcttggcgggcgaggtagggcccggcatgcttcgggacgccgtctcccgtctagaccgcgccgggcggcaagcgggcctctggggcgagcggaccgcgaagtacgccgccaaccaggggggcctcgcccagcgcctctcagagatggccgagactctccagcggctccccgaggagctcgaggagacgatcaagtcatcctcgagagacctcgcccggggggcagtggagcttgtactggcaagctaccaggccagggacccggacttctccccgtgggcagcgctggacgagttccctcccggaaccgaggacgacgcgcgcgcgcaggtccgggacgccgtcgaccacatcgtccacagcttcgagggtacggcccctcggctcgcgttcgccctcgactccgacgaggagggcggcgacggtggtgtggacgacagcgaccacgaggccggcgacccgggagcctcgaagtgagcccccaggcccccgccaatcttaaatagtttttcctttcttcttccgaggccttcgggcccccttcttgtataaactaatttaatctgcaatcaaataaagaagaaatttctgtgtcaattttatttgttgtgtgtatgagacgaggatggtctgtgcggcggtccttccgtgtcttggcttgaacaagggctcgtgcccaggtcccagcctcaaacggcgcgggtcggggctagtgcctggggagatgcacgtgtcgagactggccaggccgggagcgcggtgaccgagggttatggggacccgattgtgggcctttgccgattcccccccggagttcaccacgccccggggcacggctcggttctgggccccgtttggcgatttccgccggcccgggccaccgagggcagggtcgagcacgagcgtgctaattcaagccaaaactcttcaaaaggaaacaatggcacagacacagtccttaggaaatcgaaaaagcttttattgaaatacggaagagaaaaaagataagtatatgcatatgtggtagcccccggccaaccctgcacgcccgaggggggtgcggggttggcccgagcccgagacctgacacccgacccccactaggggtagaagcgacgaaggtgttcgatgttccacgggttaggcagctctgtgccgtcgcccgtggccagccgaacggagcccggccgggggacgccgatcactcgatacggaccctcccacattggtgagagcttgctcagtccagcacgcgtttggacgcagcgtaggacgaggtcgtcgacgcagagtgatcgggcccggacgtgacgctgatggtagcgccgcaggctctgctggtagcgcgcggctcgaaggaccgcgcgccgccttcgttcttccaagtagtcgaggtcatctctgcgaagctaatcttgatcagcctcgcagtacatggtggcccgaggggacctcagggtgagctcggatgggagaaccgcctccgcgccgtagacgaggaagaaaggcgtttccccggttgctcggcttggcgtggttcggttcgcccagagcaccgctggcagctcctcgatccacgagtcgccgtgcgtcttgagaatgttgaaggtcttggttttgaggcccttgaggatttctgcgttggcgcgctccacttggccattgcttctggggtgggcgggagaggcgaagcagagcttaatgcccatgtcttcgcagtagtcactgaagagctcactagtgaactaggtgccgttatccgtaatgatacggttaggcaccccaaaccgagcagtgatacccctgatgaatttaagtgcggagtgcttatcgatcttgatgaccggataagcctcgggccacttagtgaacttgtcgatagcgacatacagatactcgaacccgcccggggcccgtctaaacggacccaggatatcgagcccccagacagcaaacggccatgaaagaggtatggtctgcagggcctgggccggctgatgggtttgcttggcatggaactggcacgccctgcaccgccggaccaggtcgaccgcatcgttgagagccgtcggccaatagaaaccctagcgaaaggccttgccaaccaaggtgcgtgaggcagagtgggctccgcactcgccttcatggatatcggcaagaagctcgacgccttgttcccgaggaatgcacttcaggaggactccgttagccgcgtgccgatagagggtcccttccaccagcacgtagcgcttggagatgcgctggacgcgttcactcccttcgcggtcctcgggtagagtcttatctgcgaggtacgcctggatctcagcgatccaagcaatcaatctaagggagctgggagcgcccccctcgggtcccgaggcctggactccgacgggcctcgggggccgttcaggcacgtccgtctcccctagggggtcgggtcgcgccgacggctgggcaagcctttcttcaaaggcgcccggtggggtctgggctcgcgaggaagcgagccttgagagttcgtcggcgaccgcgttatcccgtctgggcacgtgccgaagctctatcccgtcaaaatggcgctccatacgccgcacctggcgcacgtaagcatccatctgcgggtcagagcactggtactccttggagacctggttaacgactaactgagagtcgcctaacaccaggaggcggcggatccccagtccagccgccactctgagtcccgcaaggagtccctcatactctgccatattgttggttgcccgaaagtcgaggcggaccaggtatttgaggacatctccgctcggcgaggtcaacgtgacccccgcaccggcgccctaaagagacagggagccgtcgaactgcatcacccaataggcggtgtgaggcagctgcgaagggcccgagctggcctcggggatggagacgggctcgggagccggtgtccactctgccacaaagtcggcgagggcctggctcttgatcgcgtggcgtggttcaaagtgcaaatcgaactcagagagttcgattgcccatttcaccacccgtccagtaccctctcggttatgcaagatttggccgagggggtaggacgtaaccaccgtgacccgatgcgcctggaaataatggcgcaacttcctcgaagccatcagaatagcgtaaagcatcttctgggcctgagggtatcgggtcttggcatcccggagggcctcactaacaaagtagacgggccgctgcaccttttgtcggggccgatcctcttcaccaggggccgcatctccagggcgcttttcgtccgagaggccgcgcggggcgcactcggcttctgtgtcgacgacctcggggtcggaaggcgactggcgcggccttcccgcagtggccccggggccatcctgggggtcgggggctcctagcaccgtcggacaagcgggcagagggccagctccggtcgtcgggggcctcgggccgccgttcggctcgggggcctctcctccctgctctctcccgggtcgagtcgacacagggtggggatgcgcggagcgagggtcgtcctcgtcgcactccgcgaccaacgccgcgctgaccacctgcagagttgccgccaggtagagtagcaacggctcatctggctccggggcgaccaggactgggggagaactgaggtacgccttcaactgagtgagagcccgttcagcctcctccgtccagataaacggcccggagcatttgaggagcttaaataggggtagcgccttctctcccagcctcgatatgaaccgacttagggcggccatacagccagtgacgcattgcacatccctaagcttgctgggggggcgcatccgctctatagctcgtatcttctcggggttggcctcaatgcctcgggcagagattaagaacccgagaagcttgcccgtaggcacgccgaacacgcacttgtcggggttcagctttatgcgggcggtgcggagactttcgaaagtttccgctagatccgagagtaaggtctcctggttgcgtgttttcacaaccaagtcatcaacataggcctcaacattacgtcctatttggctacccaaagaaattcgagtagtacgttgaaaagtaggacctgcattctttaacccgaaaggcattgtcgtataacaataagttcctatgggggtaatgaatgcagttttttcctcatcctccctagccatgcgaatctgatgataaccagagtatgcatctagaaaacacaaaaggtcgcaccccgtggtggaccttaggacatgccttgttaaggtcggtgtagtcgatgcacatccgaagcttgccgttcgccttgggaacgacgaccgggttcgccagccactccggatggatgacctctcggatgaatccggcctccagaagtcgcgccacctcctcgcggatgaaggcttgacgttccggggcctgccgccgcactttctgccggaccggccttgcacccggccgtacggcgagacggtgctcaatcacctccctggggaccccgggcatgtccgccggtctccaggcgaagacgtcggcgtttgcccgcaggaaggagacgagcgcgtcttcctatttgtcgtccagaagaccaccgattcgtgtggtcttggacgggccgtcgcccagggcaacctgcttgatcgggacctcgtcacacgtgatcatccgctgcctcggggcagctgggacggaggtgctgagcctctcgtcgccacccgcgggcttggatgccgcggcgaggtggtccgcgcgctgctccatgcaagcaagcgcgactttgaggtcgccatggacggtgatagggccaccggggcccggcatcttcatctggagataggcgtagtggaccgccaccatgaacttcaccaacgcgggcctccccaggaccgcgttgtagggcagactgaggtccgccacatcgaagttcacccgctccgtgcggaagttggcggaaccatcgaaggtgaccgggaggtcgatatggcctagcggccaagtgtgccccggcgtcacaccgatgatcggctgggacggccggagcactatccacggggccttgatggcgtcaaaggcagcgggggaaaggacgttgagggctgcacccccgtcaacgaggacacgccccaacttcacattgcaaacggtgggggaaaccaccatcgcgatctgtcctccccgggcaacgcacggtgggtggtcggtgtcacgtcctgataaattcatcccgaaataaaaatcattctctaaaaggaataatagaattaattaaaattcgaaaagaaattggcaaacattaaaatacgtgcaagaaaaattcaaatgtggcccggagaatttttgttaaattctccttggtcaaaaaggagccctcaaattttagtggaattttcagagcacaaataataattattaagaaataaacaaagttaaaatggttttataaaaagaaaagccctaaaaagtccttttttccccttcccctcttgggccggctcggcccacctccctccctctctctcctctcccccgcggcccaatcggcctcctccccgcgcgcgtgccgctgacgagcgggcccgcccgccaccctcgctgacgggtggggcccacctgtcatccctatcctcccgccgctcccgccgcctcgcccgtgccctagcgccgccgccgccgcgaatcccgccgcctcccgccgtccccgcgcgcaataaagagggggaaatcactccccgtgattccctctctctttccccccatttttccctccctctctccctcggattcggttggaaaccgctcccctaatctcgccggcgccattgatggcggccgacctcctgcgccggtttcctcccttccccggccaccctctctcgccccggctctatttaaacgctccccgtgcctctctcctccgtttccgccgctcgccgctctctctccccgtcggaatcgagctcgcgccgtcgtcctctctctccgccgtcgccaccgagcttcggtccgccgtcatcgtcgccccggacctccgcccgcttcggcatcgcctccttcggcttcgccgcgtcctcgccgacctcgtccacccctccgtttcgcccgccgaccgccggaacgccgccgtccccgtcgacccgagccgcgccgccgccttcctccgctccggtagccgttcccgtcgtcgccgtcgacccggggtgagccgtggactgccgtttcgcttcccccttccctcccctctctcgggcgccgctccgccgcgccggtgatcaccggcggcgacgaccatcggggcgcgggcgcgccgcctcccgtcggctgtgccggcgaggccgccttcgggcgcgccccgcggctgccatgtggggcccggccgtcagccgcccgcgtcctcgggtgcggctgacgcgtgggacccacggcgccggccggcgtaagccgcgtgcacccggtccaccgtggaccgagaggctgccgcgtgggccccactcccatggacccggtccgcgcgcccctcccctcggttgacgcaataaatccgattttaaattaaaatttaaatgaagaaattcgcaaatatccatttaaagagcatataaacttcaaatggccataacttggccatttgaactcggaattggaccgttcaagtctctaatttttccttaagaagtcaagaacccatttttgtgctttgtttctgcttgttatatggagtttattagagtaaaatccttttcttttccgttggtcgtgtagacgctgcagcttcggaagatccgctcttcgtggaagttgaagccgacgtttgggaaagcgagcaaggcaagtcacatcatccttgagcatattgaatcccagtttataaaattattttgatttaaattaatgcattaccgctttatctaaattcccgcgttatcactgttttatttagccatgcctatttatcattgttaagacattattattgctattgttattattaccttgttcaccccaggaaaataaaaccccaactagtgggtactctatttatggttccactagtatgaacttaggtagatgcttcgctggttaattaggcaacattaggtggttttataactttagactttgggaaatctcatatcatttggacagtagggaattgttggattattgtggaattggacacacacctccccctctattcaaaacccccaaaatggttttaggctgggctcgaggtgcgtggttgggttttgctagtcgtacctcgggtactataaggattaagctcaggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtagagatgtcatggcacagggctggtgtcctgctgctgggggctcattcctgcctacctgtcccggaggttccggccgtaggtggggttgggtcgatactcttgtctatggctaggatgggttggaaactatgtcacgtcttccgtctgtataccgtggtggtatgtggcacgtggttgcacgtgagggagatgtgtcttgtgggtaaagatgtacacctctgatcagagtataatctattcgaatagccgcgccctcggttatgggcaagccgagcaatgtacccaagttagtgttttaattcttaaaatttgctcaacaactaaaatgtggaatggttggcctgggttggcttgggacgagctgggacccagggtcgggttgccagttcggtctgaatcatcgtaggccttgggttaaggcaggttcgtgcgggttcacgaccctgattaataatattgtgtagctctaggatcgtccttataaaatggctttgggcaactaagtgacttttaaatgcggatttctgcaaaacttaacccctatattattatccccttgtactcccttgcattaattatgcatctccggtgtggcttgctgagtactgtggttgtactcatccttgctcaatctttccccccttcagtaagagaagctttggagaagaagtcttaggtggagtcctggcttataccccagttgagcgcctgtgaagatggagccgtaggcccgctagtccgctgctgtttattttgattgtcaggccttaagcgcctttgtaataatgtaaatattatcgatataataaagatgtgtcttttatatcatgtttgtatggtgtaccccgacttttcctgggacggggattaatacactagcgttcgggaaaaggcaattttcccggtcgcgacagtcggtctggtcgaaggtgagggcaacctccgaccaccgcgcccgccacgtcgcctcatgggtaggggccacggccagaagctctcgcttcatggccttgaggctccggcgagaagcgtgagcacacgctcccccatcaacggtggcgacagtggcctcaggctcctggaaccctaggtcatcgtcgccatcgttgatgtcctcggcgggggccttctgcttggcctcacctcaccggttgccggcgggagccgccggggtattgccctcacggcgctcctgcctcctctcctcctcccacttcctcgtccgctcagccaaacttttgaccgcgcggcagtccgcgaggtcgtggagggaggtgttgtgcatggtgcaccacttgccggtcgggcgctccctgctgggagcgccggcctccttctttttgtcgctcgcaggcctcccctttcgggtggcccgcaaagcgccctcgacggcgaggacgtgaccctcgtcgtcggaatgggccgacctcttcttcctcctcctgtcccgtcgccctgaccgagcggcggatccgggggcggccgaagctgccacaccggaaccggaggagttccaggtccaggcctcctccttgcgagccacacggtccgcgagctgaaaaagctccgcggtggtctggggctccttggaggcgatcttctcgagcatgcggttgtggcgcacgccccccctgaacgcgtagatcaccgcgtgtgcagggatgcacggtatggtgttgcggacttgacaaaaccgctgaatgtacgagcgaagagactcatcgtcccctcgctgtaccgcgtgcaagtccgcttcttcacctgggcgcggatatgtgccctggaagttcatggtgaactgctggcacaaatcctccaagagtggaccgacgcgggtggcaagttcattagccaaccccgcgcctgtcctttcagggccatggggaagaaattcgccatgaccctgtcgtcacccccggcggcctcgatcccagtcgtgtagatctggagaaactcggcggggttgacgcttccgtcgtatttttcggtgatggtgggccggaaccttgggggccaacggacgttccgaaggcttgccacaaaggctcgacagccggcaccgccaaccggggacacggggggtggcccccgtgcccggaccgaagtggcgctccggacaaggaagcgccctccgatgcgtgggcagcacggcgatcattgcgccggcgctcgatattgaagcgggcatctggccccctaagcacatcttcttgggttggaggcgttgacgagggaatggcggacgaacggcgggtagcggccgccgctcgccgcgccctccgcctcgacgacacggagccagcagtagcaacgccagtggccttggtggcggaggaccgccagccggcgcctaggcgctgctgcgccgtcatgaccaaattggccacgtcatctagccaacgtccagttggagtctctggatcagggatgacgggcgggtgacgcaggagcgcgcccgcagcctggagcgcgccctggggcgtgctgccatcaccgtagacgaggagacgacgctccccgtctcgccgtccttctccatcgcccgcgtgcggcgaagtcgcggatttttcgacctcctcgagcgcctcctcccgcccaagacttcggcgagagggggacagtggagtacgagctcgacggcgcgggttctgctccccgtcttcaccgctagcgctcggagagagattgtgcaccactgcccgttcggccattgggctgagcgggagaagcttggcgcacacgaaagaggacgaggccttagaaaaacacacgcgccccctacctggcgcgccagatgacggagcgtggggctcctcaccgggagaccgcgcaggcccccctttgccggttcggccgggggcgctaagtgaggttcttcgccctcgatcgatctggagaatgttcgcgagagagcaagtgcacgagacacgggcgatgtagacaggttcgggccgctgagaagcgtaataccctactcctgtgttctggtggatctgtgtgtaaaagatctacagagagccggagagccagagagttcaggctccagaacccctctcgcccccccttttcttttcttctttctttttcttttggtgggcaaggtcctccttttatatctcaaggggatattacatgcaccacttctacctacttttcttctgggtggggacctaccctatcttgaccaaaacttggcttgcaccttcgcctggaagctaaatcacaacttgtccttgagtgaggctcagcgccgtctctcgcctgacaccggggatctccctgttactccctcattaatgggcggagatttgccatggctgctttccaaatgaccatccgacaagatgggtcatacctacctccactccaccggaggcagatgcatcgtgggagcacggttgtctgccgatgacgcgaccggcgtcagaccagtcacagaccggtcattcttgt

SEQ ID NO: 68946 - DNA, 816 bp, Oryza sativa
taatttattttaggagaattctagaatcctatttttctatattttgccagatcaaacaccagattccgaatcagactctgactctcctatcgagtcctggtaaaactgagtccattttgcacttgaaaactgtttgttattaaaataaaatctataggtcttcattattatgccatccttggcaaacaatgttgtttctttacataacgttgagggccatggcggtacttttaatttcagatattaataggtgatacctttcaggccaacatgaggtcttagcttctggaccaattgaagatcttatagcacatcgtgagcataggtgtgttccactccaactttgttgtttatccgtatatctggttctatcattatctcatcatttttcacaaaatggattatattaggtaccgtatatcaggatctcaattgctagcagcaatggatttgagttcaagcgttccacattctgagttactatcagctcgagctagtgaagcgtctccatttttggacaaacaagaacagatgtctgctctattccaaggaaaggaagaagccctctcaaggttagatgataggaatggacgtgctcaacaacagactgttgatgtggctgaaattcttcgccgttggactcatgctttacagcgtattcataaacagtctcttcatttggtacgctattcttacattaattttgatgagtttaatggcattcttatgcatttaatttatttgaagttttgaacgcgtctgctttcatatagaaatatgtgcattcaacctttcacaactactgtcactgtgaaa

SEQ ID NO: 68947 - DNA, 20767 bp, Oryza sativa
  unsure (1)..(20767): unsure at all n locations
caaaatcaatgtcttcctcatcttattcctccatttatgccttcagtgttaccattaggagatccaattctggcgctcccttcacctatccgatgctcatattgtcacactctcgaatgccaccaatctcaacctgcctcctttgcagccccttgtggccatcttgccatagttaccaatccacttctggttcttgatctagctacccctgattctgtttcctgtctcccctggtgtttcagcagcaatgacacttgtatgctggccatactaatctcatcattcgtagacatttaaaacttcagcattgataatttgaatccccttattagtggttgaagtattatagcatttccaaaacattaaatgaagtattacttgcaggtggttaatatgactgttttgtaataggtgccattcaatgcttagcgttgatatgtgttaaaagtgaagttatacatcatttttatgtttcacaactgatactattgtagatggctaagtatgcataaaactataattccatatgattatcgaactgattttttccataaattgtggaaaattaaacaataggaatttctaattgttttcttttccgtcctttgctgtattttttcagttctgatatcactatttcaggaaatactagagcactttaaatcaaggatataaaataatcttctgcatcacccatatttgttggttgcattgcatatttggcgccatattggtatctaatgcatattaagtactggtatggtgagtttttagaggattctatgttgtctgctggcggttaggcaagctcctgggcaatgatggggtcctggacttggtcaatacagctcttgtctgaaacctaggcacaacagacttgtgcagtatttatgcataatatcttccgttagctaacatgtagctgtgtactaatttgacaggccaaagcaaatgatggagatggaccagaactactccgaagtgcatctgatggtgaaactagtacccatgctgactcattaacggcaacattggctgaacatcgtcagcacttagtcagtatacaggtaaaaccaactatggttggaagctaagcttgcaaaactagtgtccaaaatttttgtggtgtcgactcgtgtccgcttgtctgacgcggggagacacgcatctgaccctgctaggcgtgtccaaattccaaactaaaggaagggatttggtgggggaggggggggagcgagggagatggacaaatggtagtattttcttgctttgtggtggtttcttgggagcagcaaaaggagagagaagcatcaaggagagagagagctcagctgcacccctaccctttagcctagcacacagttggcctgttaggtagtactaaggacctgtttggtagagctctaagcctctaactcctaaatttaactatgggagttggatctggagtggagttgtggagcagcatatacccaactccacctttctagttcattttatgaatgcgctccacccagctccactcacattttagatggagctaaaactgtttggctgggctccagctccaagagaggtggaggtggaggtggagccgtgccaaacatgccctaaagtattaatgtgtgtctgtgaaagctctactcacgagagtagctggctaggattatctatgcataaaggatcctctgcttggctctgtgggtgtctccagagtctttatccctatttctgctttttattttatttattagtgtataatacatgtgagtccccgaatcctattttttagagtttaccgagtcggactcctgagtttgagtaggacactggctcctgtgtccgagtcccagtaacacagcaacacccttggggtttgaatcacgtggattttactgatgattacttttatctgtcaactgactgattctctaaccattttctagggcctaattaatcaactcaaggaagctatcccggcaatgcagcagtcaatagcagatctgtcagaggaagtaaatagcgtatctagtaatccaatggataaaatcatctccagattgtctccgtcagtgcaaaattcagggtttggaagagcagaagtaagaaaaagaaaaaaatattggattggttttttgttcgatgatgatataccatgttttgatcaatacagaaaatagtctcgttaaaaagaaaaatagtggggctatttggtttgtgaaatgtccatgctcgtttaatcagcttattgaggaatgtgtgtctgttttgatcagctgtccttgaatcattgggtccaagaggcatgcactttgtgtaatagggtgaattcatcctgcacaagctaataaactgtagcatgggtaagggtgtacagaaccagttgaacagggttggtaatctccataattcatgcatgagaagcagtccatgcatgcatacaagcccaataccaattattggcaaaatttgtttttatacacacctagctaattgtcatgttaatccaatccccattataatggacttcgcgtggcataggggtattcctcaaccaattggagtcttcttttctcttgtagttaccacaacagcttttggtgtaaagacattatatcaccatgttatggcgtgtcactttgagtctgtctatttattctcctgctttctaataactttttacaggaaagcagcagtgaactttcagagatgacttccaagctttcttctacacaccttgacaaggctgggagcagtcctgctctaaagctaccacctttatttagtctgactccaagttcttctggaaaaggaacacaggcacaaaaaaggaatgcgttaggacggcaacctagccaagaaatcctgtctgaagagaaaactcttccccttccctcaactaaagatgaaacaaatggctcaatacatggtattttctatattgtctaaaccatatgtttcttctgtaaattccttattgttccgttggttacaagctgaacttttgacaatgacattggctaatttttttttctatatctatttttgcagaaaatgagggttattttgctcataacatcagacgttctgttcgtgaagctgctctatcaaagccattaagaaacccagagaggccacatgaccagagtagtgatgatggttcagagcacttctttattcccctatcaacaggtgcttcaaagatggagattgatgccgtcgataataatagaagaatgcaaaaactgggtttttcatcaccacaaatgaagttcagtgatcttcacttcaatgttgacagcccaatgcatgcaactcctgttctgtcaagtaaacttaatgggcatgatgatcctaacactgtcacaagcatgcttgatccagtaagtggtctgggacatcagtcatttataactgatgatgctcttgatcaagtattctccccaccactgttgttggagacttctttatttcaggatgcatacgaggacttgcttggtaagtcttcccagactcattgtcacgcttaagtagttattaggtgtacgctcaaactattgtatgcatgcaagtctttaaggttttgtgttgtctgaattgattaggcctcagtaacagtctgatatttaaggatctgtcggttgaaggaatgtgacgaatgattgaccactcaatctgacatgacttatttggtttgagaaacatgatagttggaggatccgtaataccttaagccctcaaatgcatagctcagtaggaaaaaaaagaggaattagatttatatcccaccaaaattatggaatgacccattatggatcaactttgacaacttattttactaataatatttaaaataaaaagtataatattgatgtaaaaaatgtgtacaattctaatgatgtcaactattacgataaatcaaaatttatttatatataatagcagtagaaatttaaaaagttatgacgacattttttgaaagtcatattgttttagagagggcagtactttgaaggcaagtttggtgcatccctttctgttttgattcacaggtttgcagttacagcacccaaaaaaaaaatcaaacttacctgtatgttatctgttatgcagctccattatctgaaaccgatacagctttaatggaacactagagctcacatgtacattgtgtaatactttgaccactgccgtaagcttcagtgcttgatcacagcctggaggttcttatggtttggttctgactgctgctgggacatttttggtgaatttcttgctggttgtgttgcttgccagttgccaccagcttgtgagggatgtctgcgtcagaagaaggggtattattagggaaagttggggtatttggttttggggagaggaaaagagtgttttagcggtgatatagatgtctgtaatgttccagccgttgtgtgcacagtaagataagattcaaaatcgtgtgtatttagcgtacattgtatgtatttcttgtaataatttgcttcgcttaaaagtttttctgatgtgcgggttctgctgttctgcacttggtgaattgcaccggcgatttgcgggaaagcaatctttggagacatacatcgatgggggaaaatgtcgaaaagtcatgaactaatgctgaaaagcttggagtccacaggtgtgacatctggtgggattctgatggttcgatgaatgaagaattttgagaaattccgtgcatgaagtgcccaccgggcacctgccaccgcctctcatcggtaactttgcttatctagtccgaaccaaactggaacacttgtgttaactagtaatcgtgcacgtgcattgcacgtttcccacattagttatagtaatcatataaaaacacttcaaatttcttgcattttcctgtgatatatgtcaggcaaaatatacaacatactagaaagtttaagaactatatgtactataatgtaacttgacatactcctttaaacaataaagaaatgcaaagcagctggcaatgccggacatataatttgtcatagcttgataaacacttgaaaagctcaaagcaagatatgtgtatttatggtattgaattagaccccacagcatacaacctcttatcaggaaaaaagactcagatcttcaccaacaatacttcaaatatatccttcatggccagcaactaaaaatagcatttacatgatcaccaatgaggtgtatacagctcctgccgtgggtccacagaagttcatgtgatctgcaaaacacaaatttacatccatttcacttgtaagaaatggtcatcacatataattccaaaaagaatattgtctatagttgccttaattgaagtaaaaaagtagatagcaagtgtgaacattccagaaacactaacatttgtcaaaacgcctctatattttccttgaccacaatattaatctaaagtggtcatattgctaaactatgcacacacctgcagttgaagtggcagccacgaaaggatctaccaatcttaaaatctggagaccaatatctttcatggaattccctcaaggaaagggttccactattagactggaaaaagggaaacatatcaaatcatgaaaaaggcataatctgaaattggaatagcgtatatctttttaagatttaatttaatcctggagtccacacttttttcgtgaagctacaaataaataatatatccataatggtgatgaaaaggatttaaaacatggatagtagcactggattaaaaacatgaaaagcaccttacaatccaaaagcttgagaagacattagcatcaggcatcttcctaagaaaccaaatgctcttttagccacatcaaaattttcaagcaaactacgtatgtccaaataaaaagaaataacaaaccgtccaagcaagcatatgccgatggataaaatttatgaattacatcattagtaattagaagtcatcagcacaaagcaaatattcaaacttcccaaaaacaatgcaaattatcagaggagaaacatcaaattccatgcttataacttgtagaatatacactggattcaactgatgcactttttaaggaaatgaagccatagttccattgtcctgagctccaaaattgatcattggtatatacaaaggggatattcacttatatttaagtctgctagaataaaactctcttgacctatggagttatatgtgcatacatacaaactgaaagagacgcttacatttaagcttgaggacatttcaacctgataggctcatgtcaaaccaaccgttgaaacaattccgaaattaagtgattaccagctagagtgacagccaaaagcaagctcaacattgcaatggggaaattgcgattagggaaatcttgcccgtgattgcaatttcggaacaaaattttcaaaattttgcctccccccccaccggcaagcatatatctcacccgaaatttctccttttttcatgtttttgtgaatttggtcaaagtttattctaaatcattcaaaattcgtcaatttttcaaataaattcagtgattttggttctttcgccccctccccccacggaaaaaaccccaatttctagaatgcaaaccctgaatattgcagtaaaactacagtgaaatacttggtgcacaaatgtcattacgggtggcaccgcttcaggttttttttttcttttgcaaaaatttgagagcattacatcacctatggcaattgtagattgatgcatccttccgctgcttgtactcatggttctgttgaaccttagcttgctactgcttacaattgagcaaagcatacctcatccaagcttgctatcttctttaactcgagagcacttaaattagtggtattccctacggtgtttgccagtaaattagaattagttaactcaaacagtacatgatatatagtgaagaaatcacaagcttaaaagctgttacataccatcgatctgtataaattaatttcagagatatacaattagcaattaactggcagcggcataacagctttgcaaaagaagcgaacatgatgtgtattatttacttgtcactgcaagcaatggtgacgtaaagcttcctgcattaccgggccgagctgcaaaggtgagtcgtgataaactttattacattcagatcacaaatgttgattaaaatattttttttgagcattcaatcgatccagagtactacctgatgtagatcgaaccactatacatgaatatttgtcagaaccactatcaatgtttgtcgttgatgaaatcccactgatggatctgagcaaccaaaacatcacatcagcatttgcatgttcctagcaaggccgaggaaccaatcatgagtttgttctgcgtattgtattcatgcagaacatatgcgccaagcagaacctgaacccggacaggtcgccttcaatctcactcaaaatttgtaaagctagaaggaacaagaaaagggattgcgatgaacaagagttgtagccaatcgttgtacttacaggacagatcggtggaggaagaccttgggggtgcatgtagcgacgcaactgctcgcttgcggcggcaggaaagggaccacttgcgttccggtatttgcacgacgagcgcggccgcaacggcgaattgcctctcgctcgtggcggcaccaggggctccgacctcgccttcgtgtatcggtgtgcgactaaggatgaccgagctgcggtggagtgtacggtgaggcgctggagtggaggaaggctctcgccggcgcaagtggaggatgttggatcggttgagtgtattcaagcgctggcgggggcaggccgcggttggggaagacctcgacttcgtcgggggcagcggtggacttcggcggccaccacggatggggaagaactcggctccagcggcaactggggacgacgtcggctccggggaagaccacggctccggcggtggctggggatgacctaatctccggcgtgggcagcgggggtggcagcggaaggggacgacctcgttgccccgtcgcgaggaggagggaggatgcgcacggagcgaggagacggcggggattcgtgggtgtggaggagaagcgaggaggcgcggggattcgccgggcggcgaggaggagcgaggaggcagcggcgaggaggagcgaggaggcgggggcgattttgggggcgaagttgtcgcggcggggaggagcgagggggcggaggaggcggtggggatttgtgcggcgtagtcatcgcgtgatttctgaataggtggaatcgctcatcgctgcgcacagttaggaggatagcggacgtatgagattaaatcagatgacggatggacggtagagatttgattcgggtgatttccccagtaggattggagaggtacagctcctcttttttatattagtatatagatatagatatagaaattatactatgtataccaagaagggagggctagtagaatcaaggatgtagagcttttgtatttgtataggagtcttgacttagtctgcatcttagttgaaccattaatattgttacctgcacaatgttacgttggattggatttctcttaatttgattcactagcaaattgcatgtgccttgcacgggaaaaactaacttatgacagacattatataatttggattaactatttcttgtacacttaatacaattttttttgctgtgtcggtagtgaaggagcatcccgaccaattttgttagggtataaattgcatcttgggccgagtttagttaaaactttttcttcaaacttctaatttttttatcacattaaaatttttctacacacacaaacttttaactttttcgtcacatcgttttaatttcgtcaaaactttcaattttaatgtgaactaaacacacaccctggaccatctttttttacctttgttccaagttagacttgggtaggacagttttcactagtctcgactagggaagtttgcataatatttcactttagaccagttcttctctatcctctgccattgcggtcctcaacgactttgcgcagctcctgacctgtcttcctggaactttgctcctccgccccagctccgttcattcccgagcttgaaagtccaaacgattatctccgtcagttcgcttgctccatgtcaccttcacccttgacatcccactcgtgcgacaagcacgagagagagaggatgaagaacttttgcctgagcaactcgaaatggccaacttctgctgctcttgcatcctctgcgtgggcggataccgaggcaaacgatctagttgacgcgcggcggcgtaaacctcggcgcactcgcggccaaagcttacatccaccatcttccgtgcgatctggtgcatgttcgcaactgaccctggcgaaagctcatcgatcaccacatcctagtctatcaccggcttggcaattgggatcggcttgccgccgtaggccgtagccttcctcatcaccaatcctgtggtcttgggctggttgcattgcttctacctaaaagtagtactctaggaggcaagcagaggagagaatgggccggcggcggctcgacgctcattggcgctcctgcagcccatggaagacgattaggagaaggaataagttcactttacatcccttaatttgttgccgagtttaaaattcatcccaaattgcaataccacatacgatgtgcccctcaacttcaaacaatacaaataaatttcaaggcggtttggatgacggttttggctgacatagcacctacgtgacaagtttgacttggtcctcctacgtggccgtgacgtgtcactaaaagcaaaaatataaaaattaattaattttcttagaactgtggggcccacatgaattcttttcttattctttctccacttagcttagtatttatttaatgagggaaacttagttctttcttctgtttgtcacctaccttttgaatcacttaacccctacatagactttgatatatacaagtaatatatagctattagcatagtactctcttatcatatcttccattgggattaaataaatacgatatattggaatactctcgagtgaaatgctacaatggtatatccgtgcgcttgcggattatatctgtgacactgatttcacgtagaaggcttgaaggagggagaggatgagagtgaagatctacttgtctctcgtgccaacctggtgatgagatccaagatccaagatactccctccatctatttttgatagtcatatttccaaatctgaaaaatttatttttgataggcatatttcaatccaacaatctatcctcttaatgactttattagatttaatgcgtgactctccattcttccacacatgattggctacataggcattgagaaatgtaaatattaatgaatcacttgcttacgagaaatgactagtagcatgtttaaatggatgataagtagaattatttatccttagtctgtgtgtcaagatgaaatatgactatcaaaaatagatggagggttccctgcaaaaaaaaaatggagggagtacatgttaaggactgagctaagagaaggtgaggaaggaagacctcatagacaatgcctctagggaggtcgtgccaccaatgcacaccaccatcgtccatctaaattctttacaactcctcatttcctatgttccaaacaaacgaaaaccatcacatatttttcttatgtctttcattactctattttgcatatacaatcatctcatagggattcctatattttcctataattttctccattcgtaaggggttataagggctcgaaaagcgcatttggaaatagctgattagctacacctgaaacatgggcgcatctgattaattcagtattaattattaaaaccatcaaattattttattttttcaaaacaactaattatataggatatgtttggggagtttttacggtccaagatcttcgtccatattctaagtagttctagaatctagaaaataaattctctagaatatcaaaagctgggtaccaaccagctcattctcagaatattaaactcccccaaatagaccaatagaaagtttgaaaaatgtgctaacagaaatcaatgaagtagtcaagctgaaacttttaggctgtgttcaagaggacgggttacgacacgtacaatgaagcactcattagcatataattaattaagtattaacttaaaaatggattaatattatttttaaaaataatttccctagagaacttttacaaaagacatatcacttagtagtttggaaagcgtacacgtggaaaatgagagagataagttgaaaaagtaaatagaagaacaggccataaaggtatacagacctacatgtagagtaaataaggccgtgtttagatctaaagtttttcttcaaactttcaatttttccatcacatcaaaacttttctacacacaaacttttaacttttctatcacatcggtccaattttaaccaaacttttaattctggtgtaaactaaacacattacatttagcctagctataccagattaccagtacatgaaaataaacttaaaaaatacgctctcaatgtccaactaataatacgtgtagacgaaaaaaagagccacattccctcgaaagaaagaaagagaaaaagagccacatgtaaaacactccggaggggagattaggtgagcagtccaagtgtctgcgcgtcctgtcccagttagtcaaaaaggaggaagcagtaccgctgctttcagttcctaccacacacacccccatcctcaccgatctctctaaacccaaatacgcaacaaatactcaatcgtcacatcttaaaaaacaaagaaaaaggaagagagagagagagggaaaacaaaaaagaaaagaaaaatcaattcccaaccttgctgctacaaatgcctcaggcttagcaactcgacctcctccccccttctccccttcctcccttctttgacttcccctttcctcctccgtgcgcacgctctcctgattcatacagcatttcgtcggggatgacgtcgacggcgtactcccggccgtcgaagctgccgggcggcggcaacggcagcgaccgcaggctgccgccgcggctgatgaggggcctcaccaccaagatcgagcccaagaagctcggcgtcggcctcctcgccggctgctgcctcgcgctcctcacctacgtctcccttgccaagctcttcgcaatctactcccctgtgttcggtgcgtgctcccctaatcccgatccgccctaggagcttacttttggttaaatcccctcccgcgttgtctctcgaatccaatccattttgatttagtctaatgggagctgttttgaatccgttttcagccagcacagccaacacatccgctctgatgcagaactcgccgccatcctcgccggagacgggacccattccgccccaagaaactgcagctggcgccggaaacaatgacagcactgtggaccccgtcgatctccctgaggacaagtcgctggtggaggcgcagcctcaagaacccggcttcccctcggcggaatctcaggagcctggcttgccggcggcgctctcgaggaaggaggatgatgcggagagggcggcggcggcggcggcctcggagataaagcaatgtaaggaaatcttgcctctttcttccgctcccttttatttgcgcacctttactggaaggcagagcaagctacagtagagcaagtccccagttgttgttgagcgcaagcaagcaatcaatctcgtttggatttggtagagacgcacgagatctgggcggtgttttattggggatttgatggtaattcagtctcgttggtttggttaattcagccgagaagaagaacggcgtggcggcgggtggtgataccaagataaagtgcgacgagaacggcgtggacgagggcttcccgtacgcgcggccgtcggtttgcgagctgtacggcgacgtccgcgtcagccccaagcagaagaccatttacgtcgtgaacccgtcgggcgccggcggcttcgacgagaacggcgagaagcggctccggccctacgcccgcaaggacgatttcctcctcccgggcgtggtggaggtgactatcaagtccgtgccctccgaggcggcggcccccaagtgcacgaagcagcacgccgtccccgccgtggtgttctccgtggccgggtacacggacaacttcttccacgacatgaccgatgccatgatcccgctattcctgacgacggcgcacctcaagggcgaggtccagatcctcatcaccaactacaagccgtggtgggtgcagaagtacacgccgctgctccgcaagctgtccaactacgacgtcatcaacttcgacgaggacgccggcgtgcactgcttcccgcaggggtacctcggtctgtaccgcgaccgcgacctcatcatctccccgcacccgacccgcaacccgcgcaactacaccatggtggactacaaccgcttcctccgcgacgctctggagctccggcgcgaccgcccgtcggtgctgggcgaggagcccgggatgcggccgcggatgctgatcatctcccgcgccggcacgcgcaagctgctgaacctcgaggaggtggccgcggccgcgacggagcttggtttcaacgtgacggtggcggaggccggtgctgacgtgcccgcgttcgcggcgctggtgaactcggcggacgtgctgctggccgtgcacggcgccgggctgacgaaccagatcttcctcccggcggaggccgtggtggtgcagatcgtgccgtgggggaacatggactggatggcgaccaacttttacgggcagccggcgagggacatgcagctccggtacgtggagtactacgtcggcgaggaggagacgagcctgaagcacaactactcgcgagatcacatggtgttcaaggaccccaaggcgctccacgcacagggatggcagacactcgccgcgactatcatgaagcaggacgtcgaggtcaacctcaccaggttccggccaatcctgctgcaggcgctcgacaggctgcagcagtaactcgtctatcccaataatcgcaggcagctcatggcacacatcaatgtatatgccgggacgagacgacacgacgaggaacaagaacggatactagtatattgtactgctgcttgaaagagatgatgatgatcttaaccggaggagaaccatcagttgttggcgaggcggtggaagcttttcgcatattggtaattggttgggttgtccattttgggtttgtaacaatttgcataggcattacacaccaaagatgttcgatttttttgttcttcttacacttcttcacttcgccagcccattcaacactatacattcttttctactaatacggagccaaactaaactatggtgtttaattattaaaacatcaaattggtcacccaaacaaaacaaagtggcgatgaaagaaagatccaaatctgagagttgtttcagacatgtgcaatctcctctaataaattgaacaaatggttgttaaacgaatctgcatcccgagcgttgaaggggcttagctggtgcggacgtgccagcatggaagtgttcgtggagaaggaaaatggattcgatgctctgtccaacactggtgaactgctgtatatgcacccgcctgctgcctgctttcagcttaaggaaaagatcactaataattgaaaagcacaggctaactaaccgggctctgcaagaaagctgtgacaggtaagtcgtaactagttttgggcaatcgaataccttctctcttttcttctcttttcttgagaggcagacagggagatatagagaaagaccttctccttttatctttattttttcttttttcctagaaccttcttgctgtcttttggtagggaaagagactagaaaatggaacgatgatgaatgcatgaatttcccataagaaattggcaagctagcctcaccttttcagtatcgtatgcatcacgcgaaaagattaatcacaagagggtgacccggcaacgagaagaggagatcagccaagacaatcttgtagccgttagtatgaaacacacgattaatcacaagccacgccatgctcttcatgccgtcacttggatggacgcatgcaaactaagtcccccttttatttatattaggaaaccataacaaatttagaggattttaattctacagaaaaaattcttacgaaaatacttgaaacaaaatattgattcatatactgaggaaagttaatatgagctccaacctttcaaaaaaaaaaatagtcattcattcttatcgattcatgtatttttctaccgtttattcgaacaataatttatgcatcttttttgtgttttgtacttatgtttctattaaaatcaagtgtattttttattctttgcttttttgggtcctgcaatagcccttatatgtaaaattgtttggagcacgtgtgtttgagtagtcatatttctcacgaacggagtggtagatcattatgctacattttttttcctccagaaacatatgtgcagatgctggcacatgtatcgggcataaatttatctggaatcaactcaggactcaaccagtatgtcagtgatgccgatttattggcggaattcgtagactttgtgtgcccttgatctggccactttgcgccagtcactacaaggtcaaccgtagctatcccataacctcttcccttagtttcctactctccataacataatcatgttcgtgtagacgtacactactgtttgtatcagatcgtgacgtttctggatgtgtgtgcgcgcgtgtgtacacaagtttctggatgtgtgtgcgcgcgtgtgtacacaaactagaaatacttacatttttttccttttcttcgccattacaaattcacaattagaatataagtattttagtttgtgcagtatagatcaaaggttaatataaaaaaacttcagcaccgctccaaaaataagggatggatggcgtgagaggaaggtgggataagattaggagaaatttcaagtggagaaaattgatgggacaactagtattatgaataatgttagaaatcttaagggtccctttgaattggaggaaaaacatagtaattttaggccccctttgattcagaattttagaggattttattcctataggaatttttcctacaaagccctttgaatcaaaggaatgaatcctatggaatcctatgaaatttctatggaatgcctcttcccatacaagttttagatgaattttaacaaggggtagtacctcatggaagaaatcctttgaggttcaatcaaacggtcattcctatgtttttcctgtattttgcaaatcctctgttttacatttacattcctgtcagaatcctatgtttttcctattcctccgttttttcattcctgtgattcaaaggggccctaggatttcaatcctataggaaaatttcctatgaagccctttgaaacaaaggattgaatcttatccaatcctttgaaattcctatagaatggacaattctatagagattttggaggaaatttagcaagagctttaatctcttggtaacttttctttaagtctatctctctcatccaattcctatgtttttcctgcggttcaatcaaacggtcattcctatgtttttcctgcgttttgcaattctctgttttacattcctatcaaaatcctatgttttttctattgttatgttttctcaatcttacgattcaaatgggcccttaatgtttaaaaattcaagattcaaatgctaaaacatctagtattttcaaagagaattctgtaaaagaaataggaaacgttgatggagtgtaggagaatgaagtaaaggcatgcccaacctttggcacgaagaatgctgtgtcattcttgcacaagggggaaacgaaaatcatgccactattgttggtccagagagaaagcatgcaagaaacgtctttgctttgaacatacgtgctgtctgcccaaggcatgccaagtactctggaatttatgaaatcctgcagctcacaaatcttttacgaaatacagctcgcaattttttttagtgaaatccagcaaacaatttacatggcccgaacaacaacggcattgtgttttgtttgaaatagaatggcaaaaattaggtgaaaatgttacaagaagacggttggtttacattggcatttctggaccaacggcaatttgttcgttactgcctcgttttcagagaaatctgatcagctctcgcctctcggcttcagagaagctcccttgctacaaaccaaaccaaaccccgtccagcccccccccnanccccccaaaagtttctgttcgaagtaggtacacaaataaaaacaactatggtttccatgtcacagtcaggtcagtagcagtttggtaggcctaaaaattaatgcgcacatttgacactgctgctgcaacttggacctctatgtttcccgttcatttctccaagaaaagtcggataaaaaaaaatttcgtgacacgttttttaaactgcgaaaattttctatatgaaagttgctttaaaatatcatattaatctattttttaaatatgtaataattaaaactcaatcaatcaaacgttaatatcaacttgttttacgtaaaataacttaatcttcatattcatcttcatcttcagtcctagatttctattactgagtatactagtactactacaaaataaagcttgattaatcaagtactagtactccctctgtctcattttaagtgcagtcgtggatttccgtacccaacgtttgacccatccgttttatttaaaaaatttataaaataaattttaaaaaataagtcacatataaagtactatttattttttatcatctaataacaacaaaaatacactaactataaaaaattttaaataagactaacggttaaacgttaggtacagaaacatttaaagtgggatggagggagtaggtgtgcacaaggcttggtcgctgtcatgtacgttggccacgaacactgacgcaacaagaaattagatcaatttgttttgcttgtgcctcactccataaatgatggttatgaacaaaaaaaaaacaaaatttaaggggattataaacgtgtagtatcggaaacatggcccctttaggatttagccttgtcaagtggagatgaacgtagatagttactaattacgcctaaatttgataccaagattcgaaatatgaaaacattgtcaaaattttgaaggcattgggtttccttcacggggccagtataactgtcgcctatggactagtttgaccgatatgttgggcaggtctaaccagcggcatgtgaccgccgatcagaccgacatagtttgactccgagctgttttcgtcgggtcttgggcttgcttgctcaggaatgtatgcttcgggttttcattggtttctaccctgagttagatgtcgaggagaacctatagaaggcaagatcaaccccttaacaagggctaagcctggtttgattaaaaacccctcaacaatctctcaatcccgacacaatcaaatcgttcttttacctttattttttagccacattttccaatttaccctagttcagtccatctttatcgatttgcatcgtaaattgttcacctttgctgctagagtgcaattatccctttgtaattaagtttgccccgtaaacctttcattcgcccatgagacgggtggttatcttcaattcgatctaaatcagccttgtggctggttttgatacctaaatcggctctgctagcctgtttaatctttaaaatccaccctgaattccactcgaaactcaacgctgttgttggtttgatctttcggtgagttcagataactaagatttggaagaaacattaacgacctgactacaactgtacgagatgttgtgttgcgcctttgcgatcgatacacctctccatgggttgttgatcttgccggtgcagatcaaccttattcctgcaaacaaatcgaagaaacaagcaataacaagataaaagtaatctgaattgcagatagaaatgaatacacacggtaagttggtgtttcgaatacaagcacacgaacggtctagcagacacgcgcactgcaagaaagtagcaatggctaaactttcatctaaacaaaacccaagaaaccctaaaggggtacctagctatttttaacggtgggaggacaacctaggagtccctagggtcatgctccacctggttgaggcgcaccccacatggctcggggtcccaaacgaagttacatgcccattggtccaatataggtgaggcaacaccttgtttctgcatttgtgtccctctgggaaggaatttcgcactgaggttggatcaattggaaagaggactctgagagctttccatcaagtactcacgggctgaaaacgaagctcgtatactgatttggcggccgtttgagcaatgtcgcagttggccgaatcagattccagcagttggtcaacttgatcttgatgtgagcgacggttgtatcaatagtagtcatggtcacatcatactccccttcttcacggaaaaccctcctctgtttttccatgtggtgctcttcacatagtcgattcaaaacaacctgtttcatccaatcaaaactagagaaactcgaagtagtgcgattaacaataacatgtttctctaaatccgaatagatgaaaactctaagcaccaaatatatttctctatcattatattcgtcaaaggtatgaaaaatagcattagttggacatgctaatcagacttagcaaataatttctccttcaaattatcgagctcacaaaaatcatcaaactgaacatagcgcaaagtatttaaagaagatagcaattcatgtgaataacatgtgaataacatgcttaaaatcagcgcagtaagatataacagtagaaatagcatgtccattcactagttgcggcatagatataagtgaagcattatcacacaactcttgtttatcacaataaacaacaagtaattcaacttgtgacaaaggcatctcagcaattggttaatggttgctctattatagcattaaaagtgaacatgtgtagcttagctcgagaatacccaccttcatttatttcagcaccatttaatttaccttacaaactttcttcagacatcacaggtgcttcaagcttctcatccgtcttctcaggaacatcattcttcttcttttgttgaatgatcggaactccctgcaaaacgttagtaacaggagacacaaaagtttgctcctcccatgtttgcatgtcatcattgcacaaggatatatgagattcagaaacatgaaataaatcacattgttcatgctttttcgcatttgatatgatctgactctcaatgctgcgagaaagcatgaataggtgtccgatatgattatatgtcacattagtaagcatgagctgaattttagaattaagccccatgaaaaatctgcacattgtgttttcattgcactcttttatatcactgtagatgatacaaactttaaatttatggatatactccctaacagttctatcaccctgtttcagatgttctaatttctcacaaagagtacttttctaataagaactcacaaaacgctttctcatcatgtttttgcattcatcccaagtttcaggtttgttactacttcctccgtttcataatataagtcattctagcattttccacatccatatgga

SEQ ID NO: 68948 - DNA, 712 bp, Oryza sativa
ggtactgccaacgtgaggttattgaaaggttttgccttggcaagtctcattcgttgggacgtaggctcatgtgttgggcaagtcgcggagtacgggtaaagtgtacatccactgcagtgtgagtaaaaccaatctattcgaatagccgtgctcgcggatattgagcatcaggacatgtattacacttggctagactctaaattcttaaattgaatgagatgggatatgcatgatgattttatactggtggatcatcttctcgagagacgagaaggagtaaaccccagaaaaccattacagccagtaacgggaagccatctttgggaagacaatggatggtgaaaagaaccgttgctgtgtaataaatactggaattaaaactggactagtctatgctagataataagcttgtgaaaagaattgtgaaactagctttatgcaaataaaccaacggccatactttgaatatcactatctgacggagctcgtggctcctcaccgggagaccgcgcaggcccccctttgccggttcggccgggggcttaggtgaaatccaagctctctctgtatgtggaaagattgttctgctagcaagggaacgcgagacacggcgatgtatacaggttcgggccgctgccaagcgtaataccctactcctgtgtttttgtggatctgtgtatgaatgagctacaaagtgtgagccaaactctcc

SEQ ID NO: 68949 - DNA, 12959 bp, Oryza sativa
ccaacctctcctccgctccgaagcggaggtcggcggcggtggcggcggcggcggcgcgtttccccggcgagtaaggtgaccggctgctcctcccgcacttcctacgcctcgttccgtcgctacagtagcggaggagggcctgcaatctcagatcaggggtacctgtaacccgtttcggttcttggtgggtgggttggtggtggtggttcttgatccatccatccagcggttttggtgcatctgtgcgagttccatggtctaggttttttttttcttttagcatttcgtagtacgtggcccgtggtagatggcttgggggagtgcaatgaaatgctgtgggaaattagcgtgcgtttagcacatagcatctgttcttagtactgttttttttctggatatgttgtggccttgagggtatagattgttgttaatttcgatcactgaatgtgtggcagcgattaatagagtgccatgggataaactttcatggaagtagagtggttcctttttttttctcttttcattgtgctggagcatcatgatggggctaagatcggatgtttttctggttgtggttatgcttgaatgtgcgggtcttctcttggtttttcaatggtctgaaaatgtgggctttgtgctggactgtttgagattttgtgtgctatctttacacggtgatttttcataaggctgaagctgtaaagccgaatgtcgattcttatgatcggcaatataatttatagggtgcactagatctaggagagatggagacaattgtttatactggttcagaccctcgacgtgagataataccctagtccagatgagtggattagatctgtattggagtgcgcagcacggcgtaggaatagcacgtggcgcttatggaagaatgagggtttcccggtgctccttatataggtgcggaggcaaccggctagatatggtagtgtagccttcataatccgggtacctaccatctatttacaagggataggattggccaacttatcccttatctctttcttagtttacaagttaaccatgtgggcctagggcactcggcccacctcatgccgcatggcccaaaacgccttgctatgggtatctgggtaccatgtaccccacactgaactgaactgaaatccatacacacttaataacaactggagctatttttttaaagtgtatcctggaacatttattgaaaataaatagttagaatatttttttctaatttatttgctggatagctagacagatattaggatgagaagggattagcattggtagatctcaactatcaattacttaggggtaaaattcataagccaatgactctgtcaaaacctctctgccactgtttacatttcttaataaaataataagagtacaatactgaagaatgtaaaaaggaaacactagaaatggatgatatttgtttttcctgctttcctttttttacccctttccttgtgttaagcgatcgaccttactatatactcttgcattttgtcattattacatggaaatatcaccataatgtagtatgatttagtgcatggcttcctattttactacatgatcttcatttgccgacagttgaggtacatagaactgccctcacatgctattttttcaagcatcacggcatcccccttttttctttgatgtgagcatcacgacattcttatccaccagactaccactagcatttatttactattagaacaggctgaacagaagccaccatattctctatcaagggctagaaattacaacgttatcaaataaaaggagaaatatcgtcactgttcatcaggatgagctcagattataatggtgaagatttattggatatattttagagctttctttactatacctgtatgaaagttacaattgtgtttctagaaataaacctaagagttatatagcaaatgcatttctactttcaatagactataatctagccctgcaaattgcatgaagaatccggctatctctttattacaagagatactgcacacttttgtgtggttagttcttatatccagctattagattggcagtaagcagaaaaataattcaacagactacctgaattcgtttgctcttgactctctttgtgctgacaactatcattatcttagcaaaatatagtaaaaaattgaacttgtcaaaataattggtcataaatggtgtgcgtgaatttacttatcatcagctatcactgatatcgtaaacagtatgagagagcacttttttgtttttgcttcattatttatggactttgttgttctggttgtgttgatagttccttttttacacactgttttattaagtattatccacacaagttacaactgccctttttctttttttccttttttgtttaacaatggaccaagcatcatagaacaattaccttattgtccctcttatgttttccaggagaaatggaccttgcatctcaaggtgtggtaacacaacaacaaaaaccaagtggacggagaccggttggaagctcacaaatctggacggtatgtagctgcttctccctttgttttcacttggccatcgtgaacaaaattacatgcagacactcaattttccacagcgatatggtgttctgcttcccagccagcagacacggaagctaaaagaatgggttctaactgacgaacagcaacaactagttaatgctagtggtcttggacatcttgccctcaccacaggatttactattgatcgttctttgcttacagccttttgtgagagatggaacaatgaaacaaatactgcacatttcatgggatttgaaatggccccatcactccgtgatgtttcatatattcttggaattccagtgactggtcatgtggtgactgctgagccaattggtgatgaagctgtgaggcggatgtgtttgcatttcttaggagagagccctggaaatggagagcaactgtgtggcttaatcagattgacatggttgtacaggaaatttcatcaattgccagaaaatccaactatcaacgagattgcttacagcacccgggcataccttctttaccttgttggctccaccttatttcctgacacgatgaggggatttgtatcaccaagatatttacctcttctggctgattttagaaagatacgtgaatatgcctggggatctgcagcccttgctcatttgtacagaggactatctgttgctgtaacaccgaatgctactacccagtttctcggcagtgcaactttgctcatggtactgttcttgtttgaataaatttgaatgattgtcgatgatatttggtatctttgttaatgagatttattttgttctctcaaggcttggatttatgaatatcttccattaactcaaccccaacaaaagaatcagaacaccttgctgccccgggcctgtcgatggaactttggaggagcaacgcgtggacagagaaagaaagtcatggaatggagaaaagttttcgatgagcttcaattttctgatgcaagtgcaagtctacctattttatagatttataacaaagattttaactgctgttgtgttattttatattaattaattatattttcaggtcaactggaatccttacaaggacatgaatcctgcaattattccagaatattgcattgcagcagataacatctgctattctcggacatggctaatcagctttaacataaaagaggtgtatgtacctgatcggttttctaggcagtttgggagggaacaaggtcgcctccatggggtgcccatgtgggcaagaagaacttggagcaagtggaaggactggagggttgagtatgctcgtgaaatcgaggagttccatcaattggttggctgtcgtttcactcctgcagaaaccaatatcaactccctcccaattgagtctataactaaacaagatgctgcaggatgtagtcggagcacatctcagaacttctcttcaatggtaagctacaaataagaagctaatccttcatatgtttttgcttgcatagtggtccttattgtaattgctgtttgtgagatgcaggttgaagatctgaggaatgattttccagtaattgatcgttacctggagggacagttactccctgtggaagttgcaagctttctagagagagtgggtatgatgatcaagagttactccccaccacagagtagccgaaagaaagatcaagcagggcagggccaggacagcaatgtcaggtcaaagaacccaagaaagagggggaagccgtcattctttcaagatccttcaagccctccgaactcaagggcggaccgattcccagccgtgctgataccttatcaggatagcaagtgcgacatggttctggatggcaccgtccctctgctcgatggagcggaggagttcaaggaacaaggggtcatggacctctggcagaactcccacctgacgacgccgtcctgttcctcgctggactcgagctcgccggaatcaaggaagcggaggcagcaagaccgcgacgaaatccggctccccagggacaccgagaacctccgaaggagcgggcgtctctgtgtgcagctgaaaatgttcaagcacagggacggggtgggagccgaggcgaccaacccgatcttcctctgatcatccatggtttatgtacaaagtagcagaaaaacttgggctgctgacagttaactggtttatgtagcgtcgtagactttttgctggtagcgccttgccattcactgcgcagagcttgcaagctttatctccttgttaatactatctctctctagtctctaccatgtagttgggcaaaatgtagatgatgccaccaagacccttttaactgtgttgctcgtgaactggattgtgccctctcccgtttaatctgcagctcttgcaacatggtgaattggtgattttataatgatgctaagctttgactgcttgtagaatgatccaagtagagatgtagagagcctactgtgctatcacatcaattcatcagccttgtacgcttggattgtttgttgcaccagctactcctgctgctgttgatcctaaaaccagcttattgatatgctggcagtgcaccattgaaggctcctatagccatatttggcgaggcagtggctagccgaggacagtgttaccatgtgatcagtgatcattctacatgggaaagctaccagtgatgagagcgccacgtttcgccctagcagcgacctctggcacggggggccccacacgtcagcggtggaggcaaggcaaccacgaaggcaatcgccatcgcctgccctttcattgcccaaccaacgctcgcctgcatagaagaagctcttcgccttctttgctgtgctcttgttgcctctcgctcgctgctgcggctactcattgatcctggttagtttgctctctcttttctatcactctcatcgtgtgatatgatatgccagtatttttttttccttgcatctccttcgttcatggtgaatcccggatcgctttgtttgctcctgcattttggtattctttcatcatttcatccttgtgcttatgactgggaatcgcctgtgtggggtgtgtgtttctgttttcctgctgaatttttcaactgctatggatggtctccagcttctgtgtaagggttccatctcatctatggtcttcagttttttttttctcctttcccctttgttttctgtcccgatttccatatttgtggttgggttttagaggatagcggtcaattttattttgctcttcctagtcagttttagaaggaaatggatggttatcggatgtatttcttcgatattttgttccccctcttttgtgtgatgttttctatgattaaaatggtataccatcttcttgatcaagtgtatactcgttaatttagtgctggtattcttcctcatctgctgcaatattttaagatgatggaaatggctgctgttaggcgcacaaccaacttcatctacgtcatttcgattcaattttcctccagattttgtttctttatttttacagttgattagatgagtagttcagttcctgtttcacaacgtatcttttttgttcaggtaaactttgatggtttcttggctggttgctgctgtccttttgtaccttgtatgtggccaatcctggcattttgctttctccttattctgaagaaaatttaaagcagttgttcctagtgcttttgctctttgtggttgcagttctcttcctcttaagggtagagctcacgtcatctgtttaaaaacttctacagttttttggtgaactttagtgaatcaaacctggtatctacagtttttcccagccttattatcatcatgcctgatatatacagtccttttgattaccaatgtcaaagtttccagattctgtgctagttaattttttcatttccttgaggggaacaaagtctcaattacatgttcagttgctcatataagcaatagaccgctcattgaggacttgttaagttgttatcaaacttatgcaaattcttgccgtacttaacctggatgcttaaactgaaatttctctgcgagcaattcttggattgtatgcacacttaccacataacattccttctcttaatggaaccagatggaatccgcagaggcagaaccaacaaacaaaagcgtcattcaggtaattattatttatcaacaacgagcaagcgacaccaatttgctgaaccttcctttggctcttgtgatatatagtttgtacctaaatcataacattttgatgctcaaacatacagggaacccatgaactaaccgtatgccagacgacggagagactcgacacatggaagctgaatgagcagcagcaacaattggtcgatgcaagcgggctcggcaacctgatacacacagcaggcctagtcatcgatcgcatcgcgctcatggcattcttcgaactgtggagcaaggagaccaacactgctcagctcaatggctttgaaatggcaccctcactcagggacgccgcctacatactggggattccggtgacaggccgtgtggtgacaaccggagctgtgctcaacaagtcggtcgaagacctctgcttccagtatctggggcaagtgcctgattgcagggactgcaggggcagccatgtgaagctctcttggctgcaatccaagtttagccggatcccggaacgccccaccaatgatcagaccatgtatggcaccagggcatatctcctgttcttgattggatcagccttacttccagagagggacaggggctatgtctcaccaaagtatttgccacttctgtcagactttgacaaggtacaggaatatgcttggggtgctgctgctcttgctcatctctacaaggctctctccatcgccgtggcccattctgccagaaaaaggctattcggtagcgcggctttgctcatggtatgtttaacaaaaccattgtataggaaaatatcacttgaatttcgagtaggaaatgatcttccagttctatgaaactatcaaaaaactattttgattgttatgatctgttcatgttttctgaaaaggattaatgaacttcaacatgagaattgtaattgatagtaaggcataaagatgataggaaataacaaaattctccatttttgtttctcacaaaattttaccttacagaccaagtttgtgacttgtgccttcactgtgtccattgcgaaaatgttctgatatattctgaatatctgtctgtagggctggatatatgagtatattccggcattgcgccctgacatgtatgatcctccagaacacatcttcccacgagtactcaagtggacagggagcacgatctctcaaccggccaagaacgtttcagacatcaggaaagccttcggcctgcttcaagtttctgatgtaaaagtctatccatctgagttgtgattctcatcagtcatcaccacagttttgtgttcagcatttcatcctttcccttgccatttgatttgagaccatatgatgatatgaacaacaacttcaggtcaactgggagccctacaagggcgttgatcctgcatccattccgaagcattgcgctgctccggataacctctgcttctccagaacatggctggtcagcttcaacctcaaggaaatctacgccccggaccggttcgctcgccagtttgggcaagaacagcatcgcccgctcaacgatgtccccgcgttccagcggcagctgtggaacccggcagtggactggagcctgatgtacgcttcagagatcgaacggttccagcagctgatcaacgctgcagatggtggtgatcatggtcatacagcagatgccgccgccgccgccgccgcagatgttttcactccggcgaccatggcgcgagcttcccttgggctcagcctgatatccgtggtaaaactacctgtcggtgaaacacttttaatcacttaggtggacatctacccttttgctacatactatcaactaaatggttataaaaaaattaaaaaaaaaataacaaggtagattcatatgtaataatatgttatcctacaaatatgcaagctcaaattttacttatttaaattgtaataaaagtagcaaattaaattttaattagtatagatatattcgcaattaactttgttatcattgttacaacttacagaagtcgaatttgctggcatgtttgttatcaatctatcttgtcattttttttaaaaaaatcatagtcatatagctaacgtataataaacgtgtggacatgcaccgagtgattagattagaatccatctccctaacactcgtgctgaggaagctgtcacattgacgtgagcgtgtcatcgcggttcagttcgggtgattgcatcgtgcgtttcgttgttgtgatcgattggatcggttcatgcaggtggagggcgtcagggaggagctcccgaccgtcgcgcggtttctggagcaacaccgcctccccgccgagctggcgacgtccctgtccaggatccgcggtctcatcgaggcctcccctcctgctccgccgcttaagcgaggcgacgccgcgccacagccccagccccaggtgatcgcggtgatccctcccctggctgtgatgccaccgcgcgagcaggaagcgccgcatggcacgggggacgcggaggctccggggatcgtgcgcggcgacgccgacgacgacgacgccgtgccgccgaaggagcggtctgatgagcagcagcagcaggatgaggaggaggaggaggaggaggagcagaagtggcggcggcggcggcggcgggaggaggaggacggggcggcgaagggatcaggcggcggcggcggcgcggtgcggcggagcagccggagctgcgtgcaggcgaagaggttcaggcgcgtgggagggaagggctcgcagtcgtccgaccccatcgtgctgtgaatctgcggccgctgctctcatcagctttgctactagcctaccagtagtgctacctttgcagtgaactacggttgtgttcggtgtccatgtgtcatgtgtgttaggcttaggcagacggtcgaagagctctggtactggtacttactcctatgtatgtcgttgatcgttgaattcaggttatgtagcatttgatttgactactatggatttgatgactacgctagatttaaaaataaaataagcattgaatttaaatgctactccctctgtcccaaaataaaccaacttcgtactaggacgtgagacatcatgttcatttatactaggatgcgtcatattctattatgaggttagtttattttgggatggagggagtagtttgctagcgaatctcataagaatctaaaacattgtgggcttgatcgaccgggattgttgttgcgactgcatcaattgaacaccgtggtaggttatagctatttttcaactgttgcaggaacaatagttgttgataacacctgataattcaaaagatgatgtgtttgaatgactaacagaaaaataatatttgaatttggattgattctaaaggagagagagacagagagaagacgcaattgacttcttaagagcatatacaataagatgaatcagcaggctccaaaaactttaatgtcatcatattcctaggtggagggggagataattaaggaaagagaagagagcgagctataaatctggcaccgggcggtagcacaacttcacatgtcaaacaacttgcatgcagccagtactagcgattaaaaacatgttttgtgggtcccacatcacccccatttgatcccatgtgcttcgtctcacttcgcccttgtgccagatccacatgtggcgcacacaagatgggtgcccctgatgtgcgccatcctcttcgctcctctggcgtacgaaaaaaaaaaaatcgttgcctcggcttcagtagatcgacgttggacgcccgccctctcacaccgacaccggtcgtcccagctggcagttcaatgtcgctccagtcgatcccgacctccgtcattgctgtcaacaccggggcggcctcaaacccaaacccaatcaccacgccgccttgcccaacgtcacacctgtatccccccacactgtcgtgatggccggcatcgtggctctcgccttcccacatatatagctcactcgttcttgccattcttcttctagtgtgggtgtaggtgactgatcgatcaagttgctacttttcaccgtgctaactagcttctcggtcaaatagggcgacgactttagtgtggatggtggtggccacaatccctcatgttactcttccaccacagccaataagagctccactagtggtagtcatcggcactcacctacgctcgctcgttcattccggcaccccgtccgcggccggggcccacgctcgctcgttcattccggcaccccgtccgcagccggggcccatctcccgcgtcttgcagctacacaagatgtggaagagaaaacatcacaaagaaaaagtagaggatatgtttatactaggaaagctgagattagaaaaagaaaagcaatcaaaggaaaaaataaaaatgaggtttgaggtcatgggttaaattcatatggaattaacgtataggaatgtgattcaaaggaatttccatacttcaatcttacgttaacaacctagataagaaaaaattctaaggatttggattctcaaaattcatatgaaaattctttaatccaaaggtgccttaagtttgttgtatctcctcaactctttttcccttgagagggagttattttatacggttgtaatcacattaacgctgttgtacgatatacacgcacgtatgtgtcgtgcgtgtaatttacacacatttaaatattgtttgaggcacatgtactcacctaccaaacatgcatttgtgtaattactcaaagattattgatatataccggtggtaaatcggatttgaatctttataagctagatgcacaaccacgatatatagacatgaagtcatgtaatcacatcttagcttttgagtccatctcaacttgtatttggaattgttgtttgcttaccaccttataggatggattggaaaatagaaatccatcattgaaggtgcaatttatgtccagccacaaaaggaggaccattgtacaattcaaaattcaatccaactactcagtatctaaaggggttgatgataagtcagcttcactttttctttatctttgcttgaaatggtttagtttggttcatttttttttctatacaattagttgagaccaaattcagaaaggagctaaagaaccgatccagtcaaaaaatcaacaaatcttaatttgattaaaggaaatgttgttactagagcatttttaaaccaaaccaccgatcgagctagccaatcttcttcatataattttaatggatttttgtacaagcactttcggggggcaagccacctatgcctcctggtatgctaatgtttaaaatatactaatatacacattgaataattttttagagcctccatctaatatcgaacttttatactgcaagtgtaagttgtaaatttgcaagaggtagtttgagtcaaagtcacctctaattccccttaggtttggttgattatggtatttttaccaatgttcattttgaaccacccatatttaacgatattacttcaagctgtgtatgtttgtcaattttatactatgatcatccttaatccatctctcttctctaactccaattatgcagcaccaccaccatcatttacatctcatcacctcccctaagatcaagtttaatctactcatcacctcccctaagatcaagttcaagatctacctataccatacttgtagctcgagcgtctctgccagtgccacccaaggcttgagctcaagcttctccatagaggaaagcaacgacggttctcgaattttgcagccgagagtctccacaaattatggtgttgccatgttgttcctatttaattcttagatccagctggttggagttcgaaaaaggttgctgccatcctactcgcctccacatgagacatcggcgctatccacccacccatatctgtttagttggagttagagatggttgcaccacattgctcatgcttcttcatgagcttgtcattgccatcttacatttctactcatctgtcctccaaatccgctccatgcactaagattaacgacatcgatacgaccctgagctcgatctctatttgcattgcctagagtgccatctcaagctcgagctccatttatcttcaccaatgctcttgtggctcatgagtttgacttacttcttttttgacgcattttattgctgagttgctagtaggcatgatggacaaacataattaggagagaccgccactttatccatcaagctttaagcggtggaagtgggaaaccgaagttgaagaaaagaggacataggatatt

SEQ ID NO: 68950 - DNA, 1587 bp, Oryza sativa
ttaccttcctctccctctctctctcgtgtttcacgctcgcggatttcgggacgatgatgtgtgttggggggaggaggtggggaggggcgacggtggcgtcttgtttcgctctcggggcgagcggcattgggcgtttcgagcgttggggtgcttcgagacggtgtagcattctgcatttctccgcatttcatgggggggaatttgggtgtcgcggctagttaggtgccattggttgttcgatcaggatctgcgaggaaaggtatgcggttcgagtgtgtggcagggaaacaaaagaaatgctagtttagtgccttaatgagataaatctgttttaatttctccgtgttagctgagtggcagggttcgtgccatgagttctataccttgattttgtggtttatatctggtgcaaaaagatgtccgcgtagggaatatgctacggcagttccttccacttgaccggaacttgttttttttttccagcctcgtggaaagtttgtattttctggtggtaaaactggtcagaatcttattagtaacgaggaactagactagatagcttaggtatactaatctgtatcatgactatgtgttattatgatccggctgtataatcatccgtttatatgtacacggaaaggaaagtatcacatacatgtaactgggtatggttttttgctatacaaacgttaaaacgactggctggaccgattaattggtcaattaatggttaattatctgattgagctgctcaatcttgtgttaataccaacaaatcttctctagtttgcatgtgcccgtagcttgcagttggcccaattaagttcatgcttgcagatacgttgcttccatgtctagtttgcactttgtttcaggtatatggtgctgcttttgagtttccactttgtatgctagtatgcgatgatagcatgatgtgtagcagacacttgtttatgaattttgcagttgagaaggttgcaaagctaatgtatgatccacatgtctacctactgaaaccatcattagttacatattaaagatgatatttccttatttgatttgtcaccgtacaaatgtatagttcaacccaatgtttttaaatatctccaaaaatgaacaactgggcacatatatatttttatttgtactagataaatacctgtgctttgctataaataaaataaaataaactataattttccctaaaataaatatatattttctatgaaatgtgctacccaactttttgctgagggaatactgacgttaatttgattttatatgtgactatccgtttagatttgatttttctaatattaagaagtccaaggggtattcaagggggtaatttgcaaaatttacaatcggagtagatggggtggcatattcactgccaccaccactcctcttcttttaaaggagtatagatgaatgttaaatttcggtataattccgaataattatctgtattatgactaattgcttagtggtaccttgcccgttggacaccagtattccgacttatacaacactgattattattgtttgagacacagatctccatgatacttatgccaaatatcatat

SEQ ID NO: 68951 - DNA, 1041 bp, Oryza sativa
  unsure (1)..(1041): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttggtttgaataaatactttttggtcttgacaaagaaaaataattttagcttcttttcagggccagaagattcagatagaggcaagctgtttaacatgccagaataaaatagtaaacacaaacaggaacagaacatagaaataatgagaattgcttatgtacaattaattaacaggaggtgttcaattgtacataattattcgagagtattattcaaacaaaattgcatagaatctggcaaaaacattaaacttctcatacatgcaaccagatatgacttgcttattaattttttttcacgtgtcaatattcaccacacatccgctcctgcctaacagacatcggacaccgatacctctcaccatatctcgcaggcccacagcgctgggtaagtgtcaatgttggctgtgccaaggccattcgatgataacaatgcatgggccaagacgttataggaagcagttgatctgcctgcatcatcagcgcagaggcaagggatgcagcgaaactgggcaaaccaacagcgtgctggcggttctggtcttggtgggggacaacaccagatcaactcaactcttttttaagacacgtcatggaactgcctaaaatcaaaaacccaagtacagaggcctctagtggtcgccggtggcgaggtacgccatcatggttgacagatttggtggtggaattgttgtacgtgagcaggagggaagtagatatagaagattggaacgagatatgttcggtggggaaggagtaactacactatacttcgctcctttgttctttttttttttactttattcgagtaattagggtattgt

SEQ ID NO: 68952 - DNA, 6093 bp, Oryza sativa
  unsure (1)..(6093): unsure at all n locations
ggagggggaggtggcaatgttagcgtgggcatggaggccgaccgcgtcatgcagtggcttaacggaaaggagctgcgctccgtggttttcgtctccttggcaatgatggcgcacgggctggagctgagcggcgctgccttcgtgcacggggctggtggtggaacggtgggcgcgcgcagtggcgcgtgtgcgtcatcgtctttgtcgtcattgcggtagcggcagcgaacatgactcccaacctcaccggtcacctctcccctccctcttccaccggtgcctccccctccctcctaggctcgccgaccgtctctccccactttcccgccggtgcggccgaccgcctctctccctctctccctccaaggctcaccaacctcctatcctcttctctcccttctagactcgccgacctcctctccccgctctcccgccggcgcatttggtctctctccctccctcccaggctcaccgacctcctcctccccccctcccgtcctatcggctgccccccatctcccaggcttaggaagaaaagagaagaaaggtgatgggactgacacgcgggcccaatattttttcttctcacttcagttacatgtgggacgcacatattatttttatgtttactttactgactacgatattatgtcagcaaaatcaaacatctatactattatcggacccaaattacatggttttgtatagtttatgggtgaagatttctactattggagataaggggcttcaaacaaactcgacgtagaatcgaggttgaggtatagcaagtggactaaggttgtgttcgggaggatgggttgggaactccttctcccccggcacgtaaaacgaagctcgtattatttcatgattaattaagtattaactatttttttaaaaaaaatagattaatatgttttttaaaacaactttcatatacaaagtttttgtataaatcatactttttaccagtttgaaaagtgtgcgcgtgaaaatggagagaggtgggttgggaaaatggaaggaagaacccaaccttattgacatattgtgcttaaaattgtggtggatcaaaagactcaaaagtgggagccgttccgttcatgcatgaagggtacgtgggccgcgtgctgccagtctgccaacacctgtattgggccggcttcccgcgagttttaattggacaggacacaggagatcgatcgatggcgtaatatttttcatcgtctgtatcctgtgtattcagggatgaaaacggtcgagaaaaaagagaaaattacagaaaccatcccataggttatttttgttacaaatacacacctttactaagttttggtgtaaaagtcatgttaggacgcacgtacttaaccaaatcagcctattatcgttgatatagatataccacacgccatgctaatcgagtcaatcttatccaagtacttacattatatttattcttcatgttttattaaactattttatgcatattgtgaaacttggttcaacaatatttaagctctcattatttatggaatctctaaaaagtattaagaccatattattgaagtatttaaatttggtaaagactacattgatggctcataatttatgaaaacacgttgattcggttaaacacgtgcataccgaggtggttttgatacaaaactaagtaggtgggcaggcattttcaacaaaataatttatggggtgaaacatcaaacttctagcttatagggtgatttttgtaaatttctaaaaagtactttttattattgaaaatgatatcggcatggttagaaatttttcatactatgaatgtgactagcaactttaatacgacgtagaagagctagtaaattttacatattactagaaactaaaacaataaaaaatcatattattttttatttttcttagaaaaaagcaaaataactgctcggcagtggtacatacgtaacttggacggaagatagcaatggttttcaaataaaaagcagctttaaattcagtcactgatgatcaacaggtcggtagatcgatcgatcgatcgacatcatatcattacctcacgatgaatacgctacatatactagtagtacaatacttctatttagtactagtacactagttaagcaaacgctaacgcaaaccggccgtcgatataattgacattgactgttcggcaatgatcgcgagaatacgtgcaacgaccccggcacaggtgcgcgcatgcaatttgtcatgcatcaggcctattaatatttccaacgttagggtgtggttaatacgtgcatgcgttcattaactattgctctatacatatagggctggctaaaaataaccgaaccaaacaaactcacaccaaaacgtggaaatgaccgagaccaaaaaagtttggttatcgactcgcagtaactgaactccctctgtttcatattgtcgcagttgaatttttttctaattgaatttatttaaatttaaacaagttcatataaaaaatttagtaacatgtatatcttattaaacacaatattaaatatattttgataatatgcttgttttgcattgaaagtattgctatattttttttaataaactaagtcaaacttaaaagtttgactatgaaaaaaatcaaagcggcttatgatataaaacactataaaacagaggtaataggacagttgatagtctatatcagtttaccgaaatggtcgaatgatgcaaagtaatacacaattcccgcaccctaggtagagccgcagaggcaggtactgcaccgctgcgcggacgtccgcaaactgtagggctcaatgcttagccgcaccgccgctcgcacgtactctacctttgtagcccaccatcgacccaccagcacagctccgtaccggctgccaccaacgtccacagcaaatgcaaccgtgatgacggtgatggtggtatatgggcactggccgcgcatcctccactcccaatgactgggatttgtgatttcttcatatgttatatgttaccaactaaactaaccaaaacaaaattatacttggcatccattgtaattgcggaaagtttcagatgcaacctctcatttgggtggaaacacgcaacccccatcttcaccgttagatctaacatatgtgcaccagatgacatcctcctttctcaccattttttgcatttagtccctggcacccattctccctctcacgctgcatctctcgctctcccacctcctttcgccaccgagacaacagcaaggcatgcgagaggcaacacaaggaattagggccactagcgaggcatgcgagcggtggcagcagcaatgaccaatgcagcgccggtgaccggcaagatgtgcaagcagcggccacctcatcatcccggacactgaattgagagctcctggtcctcaccccacctgtcctgctcctcgtcgcatgctgcgccaccccagatccactcgcccatgtgccaccgaagttggctcggaagctagctcccgctagtcgcaacgccacagtacctcttagcattgtcttctcggttatcccttaccaaactgtcatcgagatcgcaggtggatgtgccgcagctacctcgccaagttgtgaccttgctgccacctacttttttttgtgtgtattttgtttactcttaaatttaaccacttgtaattttttactgataagattcaaccgtttgtaatatttttactctcaaaatccacagagagtaaaaactttactcttggttttaagtgataagtaaatactcctaatgttaagcatgagtgttttttttactcagtacgagagagggatgatacagagagaagaagacgagcccttggaccaaaacaaaaaatacattgataggcgggcagttatttgaaaaatgtccacatatctctataatccaatggtgcaaaaaaaaagaaaaaggttaatagtgtaaaaggggtttcatggtcgtagtgaactagagttgatattttaaggcgaatgtattaattattacgcttcgttcgtttcatgggtaggaagaaaatttttcagggcacgcaaaacaagaaagaccacttacacatgattaactaagtattaattattgtaaccttaaaaaataaatttatttgattttttaaacaatttctatatgaaatttttttaaaaaatatatatcgctcagcagtttaaaaagtgtgctaacgaaaaacgaaagttgaaatttggagttgaaggtctaaataatacagttatgtcctatattcgtttttttttaacggagggatccgtacataggaatagtacagtacagtataaacctctgcatgcaggtacgtcatgcaccggcacttagtgacaagttggaaattatatggtgtaaaacgacatgacatacgctagctagggccggccgggagctgccacagtgccactgctagcccatactccaatatcgattcgggatccttgcagtacgttggcagtgtatatcgcgcagcagtaggcgactttggtgtgcgtagaggacaaagaaaactgacagtatccgatcgaccatgtaggacagcgagagatcgacttggtgtgcgtgtgcgtgcgccaccaagtttgacacgaaaacatcgtaggccaaccaacatcgagcggtacgcaggagtaggaacgtcgtcttgcacgtaatttgaggctttgagctctatagtatcccagtccaacaacaagcaacaacacattcaattttctacaaggacctctatttggagccgtgagaatttttagaaaaagaaacgttccataaaaggatgattgggaaaacttcaaccaacgaattcggctatgatgattgattaaaggagtccttgattagactacggtttgtaaaaccaactaagcaataaaaataatttatatgtaagacttccatatcgatagtattcacggttcaaaagtcaagtatgaanaatagattgtaatagaaagcttcaaattagcttaaaattaatttttaaaacctaaattttggatgtagccgatgaacgaataagtgcacgatgagataggtgatgttttcattgaaagtaaaataaaaaaatctctaaaaattagaaaatcttagatccagacatcctgtaaacattagagcgtttactgtgtatggcctaagaggagtaaccccactagtcacgtaggctcggatgccatcatggaggaaagggactgactttgaagtttgtttacaaagtgtaagacaacaagagtaccttctacaagccacaagttttccatgaaaaaagttatgtcccaaacagggatggaggagaagagaatgaagactaggaataagccacctctaatgcgcgtatgattaggaaggtccgccgaccaccgtcgctgttgagaagaggttgtcgccaccaataggacgacgtcgcaagtgcccaagcttgctaaagacggtggcgatttgtggataggcaatgccaagatctaagaactatatttggcccttgctaggggcggagacaagagtagggcagctagggctgcagccctactcctgatcctaagtattcattgaaattccattttaaaacttcaaaagctagaagataaaggcaaaattatatacattcaactaattgagccctaggtttggaaaaattctggctccgccactggcccttgccgccaaagacatcattggttgaagcctttgtggagctcgttggcccaagccattgctaaatcccattggtcgtaactccctccaaccgtggagcttgttagtccgaaccgcttccaatctataacaacgccaaatccattagctgtagttgcccccaactcggcagagcttgtcgacccaagctactcctgatttgtgcagccacgaagcttgtccatccaatttgctgcctaataagaggggaaagcgacaacgaccgtagacggggaagtggtggtggaatagtggtgcgtagatatgatggaggcgaggaggaggggccagcgacaacgagctagggtggccaaagatgatggaataggggagcaagaatgactagtaagaatgtggattatttttatttta

SEQ ID NO: 68953 - DNA, 7051 bp, Oryza sativa
  unsure (1)..(7051): unsure at all n locations
ggtggtagatccatcttctttctcctttgcattcatgtggtgatatccgtggtggtaggtccatctttcttctccaccatacatgttccgtttttcctgatttcatccattgcgccatcattttagatctgacgaattaagctgacatcattataagcttcataataagaagggcgagaccatgtcacagagacatggcctcgcccaacacggctcgcaaaccgtgcctctatcttagcttgttgctaaggcatgaggagcctcgcgggggaatgggtatgataaattgacctagctccggtatgacaacgaaccaaaaccaatgtccgctcactgcaaggcctaactgcccttactctagctaggtacgtactatctctgtttcaaaataagtgcagttatgggaatccgtatccaacgtttgaccatccgtcttatttaaaaattttatgagaaaattaaaataaattagtcacatataaagtgctatttatattttatcatcaaataacaataaaaatattaatcgtaaaaaaattgcaaataaaataaacggtcaaacgaaaacgtaagatatgaaaaactacatttattttggcagagacggagtatgacgcggaaacgcaacccacaacttgtcctccgtcgtgcagaacagacaggcacagtgccatcgatccgtatcctatccatccacacactactcctacacagtagtagtaggagggaggagctacgaaagcacgggagataggcccgctattagcagtactgcttggactagcggctctgtatccatcagattcgtgcgtgtgcatgatgtgccattacacggcctgatgtagccaaaaccagcagccagccaaagaaactactgcacgcaggcacatcagcacatgtgccgtcttggtcagcatcagcacaagagagaaaaagatgccatgccatcaaggcgcgagccaacagactactccatccgtcccaaaataaatatagttttatatattcacgtttaatatttgattgttcatcttatttaaaattttttaataattattatttttattgctattagatgataaaatatgaatagtactttatgtgtaactaaatattttcaaatttttcacaaaattttctaataagacggacggtcaaatgttgggcacgaatatttattgtgagacagaggtattacttttcaggattgcatgccgcgaaaaaagactttggaggatgcatacatacatctcgcgtcgcagcacgagacgacgccgccgggttgcaggccggccggtcgccactgccaccattgccatgggcagcagaagcggctccctttcttcgtggggcccagcaaaagagaggtacttttttttcttttcgattaaaaggagagctccttgatagtattgtatttcatcttggtacataaatcaatgataagtaattctatttatcatctatttaaacatgctactagtcatttatcgtaaacaagcgattcattaatatttacatttctcgatgcccatatagccaatattgtgtggaagaatggagagtcacgcataaaatccgagaaagtcattaagatgataggttgttggattgaaatatgtctatcaaaaataaatttttcagattttgactatcaaaaatagatggagggagtataaataagggaagcactacaaaattggatgtaggatatttcatagaacatcacatggtattgcactatattgtttcacatgttgcactactcgataaaaaaatgtttcaacaaaaaaatttcagatgtttcatcaagtaggaaaaaatatttcatcgcttgatcgaaagtatttcagtcagatacaacatccatactaattgcaacaccaagaaatcaatggatgaaacatgaaaacaaaacaaaatgaaacactcaaatcagaacattgaatcaaaacaaaatgtaactctcgaatcagaccgacgatgctggctagctacgcgcacgagattattgttgacttgccggagatgaggaaggaggacatgcggatgaaggtggcgtagaaccggatgcgacagcttggcgactacaggaggagtggaagggcgacagccactagcatcgggaggagtgctcctaaggtaggttctggtgccagctccacctcccctacaaatgtcaacctcatcgctgccaccctcgacaatacgtgctcaatcgtgtggttccggaagctagcgtctgaccagatcaagaacaccctgctaccattgttgcagtcgtggccaccagcaacggcggttctgccaatatcccgatgaacctgttcaatagctaggaaggtaagagaaaatgtgagaataattaggattaaggaagatgaaaaggtcgagccgttatggttaaatcgatgcgggcccacatggcgtaaccgcccgatgtttcgtctcgcgtcgaatgctcaatgcaaattgtttccgtttaaatagatctctttaaaacacaaaaatactacaaaatccatatgttacaaagaacaagtactttctccatccttaaatactagtaacatacacgtgctaacgctacggcagcattagataattcaaatcagaataatagaaaacgatatatgtttgagaatgagatatatatcaagnatggattgaaaaaaagaacaatatagattttttatacattgttaattacatagcaatttttttgtctttcaaaacccaagttgtacttctgatggaatgtgtgttaggcacttggtaattttatccactgcaatggggacaactctacaaggggctcagttgctcagaactgatcatcgaacacaacttcctaaaactattgtattggcacttctctcggtcacggaatatatttgtgagctggttcgcaatactgagagcaaaagcacggtgtatactcttctcctgcttctcctgcgtgaactaaaaatagcagaaatttgatgggattcatagcacaaaaagaaaggaaatcctcttatcccatatgccatcgtttgtaaatatacttcctaattgatcaggaaacataaataaaaattattcctgcttggtttgtttaagctgttctaaacaacacgttatggacaaacatatataagtatgatatgcatttgtagcctcattagaagtactattagcttgcatgctaaataattgtaattgcactaataactataaagaaataatatatgggctatcacaaatgcacctatttccataaaagtaatttccatctaacatagcttgaatatattacctaaccaaggtgttcaaagaagcagcctggttgctggcaacgcccttcaagtcgatcaccttgttcctcaaacacgctgtgtttcaccatcatcgactacgcttctcctccaccccactccacacatctgtctagaacatcccattgaaatcgcaattagggcaccactgcaacacaacatcatgctcagcgaatatttggcactgaaacagaactccaacagtaaaaaaaaactatagtaactttgacttgaataatctacagtaatttgcatcagaccagcatcccaagcctaataacagataatccattgttcacaatctcatcctgcagaaataaatgaaatggatccaacatcccaaccatatgtaccggacaaggaataaacctcctgaggcggtgtgtactgacctaaatgaaggccttggcccccgcctaggtctcagccagcacaatcagtatgagcattacagtgtactgataaggcgtcaaggataaggatggactgatataagaaggaatcaagattattggccagaacatacgtccaaacaatatagttatcaagtaaattttctgttgcttgtccatcagaagagttcattgcatcattatttacttgatttattgatacaccaaaaaaagcagattgtcaaagttaatatggtaccaagatgaatttgcaatacggagcaataacttggcaacttgcctgaccaatcaagcaacaaggacacatgaaaaaatagctacattttttccattcgtaaaacagatatgccgtagcttcttagccaaattttactcaacacataaatgacctaaacctatccaaagaataggccaatgctaacctctctctaagtctgaactgccaaaaatggacagccttccgcgtggattcagtcatcgtggagcaattgcaggagactaccattctacttgattccatacacgcaccaagatcatggcaaattggcaatttgatggtgtccatttgcactaccaaacatgcaagaaaaccatcttaaataaatatatcaggataacaagtgatgctgtatccattatgtacacttcactaccaaaaatacattgcttagttgcttatataaccatttttctccatcctgatgtagagaaaaaaacagtggttcaaaattcatgcatatttggtaactatattaatgcacagaagagggaaatttggcatatctggcataaaaccataggatatgcccaataacccaatacagcacacagagctttgtgttgtctacctttaaacccaatggctgaaaatgcttacaaagtaaatttgccgttcacatgtagtaccagatgaataacataacaaagaaaaggaagaaacataattcaatgtatttttcaataaacactaaccttaaccccgataagatgcacaccaactgctcacgctgcacacatgtccttgcaattgatccaatatttcctaggatatatgatgtacaattataatgcagtgacgaccaatgattctcaagtatgctatctactctttacattgcagaatataaaatataagcatccagtaagctgagttattgactaaatacacaaaaagcatctgtgttccctcctgctgtcataatgagaagaagctggacatcgttagtgttatccaaaatttttctacacacatgaactcctaactttttttccaaactaccaactttctccaaacttctcatcaattttagaaactaaacacagccgaaatggcggttgatatcattctttttctctactcttctttctgttacgtggtgatgccttgccttgtcttctggtaacatgaagccatctttcgcagtagatcttcaaagtgagcttcaaacggttggcgatcaatttttagcaactctccataatctactctactaatatgtatataatatttctacagggaattaatatgcacgatagaatcactaaaatatttgatcaaatatcagtttttaagaactcttttaggatatttaaccagcacaaattatgaccatctaaacttacggggagacacatattaacatgctcagaattttagatagaacattgagaggcattttgtcaagcagttcatgagcagcaaggcattttgtagcattaatacaaaccacacaatgctagcagtgaacatgtacaccatggtgattttcatcatcacaaaattcagaaaagccaccttacaatccgattggatgagtgtcaagcatgcaaggaatgtcaaaagccagaaacattgcaggcatcaagatgcttgactccgtcagaagcactcagttggcagaggtgatcctatcaggattcaagacatacaacaaactgaacgaactatattttcaaacactcaatcaaactctgcagtaccttccagaaatatttggtttgcacttcttcatcatttaagcagcaattgctacactacaaccaaaccaagtgataccaaattaaacagaatttgctcacctggcgctgaggggaagtagcacctgtatgctggattggggagaccgtgcactggacggatggccggtggtgccctgaacggaggacccgcgacgccctaaatcatcgatgggacgccaggccctgggtggaggatcgccagcgcgctggatggacggaaggacggaagggaagacggggggaggagggggggtgctgaacggaagggatggcagaggcggcacgagcgaggagatgacgcggaggagaccggcgcaaagtagaccgccgaggctgcgacggtgttcttgcggtggagataggggacggcgaggtgggcgacgattcgcggcggtcccgagcgggtggagacggcggagaaagacccgagcgacgaatacggtggtggcggcacgggacagcggtgcgtcggcccggccctgagcagcggaacgatggcggcggtggcgagacggacccgagccgcaagcttcgtggggggcggagacggcgcatggtggctgacgggtcagacggcgaagagagggcgcggtggggtgagggaggtgggagcgacgtgggccgttggattgatacggagggagctgcaggagaggcgcgatctgcgtgggagcaccggtgccatcggatgtaattcatcgggtggttttagatagttggatgtgtcacataatgaatatgaactatatggtagattggatatttcggatctctatattttaccttgagtttagagtatatttattgctcattgatagtttgcatcgctaggagtaatctatttttggttaagtaaattctgaatagcatgaaactaatttcaccttgaccttaaattctgctaaataattttgagcccattatgtatgaagatggatgggtactaaattaactttctataggcaaacgatcaaatcatgcctaatctcacagccacgatgtctcgtccctctcgtcgaactttccgccgcctcatctcacaaccacgacggaggcgtttcgttgtccagcgttttgtgtgttcatgcggtggccgcttgatggctgccatcggcttccatgtgcgttacgcggctatatttgcatgcatgagcggctggtttgaaattcagtttccgatatctttcgctttggttcgacgtcaattatagacggtgatgtgtgtaagttctaatcagtagaatgattggactctaattttgagcatttgtttttcactactagaaaaggcatttttgg

SEQ ID NO: 68954 - DNA, 730 bp, Oryza sativa
cggcgacggcacccctcccccctccctcctccggccagatctgggagggaggggggaggggagccgacgccgccgcccgaacttcggccgcaccgccctcctcggctgcgcctcctcgctgccactgccgggagcacagccaccgcgccgcctcgcctcctccgccgggagcacacgccgccgcctccggccggcggccggggagaggggagaggaggggaggagaggagaggaggagaggtgagggcaggggaggggagaggagaagatgtgaggggacttagaaaaaatttaggcccgcctgtctatttatattaagtctattttcgcgggcgtaccacttaagcggcgcctgtgaagtggtccgcctgcgccgcttaagtggaccgtctgcgaaaatattttcgcagacggacattaaatttcaccccgatttatatttttgtagatagtcatttggctctgagggtcatgtccgccttcgaaaataagatcttctatgttaggaaaaatggtttttatagtagtgtttatatttgaggacgacaaacatatagtgttgtctctgtttttaggtatcgtatttgaggaggacaaacatatataaggtgtgttgcaaccctcactccatagcaagtgaaacgaagaagcgttaagtccatgattaattcagtattagttaaaataaatttgaaagatagtaactttcatatagaatttttttttttaa

SEQ ID NO: 68955 - DNA, 1312 bp, Oryza sativa
atcttgtgagtatatgatttaaaataataataatttagaggagagaatgtgctaattaattacatgcatgcatacacgccctatattatgaaaccactttaaaaattagttgtgccctatattttggaatggagggggtaagagagaagagcagtggactacatatttatagccagcgatagcacggactccaagatataatatgtatataacaggtggaaccagatattaatagtgtaatatatgtttacaggtaactattgtatgaattaactattaaattaattatatatgttttagagctattagttagctatactaaacttgatctaagtcacccatggatgtaaattaaaccgagtacctggatcccaactccctaagctttaattattttgtggatatataataatttcataaaacctctgaaaatgcagaggtgatgagatggttggcagccaatacgtgtcaaaaatcccgtcatcggttgggacgattaggaggaagatcatagccggccggaatcgattaatattagtagtacatgtttgattgtctccttacttattacaaaagaaaagaaaacacttgaaaacgactactcgatcgtgaccctgcacttctcgacgccatttcgacccagattttcgcttgtagggcgttttcaggctagaacaaagatgccgacctgattaaattgccgtgtcagcataactctatgatgatgattatgctgggtaaatcgtaaacttgacacaggtgtttgtagctcgtatttacggttaattatccttttagtgatagatgatatacccgtcgataacgagaggagacgtttataatgattttatcaatcgtaagataaaccgatctaatctcttgaagatgtaatatataagggtatggtgtatatttgagcgtttctaagggttagtatactatctgtgtgtatatatgcaagttgtgagctcgtttgaacagtgttttaaagaaaattccggttcttgtttgcgaattttgtgcacaaaatttctgtttttgtgcgtagtttggacgtttcctttttgtaaattaatgacgttacagtactaagtaatcagttggttttgtggaagacagcaattggattagctgtgtttgtgccgggctgcttaaatattcgcgctacgtactctcgtacgcgacagcgtgtcgctctcgatgcacggcaaagctatacttgtccgtcgttgatgcagccatatctctatctcactcatcttatctgcacaattaatgatcagttaattaatgggcagtaattcccaagaga

SEQ ID NO: 68956 - DNA, 752 bp, Oryza sativa
tgcaggtggcgaaaccaagtttcccaagatcttaactgcgtctgaagacaatacaaaaaaaaaaaaacccgtcatgattcaatgtataattaattttgagtgtacataacgctatggttagaaatctctttgttgctagctgttctcagcagcttgtgctgctaccggttgtttcatttgtttgtgttcgcggtgaataacacattttctacccattttataatgtaactttgcacccactgtacctgtatatcacctgaggaacattaataacacatcaatttttttccattttctgatgcccgagaatttatgaattaatctggcctcctatatctgttcggccctgtttaataggcaacaggctggcaagaaccggaatatttgtgtcacgctttgaaaactattattcctccaaaaagaaattatttaaactttttccaatttaacttgttactccctctcctaaaatataaggcatgtaagatttttattctccaatgtaaaacttttatcatatagaagagatagaaagatgaatctaatgtatttttgtacaattaagtagatatatggcacattcgttgtctttgaatgtcacatttatgttaggccgcacttatattaggacgaagaggagataatttatttaaacagaccaaacttaagattcttcttctcagctataagaataatatttgatttgattgagaatgtttttaccgaaatgagaatgtgagctgactccagtt

SEQ ID NO: 68957 - DNA, 740 bp, Oryza sativa
gaagtagttagtggagtgaaatgagcttagctgaactggttaagttccttgcggtggaactacccacctaagtatcctatatttgatacgtgtgctcgtatttacggctaattattttttcagtggtagataatgtaattgttgatagcgagacacctctctttcgttgtaaagttgttagtggaaatctgatgcacgccagtttcctactattaatgccaggaaaagaaaattgcccatttccatgagtggtacaaggggaacaaaattaatctttacatagttcccttcaaggcttgaataactttattaacatcgtttccgtatgaacattttgcttatctataaactattaacttatctccatatatatatagcatcttcagaaggatcctggcaatctcctcatcacaacaaccatgtgatcatatgacagccagaacaaaaaacaatggcagtcttctcgcaacaacagcaatcatttgaccgccaaacatcccaattgtgctggataatttgcagagttcaacagtttcagaccattttcctcccagccttcagctattacgctgtcgttctcgaatccggggacaaactcatcaaaatctgctaacgatttaagttgcctgttcagtgaagctattgtcttctggcagtctgccagtttccctgctgcacgagctagctctttctcctgcagaaagtggtgacatctcattagtagcatacaaactaaaagt

SEQ ID NO: 68958 - DNA, 4786 bp, Oryza sativa
  unsure (1)..(4786): unsure at all n locations
tgttagagagagttattagcggactcatgggccttgagttggtacgtgaaactaatgaaaatgaagattaagtaagggcacggaaaacaagaaatctcttagcgcatggttagatttatttgacattttagggtaacttctatatacaaagttttcgtgcaaaatatatcctacttcctccgtttcataatgtaagtcattctagcnttgcccacgttcatatagatgttaatgaatctagacatatatgtgtagctagattcattagcatctatatgaatgcaatgctagaatgacttacattatgaaacagaggaagtattatttagcagtttgaaaagcatgctaacggaaaccaaggtagaatctacgtactaatcagaagagattcgcttcggtcctggtgcatggttcctcgcggtactaaatcattttcgatcgttaaatctagctaggtagggtggacattgttagatccaacgatcgaaaacgatttagtaccatgaggtactttttattgaactggagcgaatttctgatcagaaaagaacgggaactgtccaaaatgcagagctgttgggggaaaaaagaggaaatggcattacctgcagccttctgcattcggcttcgagcttggctatcttcttgatgctctcaagctgctgcttgctggccgtctctgctgccctcctgttcagctccttctcgatggtcctgagctccacctcctccgacatggccagcagctgaaccttgagagcagagttctccttctccaaggaggccagccttgagctcgcatcagtttcagcgttcaccgagaactcggacttcgcctccagcttcgccttcagctcgactactcgcagctcgaggtcggccttctccgactcccattctcgcgactgctgcgctagcgcgtcctggatgccatgatccagctcttccttggcacgccggagttgcctgacgcattccttgagggcgccgtcgaggtgaacgattctgtcttccagtgttgagttcttggcagttgcagcgttcagctgggtcttcagtgatgctatctctttctcggccttctcccatcctagtaggagaattgcaggtttttgttatgaagatctggcttgtcagttgtcagttctatttatgcatgtgtagaaataacactgtttctaggatcagattaaaaaaagaactctttctaggggattaagcttttgcttcaaatcattagtacattattcgtgaaaaaaatattagtacataaaacttaaggattaggttgagaggaccttagaataagaatgttctttttctaagtcagggaattgataaaactacaaatgagcttttggaccacatgatcagtacaaaaaattaaaagcaagagacaaggaacatatctgcatatgcatatgcagtatatccaggtccaaacagagtcatttcttaaattttttggcccagcgaaaaacaataatttgtttgaatttttgcttcatgtactgaaactgtacgattcagtcatgtttaacatcatacctagaacagcttcctccgcaacttttgaatgctgcttcacaagatcatcttttgcacgtatgtccaaaactgcagatgacagtctctcgctcaacaccttcaccttcacattgtcatcctgcgcttccttcgacgagatctccggtgattgaactgagcttggagaactctttggagtatcctaaccaagaacaaacaggatcaaacattgtcctgactagaaagtgcaaaattaggaggctattcatgcaaaatttcttgtgaacttcagctattagtcatgcaacagtattgcagaacaaagggagtggctgaagtaacaataagaaacctctattggatgcatctgaaaatttggaagaatcaattatcaaagtattaaatactgttttttttctggacaaaagcaaatgagcacgtgaagtacgacatggtactttctgagatcatgttcttgcatgattcccaacattatgctcagagaagcacaatgattaaggggattcttaggactttgagcaccattactccataatcatcatcatattaacttctatacaataggacacccctaattaaatgcacaactccatcagaattccagacatttctttggaggtacaggtagagctgatggtcaaagatcaggaattcacaagtaaatgttgcacatgaacagaggtgagagagagagagagagagagagagagagaggcatcttgattgctctgtgccagcagacacattatgaggcatttgggttgggccaaagggtgatgctgcagcacatggagatggatggagtggccaccaaagaaaatgcatcttgccctcatgcaagccataattcctgcagagaaaagctagtcccaactaacatcacatccttgttgtccatggataggtaaggcttgtcctataatcccttcccggtatagaaacaaacaggacccctctctctcattctctccttcagtttacaggcctacccaaaaactgtgacatatgatcatggactaattgccagtgtcacctaccaaacaaaggaagggaaactgaatctatcttacagtcccctcattttgtcatgtggctagtatgattgggagctgctatgtggatgtctacgaggatgtcgcaaacgcgcgattttcgcgatatcaccagacaagagaataaacctgctaggatggatgaatcatcaaacagaaagaataattcttgtaccctacatggtacaactaggattggtcaggaagaactgagctgtttttatgcagaggaactctgatcctccatcaaaatctttatctaatgccatcagagcttcaaatcttaaagagttcacatctgcaacatggtggtagattaccaaagcttccagcctctacagatctgaaaccggatgaaacctcacatgtttgccatatcagatggacccttattttctctgtactgcacatgttacatgatctgttcaatggaaggagcgtagggctcacaaagtcaattgacaatcatcaattcgtttgagcatgcttgcacaacactcctagacactagacaggtattatcattcttcaacatttgagcctcttttactgttacccagttactttttcctgctccttggacccattggtagtttgagaaatgtgagataaacatgcggaaatgaccgcgatttcggaaaaaaaatatgaactttattttccgagaacacgcagaagagctgcgtgtctttggattggtaggaaaagattactgcccaattatcgtgatattctaatattgcaagtagtacctactgtttgactttaaattgtgcaaatatgtataaacttctgaaatgtgaatgcagtatacagggagaagaagaaagagagtgacttgttttttttttctcacctgttcatcagacagcctctcggatggagaagaaaccgagctctcggtctcggccgggctcttctccgtcgatctccgccgccatagccagctccggcgatccatccctggagctctctacaccattcggctcaatgccgatgcttctgcgcctcaatctctctgcttatctcactgtcttcctattcagcaatccaaattcgatgagttcatttttttttctgaagaaaaaggaaagaaattttgcctcttatattaataaagcaggaattcgatgagttcatggtcgcacaagaaaccaaacacacagaaaggaaaaaaaggagttgcagcttttgtatttttgtccgtccaagaacacaatcaaaaagccttcaaaaagtcaacttgatacagtccagtgaccgtgagacaaaacctccttgatcgagacatgaaattcagctcaagttcagaagtttatcagtgtgcgacgaactcacccagaaaaaagtttacaaatcctaccaaattaccatcccggcaccaagacctatcactctatcagagattcagagccaaaatttcacccaatgcatccacatctaatcagagaagaaacaaaaacagaaagaaaaaaaaaagaaagaaaccatcctacctgccatccatggagaatgaacagaaaacaaccatcagatggattagctcgtactgggccaatccaagaacaagcattgcatatcgttttcacctcaaaaaccacccaaatcaacccgaaagatttcatcaagaaaaccaaaaatcccagaacacgctcccctccactacaaattaatcaccaagaaatgggagaagcgaaggcagagtccacacgaacaggacatgaatccaagcagagaagaagagcagtggagcagcagcacacgcacctcccggaggaggccgagaagcgtgacgagccgcggccggaaggaagcgaggcggcgcgatacacgagacccgacccgctggattcctcctcctactcttcctcctttacctcgcctatttaaaaccgcgaggtcggagagtacaaaaggagtgtgaaaaataaatacttgaaaaaaaagagagaggaagaaaggtgtggcgtctcaatagggagaagaaagaaatggaggcttcgatgtggcattttcacgcgagataagggtttgatgaaaaaaaactgagaaataggaaaaaaatacagtattttaacaatgataagggcccctttgaatcaaaggaattataaaggaattttatagggttgaaatactataggaaatttttccacgtagccctttgattcaaaggattgcaattt

SEQ ID NO: 68959 - DNA, 10569 bp, Oryza sativa
ggaaacttagcaagaggtccaatctcttggtaaaaatcctttgagtctatctctctcatccgattcctgtgtttttcctgtggtccaatcaaacgatcattcctgtgttttgtaatcctctgttttacacttacattcctgtcagaatcctatgtttttcctattcctccgtttttttattcctacgattcaaaggggcccttaatagtgcaaatgttgaaaatataatcataactaactgggtgacccgcgcaattgcgcgggtagcacccaaacaaaatcatatatttttttaatatgattttacttaaaatttattaaatagctatctaattgtcttaaaactttgaaggactaaaccttatcatccctgacggagcgtggagctcctcaccgggagaccgcgcaggcccccctttgccggttcggccgggggcgctaagtgaggttcttcgccctcgatcgatctggagaatgttcgcgagagagcaagtgcacgagacacgggcgatgtagacaggttcgggctgctgagaagcgtaataccctactcctgtgttctggtggatctgtgtgtgaaggagttacagagagccggagagccagagagttcaggctccagaacccctctagcctccttttttcttctttttttctttcctcctcctttttggtgggcaaggtcctccttttatatctcaaggggataccacatgcaccacttctacctacttttcttttgggtggggacctaccctatcttgaccaaaacttggcttgcaccttcgcctggaagttaaatcacaacttgtccttgagtgaggctcagcgccgtcactcgcctgacatcggggatctccatgttactccctcattaatgggcggagatttgccatggctgctttccaaatgaccatccgacgagatgggtcatacctacctccactccaccggaggcagatgcatcgtgggagcacggttgtctgccgatgacgcgaccggcgtcagaccagtcacagaccggtcattcttgtccaccacgtgtcagtttagcatgctacacgtctgcccttcttcatacaatgacttccttgcaatggttgcgatgaagcctggaatgtatctggccggggctgacgtgccaactccaggagttcccacgccggctccggctagggacgagtgcctggaggctctcatcattccgacgggacggggcgaggcgtgtgtcaggccgcctgttgccacctaacccgcgatctgaccggtctgtgaccggtcacacactgtgacctgtcacggaccgaacgagtgtgctacgctgcattaaatgcggcgtggggcgctcgtccaacccgcaataaacgcggttaggtgagcgccgctgtgctcacctaacccacacacgtggcgccaaacccatagggggtcggggcgccccagctctcggggccgaaacgggagcggcccgacccctcggggagacagagggaggggcggccacatcaccctcgggcccgaccccccccccgagggggtcaggccacgtgggtgactgcagctgccccaaacctctagtcaagatacccccggtcccatgtcaccgacagtagcccccggcgttacgccagggcgatcgcccccctcgagggaagcgctcgggcgtgacgccactccttagacctggtgacagatggggccggtctctacaggcagcagaaacccagcggtcgcaaatcgcgcacatcggcaaggaaaaaccgaccgacaataatgagcggctttctttaagaccgctacattacttaagtagcgcgcgaaccgggacgagccagttcgtttcgcctggagatgtgatgacggtgcatcggtcggcgagcgtagttaacgcgcgcacgatatgtcccatctcgactgccacggccgcacatccgcctcgtgcgccgcaaacgggcgagcgggattagtggaggcgtgggcgcgaaagacgagggggcgaggtagtgggcgcggggatcgaggagccgggcatagcgttggcaagggtactaagacatcaaggaagggatttgtttccttcctctcgtcactcttccctttgcctttgccacttgtgctctgactctccgtttccggcgccctacccttgccatactcgctcgctctcaagctcctcctccgccggcgtcatggcacggggctccgcaccgctcgagggtagcgtgctgccgccttcccgcatcgtgagcgagaggcaggccgggctgccgcgccgattcatgccggaatctgccaccggccgggaggtggtcgcgctgggcgagggacgcccggcgccgcattacccggggcggtccgtcttcttcctctctttcgtaatggcagggctggtcccgccattctcttctttcttcatggatgttctggagctttatgatctccagatggcgcacctcacccccaacgcggtaatgacgttggccatcttcgcgcacctatgcgagatgttcatcagggtgcgcccatctcttcggctgttccggtggttcttcaccgtacagccggtgttgccaccgtcggtagtcggtggctgctactttcagctgcgggggccagtgctgaaccgctacattccctgcgtccttcgcaagaagtgggacgactggaagagcgactggttctacacccctctcgccgacgaagcgcacctccgacttccgagccagcccccggcgcaggcctccagctggcgggcgccggtagatctgggagacggctacgacgccgttcttgaccgcctggcgggtctgcgatcccaggggctcacgggggccatggtgttcggcgactaccttcgtcgccggatcgcgccactccagcggcgcgcccgggacgcctgggagtacactgggtccgaggactacatgaggacccaccaggggggcagatgggactgggcccctgaggacttcaagatggtggtccaacaggtgctgaatctcagctccgtggaggcatccctcatcccccaaggtgtcctccccctctgcagcgatccagagcgcgccaacatcctgactatcatgcaggaggtcagggcgtcaggggagcgggctcctcgaggccacgatggcgcgggcgggagccgcaggggggaacaatctaccccgggagggggtcgtgcttctgggccccgtgatgggggcccggggggcagccgccctgccgacgcccgggggaagaggaaacaggaggataccccctccccatctcctccccgagggggcggggcggtgcgtgccagcagcaggcgcccggagggtgctgtgccgacgtcgcagcccgagggggagcgaaaaaagaagcggctccgcaagatggggggaccgaaccatgccggggaaacctcatctcccccccaaggtggtcgtttagccgacctcctcgcaggttcgtccccgcgcccactgcggccgtattcattctcccaaggtgagttttcacttacccgttttctttttgtcttctggtttttcttccgctttcagcgagattccgtcgcgcccccctcgccattccaagtccggccagtctgaggccgaggagacagcgaccgcggaggcccggaggcgggaagctgtccggcgagaagccgcggaccgcctccgggaagctgaggaggctgcccaggaagccgtccgggttcgccaggctgaggaggccgctcaggaggaggccagactccgccgggccgggaagtcagcccgggaggcagaggcgacacgcgcacgccaggcggcctgccaagcccccgacccgactccgcccgaggcaacgacgacttccgaggccacccacgacgaggccgcgggcgcgccgctcggacccgacccttcgggcgacgttcgggacgagccagcctcgggggacgcccctgagtccggcacgtcgattggcgggccgagccgcacagcgcccacaccaaggcagctctcccctctgccttccaccgccccactgaacacagagcccctcctgcaggccctggccgccgcgaacacgacggtgctggacgggttaggtgcccagatggaggtcctgcaagcagagcgggcggaactcgacgcggcgtgggcgcgcgtcgaagaggggcggcgctcggtggaggccatggtggaggcgggccgcaaggcataccgccggcacgcctcagagctcgaggcccgtcggtgggagctggcggagatcgccagggaggtggaggaggagcgggagactgccctcatcgccaccgccgtgctcaacgaggcgcgggacgatctccgccttcaatacgggagccgggtggcggagctagagaagaaactcgacgccgcccggggagtccttgacgccgccactgcacgggaacggcgggcgacggagaacgaggcggcgtcccggcggcgcgaagtggcccttgaggctcgcgccacggcgctggaagagcgcgcccgcgcgagggagagggacctggcggaccgcgagaccgccatcgctatccgggaggcaacgctggcggcgcacgaggccgcctgcgccgaagaggagtccgcactccgcctccgcgaggacgcgctcaccgagcgggagcgagctctcgaggaggccgaggccgcggcgcagcggctggcggacagcctgtccctccacgaggcagcgcgggaggagcaggcgcgccgtaatctggaaggcgcccgcgccgagagggccgcactggatcagcgggccgctgagctcgaggcgcgggcgaaggagctggacgcgagggcgcgcagcggcggggcggccgcgggcgacggcgatctagccgcccgcctcgcagctgtcgaacacaccatcgccgatctgcagggcgcgctggactcgtccgccggggaggtcgaggccctccgcttggcgggcgaggtagggctcggcatgcttcgggacgccgtctcccgtctagaccgcgccgggcggcaagcgggcctctggggcgagcggaccgcgaagtacgccgccaaccaggggggcctcgcccagcgcctctcagagatggccgggactctccagcggctccccgaggaactcgaggagacgatcaagtcatcctcgagagacctcgcccggggggcagtggagtttgtactggcaagctaccaggccagggacccggacttctccccgtgggcagcactggacgagttccctcccggaaccgaggacgacgcgcgcgcgcaggtccgggacgccgccgaccacatcgtccacagcttcgagggtacggcccctcggctcgcgttcgccctcgactccgacgaggagggcggcgacggtggtgtggacgacagcgaccacgaggccggcgacccgggagcctcgaagtgagcccccaggcccccgccaatcttaaaagtttttcctttcttcttccgaggccttcgggcccccttcttgtataaactaatttaatctgcaatcaaacaaagaagaaatttctgtgtcaattttatttgttgtgtgtatgagacgaggatggtctgtgccgcggtccttctgtgtcttggcttgaacaagggctcgtgcccaggtcccagcttcaaacggcgggggtcggggctagtgcctggggagatccacgtgtcgagactggccaggccgggagcgcggtgaccgagggttatggggacccgattgtgggcctttgccgattcccccccggagttcaccacgccccggggcacggctcggttctgggccccgtttggcgatttccgccggcccgggccaccgagggcagggtcgagcacgagcgtgctaattcaagccaagactcttcaaaaggaaacaatggcacagacacagtccttaggaaatcgaaaaagcttttattgaaatacggaagagaaaaaagataagtatatgcatatgtggtagcccccggccaaccctgcacgcccgaggggggtgcggggttggcccgagcccgagacctgacacccgacccccactaggggtagaagcgacgaaggtgttcgatgttccacgggttaggcagctctgtgccgtcgcccgtggccagccgaacggagcccggccgggggacgccgatcactcgatacggaccctcccacattggtgagagcttactcagtccagcacgcgtttggacgcggcgtaggacgaggtcgtctacgcagagtgatcgggcccggacgtgacgctgatggtagcgccgcaggctctgctggtagcgcgcggctcgaagggccgcgcgccgccttcgttcttccaagtagtcgaggtcatctctgcaaagctgatcttgatcagcctcgcagtacatggtggcccgaggggacctcagggtgagctcggatgggagaaccgcctccgcgccgtagacgaggaagaaaggcgtttccccggttgctcggcttggcgtggttcggtttgcccagagcaccgctagcagctcctcgatccacgagtcgccgtgcttcttgaggaatttgaaggtcttggttttgaggcccttgaggatttctgcgttggcgcgctccacttggccattgcttctggggtgggtgggagaggcgaagcagagcttaatgcccatgtcttcgcagtagccaccgaagagctcactagtgaactgggtgccgttatccgtaatgatacggttaggcaccccaaaccgagcagtgatacccctgatgaatttaagtgcggagtgcttattgatcttgatgaccggataagcctcgggccacttagtgaacttgtcgatagcgacatacagatactcgaacccgcccggggcccgtctaaacggacccaggatatcgagcccccagacagcaaacggccatgaaagaggtatggtctgcagggcctaggccggctgatgggtttgcttggcgtggatctggcacgccctgcaccgccggaccaggtcgaccgcatcgttgcgagccgtcggccaatagaaaccctgacgaaaggccttgccaaccaaggtgcgtgaggcagagtgggctccgcactcgccttcatggatatcggcaagaagctcgatgccttgttcccgaggaatgcacttcaggatgactccgttagccgcgtgccgatagagggtcccttccaccagcacgtagtgcttggagatgcgctggacgcgttcactcccttcgcggtcctcgggtagagtcttatctgcgaggtacgcctggatctcagcgatccaagcaatcaatctaagggagctgggagcgctcccctcgggtcccgaggcctggactccgacgggcctcgggggccgttcaggcgcgtccgtctcccctagggggtcgggtcgcgccgacggctgggcaagcctttcttcaaaggcgcctggtggggtctgggctcgcgaggaagcgagccttgagagttcgtcggcgaccgcgttatcccgtctgggcacgtgccgaagctctatcccgttaaaatggcgctccatacgccgcacctggcgcacgtaagcatccatctgcgggtcagagcactggtactccttggagacctggttaacgaccaactgagagtcgcctaacaccaggaggcggcggatccccagtccaaccgccactctgagtcccgcaaggagtccctcgtactctgccatattgttggttgcccgaaagtcgaggtggaccaggtatttaaggacatctccgctcggcgaggtcaacgtaacccccgcaccggcgccctgaagagatagggagccgtcgaattgcatcacccaataggcggtgtgaggcagctgcgaagggcccgagctgacctcggggatggagacgggctcgggagccggtgtccactctgccacaaagtcggcgagggcctggctcttgatcgcgtggcgtggttcaaagtgcaaatcgaactcagagagttcgattgcccatttcaccacccgtccagtaccctctcggttatgcaagatttggccgagggggtaggacgtaaccaccgtgacccgatgcgcctggaaataatggcgcaacttcctcgaagccatcagaatagcgtaaagcatcttctgggcctgagggtatcgggtcttggcgtcccggagggcctcactaacaaagtagacgggccgttgcaccttttggcggggccgatcctcttcgccaggggccgcatctccagggcgcttttcgtccgagaggccgcgcggggcgcactcggcttctgtgtcgacgacctcggggtcggaaggcgacaggcgcggccttcccgcagtggccccggggccatcctgggggtcgggggcgcctggcaccttcggacaagcgggcagagggccagctccgatcgtcgggggcctcgggccaccgttcggctcgggggcctctcctccctgctctctcccgggtcgagtcgacacaaggtggggatgcgcggagcgagggtcgtcctcgtcgcgctccacgaccaacgccgcgctgaccatctgcggagttgccgccaggtagagtagcaacggctcctctggctccggggcgaccaggactgggggagaactgaggtacgccttcaactgagtgagggcccgttcagcctcctccgtccagataaacggcccgaagcgtttgaggagcttaaataggggtagcgccttctctcccagcctcgatatgaaccgacttagggcggccatacagccagtgacgcattgcacatccctaagcttgctgggggggcgcatccgctctatagctcatatcttctcggggttggcctcaatgcctcgggcagagatcaagaacccgagaagcttgcccgcaggcacgccgaacacgcacttgtcggggttcagctttatgcgggcggtgcggagactttcgaaagtttccgctagatctgagagtaaggtctcctggttgcgtgttttcacaaccaagtcatcaacataggcctcaacattacgtcctatttggctacccaaagaaattcgagtagtacgttgaaaagtaggacctgcattgtttaacccgaaaggcattgtcgtataacaataagttcctatgggggtaatgaatgcagttttttcctcatcctccctagccatgcgaatctgatgataaccagagtatgcatctagaaaacacaaaaggtcgcaccccgcggtggagtcgacaatctgatctatgcgtggcagggggtaagggtccttaggacatgccttgttaaggtcggtgtagtcgatgcacatccgaagcttgccgttcgccttgggaacgacgaccgggttcgccagccactccggatggatgacctctcggatgaatccggcctccagaagtcgcgccacctcctcgcggatgaaggcttgacgttccggggcctgccgccgcactttctgccggaccggccttgcgcccggccgtacggcgagacggtgctcaatcacctccctggggaccccgggcatgtccgccggtctccaggcgaagacgtcggcgtttgcccgcaggaaggagacgagcgcgtcttcctatttgtcgtccagaagaccaccgattcgtgtggtcttggacgggccgtcgcccagggcaacctgcttgatcgggacctcgtcgcacgtgatcatccgctgcctcggggcggctgggacggaggtgctgagcctctcgtcaccacccgcgggcttggatgccacggcgaggtggtccgcgcgctgctccatgcaagcaagcgcgactttgaggtcgccatggacggtgatggggccaccggggcccggcatcttcatctggagataggcgtagtgtaccgccaccatgaacttcaccaacgcgggcctccccaggaccgcgttgtagggcagactgaggtccgccacatcgaagttcacccgctccgtgcggaagttggcggaaccaccgaaggtgaccgggaggtcgatatggcctagcggccaagtgtgccccggcgtcacaccgatgatcggctgggacggccggagcaccatccccggggccttgatggcgtcaaaggcagcgggggaaaggatgttgagggctgcacccccgtcaatgaggacacgccccaacttcacattgcaaacggtgggagaaaccaccatcgcgatctgtcctccccgggcaacgcacggtgggtggtcggtctggtcgaaggtgagggcaacctccgaccaccgtgcccgccgcgtcgcctcatgggtaggggccacggccagaagctctcgcttcatggccttgaggctccggtgagaagcgtgagcacacgctcccccatcaacggtggcgacggtggcctcaggctcctggaaccctaggtcatcgtcggcatcgttgatgtcctcggcgggggccttctgcttggcctcaccacgccggttgccggcgggagccgccggggtattgccctcacggcgctcctgcctcctctcctcctcccacttcctcgtccgctcagccaaacttttgaccgcgcggcagtccacgaggtcgtggagggaggtattgtgcacgg

SEQ ID NO: 68960 - DNA, 1226 bp, Oryza sativa
gactcatcgtcccctcgctgtaccgcgtgcaagtccgcttcttcacctgggcgcggatatgtgccctggaagttcatggtgaactgctggcacaaatcctcccaagagtggaccgacgcgggtggcaagttcattagccaaccccgcgcctgtcctttcagggccatggggaaaaaattcgccatgaccctgtcgtcacccccggcggcctcgatcccaatcgtgtagatctggagaaactcggcggggttgacgcttccgtcgtatttttcggtgatggtgggccggaaccttgggggccaacggacgttccgaaggctcgccacaaaggctcgacagccggcaccgccaaccggggacacggggggctggcccccgtgcccggaccgaagtggcgctccggacgaggaagcgccctccgatgcgtgggcagcacggcgatcattgcgccggcgcttgatattgaagcgggcatctggccccctacgcacatcttcttgggttagaggcgttgacgagggaatggcggacgaacggcgggtaacggccgccgctcgcggcgccctccgcctcgacgacacggagccagcagtagcaacgccagtggccttagtggcggaggaccgccagccggcgcgtaggcgctgctgcgccgtcatgaccaaattggccacgtcatctagccaacgtcgggttggagtctctggatcagggatgacgggcgggtgacgcaggagcgcgcccgcagcctggagcgcgccctggggcgtgctgccatcaccgtagacgaggagacgacgctccccgtctcgccgtccttctccatcgcccgcgtgcggcgaagtcgcggatctttcgacctcctcgagcgcctcctcccgcccaagacttcggcgagagggggacagtggagtacgagctcgacggcgcgggttctgctccccgtcgtcaccgctagcgctcggagagagattgtgcgccactgcccgttcggccatggggctgagcaggagaagcttggcgcacacgaaagaggacgagggcttagaaagacacacgcgccccctacctggcgcgccagatgacggagcgtggagctcctcaccgggagaccgcgcaggcccccctttgccggttcggccgggggcgctaagtgaggttcttcgccctcgatcgatctggagaatgttcgtgagagagcaagtgcacgagacacgggcgatgta

SEQ ID NO: 68961 - DNA, 2769 bp, Oryza sativa
tgtcaccgacaatccccatgtttctaattatatagttttaaaagtcacaccagttgctaccacttatgtcatctcctcctttacttgcttgctcgatctaccactatttctattcattctctttggaatttttaaaaattggatcttatagttttaaaagtttattgtcacgttgggtttcgtttttttaatttctatatgtcccgtcaaacgttgccattatactcctctatggcctgtccactatctcttctctttattatcattgagattttaaaaatcgaatataattatcgtttgggttcatttttacttctagaagtcctgccaaaccgttagcggctttgccattgtacttctctacagctcgctcgctgcctcacttttttattgtcattgagattttaaaatcgaacatgattatcattgttttttttttactttttagaagttccgaacctttaaaaattagggtttcattttttataatttttagaagtcccgtaaaatgatgccactatgcttctctatggcccgtccgccacctactctttattgtcattgtgattctagaaatcaaacataactatcgttggaatttatttttattttctagaagtcctgtcaaccgttggctgctctgcaactatactcctataaaccccgctcgttgcttctcctttttatagtcattgagattttaaaaatcgaatatgataatcaaatggggtttatttttttttactatctagaagtcctggcaaccgccttgctcgttttcttcatggcctgctggtcgtccctccttttaatcgtcattaggatctatttggtgttttatcaacagtttttatatgttgtatcaaccgtcaccactctactcttttataggtatgttacttaatttatctcgtcatgtgttttagatggtcttttctttcaatagtctttatttttatcacaaattttagttatttataaattttattcctaattgaaatcttatttttatttttccaattttagaatttatttttttttcaaattttaattaatatcatattgtgttcttttaatttttttatttttttattttcaatttcagttgtttcaaaattgtattcctagttgaactctcttttaatttttctaatttcagatattattttattttttattctgaattttcattaatcttgtattaggttcttatatggattcttctttcaatattgcttatttttaattctgaattccagctaattttaaattgtattcctacttgaaactcttcttttatttttttgctaatttcgaatttttattttatttttattcccaattttaattaatctcgtattgggttcttatatggactcttctttttaatattccttatttttaattccgaatttcaacttttttaaaattgtattcctacatgaactatcctttcttttctaattttggattttattttatttttttcaaattttgattaatctcgtattgggttcttacatggaaacttctttaaatattgcttatttttaattccgaatttcagctatttttaaattgtattttttacttagactctccttttttttctaattttggattttattttatttttatttcgaattttgattaatctcgtattgggttcttatatgaaaacttctttcaatattgcttattttaattcctaattttagctatttttaaattgtatttctacttgaactctccttttctttctttttcttttttccgattaatgtgagaatttctagctcccagagtgaacgcagtggctacttttaaagctgttttaataatataatagatagatagattcggcatattttaataaaaaacaagatactaaacatgacatgtgaataacaggaggatgatcaagtgatagtactaaacacaaacatgctaataacaagaataatatcatctagtaacatgttaacactaaagtgaatagagtgatatgcggagaacgctccggattcaaaggcgatggtgttggtgttgtcgctaccgttgccattggcgtctcctccattccattgctagtcgacgtagaggaagaccgttgctgttggcgtcttctcctccattgctgctcgacgtagaggaagaagaacctggcgtagaggaagcagtgtagagagcttattgtctatcggttccgctttctcataaaaacagaaaagacaagaaaacgagcggctggctcgccagccccgttgctccgctccgctaactcggcccggttggctcgactcggcgcacgagcgcgcggtggcagttcgaccaccatcttaaccgctcgacatgtgctctcatttagcaacttacttctcattggttccaaggtgggattaatcttttaacattaattgtgtgcctttgaaattagtatgattaaatcggggctagcccatttaattctaacaataaatatgcagattacaaaatacagaaaaataaaaaacgaatgtttgaatataatgtgtaaaagagtaggaattagaaaaaataagtgcttaaatatactgtatagaaagaaaagtaggaatttgtcgacgggctatacccgcagacgggatttgtagagtatgggaatcgttggaacctgcagacgtgagatcagatcgagcagacaaggaaaaagatttatactgatttggaccctcaaggatagtaataaccctaatctagattatatggatttatggatggaatatcacc

SEQ ID NO: 68962 - DNA, 1159 bp, Oryza sativa
cgacgatgaagcttatcccccatcgtctcactggccgaccttggcccctgttatttttgggtcatatctaattcgttatactcaaaatacacctttggtacaaaattaataatctcacaaggatgaaatatcagtaattttctatttactggttgatcccatcttttacggcatcaattccttttttgaacgtacaaaaatttggggagctcagcgtgtctggaagcacgggagaacgttcttttgctgatattattaccagtattcgatactgggttactcataggaaaatcagcctttccctatatcaggcactaatttatttttaacgtctaattagatcagggagttcttccaattaagaagttaagctcgttgctttttgtttcaccagaattggagccaggctctatccatttattcataaaaggaggtccaggcctacttagggaggggttgagccctttttcacttgaggagttctcctgcccctcattattaacaccttctactccaacaaggagatcttgtaatttctcccacaattagctaagcacaagagtagggtataacgcttctcagcggcccgaacctatataaacccctcttgtctcatcgtccttgaggggcctgacccctatgcactgaactatccaccgagcccttgagtctcacctgctgcccctggccgaaccaacaaggggctctcactatcccctgcttgaggagttcaccctccgacaggattctaacacattctattccgataaggtaattttcttctttatctgtcgtatttcgtaatcaaatgatacattgtcgtatataatcaggtatatggtattgcggtattccatgaatccatgtataggaggtatgtcttatccttgacactgacataattaaataaaaaagacagattcaagggaaatttttctaaagttgtagcttttacgaattttcctccaaaatctatgtagtattttccctagaaaaaagatctctgtagtatcgtccattatattagagtttcaatggaaaggagatgatttaattatttgtttcaaatatgcttttaggaattttttttcatataaatttgaaactccctaatttttctgtcttttttctgttcgagcctgattgatcttgaccatgt

SEQ ID NO: 68963 - DNA, 1089 bp, Oryza sativa
catatttttatagtcgttacataggatttgttgagtacatttctttctgcactcccaattgttgtgttcgaatccaacgatcaggagtgaatgtgatgatgatgctctaactcatgcctcattttgtgcatggcttttttaaagattaaagatttaccttatattttctccatgacctttcttctaatctaacctctttttctgtgacagtaaagttcagttcttactttatgttttcttgtcatttattctataggtttgacaaggaactgcataaggaagttgcaataaaagttatcgatttagaagaagcgtgagtctcttcactgaagttccctctgactccttatttaccatattatatcaggttttatggcatataagccgacatgtttcttgccatttgcaatcatgatatcctttttttattggcttattgcaagaagaaaaggtgtattgtgtactggtgctaatatatttcttgtaccagtaacaaagtggtgtattctgtttgctcttttagatttgcctggttcttttgatatagttttctacactaccagaattttatattagttacttatatgtcctttaattctatgcagtgaggatgacattgaagacatccaaaaggttgttctttcgccttatacgctgtatcaattacaggatatgatgagatcaaattgaatgtggataatttatttcctaattcctaataggattaatttcatgttgcaggagatatctgttttgtcacaatgccgttgtccatatataactgactattatggctcatatcttcatcaaacgaaactgtggatagtaatggaatatatggctggtggttctgtcgctgacctagtatgtgtttattttttatattttatttgacacggcaaaatcttatattatctacatacaagttaataaatcatttcagtttcaagaatcattcaattggttcaaaatttgaagttggtatgatttctgttttcatctgtagctccaaactggccctcctctagatgaattgtctattgcatgcattctgagggacttgttacatgcagttgaatatcttcattc

SEQ ID NO: 68964 - DNA, 1226 bp, Oryza sativa
actccagtgttgtgtgtcctatctatgcgacttgctgcttcttgcttttctttttcattcctttgcttttttcaccagatttttttctctttgaggtgtgcatttcagaatcactgtcatcatggtcgagcattctagtttcgtcttcatccatttcactcgttctattcttcttttcctttctttcctttctaacttctgccccaactggatctggctgcttggatttagtctcctcgagttctgaacatccaacaagagcgtaagtagatgaacacgtggaattcttcatgaatcaattcgatatggcaatgaacttcgtttcaaaaagtttgaagagtagcactacatcttgggctttggggtcctagggctgaaagatgtagattactatcttaactagcccttctattcaagataatagaagcactgctctattaagtctcactattatttaaggtgatgtgtgctggaattacattggtaaacaaagaacagtaataaatggaatggtaccttcagtggagaaatgtgaatcaataaccacagctgtcaggtgctgcttgaggaagacctgttacgaaacaggacagtgaagagcattagatcgtgcaactacaaggataaaatgtttaaacctggacacagtttcaagttgcacaagaatcatggtacattataacttcactgtgaagcacgtaatttccgaagggagatatatcttaattttaaatagaatgcagcaaactagcaaaacaaccaccaaaaggcaattaactagacagcaaaagggtggccagaagaaaaatcaataccaataccaataccaatacacttgcgcatgccaaccagtaaaagagtaccccaaggttaagtctaaaatgtttgactagcccatgatgtcttcatgaccacaataattcacttatatggtatgtccaaaatgaagcaatggcaaataaaagcagaactgaaacagtatctgttaattgcatggaaaatatagtatttgaatactatgaaattaactgttaaacgtaccgcagagagcagctgccttgtatttgtgtcccagatgcgtaagtaactgtccagtcctacaatagtaaattggtttcctgagttaatgcaaacagaataacctagactagtaaaggtgtgcaagacaaatacatgtaaccaataaatttgcgctcaaaataaatgaatatgaaataattggaaaa

SEQ ID NO: 68965 - DNA, 6074 bp, Oryza sativa
cctttcctaaaatgaaatattattattagcgcctcaaccttcataaaagctactcatgtttccaattgagtagttagtaatcagaagcaatatttttttatagtacacttagatgctacataatgaatataaagattattgtaaacccaccctccgaacatcgcgtagctttcaccagcatccactgaagaaaattgcactgtacccgaattgctcacatcccatgagcttgatggcccaacagccatgtccgaggatgcattttcctttgcgacagacttgacatatgctttccccttctctgtacaagcaagaaatgtgcctaacctgacatatgcaatgaatacatcataagtatgccattatctacaaaatgaaagaacactaaagcatggagaccacaaatgcaggtggattcataacccatatctacatggcaaattgagtgtgcacaataaattgccaaagagcatcaaatgaaaattacatggatgagtccagcgcatgtcttctgaagagatgcagcgtggctaaggggtcctcttctgcagaactatcagccggtgccgcccgcccagcagcagcgttgacgcctgcgagagtctccccattcagtggattcagcagctcaacctacacacaaaacccacagcaataaacaaccagcacaaaaatgctcaacgagtgcttcagctctccaaatgcaaacgcgttgctcaccacgccgttcttccgcgccacggccaaaacctgtagaagaagagaagaagcgaggaacgcagtgaggatcatactctgaccaattaccgcggggaggaataacgggaggtcgcgaacactcacggggtcgacggcgcggtcggcgagcgaggcggcgaggacggcgcggggcgcgtcgggcgcgccccacgtctcgacgaccttggcgacgcccgccggcttcgtgcgggcctccacgactgcgcggttgaggatgaataccacaaaacatgatcagccctctcaccggaggaggcaaaccagcacgccgccgccgcggcggcggcggcggcgggaagggtggggacgggctacctttgatgaggccgaggatgtcggtggtgagggcccggagcggcgggcagccggggctctcgaccacgctcgtccgcggcatgccttcttctctccggctagaagcggccgccggcgatggagggggaggaggcggaggcggcaacgtcgggaggagtggagaaagggcggtggtttttttagggttttcgacgtgcgacacggcgccctgtttcttggcccgcgcgtattctagtcctgggccaggtttggcccaatgggctctactgcggcatcgacagaatcgatggctttttcaaaaaaataaaattgtattatatacttcttctctatggaaaaagtgtaccggaggtcctgaacttgtcaccaagatactaaaacgtcctccaaccgcaataccagatatggggggtctcctaagtatgcaataccggtcacccgaggtcccaggcaggatttctccccgatttgtccgacgtggcagcggttttgtccatcgtggcgctttgacctcggtcgtcgttgttgactcagcagcccggtagttaggatataacgagggaaatgtttggcgcggtttgcttctcccccaaacaccgaaaccctagcgagcgggcggcggcggcggcagcgatttgtagagcggcggcgacttggcgagtggcggtacggagatgtcgagctcgatgagcgacggctcgtcgtcttcccatcagtggaagccttctcccgtgccttaccgggttggtcctctggattaccaacccgcggtgatgtgccgatgccgatgcccggcgaaagcggcgaggtggatctcatggagcacggacaaccctgggcgccgatactacaagtgttaacatgctagggtaagtgagggcttttggttgttctgttgttgaatttggatttggacggtttgggatttgaatgtagggttgtggtttcaggttggggggtgtgatttctgggcatggtgtgacgacccgacttccagtttcatcagtgagctattgaatgacttgcgggacatggtgaattcgttgaggagggagaaggaattgttgcataaggaagttgaagacagtcgggctaagggggagcgagagaggagagaaatagatgatgtgagggctatggttgctgtgaaaaaggaaaaaattagaagcttgaaggctaggaatcaaaagttagagaaggagaaaaaaatccttgtaatctgtatgctgtcacgtatttttatgctgtttgtggtgttagttgggaaggaatgagacatgttgatgtgtggactgatgtgtggtgttagatgtgtgttgtctatatgctatgtggactgaatggtgtgatcaagtctttcctttgatgtgtcaaaatatgtatgtatcagttgtgcacttgtgctatccagttggaattaaatttgtgaatgagtgggtgttaagagcaatatggaatctgaaagaaaatcagcatgcaatgtgtatcaggttgtgcaaattttggtgtttgttcagggaaacaaaatcaagcggtgtatgaaaaatccatttgtgtagtgaatgaaacatgtcaatttctgcagcaaatgtccatgtcagcaggaaatgaaacaaatacaaacagtgtatgaaacctgccaatttctgcagcaaacctcatgacaatgcaaaatgtgactccatatttggcttccagcagtaacagataagcaaacattcattgtctgacattcaaatacacataataagtgacatagctagcctaacagtctggcatgacaacataaataatttgtcttacatcactgataagagagccaaatagcatggcatcatagagatcacatagccaaacattttggcatcacagattacttggctaaatagtctgccattacatcacaaaagaagttcaaatattgcactaacattactgacaatggcacattcaaagcttctttgcttcccagggcagaagaataagtaatcctccagctctcttctttggcttgttttttgtaggctcttgagctgagacagtgacagttgccttgccagatgtgagcctcacagacgcagtagtagagctgtttgaatggggaactattgcttgaagatctactctagcagatccaccctgagctgttgaaaccttggcctttgcagcaaccctgaccacttcctggctatccattgctgcctgtagtgggaaagtatggcaattaggtaaagttagcgaaagtgaaaatagtgaaaaattgttgccatttaccttgctctttgattggttgctcttggaatgttctgtggtgcttgttgtagtaaggctgacagctttcctcttcctgctttgagcagaactgcctggtgtgtttgataacaccatctgttgacttggtgatggaagctactcagaactgcctaggttgctagaacttgcaccatgatgctttgcacaggtagatttgttgtgcccaatttgcttgcagctagtgcatctaatgacagtaccatacttggacattttggtaggcttgggtggttcatgcatctccctcctccttttagttcttggccttcctggcatctttatgtatccaggagcattgagtgcttctctatcatcctccggccaagcactcattccctctactggctgaaggcagtgcacatgtgtgcttctgaaatcatccacatagtaacaaggtgctatgtactcatctagcttgttggttctatagtaaatgcaagatattgcatgagggcatggtagtcctgacagctgccaatacctacaagagcattcctttttgtccaaatgtattgtaaacctatggtcatggtgattaacctcaaaattatcacctccattgcaaattgcatggcaaaaggctgactcagctatgtaaacatttagttttttctcaatccctggcatacaacatttgtccactttgcaccatttgatttctgatcactaatcctaaccatgacctttctcctaatagtctcaagcattgtgatgattggatagaatctagattctaaaatccatttgttgaaagattcacacatgttattgtttactgagtcacagttagaacctaacctgaaccaggctctactccaatgctcagggtgtgtgttcagtatggcttgagctccagcttgagtcacctgagcaagttttgccctagcaagattgaataacatcctgcagggagcctttgcacacctccagaactttttctggaattgcttgtcaggaaaatgcctcttccaattggcataaatgtgcctagcacagttcctgtgctcagcctcaggtaggggtggaaaaaaagctcgggctcgtgagctcagctcaggcttggctcgagctcgcttagctcggctcggcttgaatgccaaacgagccaagcccaagcctccttttcagctcgtttctaaaacaagccaagcccgagctggctcgtgagcctaggccatcatatatttatatggatgattttattttgtagtggagttattatttgttaatatgtaatttatcgtctagatcttgatgaattgaatatataaagttattttaattttacatgttgatgatttgttattgcttttcttaatgattacaaattatatagcttcaacggaaggcttgcaagctagctcgagctggctcgagccaagaaacgagccaagccgagctcatgttttagctcgtttccctaacggagaggagccaagccaagcctagcttgttgcgagccattgcaagccgagccgagctaaggcttggctcggctcgtttccacccctagcctccagtgcccacttctcaacagcatttaggataccctgtatggaaatacaaaaaataaaggttcagtgacatgtgatggaaatttacaagtgaaaaaagcagtttgtaatgatattatcttctgctgatctgaaatgaatacccagcttgcccctgtccccactttcaagtccccacaaagcaaatcaagaaaccaatctcattcctcattgttttctttggcaaccactgcccaagcaatagggtacatttggttgttagcatctctgcccattgcacacagcagctctccattggttgccctcttgaaaaaacatccatccagtcccacaactttcctacagccagctatgaaacctttcttcaatgcatccaagcatatgtagattctcttaaagactggtggaaccatgccaatctctctgttgataaccacagtgctaccagggttgcttctaagaagctctagttgatacctatacaactgctggtattgccccttagtagcctcaaactttttcttttgcacaagccattttgctctcttcaacttagccacagaagcatctgcaaacatttcctcttgtacaatagctttcatgtgagcaagtagccaagaaggattagcagctaagaagtttccatacttctctgctattctaacagaggtaactagcctactatccctcctaggtggacaagcatgcaaattttcaaatgttactatttgccaactgttggacctagaatttttggatagcaaacatacccagggacagttatgccaatcacacttggcccttaccctttgcccatcatccttaataaagttaatcactttcttctctgcaagagcatattttgtaatagccttcttgaattgcttcttacagttgaacttcatccctagttcaaacttaggcacaccttcactcttcttgtaccttggttccttacttctcttagtcctcacctccccatcactaccaatctcatctactgagtcctcctcatcgctgtttgcataaggggtttcattccctgcatcttcaacaccaccatgcacacttggttgtcccctctctagaaagaagtcatccaggttctctagctgtcctgccttcaccttcctcttgaccttcttgtaatgtttctctatctcagcagcctct

SEQ ID NO: 68966 - DNA, 12897 bp, Oryza sativa
tccaaataactccgacaaggaaatcttatccctatctacatatgacaaagcctcagatccaccgcaatacttcttctcactcccatctaacagaaaaaccccattcatatgaaacctaaccacgagagtgtccaacacgtccatccccttcatgctaaacaacatataaaactgatttagggtatattataattgacctacacatgcataccatgtccaaatcgaaacttttgcacagaggtaagcctaaataacctctaatcaactacatacctaaataaaaaactcccaacttacatcaaatcccagataaaaaaggcatctcacaatataaaaaatttcacttcccaaatcccactggtaccatgcaagcacacacagttaactacgaaaggtaatacctgccagattcggattcccaattggaggggtactcgccgatgcaacctcgaggtcgcccaaggtggctgctggtcgccgcgcctaagccgcccccagatccacctcgagctcgaggtagtcgacggtagaggcacgccggtcaccgcctcgcctgcacgacactccgcccgtccgccgcagcctgctccgaatcgccttcatcgctagctgcgtcgccctcgccgatctagggtttccagaggagggagaagtgaagtgaatgccccttcagtgcgccacgggttgtcctaactaccgggctgctaagtcagcgacgacgaccgaggtcaaagcgccacggtggacaaaaccgctgccacgtcagacaaatcggggagaaatcctgccctgggacctcgggtgaccggtattgcatacttaggggaccccccatatctggtattgcggttggaggacattttcgtatctcggtgacaagttcagggacctccggtacactttttcctacttctatactccctttttttccacgctagtgactagtgtgggaccgtgggttcaacactctcttttttttcacgcatatgcttcctaaattattaaatggggacgcgactacgtagcacgaagtcgcttcgttgcctaaacacgcaactcactcttctcctaattagcatatgtacgaaggcgcgcctctttccaaaaagggtatctcgtagttactattgcagagctaagttacttctacgattcaagtacttcctccgtttcatattataagacttataatatgaaacggaggaagtaattatttaaaatgtttggatatattcaatgttagactcgttttatcgtatattttgagtacagcataatggtacaaactaaactaaaataacaatgctagtgtagccaatctttagttttgatgattggtggtgtcctttgtagcaatactggacgctatacagattcctcactttgatgaagcaatcgtgtctctccaacagcacgaagacacggatagacggctataagatgcgtcgcgcgataggaggaaaccgagagcgctcttgatttaactttttcaattattaaacatgtgctttatgaaaaagttttctatagaaatgttgcttgaaaaatcatattaatttattttgaaaaattttaagcatataattaattaattatgcgctaattcacagttccgttttatatgttgaaggggaaggattctaactcccttgctgaactcagcctttaaagccactctaaatttgaattttttagttttttcattatagtttatttttcaccgtttacttttaaattgctaaaagcatatataagtcctattcataaaatattttttgtttgctgttttaagccaaacgttgtgcttacatttagactcagctggtaatccttagctagttccccatgcgagcattttttttttcttcaggccattcaatttttgttgcatgtttgtgttatgcatttgtttcagaattgagataaaaaaattcagcaatttatttttttttcgcgttgagagaattttgataaagaaaaagtgatagggcaaaaggaattaatgaaccatccactggaattgtagggataatatatgaacatgtcccattggggcattcaacaatcggcaatgttcgacaagactaaccagaatattcaacaaaagtaacaacactgaaaccatcagatggtagcaattgtacacttgtatgagactctgtttctgctagcagaggaattttacaacgatgcaggagatgtcgtctttgcttttccggttcacggcctgctccgtcagatgcttcgcagctgcctgagcatccttgaagtccttgatttcatccaccgcctcttggttggacatcacctggatatgtatgatcttgaaattataatcgttgcatatgataaaagaacgtcgctaatgcaacttagcagctcattaaggctgggaacccctcctccccggcacgcaaaacggagcacgtactattgcacaattaattatgtattaactttttttttgaaaaatggattaatataattttttaaaacaactttcgtatagaaattttttacaaaaaaacacaccgtttagcagtttgaaaagcatgcacgtggaaaacgagcgaggtgagttgggaaaactagcataaaaagagtaaagaactcaactaaaacaaaaaaaaaaacaatcatgcaatagtcatagatgcagcttaagaaaatagaaaaatcaaggttcgcaactcatgagtcaggatgtgcttatgcatgccaaattacatacttcattcatcccaaaatataagcatttttagaatagtgccaaatcaaactttttaaatgttgactattaatagcaaaataatgaaaaagatcaatcatgtaaatttgatattgctagatttatcattaaacaaactatcataatatgcaactctttttatttaaaacatattacttttatagacattgttggtcaaagtagcatctcgaagaccgtgtagatatctaaaaatgcttatattttgggacggaggaagtagctgaaatgtaggaataagcactttcacctgttagacaaaactcaacctccagtacctcatgttcaaaattaaataatgtagtgcatgcatgtatgcatattctgagatttggtgtgtatatagaattaaataaggtaggacatggtctccagtttgttgagcttaggttaggtatgcatatagaatgcaaaacaataaatttaggtgtaatctatcatggatggttggtatgagctttataggcatcaccttccataatccatcacttgcaagaattagaaaatcagtattctcgtctataggttcctccaccacatctggctctgagctgaggtgcttctttaggctccggtctccaaatgcccttgcaaccgcaagctgaccatcaacacgcggtacatctcctgcaagtaaaaaatttttggaattgaagctcgatagattgcatctcatatgttgtgacagtaacagcatagaagcagttaagagtagggtctgtgtacgccactgctggtaattactaatgcaatattggcataggtatgcttagtgttagggtgtatcctggacctaggatctgatgcaatgtcaaccaatgaaacgggctcaaatagatgggcagtattgagggccacatggctagtatatagtcatacaaggacataaatccaaataagaaagcagtgtggaactaaacattagatacactagattagcaaacaaaaaaacctcagtaaaaaacatctataactttaaactgttaattacaatgactaaacccccccccaaaaaaaaaaaaaaaggaaaaagagttgacaagaaatggtcatttacctggtaagtttgaaacaaagccaccttttttctcgattgaatgccgctccttgtttggttcatgatcaaccgaaagctgttttgctacaccactcttgctaataactgctcgtgaatctccaacatttgcaactactaggttcacagaattttcactgcttattaatatggcagtaacagcagtggagcctcctctgcccaactcagctgcgctttccaatatttttgcatccgtaagttgatatgcatttcgaattgcagcttgtgggttgctcaagaattctggctgaggttgaaggagtcaataaataatcagcacagttgtgaattcagttgactatcttcaattgcatagacattatctatatatttaggtcactccatagttattcctagcatggttcttgcaagtagattgtagaacaagcacagataacacttgtaagcgtaacagaagtacaactcttcttaccctgtttatagtttaccatatgcattatagattgacttgctctttctgtgtttttgaggataagtataatacctaaaagaaaaagagtagtgatgctggtggtaaatcgccaccccactaactccgccttgtttttcttttctcaaaatgcttcctacatttctttaatattatgcaatcttcattccatatattctaattccatttttttaaaccttctaaactcagaatttaacacataaaagtacatagcgaatgggttatttttactgtaagtacagacactgtcagatgctccttaaaacgacaaaaaaaatgaatgacacaactatttattgtgaacagcattagaacttggatggttcatttttatccatagtaaatcaaaggacatgtagctagtaaaaatacaatattggaacaattgacgcatgatgacaaaacaatcttactatctgagcatgtaggcaatgcagcaagtattgaggctaagcctattaacaggacattgaatttgaaatattacctgctttaagatattatcaaagagatgtgagcgcaggaagtctggaacagtgtggcccaaatgcccatcaaatattgcaaacagccccagatcatgctctccttcttgcctgtactctgccactagatagtcctccatcggatgatttgattttcccttcacaagatggtaaccatgcttgacacgcttgcctgacaattttgtttttcctttccctgtttctggtcctgacgaactaaaagcatctttcacctgttaaacaaaacataatcgttcgtcaagcatgttaagttgctaatagtacaacactaagcaaagcaaatatataagcttgcggaaaacatccagcacaatggagcaaaaaaacagttttcgcttttttgacattggttgcatcacagcaagaataaacacaaagaaggtgcataaggtagtctaccaaaatgaatttagtctggatttagtgatgtgtgtattctacattgagtagagtataacatttcaagataacttctagtttccaggctgcaaactctaaaactcccaaggaacaacgtcaatcaaacgagttcttgagttccaaaagctttcataaaaaagaatatccaaaaaaatctaagcataaaataaaattcatgcttaaccggcaaaagccggagatcgtgttcttgaagttttatggtgaaatggaccagattcccataaccaacatattgaaatgcttgtctctctactggtctagacgagttatgttttgtttcctcagtagttattttctccactgatacatgtttcctgcttctgctagtaggaacgagaaacatgataactccaagaatctaacgtcaacacggagtttcatggcatcgggactcattatgtttatagaaccacaaaccattggattgtcgtaattaagcaacagatttggcccaaaataaataaatagacaccatagcctagcatcattccaagatttttaagacatgttcagacttctagccttcgccatttcaagatcccctcaagctaatatgaaaaggaaaagattcgacacaacggtgcacctaaatattaccccaaaaatagcacaggaatagcaaaaaaataaaaaaaaacaataaacatgaaagggaaatggaggccaaaggaagaacaaacaagaatccccatcctccagtcctccattactcagtaccttgtccttcatcttgtggtagatttccttgccagccattgtttccctcttacaaaacctccaattccgacttctttagcctcaaattcaacaagcaccaacccggacagcagcagcagcagaaagatggtccctttcttgaaaattcagagccctccctcccccttctgcacctctctgcaccacaaccaaacttccctttcttggatcagtctgaagcaatcagcagtagttgtaggcttataattgagggaagggggttggtggggagtggggcttgattgggtttggatggagctgcttttgggaagaagattgggggggaaatgaggctcgaggaaggaaggaaggagaaagggggactggatcttggatagaatcggttgacctgagaaaggggagatagggacaaggactggtcaagtagggacaagtgagaaaaaaggaaaaacaaaaggtttttttttctgtttttctttttctattcaggatggatttttcttttcatatatcaactgtggacagagatgcgacagaactgacagatgaccctgtgaaattttccatctgaaaatttgaagtttcatgagaataactaaaatccagagtaattgaattatgttttaatagctagtattgcctattttcttatttcttttttttcagaaagagaaagctttactgatgagaacaaagttatttcaatcgttgagaacaaggccttgaatgcaggtgggaatatgctcccaccatagtgcacaatgcttcgttctactagtcagctgcgctaactcatgagtaccctattgcaacctctttcgacatgacgatatttcacctctgctagcaactcctttgtactttgcacatcggcgataatgtggtaccattgggatcggttctcttggtatggctttagtgcattagctacaaacaaacaatcagtctatttttcttgtttcgagtttttatactctctcccccgctctctggtcattatacttgatgttcatgtaagatttggataattttttaaatctcaaccatctgaaacgcttaattttcaaaattaaaagaggtgcacttaaattacctcaaaaatattaccataatatcataattcttttccatctgaaatttgaggtttcatgagaataactaaataaatctagagtaattgaattacttcatccgtttcacaatgtaagtcattctagcatttcctacattcatattgatctaaatgaatctagacatatatatatctatagctactattgtctattttcttatttcagatctttatactctctctctccgatctctagtcattatatttgattattgggcaaatttttaaatctcaaccatttgaaacacttaattttagaaagtaaaaaagtgcacttaaatttacctaaaatattattcataaatttattagattttgtaaaaacttattttgaaatttcaaaagtttgactaaagtgtcgaatatttatgaccgtatgttattaaagcagttcgatgataaatctaatgatacaaatctatagtaaaaaaaaatatgaaccgtcgaactttttcattgtttgctcgttgccttaccagtcttttcgaatttgagttgtagaacttaatttataattgatcatgggttgtttcattattttcttttttaagccctcttaaaattactttcttggatgatttctcatataagaactagttctcgctcctagttctcatgtatcagaaacttctatatgtattaactatttagtacatcgagtacatactattatattgtggattttaaagagaaaaacacgtgcacaaagcatttcctcataacctgtttttttctatcccactactatacacacgagtactaccgcaggacgacgacggccctactgcgcaatgacgatgactagcgccggctgcgtcgctagctcgctgccccaaccctcccttcccagatccagctggaggggggagggaggcggcggcggccaccccatacaacaaaggagttcgccggcgatgacgacgtgtttttttttaagtttacatgttcattgttgttaacttgctgtagatttgaatccaatgattttgtgttgcaactttacaatgtttgtgattggattttgtttcttggatgagatttgtgagaatttgtggtttgtgatttgaagcccctagggacgggtggggttggcgagaaaaaaaattttggcgctgagggtatttttacaagcgggactactgtagcacctacagcgtctggaaagattcaaactgccccctgatttttgcaggcagtgctttggtccacctgtaaaaattagggatttttaccgtcgtttagatatagacggaaggttttgccgcctgtgagaacatgttttgaccgcctgaaaaaacatttttttctaagtagtgtcagtagcaaatatttgccctcgttaaattactattgaaagcgcagatagtattaagtcttgcacccatgggtgacagcttcaccggtcaccactacgcctacttttcccatagaacccatttttattcttgttaaaaggtggctaggcatgcaaaacgtccataagttaatgaaatgatgggcaatttacatcttaaatagaagccgacgacaaccatgatagctaaggttagttgccacacacgagattctggtcgagctactttatattaatgggaaatgcacacaagcacatcaacacacatgtatataacaattacatatatccgtaaatgtgtgtttttttaacgcattagatggatggagggggccatggataaattcgtgaaccccattgaaacttctacacaaagtgaactcatggtcccatgtgttcttaattgtggggatcagaatttgaaccgaaaaggaagaaagatatccgtgtcacccacgcacagacggctcgaagcgaaatcctagccacccgccgccgtccctcccaccctcctcgatgcctcgctgccaccggagctcaccgcctggaaaaccgggcgacaagcaaggatggcggtggcggggccaaaacccgacgacactccatctacagcgcgggggaagcgacgcaaagctcagaaagttgtcagtgaacttcggcatgggcggcgttggcctcagtagaaggccgacggctacgggccgacagcgtcggcggccgcgggacgcctgcgttggcggaagtaagaggccggtgctggaagctacgacagcggatgagaaggaggttgacgcagccgactacagcgggtagatgacgacatttggagtaggaggctgacgtgacgtggttggtgatagaagcaagttgcggtcagcaaaggcctatgtgacgcaagcttggtgtgtccggcggtggcaggaggccggcacggtgacgaggttgagagcagcgaggcgcaggccggccagcggcaaactgagctggtacggtgcatggcgaggacaaggtggcagtgatgcggatgggcggcctgagatgacgctagcagtctagctgtggcagtgacaacggtggccttgtgaggtgtgcgttgcaggcctaccataagaaggccacttgtggcgacgacaccataagaaggcctcgttggcagattagtgcggagaggagatccattcttctctctcgccctccaacctaaccgtgtggatggatttggaatgcgtcggatgtcgagcttctactcgatggtcagctggcagcaagatgctggcgcggtggctgtgcgtcgaaggagtgtggttggtggtgttctctatgaccagcagaagatcttgacacgaggaagtaggaagattacaaacgaaagcctagcctctttgagctagcaagggcgacgcttgcgagcgccacttttccccttagggtattattgagtgatctcttttgccccctgatggattcctctaggtgaaatgtcttgaacctaggatggacggtgctggcatctcagtgtcatatcgttcttgaagtcgtcgtttggaaaatccttttccttcgagatgtcgtattactatctcattagtagttcattagtagtgaggtctgattgtaaacgtgtggtgtggttgcttttttttccaggctatagcctcccaaggctatattcttgtttttttttattgttctatccatacgaaatatcgcactatacctatatgtgttgtttaagaaaaattgaaccaagttcacatgaatcaacggtgcttcccaagctataattaacccaactagatttaagtttaatcatccctgcaaaagaaatattaaggtaccatgttaaaacaaaagaaacattaaggttaattacccggactgccttaaggcttaacgttgaaccaaacgcggtttggacgaagtgctatcacctccgtctgatagtaagaggacaaaaagaaatgtttggcacaaaacgtaaagggatatattttgtccgaaagcatgtggcttttcgaaagaaaagtttgacaaaaacaaagcgaacttttcgcatagaaagctcaagcgcatgagcggattcacctatattttcaatccaaagaacatgtcaaatgctagggattatagtatcattattttctgctacacatgcatcgatcaatcttggaaatggagagaaatactagaattacacggatgggatttgtgtccagatccagaccaccggcctatccaaatcgtagtatctttggaacgagtctacgctgctgagtggattgatttcgtaagcgaaatcccccaatggttttgcgcaagtcaagagtcgtcggctcgtcgcccgtcagcagtagttgggggaaagcatgtgacaatgtgattgacgtactatcaacgaacagaatcgcgaacggtattctgggagaaaatttagatgaaatacgggcatgtgtgatcatgcatctaagtttttgaccggtcatttttacatgattcatgagaaggatgtgaatttggtggacaggttttcacaggattcgtctattttctcgggagagtttttcaaatgcccagatttctgcttccagccgccgtccttaactccttacatattgttcaacgttgatagaaatctgaaatgataaacaaaatgagtacaacttccatatgtccaaatgagtaaaacattgatactccctccgtttcgaaatgtttgacactgttgacttttaagcacatatatgaccgttcgtcttattcaaaaacttttgtgaaatatgtaaaattatatgcctacataaaaatatatttaacaatgaatcaaatgataggaaaagaattaataattacttaaattttttgaataagacgaacggtcaaacatgtgctaaaaaagtcaacggcgttaaacatttcgaaacggatgatggagtagaatgctaggttgttgacatgaatcagtttttcttggtacatatgtttctcacgagagttttccaagtgccgagatatgaattagattattcaacatcgacagaactccaggatagttcagagatgataaacaaataatgaatacaacttgcattcgtcgaaacagacgaggaggacactgacagggtgtcatcctattgtcgttcatcgaacagcacacacacacagcacacaaactgaatttacaataatgcagtcaagcatcagcagaaccctaaaggagcatacacacgccgtcagctgtgttgactgactatataacaggattggatcggcctatttatgtattggtcagaaagaatcgctgcgagaattggggatgatcttgacgtcaagaacagaagagaaaacagcagcagccagtgggtaaccgattgacgacaacaagatgagccggagagttggatcatctgatgaaggcgtgccttcttgcccgtcttgggtcgacctgaagctgtggggacttcggcctcgtcacctgcttggttgatctgtgtgcgaaacaacgagttcacgtttgtgagatgaaacggaaaggtcgatgacattgtaggcaaaaatcttggccgtttctgctcttacctctggggacgaaatggtctgtcaaacttcgggagaggccgtgcttgtggcaccaaggtcctcctgagctgcttcaacgctttctcttcctcaatcttcacatgaaaagatcacagcaagttagttgccagaacagatgaaaatgcatccaacaatgtagggattttgagaagaaggcataagaaaataataaccttttgtgcgaattcattttcctctcgcaatctcttgtaagttatttccttttccttcacctgcacgacaacgaattgctcagtaaattcagccaatttggcaggctcctccaaaccagataatagaacaagcttgctttgctgaccatattgtcaaattctgatctttggaccgccctttcatcaacatgtaacttaagtggttgaacttcagtgagaggcttcctctctttctctggaagaggaatgggatccctgcaacaaaattaacagtattaatatgcatcttataagggaaaccaggaactgttgggacaagagaaaccgtaatgtgaaggcttactctttcattatggggtgtgccttcactactctcctctgggcctcttccctctccatcctctctctttcttccattatcctctgttgctccatctcatgcctcaccaaactctctaactgaaagccttctggcctcgtgcatggttttggttcaggcttcggtggtatctgaagagagagaaaatgttaaggctagcagaatatgagatggtcagcaaccaggacatgtaatattcggtatgttactttgcacgtaccactggatagtcagttgtgtag

SEQ ID NO: 68967 - DNA, 3068 bp, Oryza sativa
atgttttgaagcacaatgcaatcaatgtatcaaatgtacaagcttcaagaagataaggagacctttttgttcagtggctttgccttgaacttgggagccttttctaattcttctagttccaattcctgagaacttttcaccctgcagaaagatgatgttagagtaatcgaaaataatcaataacataaaatggcttgttttctgaatgatgcaagtggcaaagggaaaccttggtggtctagctcgtaatgctgtctcaagttggggtggttttggcgctgtcaaggtcagtggcttactgctctgactctgcaagatttgattaaactttcagtaatgccaagaattttaatttttaggagactaataagaagaagaatttacatactgatattagcaaccaggttaagtgaagggagcttaccctgatagtccccacggaagaagcttcggaacaggtgtctgcatgtcgtgtagctctctccatcgttttaagatgaaactcctgtaggtgttggaaaggaataactgaatcagccaaacaaagctgtggagctcataaatttctgaatcagccaaacaagacgtacattaaattcaggaagctgtggagctttccttggaagaggaggaaatgaaggggcctccgcaatctgaaaggagaagcaaacaaatagttagtcttcagatcctggattgagtagttagtataatcaaaaccaaagcaaacaaatttctcacttttttgttaaacggccgtgctctgaacttcggaattttggctagcatctcctcctctagctcagcagagcttttcactctgacagcacggaccctgtgggaggtctggaactcaggttcctttggccttgttagcatcagctttgttcttctttgtaatgcggttgctgcatcctcctgcattgtgcacaaattgcaatatgtcaaaattcttagtaccaataatgatttcgtcgtcaacggttcagatgtaataactgtgcaatatttgatatgcagatatcagtatcacaaaaaggacatcggtctttgtatggaaccaaatacccacaacaagactgagaagacatgtatattaataaaattggagaaatgcacacaatttaaaattaataataaagggcacatgagtgctaacatgagaaagcgatctgttgtgagggatggccaactctctagtcccagactcgaacttctttaccatctctgctgccgatatatagtgagtcacttcctgcacatggcagaaacaaaagttgtaagtgccaagctcacaataacaaaatcacattatacttgcattctcacaagaaacattacaattaagtctatcatttaagagtcagaagagcaacttgggagctaccttgagagagtgtgaatcgtcacggtgcttcctcatggccgacaggctcatctcggtgcttcctgctagaccacctcctctccccttgtgaggcagggtccttgtcttcacgttcagtatctaaccacgacggcaaacacaatgtttctcagaaatctcgcgcaacgcaaacacatgtatttgaagtgccatctttaatctcatcccagtattacctgtcttgtcctcccatcatcaagcttctgtctcttgacagcttgattttcttgtgcgatttcattcgcagcagtagcggccttcccagccagcaactcacgagggcatctgaaaaaccaacaattcagacattagtaagaaaataatctccagattaatatatttttttatgagtgagcatgactcttacttgatcacactcctcttgacgctcatcgactgcttcaaagcagatggatgtgcccttgagccagtcaagggtgcaagacctctggaggagttcgttgcctgcaccttcggagtgaaggcttctgtcttcactgtcagcttgggacaggtaggcaccgtagtgacagctttgacgggtggaggcctctgaatcttcggtgtgctagaagcaacatctgctgctaaagccatgcaacattgatatcaaaatccagggatcagagttcttccccactgccattgctcatatataactagcaacttacattttgcattggaagggacaaactcgaaggattttggcgattccttctcatcctcctctgctggtggcgactccaacattgcatcactgcccaaaacaaccaattagtcattcacatgccaaaaccagcaagaaacggaatgaaccaacaaattgaggtcttgaaatgcacctttcttggtgcttatgatcgccgtcagtgacacaattttcactgggatttgcttcatggacctgaagaattcaggatgtgagctgctagaaacccaacactagtacttactgaaactgagaacatagaaaacatgaaaacatcaagaaatcacgtacaagtttgatggagccgtccttattctgttgcacattcctgaacatccaaaagtgaagatgaaaaacacacgagaaatcgattaacttcatcagatcacaacgaatcatcataaacaatttctttagttctccaactcttacccatcagaattctgcgagggattggcggcgcttcctgctgcctcctccactgctacctcctatcatgacgaacgcagaggccaacggacaataagaaggggggagatttacagaaattagggcaaaattggggggttattcccgcagctttctgcttcgtaccttcggaatcggctccgcgtcggtgaagtcgcagaggctctcgatcttgacctccgccctcgactccttgatcctcggagcgaacgctgcaagcaggtaaaagaagaagagccctaatcagcgcaaaaaaagcaaaacacgggagagggggggatgatcgaggcggcggggtggggattggggagcgtacgggaaggggcgtggctggcggaggcctcaaccagcgctcggcggcgcggatttcctcctccgtctcgtcgcagacgaagtcgaagaacttgggcgcgcagaactcgtagccctcgtccaccagtaactgcggcggcggcgccgccgcct

SEQ ID NO: 68968 - DNA, 905 bp, Oryza sativa
gtaggggcagccaaggaaggtgtattagccattttcttgttacttggaggttcagagggaggttcagatttctttgcgaaaactgatgtcgccgtctcttgaagactttgcagcgaggactccttcgagctgcaaacaaggaggtatcatgagctacaagctgagcacagaggtaaggtaagcagaggagagcacaggggtaaggtaagcagaggagcgcataagagagaacacaagtgaaactcagacctccctagccgatggagcattctgccaatcagcacctcacaagatccaggtagctctttttcgagatgcatcaaggaatcaaggaatgtatgaacaactggtccgttaaacttgtcaccagtagcctgcagcatgtcatcaatacagtgaagagtttggcatgtctcgagttgtacaaagatcaaactgataaaatgtggtgatgacacaactcattcgagattggattatccaatattaaggttaaggcttcattcgtttcagaatgttggctgaaactttcccccgttcactgtgcgcatgcttctcaaattgctaaatgaagtatatagaagtttctttaaaaaaatcatattaatccatctttcaagtttgaaataattaatgctcaattaatcatgtgctaatggtttatctcgttttacatgcagctgagtagctaagcacaaatgtccttcaaattcaacctaattcttataaaaaaatgttaagagcgtaaataaatgtgttttggggcttataaagaattttcaagaaacaaatgtataatgagtagtgtcaatgtagcaactaatagcaaacacagtagattgaaaagggaatgagttaaatatactgtacctcttttagagaaggaattatcaatgacgagagtg

SEQ ID NO: 68969 - DNA, 981 bp, Oryza sativa
gtttccgcctgcacggctggcctattatgccgctgttgttgggcgtctacgttttcaccgaccggccgcttcgaccgccgccgactagtgtttccgcctgcacggctggcctattatgccgccgttgttgggcgtctacgttttcaccgaccggccgcctcgtccgccgttgttggatgtctacatcttcaccgttggctcactttcgttgccgtcgactggtgtttccgcttacacggctggcctattatgccgccgttagtgggcatcttcgctttcaccgtcgaccgccttcgtcgccgccgactggtgtcttcattgttattgatggacgactttgttcccacattggccacttctgccatcaccaaggggaatattacaaagctaagtcatcatttattttattctttatatgatatttttccttttcctctgcctcactacaccaattggtcttccattgagtagtgagtcgggggctacagatgttatatcatatttttcataatatttatcttgattgcttgcgacataatctgagtacaaaagtacctatcgagttatggagttctatcttcctatgctttccgttcggtttgccaatggatggttgcctttgggccgattcctagcacccgggggctcgttggatggaccgaataacgcaaggtgctaagtattattcggaataaatcaaaagcatagagataagataatttattttctgctcttaataattgcaaaagtacctgagtagtaaattctaatccgtgaaactttgttccattaatgacgaactcatatcactcatatgcatgtttgggaagtgcctaggccgactcccgatgcttggtggttatgactagtcgggcagagtgtttaaacgtacagagtcatctgctcggggaaatcaaaattgacaagaggagaaatacatatttataaatattttaaaatacttgattttttctcgagtat

SEQ ID NO: 68970 - DNA, 713 bp, Oryza sativa
tatggataccccagacccacacggcatgtgtatccgactgggtatgggatgccatgtatagatagaatatctttaaagggactcgggttaaattctaaacttgtatgacaaggaaatacccgggatcctagtcgtttacgattgtatccaatctgtaactaccaattccgttagagatatgggctttattttgtaatacggaccccttcccttatataaggaggggtccgggtgcctcaaggggcacgattttgctcccagatcatacgatcaataatacactcgacggatcaatcgttgtacaggagtagggtattacttcttattaagaaggtctgaacctgtataaaatttcttgtctctaaacccatccacttttctagcttgatagccactccttttagtattgccgaaatcttgtttcgacaccgttcaaccttcctaaagatatctgagttgggcagtagcgacgttaatgtcctaggggaaatcgttttgtgcctgtgatatgtaatggaagctagtgtccctagcgcaaacatggatgtttagtttctgctgttatgtgttttttttttctgttttttctgtatcagactatgtttctgttctgggcctgtgtttcagactgggtgagtaaaattacctgctgtcaaaaaaaaaatccatctgcagactccactgaaaacgttaatccacagggctgcaggaat

SEQ ID NO: 68971 - DNA, 12119 bp, Oryza sativa
  unsure (1)..(12119): unsure at all n locations
tgcacccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcaacgataatagaatggtccccttattccagtgaagcagaacttcttcaagaggtttatgttatgttatgttgtatttatattatattattttattggttctaaatgcggatatagctgtgttttgaatgtgttcggaatagcttgttcattgtttgcagaataaaggaaagggcacagctttgcaaacaaaaacatacattaccaatgtagtaaaaccaagttactgttagattacgcgacacattgttgaacctggcatatcataaaaataaagtactgatcgttgttgctgatgtctcttcttttcttggcttagttccttaaatgattttttttctctgtactttgttaccgttgtcctcatcttcttttctgtgtgtctaatggctttataatagtacagtttagctcaatcaaggaacaagggactcggattattatatacaatctatgggagaatgaacagggagagttggagcttgattttgatactgatgtaaatgtgagtgccaactaataattaatgaagtcatatagccagcaacagaaaatgtggttaaatatgaaatttagtgatgtttgagatggcaggatattcaaattagaggtggtaaccgagatcagaaaaatatccagctggcaaagcagtttccaaactccagacatttttttacatatagacattcactgcaggtaggttccagatttactttgtctgtttgtgccaaagcaatgctctgaatgcttttttttttcttttttcctgaggaggcctctgcagttaatgtatcaaaagaaaaaggaaattttagtttcaaagagaaaaacaaaaaaatcatggtaaaaagagagagaagaaattacagggaagacaacaaaaaaagagccctctactctgaatcataattgatattaggaataccatttaatgttggatggctacttattttcttagagaacatgcaaaggcactgcatatcattttattaaggcagacttagaaatgataacaaggcttggttgattgtagtgctatttgctaatccactaattctatggtgaattttctgcagtagaaaagacagtagtaagcatatgagccataaatagttcattggaaaatttagcacacttacataaattgtgcagaggatatatgtcaacctgatgttacttcctttctgcagagctatgcatcgattttgtatcttcgagttccatctgtattccaaatgattttacgaggcaaagagattgaacatcataatattattggtgacatgatgatgaagaatcatgttatttacaaaccagtgatgactgatggatttccgagggatatcgatgtaaagattacaagttctgtacccatcgtttcttgtatagtgatgatcccttaacatattttgtgcatggttcctcatctttgcatgctagatgatgactgatgttacaattggttttgttaaagatgcaaaacatcatattcccattcaaggatttaatgtttaccacaagaaccgcttgataaaggtattcatttagttatgccacatatatattcttatgatgatgaaaataaatacatttttatttctagcttctaaaatgactgcacatccatataccaattttacaattaatggaaagtaaatagatttgggatttgcacatttatgttctatgttaaatttctctgtaactcttatgttttaagctgatctatttttggagtaaaatgcaccataggtccatatggtcctgttgtcaattgggcatcgcacttgggttcttcaagttgcgggcatgtcgctttggttcctacttgcaagctgcacatataggtctgtaattttgtaaagcagtgtcaaaaaaggtcaaaaaccttcggtagttaaagatgatatgataacttagctcaatctaaaccacaatgtgaccatgctatcacctttttttagataatggaagatgagggatacatctctggtggtctggcctatgcagaatgcacccagccaatgtttcaccatttgaagtcattgggaaactaatatttttttgtttgaataataaagtttgtttctgcgtgccgttgattttcgatgcttctaattgatggtagttggcaatagcattgtcatattttagcttaaataggattgaggtgccacatttccaattaagctcagtgtcagcttctattggtacacctacacatctaaggatctagatgtgcaatcatcacgttgaggataaatgataacgtgcccacacaagtttatggacttatcgcacaccttatttctcttattacgcttggtaatcaactgaatatttcttgttctaagcatggccatcagcctgtcttaggtgattataacagtcaggatacgagtctcatcagaagtatatatgtttttttagcctttctggagagtgtgggctctacctggaattcaagggcgtggtgttataggtaagaaatccttctataagcccctttggcacaacttcttcatgtgtggaaagctgatactggaagaagctggtgacagacagcttctccttcatagccgtaagttgctgcagaatcagattctgtcaaacagcgacacttcaacttcttagtggagaagctgatgtagaaattgtgcctaaggggtctgtaggtcccttcttcagaccatgtgtaatcattataacttgcaggtgtacttgaagtcaactttgtagaaccagctcatgataagcaggactttgaacgcacaaatagccttgcaagactcgaagcacgattaaatttaatgcagaagaaatactggtttgtcatgtcgttttgcattgtccatttgttgtctgtaggcataccagttctttgaagaattctaattagagtctaattaccatggaaaacacttacttctgtttcaggtctgataattgccatcgaataggttatggtggcaattctgctaacagaaaatctgggagagaatataaaggtaggtagtgacgcagggctccctgcttgctttatttggattacttggtttggttaatagcttaatatttgtatttttttttcaactacatagtacaaaacaagataaaccaaattggtttggaactttagatagccctgaacgcatgcatgcatacctttgaacctagcaaccttagttctttcttttctttgcgttttctttttggcagaggttttcttttacacagtttttctgcataacctgtgctaacaactgagaattttttttttgtttcattctaaggacatactattatatgttgattcaaacaaatacactggcatgcatgtcagttggcaacttcccttgtgtgttcatgtttgtacatccattgccaaacatatgtcaagacataggctaaatatgctaattatatagttgatgcatgagacaattgctttattaagtaccctattattttgttggaatagagacacctgaaaatactccacacacaggaccaacatcagatcaatctcctgaaggctgtagaagttcgaattatttgcaaagaaaaagaagttttggaagtccatattctggatcaagtaataacaatagcaaaactggaataacatccttgaacacaagtaaaataagtcttcctgagagcagattctctttaagaacaacagctcagcagacagttgagaagaccaaaaggaccttaagatatacgagaccactactgcacggtctatcacatacaagtaatgatagtgatgctcagacttcaggcaccccatcaagatcaacttctcatattctaaagacacctgaaaaatcatgccacaatgagaatactttgcctttaattccatctagtgaagcaataagaagtgaagggacaacaagatatcagtcagaggtatttgtgttcctctacatgtaataaactttgtttctgtttccaatatttgtgggtatagtggtagttaaataagctttatcatgatcttacacagtaagttgcattcataatggctgcaacatagcagatagcacaaagcttggattggtttttggtagatcctttactgttgaagtgttcgatttccttttggcctcaggaacaataagatgaatgtactctgcacaacttatctcactatgggaccaaaaaaaagaaaaagaagcaaatgataataccctaccttgttcttttcctccatcttaattacattggatgacctccttcggtcatcccgacaaaaaaaaaaaaacataccttgttctattccagtaattatgtgatggaaaatagttgacatgggatgatctctcatagttttactttcttctagatgactgtttcagtagagatgacctctcaccttaggaagacagtaacattcctcccattaaaagttaacaaagtatgtagtaccagaaaaaggaatgcagatgagtgaagtttaagtacagtgtaaattatagtaagaaaaaactgaagagcaatgagagatggtcattaaagatgtactgaatgtcctaatctatccttctttacattttgcaaattttccttggtttgttctttacatatcaagagcatttttttttccttttgagacaactgatatatatgctttacaggaaagaaatgtaacaaataatggagatggacaaactgttgataaccctgagacagttatcaaattgttgaccgatgaaaattcgtcattaaaagaaaggtagctattaccagtgcttcattcatttcttttttacgttttactggcagttgtatggacaataataggcggtaatcagttgaaatctgaaatcttaagtaatgttgagaggttaaatgttactgtagttgaatttagccaacatatgggtgtttattccaggaactttaacatttgccacatgttcctttttattcctttgttaacatcagtacccttttttgaattattaaaattgtttcctgatgtatgatcagcagaaacttgtttgtttaattcaaaattcatgtaaaatttttattttaaaatcactttatttccaaacagaagtatatgacaccatttaatatcaaacccaagatcatgaaagcttggcttagatatttggtttttcagtgttcaatatatcaaaggtcctaatccaatggattgcttgttaaaggttttccccaaatgacacttagttgttcgcatgaaataagatttggaacttagagtgacttttcctcttcattcttgtttttttccctgtgtgatagtatcatgaagatggaggaatctttgtcaagagaattacatatcgaacgggacaagaataagtctctcattgaaagggtaagcaatactaacttttacctgtggggctgttggtagtatactgtgtgcttgtcctgaaatttttactatttagcccttattcaaaacttgctgcaaaaatgaaccccgccaaaaaagttcaacaaaaaatggcccctgatctctgcaccatcggactgacactgagatcgcgatgttggcattgacccttgccacggtggtgggtggggagactggcgtggcaaagggggtcagcaccagaggtattggcgctaacctcctattggtaaaagggtaataggctattctatacaacgatgcaaaatgtggtgcagtggtgtgatgtctcatgctaccaacacatttattttcttctttatccaaatcatgcctatatatgcctaattctgaccagctaatcgaaagtatgttttatgtttagctaatgtgaactgtatatttttgcaaaagtaattagtacctttttttaaaaaaaaaaacaaagaatttgaacatgtgtgtgtatgcttaataatggtcattcaaagaagagggactcatcctaagaaggccttctttggtaaagcaacaaactactataaggccttctttgtgttgaaggtgtgcctactacatttttaagttataggaggttagtgccaaaggcctcggggctgacccctttgccacatcagtcagcgagctcccctgccaccaccgtggcagggtcggtgccagcatcgatagtgctgagtacctcagcgcgaggtcggagtcaatttgtggttaaagtttttggtggggttcatttttgcaataagttttcaaaaggagcaaaatagtcaaaacttcagcttgccatgcgttaccccaattacaggttaccagaattttattcaactttgcacctactgaggacaatttattctttttcactacagtttggtgtagtgatttatagaaacattttaggcgtcacaaaatatactgacatgacacatgcgatgcgatttactggagccaataatggcttgaagggtttgaaaggtcagactgcattatttcagtctttgtaaccaagtccttccatattttgttttccagttggagaatgttcagaagcaacttggaactgcaaacaaggagcaagaagcattggtagatatctttacagaagaaagagcgcgtcgagaccaagaggtggagaaccagcggacgaaactaaaggttagttagatcttaaaactgtagtggatttattgcgcgaatgcaccgatccaatccgccttgtcgttgaggatggcatcacggcataactaagctcctcagtcggcatagccatttttgatgtcgtctctgctgttccaggaggcgtcgtccaccatacagaacctgctggatcagctgaatgctgccaggagctgccgcaagaactagaaatggaatgaagaagatcaattacctcgttggtccattgtggctatcgccgtaaaataagtttcccttgtacatgttagaataagctatatatgtcccagatggttaattggtgctagaacagctagctgttggtatgttttatgtgcaaggtatgcagtgctgcattttccagtgctaacaaagaagggtgagtcgaccaccactctaaactcgaaaatgtgggagatcgaccatatcggtttcagaccttcagtatcattcgatgcaatactttgtctaaacttgagcagtatgtaaaactgtagttctaaaactcctatcataatgttagtctggttaatcttatatttttacgagttcaccttggtgtgtattatgtttctcggtattataattgtcttccgtgttgatacgcacatatgcttttcctatgaagtccattttttggtagtaaatttattttacaaaacattaatcatgaacttggtatatacatgatcaccaaaagcttatgtggaatatgaggtgatgaaccgaccggttaaagaaacagaattgtagatgtaggtgttgacgcagtaggtgaacgttggggtgaggaatactgaggatgttgccagagagtacgctggggtaaagctatagatggccaaaatggccgccccgcccgggggcggctgataagcgatcagccgcgcgcgcgcggtcagtcgcctccctcctccctctagtatctcatatatactactatatacattttatatatatatatatatatatatatatatatatatatatatatatatatatatatattatttgtttggtgctccatggtgcccgggcaccattgttgaaattgagtatatacccaattcaaatgagtatgaaactttttcaattacttaggtattaacattaactactttactaactagtttaaagcaagtttgaactgaatttgaacttgtttttgttagattttgattctaggtatatagcatccatacatataattagttaggtatgtaatcatggattgtgaaataaagttaaatttgagttgttttgttgataagtataggtatgaatcaaattattataactaggtatatactcacaatttgaaaattttgaaaaatttgagtgattttgtgcattagataccatggtgccccatatgagtgtcctatatatatatatatatatatatatatatatatatatatatatatatatatatatatatatatatatatatatatatatatatatatacatatatatatatataagcaatactagaaagttttacattgtgaaatagagaaagtaacagacagtgcctacttacttcctccatcatagaaaaaaataatttctgcatatgtttagatacatatatagtcagaagatgattttcttttcttacgaagggtgcatctcacagtgcaacctgtttttatatatatttgttgattggtgagagacaatttcaactccgtacttggtaccttaataggtgtagcggcctattgaaattaagtacacgtatggtttctttatttatgattgttagttggtgtgcaacgtcactatatctgtatcttaagtttgtatgcgcatgatatatatgttcatctaatgaccatcccttttatcaatatccatcgtttatcacgctatatttcatgtctagctttaaaaatgatcttattttcatgggctggcaagtttcaaatttgatccaaaatattctttgatttgctaaccatttttttcaaaaaaaaaatcaaatttctgaactttcaatccatacgtaggtttgtggtttggctttttttttttgattcaaggttccataaccattgccaagagtgccacattatattttgatcttttggccggggtcggaagaggggctttaggtgtgggatatatagaatagatctccatgttcggagggaggtggctaaccaatagcacatgagcatgcttggaagcaagcggtgcagggggatgaggtcggtaacacgtacaacaagaactcaagtggctgggaggtgttggcgtcttggcgagatgtggtgctaagtgttaacaatagtggaggcttagtggatgggaatatcttagctaaagctgcacaaaacatctggtttgaagtggggggataattagtagggaagagggaattgagtgagtgagagagagagagaggaggtggctagtgaagcatgtggatgttatcaaggcaggggttgtgtctagaggaggaagggtgacgtcatcgtgttgcaactttggataaacggaggaaagccattgacagagacagctcccaggcaggtcggacaacctcccaagctccaccgctgccatcttctttgcggattgtctttcgacattaaaaaatcacagagaaacattgttagccgtttggatttaacaacggtattggttccgcccctaaagaggacgagtacggtgagggatttttttttccttaaaaaatgaagtacaggtagacactctcatttatttttcttgaccgaaaagtttctccaatatgaatttggatttccctccgacagtagcttctagatcctaacctcgtttggatgggccaaaatcctgacgaggccacgtctatcagtgatgatttccatcggtttttctgaaatgtacagctgcaccgaaatctcggccaaacggaaaacgggagttttcaactttgtgctgaattttgtcaattgcattgtcggttatcgaattgaaactactccgaataaattctgacaattggttagaatggtttgtcaattgcgtttgttcaatatctgcgctaatcgccaaatctcccccaaaatcttacaaagcaggggtcgacgaggcggaaacgagaacgacccggacactcacaacgggcaggagtgggtctcataataagttcatatttcatgtatccgtttaacctaaaaataagttaatttttaacaattattgtattattccatgcttccaaacgtataagacttattccattcttttgtttttttaaaaaatctaagtccaatttatagttactatgtgttaaattaagttgttgattagaacccaaaagccattgagggcggctagggaatgtatcccgtctgaacgggatacttgagattgacatcaatgctgacgtcattatacgtacgcggtaccacgtatgatacctacactactacgaaaacgatttttccgtgtggtccaaaagggttttcgcgtgcggatctcccgcccatctgcattgaagtgtcagcaaaaatccgattttttcgtgcgcacgcgaaaatctaattttcacgtgcgggtggcttatgtcgcaaaaaaaaaaaaaccaaaccctaacccagccgccgccctcctcgtggtcgccgtcgtcggcggtggcgttgccgccttctgccgctaccggccgccggggccggctcccagcagcgtcgctgccgcccaccgccgaatctgggcgggagaggggcgccgccgcccactgctggtcccggccacagccagggttttaaatttcaaaatacgattttatgccagtggggggcgaaattaccgaaatttcggaaatttctagccgaaattatttgaaaatttgactgaatttgaataaaatttgaccaaattcacaaaaacttgcaaaaaaccaaaaatttcgggcgagatttgagtatgccggtgggggtgaaaattaccaaaatttttgaaatttctaaccgaaatttcaaaccctggccgcagcccacaagcgaggccgtgctaccgtcgcccgtgagagacgagagagagatagaagaaatgaggataacgatgagtaggtggagaggataagatagaaatttttgaagtggttgagaggggaaaaatacctgaggagggtatttcgcgtgcggtgctcttaagatgcccgcatgcgaaaatttattttcgtgtggtccgcttgcaaaaataggtttattttttgcgtgtggactcttaaaaggcccgcatgtgaaaaccgatttttgtgtgtggtcctcttaagggtccgcacgcaaaaatgggaggacaatttttctagatgcggtcagttatggaccatatggaatctaacgaggggctcgtacaggaaaatcgttttttagcagtgcaattagttccaagacatgatatttgtgtaacaggtcagataccctataggtatcatgtcaaggtacaaaaacatgatacttaagtaacaggttagataccctataggtattacgtcaatgctgatgtcactgtatacgtatacggtaccatatatgatacctattggtatcgaacatgatacatgagtatcaagtatgatactttatgagtaccaagtatgatacctgcatgtaccagccatggtacctgggtaccaagttggtacctgtaggtaccaagtccgatacttatatataccagacttggtacctgggtaccaggtccaatacatataggtaccaaagtattatgatactactaaagtatcatagcacactaagaaccaaaaatcatatcttaccaagacagagctcaattaaaccaacaaagaaaattgattccgggaaaaaaagtcatcatagtggtagaaacacccatagaacatgtagaacaccccaagatcaaacctcaaacccaagccaacgcaaaagctcgggggtcacgagccaagatctaaatatatggatccgcaccacaagaggccttgtcctcgatgatggtgacctcatcgacgatggccacctcctgaaacgtggtgagtagctctgtcttcgtcttgtgcttgggtacctaccccacgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 68972 - DNA, 79138 bp, Oryza sativa
aacttgtttttgttagattttgattctaggtatatagcatccatacatataattagttaggtatgtaatcatggattgtgaaataaagttaaatttgagttgttttgttgataagtataggtatgaatcaaattattataactaggtatatactcacaatttgaaaattttgaaaaatttgagtgattttgtgcattagataccatggtgccccatatgagtgtcctatatatatatatatatatatatatatatatatatatatatatatatatatatatatatatatatatatatatatatatatatatatatatatatatatatatatatatatatgtatatgtgtgtatatatatatatatatatatatatatatatatttcaatgcataaaaaatatatacacatatacacaaagtttatatacgcataaaatataaaaataaataaaaaaatacatcatgaatagaaagtttgtatacgcgtatatacaagtttatatacacatatagaaagtttgtatacgcgtatagaaaagtttgtatacgcgtatagaaagtttatatacgcgtatacaaacattctatatgtacgaatacaaacttggtatacatacgaatacaaacttgatatttatacatctcgaaaaaaaaaggaaaaaaagccgaacagaagagaaaccggaaaaataacaaaccgaacggaaaaaaaaccagaggaaaaaaccaaacagaaacgaaaaaaccggtgaaaaaaaccaaccgaacataaacgaaaaaaagggaaaaaaacaaaaaaaacgaaaaactcgctcctcatccctgttagagtttgtgtcgaatatgtgtacatagtcggttacagtttaggactaggagttgtaataggtattaggactagagtatgagtcggactctatccaaggttctctcataaatagagaggcatgcctgttgtaaccgcatggcgacttagcatagcgagagggagcgactgaactccgttaacaaatatcgtgtctcggtgtcgtcatcgttttggatctcctatgacgttttcttccgcgtttagctaacgatgttgatttcggggctggttttataacaagtggtatcagagcctacatgaggtccatggtagaggcgcgatggaggtgctccacaccgcgtagcctgctgtaatgcccacggaggggcattggcgcaaggtgaagcatggcggagatcaacggagtcttgatcggtggatcgaacacttctggcagcggccggaaccgtcgatggctgctttcaacagggagatgactagacgtggtgctcgggttgatggcggcggaagcgattggcgatccaatcggtgggtcagacacttcgggcgggtggctcggactttccggtgagctactctcgacagggagacgtgcggccgcacgctcgggttgattgaagctggaggcgatcggcgttctcgatcggtggattcgaacgctctgggcggggtggcccgggcctttcgatgagctacgttcgacagggagacggctagacgtagcgctcgggtcgttcggcggctgggaagacggcatgcgacttgtcggcttcagctcgcgactagattgatggcgtttcaatcggaagtcggagcgggtggatcctataggctgttttggaggtgttgacgaggtatttgcacgatggaattgcttcaaaggcggcgtattttgtggcatatggctgaacaaagcctagggcgaatagagcagcatctagtagcggttcaaccctggagaggttttggttcaacctgtttttccctctagcagacaagaagtaaaccacgtgggctgtagatcaatgacaacagttgttggtggagtcgtcggtggtgcttggcattggtgctagatgttgtcagagatacgaagaagcccaggaggtcagggtcgcggcggtgtgcgcgtcctgcgtcgaagccgagccggcgacggagatcagggcgatgccgagaaggagctggctagggttttagctaggtcgtgcagggttcggtcttgagggtttgtggtgtggaagacacggacatggagtcgtctccggttcggtcacggcgcggacacaattgaagacaaacagtggataccaagtttcaacacgaaggggaatcggacgaggactacgattagttcatgaatcggactcgattttttcccaaataaaagcagcagaggaccacgggattgcaacaacgcaatcgaaacaaatcacctagcagagggcgagattcgtacccgattttcgcaaaggcggaggtggtttgggcggcgaggtcacgggtggctggaggcgcatccttgcaggcggtgtgtggcggcgtggtactcggcggcgtccgtcggagctcgagcgagagcttgcggcggcggctgcggcggttcccgacgaagaaccggcgtaggtcttcggtggcggtgctcccaaggcggcgcggcagcctcttgcggggccggcggctccccaaggtccggcggcgcggcggctcctcgtgggtcggcacaggcactagacggcggcgggaggcgatggtggtgtgcggcggcgcaaggcagcggtgtgcggcagcttcggcaacgaggcggcggcgcatcgggtagggcggcagcgtgcgcaggagggaggagcgaggaagccgaagagaaaaggggatcggctcgatctgagccggtctttgaccgctgttgtctggtggttgaccgagtaaaggagaccgagtccggttttttggagaaagagaaaaaaaactgattcggtccggctggtactgttcgagttagtcggtggggtcgattgaaccagggcagatcaatttaacagggcaacagctattgagttgattatcgtcgatggcggcaacggtggtttccaaatttgaggtggtgaagttcgatggcaccgggaatttcgttctctggcagatgaggctgaaggatctgttggctcaacagaggatatccaaggctcttgaggagacgatgctggaaaagatggatgctggcaagtgggaggagatgaagacgcaggcagctgcaacaatatgcttgagtctctcggattctgtcatgtaccaggtcatggatgaaaaaacgccgaaggaaatttgggacaagttggcaagcctgtatatgtccaagtcgctgacaagtaagttgtatctcaaacaacagttgtatggtttgcagatgcaagaggagtcagatcttaggaagcatgtggacgtcttcaatcaattggttgtggatctaagtaagttagatgtgaaactggatgatgaagacaaggccataattcttctgtgctcgcttccaccgtcttatgaacatgtggtgactaccctaacgcacggcaaggatactgtcaaaactgagataatttcgtcgttgcttgcacgagacttgagaagatcaaagaaaaacgaggcaatggaggcttctcaggctgagagtttgctggtcaaggcaaagcatgatcatgaagcgggggtgtcgaagagcaaggagaagggggcacggtgctataaatgtcatgagtttggacatataaggaggaattgtccgttactgaagaagaggaaaggtggcattgcaagtttagcagctcatggtgatgattcagatagcagcagtcatgagattctcacagtgtctaacgagaagtctggagaagcgtggatgttggactcagctagttcctatcacgtgacatcgaagcgggagtggttctcttcatacaaatctggtgattttggtgttgtttacttgggcgatgacacgagttatcgtttgttggagtgggcgatgtcaagttcaagatgtatgatggaaacgaggtgctactttcagatgtgagacacgtgccgggactaaggaagagtttgatttcgcttgggagcctacatgagacaggttggttgtatcaggtggattctaataggaagaccatgaatatcatgaaggacggcaagactgttatgactggtgagaggacaagctcatgtttgtacaagttacaaggaactgctgttgtaggtggagtcatggaagatgggcatgctggtgttgctgtgcacgatcctgaaggcggcgagtctagcgtaggctcgtcaggcggcttggcgtgagctgcggcagaaccaactcaagtcctggtacacggaggttcgagcaagtaacagattcggattggcgtggcatattcgccaaggtggagtttgttagagtttgtgtcaaatatgtgtacgtagtcggttacagtttaggacttggagttgtaataggtattaggactagagtatgagtcggactctatcctaggttctctcataaatagagaggcgtgcctgttgtaaccgcatggcgacttagcatagcgagagggagcggctgccggcgtcgaccggccgtgagtcgttgtaactctgatacgctgtatatgctggatcggggaggagcacccgtaatcagtgccccagagatgtaggctacggctgaactccgttaccaaatatcgtgtctcggtgtcgtcatcgttttggatctcctatgacgttttcttccgcgtttagctaccgatgttgatttcggggttggttttataacactccctccggcgcgtcgccgccccctccccgcgcgcgacacgtgtccagtcgcgcggggagggaggcgcgcgactgatcgcccaatagcaatctcggccccgcccggcacagcggccgtgcctaggccaaggtcagtcgggccagcatgggcctgacttacacgtcaggccatgccgggctgacccaaaggcatgatattctatcgtgcttctctacagaataagtctatttttcctatcttaactctttgggctttgtctatatggctggaaatacatctattttgtatttctcttctctttgggtcttaccttatatggttgattaagcctattttgcgtccctctactatttttcttccattgtactgggccgtgccgacccaacgtgccgaggtagcagcccagacacggcacggctgttgggtcggggcggcacaggcacaaccccagtcaggccgtgccgtgcttgggtcgggctaaattgctgccttgggctgggccgtcaagcctcgggccatatggccatctataggtgaagcaacaaatgtcagtgatggcaaagcttgacgccttgtaacttaaacgccgtgattaggggctctactaagtcaaagctaaagctaaagttaaaatataaatttttaattttaattttaaagttaattttaagatattttcaacgtagtttttttaatattagcttttaagtcgctaagagcatcactaaccgcaatcctatttccttactaaaactaattttgagggtttttagtgaaaaaattggatccaacagattcccaaaagcactgcaatagttttggagttcccatccccatatatttcgctctatggatttgagggcgagagagtgactcccaatctctcgttcgcgtgtttctcctctcctttatgcacgagcagtgaaaatttctaaatttctgtcggtgatcgcgatctctttctgcgcgcatggaaggaaaaaaagggaatttctgttggttgtttaacagaagggcccagtttttgggattgaatatcttttggaggcaggagtattttcacttcctattttcagttttggaaaaaattttgggatagattattgctaatctgttggtgatgctatacatatacaagatttttacatatagattaattttttataccttaataagccgtttagggaatgtgagcaaccgacaggggcggagccaggcaaaaatggcatcggggtcactatagttcttattctttactacttacgtacaacatgtactatctccgtttcatattacaagtcgtttttttcttaatcaaacttgtttaagtttgactatgtttatagaaaaatatagtaacatttctaatagagaataaacattttatttaaaatatgtggtatactctctccggcccattttaagcgcaatcataaatttatgtgtccattttttatcgttagtcttatttgaaattttttttatgattagtatttgtattgttattagatgatacaacatgaattgtactttatacgtgacttatatctttttatttttttcaaaaagaatgaaataagatggatgactaaatttagacacggaaactcatgagcttaaaatgagatgaagggagtatttaagtccagatggggataatttgttttagttttcacgagggcatgatagaggaaagaagttgaagatggggataatttgttttagttttcacgagggcatgatagaggaaagaagttgaagagtgtctgcttaaagaaaactagggtttttgttaggaggcttggctcaagggatctgagccttcgttcctttttctctgattcaacggtggtggaagggtcggcacacagggccacatggatggttggatcaagcctcgtatcagatagtacggtccacgtgaattcgaacgtgtttgctatttcaccagatgatgaggggttttctaaaaaatcgctgacgtggcgctctcccagcaatcccacggcttttaagtaaacctatattacgtgggcagccagctctgtactacttctagttagtaatataggcttgtaggccttttatgatacacgtcattacctgaaaacaggcttgaaaagctagccttctaatccccaaaacttaatggccgagctagtggaacgagatggcaaaaagaaacggggtcagatcaaaattttcaccggggtctttctagcattactaaggtggtaaggtggtgtttgggaaggaggaactaaactcacaaaaattttagtccctatagaaggggtttatgtttttgtaaaagggactaaagttcagtggtggagccaggatttcaaagttgggtatttctgtctaacaaaaaaaaagttcatagtagaaaaaaaatcaatggttcacactatgtcaatactgataatctaaaaaataaaactacaaattattacatggtacctctaattttctacctcaggcacaacctcaactgcagtaatctgaatctgaactggactctcatttgcatatgtaatcggctgaacaaaaggaacagcaacttcgctatcaattctaacgggctgtgctgttgatccagaaccagaacctgaccctaccttcctagactttgaatgtctatcccacaaagtcttcaaatcaatcgatttcttcttcattttgagagctctttaatctacagaactacagaagtacagaacaaaaaaaaaaaactactcagagactaaggtaaaaagacatggacacatgatgagtggatttaggctgattgaatcttgaactcttgattgctcacctgaagttgtgcttgccgccgggcgctgtcccgttgagccgcagccgctggccgccgcgcccttgcccctcgcggcctcgctcccgctgtcgctggtcgcccgtcagttgccgcctcgaggcctcgccgcgccgccgccgaacgcctcactgcgccgccgctggtctagctcccgtcgccaatcctgtcgccgcccaccggaagccggttgccgctcccgccggtcgccgcgccgccgccgaacgccaccacctagggtttggaaatggggaattggggagcgggcgagcagcgcgtgactgcgtgaggcgtgagcgcgagccgagccagggactcaggaggagtggggacaactactacgtgtacatgtgtatatactgatgttaggtattccggggaatacacaggaatcactgtagctccgcccctgctaaagtttagtccctccttctcaaataccacctaagggtattaccccagtgagagtatggtagctccacccctggcaaccgaggaagctacgagatcaccatgcaggtggaggtcgtccctgatctttctttagcacctcaattaatagggttttatgggttcttttggaccggagatgacatcgagagagctctcgtacgaggtttaatcctcttatagtgctaaaggagatatgaacaatttaatttatttgaattaactgcgcaatccgatcaatgcacaagtttaagaaacgtgtgcatgagctcgagaacaatagtcagcatgtcggtgacccttcttcttacggactatccgtaaataagaagtcgtcacctcgccaatcctcttatagtgctacaggagacatgaacgatttaatttatttgaattagctgcgcaatccgatcaatgcacaagtttaggaaacatgtgcatgaactcgagaacaatagtcagtatgtcggtgaccctcctccttatgaactatcctattaccatacataagaagtcgccacctcgctggagatcacaaggaaggtggtctagaggagggtgttggtgtggactgtatagagggtgataacctctgcttccgtcatgagtgggaaaacttctcaagtgcttagtttttctttaaaaaaagtatgcactggatttggcttgaaaagtgttgttataatatcataaaacttaaattatatatatatttatcttcgttagatagttgaagttttaaaagtttggctcctaaatgctagtaaatatttatgaccaagcacatgtttagtgcgtttgtatattgaaagaccaccacataacaacgagccatgtgtttatcgactcaaataacgattagctagagtattatagttcgagttcgtcaaattgttaaagtgccgtaggctcacctgtctcttgaaccgttgacgtcagtttttttttttttttggcatattgtcctaaattgaaacgtctcgaatacgtcttgttgcttattatttttaatctcactctttaaccgtcgatctggttaggtttactttggaatgcaggatatgaggtttactttgcaaaacaggataaataaaacataggaataggaaagttatagaaatataataggattgtatatgtatatataggattatcactaatctcagtactttatagcatgctaagccattgctaatggaccacgcaggaagtaaaaaattaagtagcaaaataactgagtgttgtttctgttcctagcatataggaaaataaaaagaaagaggtttgactggacggtttttttccccgtaattttcctttgagttcttcctatgtcccaaaggtaggaatagtgcctaaatcctttataatgtgaatactgagtttttccttaaaaaaactgcaatccaaagtaccctaattgtgtttctcattttccatctaatatttccatgttatatctactcactcttacacgaatgtatacaacatactaccgctaattacaaatggttctgttacactgtttttcccaaaaagatatacgagttctaaatgactttttaaaatttagaattgagttaaagggattaaattactccatccattccataatataaggcacaaccactttttttaaatgttccataatgcatgcaattaactatgacatattctccattaaattattccttttttaaatcatccactctcatgttatctaattttattggatacatgagagtatcatgcagatttttgagccaggggatcaacaccaaacaactcagatttttcagcagaaaaacaattacaaaaaaatatataaaaagaaaaaatagggatagcaagcctgccttttaccgagcccaaccacccgaggcccattaacagacccaaaaccaaacttttaccaagacccattaacaggcccaaatatcatctgagccacattgaacaaacaattttgctatatatttgtcgacaaattttctcccaaaaatttgacagatataattacagtacaatcgtagtgtaattacattgtaacttacatataattacactgtaactataatgtaacttgtatgtaactttcaaaaatctctttgtaacatgttatttcggtaaatgaaggtcatgggaacaaatcctttcagtaaaatggaggttatgggaacaaatcctttcacatatgtatgtgctgcgattttttttcttcctcaccagaacaaatcttgtaatagatctaatgattcaaaattacgtgaaacttatatacaagttacaatgtaattgcatacaagttacagtgtaattacactacgattatactataattaaatctattaaatttttaggagaaaatttgtcgacaaatgtatatgtggtcatgcaagcccaaagcacgcataccgaacttaaagaaggcctataagcgtgaacgaatctcaaataaatcaaacggtctaaaaaacgaatgattcagcgctcagaaatcattcgactgctgtatagtctttccgttattaggatgatctaaactacaagatcataataattattttttagtctttagattaagagtggttgtgtcttatattttggaatggagggagtcctatatttaaaatcggagatagcaattactccgaattccgaaagctcagtttgacatctccaggagctcatcagcaaaatcctggacatacgtaacgcacggaaaaaaattaaaaatacacctctttttcattggttttatataaatatacacgtttacgaagattttgcacaaatataccactgtcgtgaaatgaaagtgcgagatcgagctaattacttgatctcgtgcggcaggtgtgcgagaccgtctcgcgcgagaccgctccttcgcttccctaaccaccgtattcgcgtgagtaataaattaattagtgtcattagcagttaattaattaattaatatttatttaattaacatcattagtaattaattaatcgttaattatacgctaatcatgagccatgtcaggccatctcgcacgctgctcaagcgagatcgcttcttgtcttgccgtcacgccggtctcgcgtcctggtcttgcgagaccgtgcggtatcgcttaaccatcctggcctatcgtcacgctatcgttactttcgctgaataaatcagcgatattgtttcgcttttgcactttcaatcaacgacgatagtatatttgtataaacaaaattacatctcgaatattaatgagaaaaaaataaaaaacggtatattttcatatttaattccgtaacgcactgcctagcgagggttggccaagtttcgcttgggggagtagaattctaggtagacacagatatttccaaagcaaacgaaacgtgtcgccttccctccttcccaacggggagggttccgcacgcctcctctctctctcacacacacacacagccagccgggtcatagggcacgtggggcccacctgtcagctgccgatcgacaaggacgagtagatgatcttctgcgacgtgtacgtgagctcactggcgttcctgcttttattaacgccgaaagagacgacgacgactttttgtgcttttatttactaacccttgttgttgttgtttttttcagaaacgtcctccataaatcgtacagttgtttcgttggttgctgttatcgttactgacttcctgtgcgctgaaagataccttcggccaagcgggctaattgtagcgtgtgtagcttgggaataaagtagcagaattaatttttgaaataatattatttttgaaaaattgtaaaagtagaggttgatgttgaaacaacaatttagcaatagtaaaatggatagcgaacaagcaggaaagtggatgggttatgagacaaatgatttatacaagttcaggccttctcaataagaataagaagtaataacatatttctgtttgaggatttgattcacttattttggtattgatctaaagatctcaagtgtggttatgttcacaaggggccctgccttccttagatagtcggaggagataagattacaagatagagactttatcccttacagtctaaatccctataactactttacaatcgtaactgactaagactacatgatatttccttgatatgcaggttaatacaatatccgagtcttagcctatacatattctaatcatatgatatatcccctataatcagttggatagtctagccttgtgggtatatgatacccataatttccacagtagcccctgagaccttcacagtctgaaacaaaacccttctctcaaactacattatataacagccgaatgcttcaattcttcctcctgcaatctcccgagtgcttttatccctagtaggttgtgaagggctgaaaaataaaaattaggtgcatcgactagatacacctaattaggtgtagcccccgactatgagattagttgaataaactaaacatatagtcaaggataaaataaaataaccaaccgagtggtttataacaattatagtcatcaaaatgacttaatattatacaacacatattgtgtaaatccttgaataatataactcaagtgatatatcgactgctttttattaaaaaatattccaaacatatattcaacctaagccataaggttgattaataaaaatatgcacttacgtgacaataagcaatgatattgtatccaatcaattgctaatataacctaagcagtgtgttgacttataatcatataaaaaagtcagcaggacagttatgaaaaacttcattgctaggcaccttttaaaatacattgtatcaactcctaaaacattgtatatctgcggtatataaaaaaggattttaaggtattaggtacttgatcatgcgtatttttgtctaagaaaaaaacacctaagtctctaggagaatgtgacagaccacacctgaaattatgggtcgaaaacacttcaagggcctcggcccaaatgaacagtgttctccgatatcctaattataaaaaatttggtttttggtatttcaaccattcgcccttctctggtaggcttggttcttgtattcgatcctacacatcactcgtcttgataatatggtattcctagactctaaccaaagacttatttaaatttggattattttttgtcttttttaattttcaagatcaccaatcgtcattaatttcttcatggaactaatacactttcaatctttcgtacaaacattaaacacaatagatacgttttgttttatcatcaattcgccaaaacccacgggggatctaaatgcactttcaacacgtttattagtagggtttcaataatgccttgttggtacttttgcaatacataaactcaaataattgtttgttcaaaagcatagtaacaacaataatagaatgcctaaggctgtgttcgaactataaggaaggttggggatcttctagttcgtgcacataaaaatggagtagcttattaaagcacgattaatttaagtattactatcttcgtcctaaaataagtacagccgtgggtatccgtgtccaacatttgaccgttcgtcttatttgaaaaatttataaaaaaattaaaaaaatagtcacacataaagtactattcatgttttatcatctaataataataaaaatactaatcataaaaaaatttcaaataagacaaacggttaaacgttggacgtgaacagtgtaaaacattacttattttgggacggagggagtagttgtaaaaaacttaaaaaataaatcaatataatttttaaccaactttttatatagatttttttttcaaaaagattcgggaagcatgcatgcaaaagagagagagaaagcagaagtcgggttttatctttgatttgactgtgcttgcattttatttttctctcttaggatggctaggccttctctccattctatcataactatcctcccaatctcgacattacatcatctaaaaggagcactattttttccttaaactataatctgtgttaaataacctagaaagcaactactatactctatattataagatgtaagcatttttataatttttcacggaaattaaagaaataggtgaaattgaacggtggaatgttgtaattactccctcagtcttaatatgtagcaacctcggataggtcctatccgagcttgctacgtattgaaaatgagagggtaggggtgtaggtaagaagaattaggaggagaaactaaatgagatatggttgtgcttgtttgggatgagaaaaatgtagagaaatagttatatcttgggataaattcaaaactaaaaaaggatatattttggaacgatggagtagtactttaggagggaaggagtagtgtatttagcaaactaactacccctggtaattggcaggtgtacgttcgtgttcatatagaatagagatgagtgtgtgagctttgtgagcgcatatatttgtagtgctgtgttttaacaaaatatccacatccttctacttcaatataaccaatctatagaggaccattttgtaattaccacaacacccagaagtctaaacagatagagtactggaggagtagtactactgcaaatccccaccccaaaaaaataaaaaaaaaatctgctcttaacaactccctataaagctaccactacgcccccctaccgcggagaagcaaccaatccaattccgaacaagcaaggcaccaaatccccccaccatggatcaccgcctcctcctcctcggcctcctcctcctctccccggcggtggccgccgcctcagtccccggcgaggaggagccgctgatccggcaggtggtcggcggcggcgacgacaacgagctggagctgaacgcggagcgccacttcgccagcttcgtccagaggttcgggaagtcctaccgtgacgccgacgagcacgcgtaccggctctccgtgttcaaggccaacctccgccgcgcgcgccgccaccagctgctcgacccctccgcggagcacggcgtcaccaagttctccgacctcaccccggccgagttccgccgggcctacctcggcctccgcacgtcgcgccgcgccttcctgcgggggctcggcgggtccgcccacgaggcgcccgtcctccccaccgacggcctccccgacgacttcgactggagagaccacggcgccgtcggccccgtcaagaaccaggttcccctctcgtctcccgtcgatttttcccccaaaccaaggactcctcctttgatttctcgattgaatcagccgtcttatcgtttcttgattttttttaatttttttgcttttgcagggatcgtgcgggtcgtgctggtcgttcagcgcgtcgggggcgctagagggagcgaactacctggcgacgggcaagatggacgtgctctccgagcagcagatggtcgattgcgaccatgaggtgagaggcgtttgcttcccctttcttgtttttgcgtactggtatattattatccttttattaggagcaagttttatttgtaattttgtgattggtctgtgcttctatgggtgttataagagaggttggatgggtgctataagagaggttggatttttctggctttccgccaatgttttgtcagctgctgcgctgtccttttcctatctattttcttggtttgtgattgggcagcgcacccaaatgagaaggggaaagggaaattggggcaaatgaatgggaaagggaaatttgggaaaggagttgcatgattccttggctaactttgaaagggaaattatgaggaaaaaagagtggcttgtggtattatcagtgcttaagaagtcaaaccaaagtggtgaacttagcaagcaaatttgtcgtggtcgattttatagtggtgaagtaggtgaataaaacaaaagatgatgaatgcaaggctgagtggataaaatctccaattgatactggcacatgtcgctctggaagatcggtctaggtaggcgtctctctgggtctaccgcaggtggataaaactaagatgagatctaggtaagcgtctctctgggagttcatggtgaccttgtgcattgataggtctatgaaataagagagttcatgcacccttgtgtgttggtacgtgcctatggtatggtaacgaacaagcgtatacaattgggcacaaagggttgtttgagtgggcacttaatgaactgaaaagtgctgaacttgggaaccctatgattagttaaattttagagaaagggagttaagaaagtacccgatgttctggggttgtcatgtattccagcaattttagtttttaggtactagtgaagctaccatgaagaagttgtaaattactcaaatctcaaccattaagttcacttgagtgaaaaatataaatggagtcgatatcggccgcaggttgtttctgtcattgcttcatttcttattttactgtctcacttgatggatagacagccaaacgtttgtgtgcactggcttgatgtactctttcgttttggtaactgggccccaggtgagaccccatcttggtgatattgttgtacaactgaataactactgtaccttttatatcattatatcggttaagaaaaaaataatcaaatttcctcttttcttttggatgtgtcatcatattttaggggcaaatttccggtttcctctttcatttggttgtgtccatcatattttaggggcttgctcttgacctatttctttccatatttacttcttgaagcttcactcctaaatcctaattaatgaaaaagttagtgcttctctgttctgttcaaaaataaaacaaatcttatttccataataacacaattcactaaaccatccttacaaagtctgcaccaccgttttaatttccgcctatagcatgggtgattctcttcctagttgaaaattctatgtaggattttttggtagtaagatgtaagtggctctcattctagaaggcttttcattactaagcttctacattaggaaatgcgagaaatatttgttcagaaaaaacaattttctcatatatttaaaagataatcaacagtgattcctatggtaattttacaaagtagcaccaggctaatgtcttgcacaacctctacaatttgtcgtaaccagcttaagtgattttcacattgctttcatcgcaaagtacacatgtaaagcttacccgagtcgtgctcaaataatttttagccttcctggtattataatactttttttgacttgacagtgggatatgtactgttgttatttgttttctactgttacctgtttcaactgaatggggtatctcaacttactgggcttcattgttatctaattttgcagtgtgattcatcagaacctgattcatgtgatgctggatgcaatggtggattgatgactaacgccttcagctatcttttgaaatccggtggccttgagagtgagaaggattacccctacactgggagggatggcacctgcaaatttgacaagtcgaagattgttacttcagttcagaacttcagtgttgtctctgtcgatgaggatcagattgctgccaaccttgtcaaacatgggccacttgcaagtaagtactataaccatctctcggaatgatgcatttgcaggtctgactgttatatgtaaatacatgaatatattgtgcaattgctgatgaatgacttcacattttcctgcagttggcatcaatgctgcgtacatgcaaacatacattggtggtgtttcgtgcccgtacatctgtggcaggcaccttgatcacggtgttcttctcgttggctacggcgcatctggttttgctccaatccgcctaaaggataaggcctactggatcatcaagaactcctggggcgagaactggggagagcatgggtactacaagatctgcaggggctccaacgtccgcaacaaatgtggcgtggattctatggtctccaccgtgtctgccatccacacctcaaaggagtagattctgatcagtagtcccccgaccatcctgtggatggttcacagttggtgattctgatattatatataagctagaactacgaaatatacttagtttatgctccatctgcgctgttattgcagttatgataagcagcgatgatgtgaagctgcaactgaatgtttgtcctaagttatatgcttggtttgctacgcaatgctacacgctatttggaggtagctttaagtattatcgccattcacgaacttgtatttttactattaccaatcttttgaatggtctgtattatatgcatgtggtctgtttacatggaataactctgtctattgctacgaatttgcgtcttgcacattctccattttaagggactctggtattgatatttcagtatttgaatctgtacaagctgcaagatggttgggttattaccatacgagttataactacttatgcttaacaaattatggacgatagcaaaatcttggtataatccctcgagtggaactttctctctttaaatttaatgtaaatggttgtaaaaaatatttagcaatatagcgtatagtaacatctaccactgtaccaaaagtcattcaaaatgaatgttgttaatttttttagaacttttagcaactatttagatagcgtttgaataaatgaggggatatctcctcgagagtttaaaatactttctcattgtccgtggcattctcatgttagtaagactacaatctctacttatatgatcatatcaacacattttattcatattatggaaattgcaagatttgccattcatccattgggtaggggaggcgggaagagaggggaggaagagagatgacaaggactctgtggctatggtagcgatggtacaaagttgtttctcttccctagcaagaaggggcatgtagcttagtggttgtagtagccttagtagcatcccaggtcctgagttcaaagctctattagtggcgaatctaagaagaaaatagagggggtgttttattcgaatgagagtttcaggcgagtagtcgtctagcttatcacgtcagtggcgaatccaagaagaaaatagagggggtgctttgttcgaatgagagtttcgggcgagtagtcgtctagcttatcagacaagctattgacgtatgattacttaagcgctgactattataaactttaaaatttgatttatttgaattttgatgaaatttctttataagatcttttttcaaaattaagaaagtctagtggtttgacaagcacgcccacaaaaagtaccttaaaaaaactctaaatcccaaacaacagggcctaaagctagtaaactatactaccccatccaaaaaagactatcctaacaacgaatctggacacacatgtatccagattcgtacttaaaattggtttttttatgggacggagggatacacgccaatctattgtcaatcaaatttctgatttgtacgagaaagaactcaaaataaagaataaaaatatactaggtatgatagctatagttggctgtaaatatatatatgaaaaacggttcgatgttcttttttcattttttttatttggttgcacttataataaaggaaccagttagataaatatatatgaccaaaggcaggtagtactgcttccctagctagccagctactagtttgtttcttgctgtgatgacttcactagagcacgtactggatgtatgtggatagatacttgttacatatgggctatggccggccggagctggggctggagccctaaccagccccaacgatgaatccgccgctgagccccgtgggagcgaattttaggctaggtaaaaaaggtcactcgctagggaccaactagtgatgatgagcattattggtgacgacttgacagattagggtttagggttgggttgagggtggtaggaggggttaaggggaggtggccagccaacaataggctgtggatagtggacaagggtgcgtgacaaggtggcgatgaaggtagagtttgtgtgatttggtaggacaggtctcatcagcaacaacaaagcaggaggggggggggggggcgacccatgtggaatcggttagggaaagagcgagaagggaggttgaaggcatccagtaggatcagggacaaccctaggctccgagcaccctgggccatgatccagggcctaggattaagaggcaatgggccaagataaattttcaccacattgggccaaccttgtgaaaatccagtataggtcataccgaagggggggggggattaagggtaatgttgtcgacacacgaaggatgagggagtgcatgtatcgtggagaaggatacaaggggaagataaggcttctatttaagcataacgaatcttggcgtgagctagaccattcaaaatgactaaactttgcaggtaattgaggtgaccgaggaagatggaatatgttgttgggtgcaatgtactagctgtagaaagggtgaaagagctgcccctagtggattttggtttattgatgacaaacgattaagggactaatgcacttattgagtgtataagcaagtgattagtccgatgaagaagctaggaaatggacttatcgatggatgagaattaaagagaagatattgaagatgcgggtatgaagtgactacctatggcaagatggtgaagcgcaagcgacgctcagctgcgatggaccatgcagtggtgaagggcaagcaaggggcttggcgccgatgaaccgaaaccggtggtgaagggcgagtgaagactgtgtcgtgatgaaccgtgcgaggccatttgaagccatagattatccacatcaatcatttgagaaatagaagatgaaatgccaaagatcaagaagatgagatcttcccgatgatcaaatgaccttgacgttggtaaccctccaagtgaagaaacaatatggtgtgaaggtactcctattggtataactttgctttttaaatttgagtttaggatgccgtactattaagagggatactacatgcatataattggttgaatactagtgctcaaaatgcttcatctttgtgtgagttgaaaaacctaagccaaaatttcaatcccgagttgtttcacttgtcacaacacttacatcgggtttctttgcaagtttttcataatctcttgaaggttttggaccatgttttatgttgggtttgatagcccacgaaactagctttccataaagtccaagatcttcgaaatcggagttcagagtaaaaagttattgcatttttacttgagcaacatcagactatccgatttgaaatcggactatccgatgtatcggactatccgatttttcacagaacttcactctctgcctttgtttgaaaaatcctttcgagtgagtttttctaagtgtcggagtatccgatgttggatcagatagtccaatgatacagagactccgaaatttcatggaacttgagtctctgttggaggatgaagtttttgcttctaaaatatcggatactccgatttaacattagattgtccgatgtctcggaaagtccgaaatttcatggaacttcattctctgtttcttgttgccttggaggtttaaaatatcggactatccgatcttgtatcggactatccaacgtgggctgaaagattcccctccaacggtcacattttggggggatctatataaatcccccaccaacccttttctagggttgcctaaactgatttcattccaatcttgctttgggttgagctttgtgctaagtgctttggatctttgagctctctccctctctatctcaaatcccccttgttctttgtgacttggatctttgtgtgtggatttggactttgggagcctagtgtgtgtttcttttgatcttgagcactaggatttgtccaagagttgtgtggtgtttattactcttggaggttgaggactcctagacggctaggtgtcgttcttgggccaccgatctacgtggggttggccaagagaagtttgtgaaggtcggatctcgcctccgcaaggaaagagatacccttagtggaaggaggagtgcatttgtgcaacctcacgaggatagggttgaaaaagacccggctctttgcgagcccctcaacgaagactagaatcccctcaaggatttgaactccgggaaatacatcggcgcataaatctcggtgatatcctcactctctttaccttcttgttccattgctttgtgctatgctaatattatttttggtcgagctcacctctttgcttgtggattgaatctagatctcttaggttgttctcttatttgtattgttgttgtgcagttcagatagtctgatctcagttcagactatctgatcacataggactatccgacctgatatcggacaatccgaccctgttttgttttagcttccgcctttatttttaaaaccgcctattcaccccccctctaggcgacatcaaggtcctttcaaaggggttggagcatccgccgctaatgcgtggcggcagacatcgaggtggcagtgatactgctgttgtggcggcgccactgccccgcccttgttggctagtcttactgcgtcttagatccactgcttcctcttccttccactcacccctactagagcaggccaccgaatttgcccgcgtgagcaagaccttaacgagcaccaaggaggcggaagatgagggagttgagccacctttgatttttcccatatccgtgtcgagtacgccgtggatggggacactgttgagctcggtgcctcggtgggtgcccttcctctcttcctcatctcaccgcggtttgagcttcttcccctcgatgcttgagttctcccccctcatcgcctcagcctcccggatccttcctcttcgccccagccttagccggctccacgagctttgcccttcccttcacccgtctggcagtcgagtgtgtatcactggaggagaggagatcgacatctgcaccatcacactactgagtgctgacttgctaatggcggcttcattggtagagaggagaacgggttcgtggagaaccgttgcgtggatgcatggaggctcacaacaatgtctcggattctgccgtggcgtcatccaccgccacctgcctcctttgcattaccgctcgctgacatcttgccctcgctctattgccctttggtaggagatacggagaaaaaaagggaaagagagagagagagagagaggaggaggaggaggaggaggaggaggaggagggaagtagagagaggatgacacgtgggtcctactaatttttttgggttaatgggatctatgccattgcaaatttgcctattcagaaaaataccattataattcgtctattcatagttgtgccattgaaattttagaaaatttgaaccgtgacactgctgtcatgttttccatccaactccttcctttttccatcttcttccttccatagggaggggcaaaggccggagcatgcgccatcattgtagaagagctcaacgctggtggctgcggcgagggagtcgccgttgccggcggcaatggcagcgggggagcagtgcaagacaatgacagagttgaacggcaagcggtcgccggccaccgccaccgtcacgacaacccggcatgtgggtctcaggtcgttggtgatggcaggccgagtgcggcggggttacgtgccagccagtccttgagaaggccaccgccgtcgttggcagcggcgaggagggatgaggtttcttctccttattgctgggtggcagggccaacagtagtgcgtcgttggcgtgtaggggcgatgggggaggaccatcctgcagcggcgtatgtccccccaccaggcacgacgtaggcaagccaagccggcaggctggactgatgatacctcgccaagtcgccatgtgggtcccacatgttgacttagcgagttaacaacggtcaactaccatattagtaaaccactttccaaaccaccaaagatttgcactggttttcgaagattgggaaagcattagggcatgtacaatggtgtctaataacgggctctcttcgttgtcatgcaggtaaatttggtgacgtggaagaaagagagggaaggaaggagaaacatcattgttatgcatgacagcggctcagagtcaactcttagcgtttattaacggaaagtttgttgcatgagggtggagaaaaggaaagaagtataataaaaaaatatttagtgtattaatggtttagaaatcttattgtctctactattgtagaaggatagtctctaatgtcattaattaatatagagagctcatattagactctacctttgtatatgcccttatacccggttttgtggtcgagggagaaaattcagtaaggagcaagagttgagggttgcaaataaacttattccatatatggtaggtgttctgggccttaagcgattatgcccaacccatgtgaggcccagtcctccaggcaccttgacacaggctattattttctgcgaatattagcaagtagcaaccatacgatcgtcaattccactactagaaaactcattttcggcgtcgtaggggatcgattttcacaagcgggcatgtaattcggtgccaaaacccggccggaaaaaaagtacccggggtggagggggcagtccgcctgcaaagatcaatcctcgcaggcgccgcttatatggcccgcctgaaaagatgcccctatatagtcttcttcctccccgagccctgttcattctccccgaagtttctctctcctaaagtgacttaaatataggggggggggaggttttgaacttcaaatctttgagggatttttctacggtgcttagatctactcatttccacactaggtatgcaattttttaagcttttagaccttaatttgtgatggatttatgcatgcaaaattgtgaaggaagagctccatgttttttaattttatttcttttgatatgttgatgttagatgtatgtgtaatacttgatgcctcttgttgtagtggtttaatgtggtaacataaattctcaattttttttatttttgctatcacatccacctcctacttctagatctagatctagatcttgtcatatatatagagagaataaaatttttaatgtctatttattcggtgcaataaaaaaaagttatagtattttgtaatatgccgatgatatgattttgttagattttcctaatgtactaatttggcatgtctgtgtaaaaaaaattgaaataaactttgattttttattaatttacacttaacttttagttaattagttttgaatagcgataagttttttcaataaaccctacaaatttggtattaattgtgcaaatattttatgtgtattttttttagagatatggaaagtcgggaatggatgtatcattggccgaggtttttgtctccatatagaaacgaagtgtctaaatttattggtattgccaaggcacacgctgagaagaacaatatgaggaagataatttgtccatgtgctgactgtaagaatgaaatagcctgggacttcgacgatgcttttaaagtgaaggagcacttagtaactcgtagatttatggacaagtatgaaatatggacacgtcatggcgaagaacaagtggacgggcctgaaattaatgtagttccgacacaagttgaagacatggtgcatgacaatggttctgttgaggacaaaatcgacctagaggaaatgttatgtcatgcagaacccgaggtgctgatggggtcggctagagggttaaataactttgaagctttacagaaggcagcaaaggaagttttgtacgatgagtcgaagggctgtgacagtgagttcacaacactctggtcagttcttgaacttatgaggttaaaggcgagacatggatggtctgataccagtttcgacagtttgttagaacttctgcagaaaatgctcccgaggcctaactcactaccatccagcacatatcaagcaaagaaactcatatgccctctttcacttggtgtggaaaagattcatgcgtgtgtaaatcactgcatactgtacaggaaagagtacgcttctttagatgaatgtccaacatgcggtgctagccggtacaaatcgaatagcaatactggcctagaaccgtctgacacaactgagggacgacagagaaaaatcccacagcttgtgatgtggtaccttcctgtcaaagaccgcattaaacggatatactcaaacccgcgagatgcggaactagtgtgctggcatgaagaagggcgcaagaaggatgggatgattcgacacccggcagatgctcgtcagtggataaactttgatgctcagtacagagagtttgctaaagacccatggaacattagatttgccctgagtactgatagagttaatccttttggagacatgagcagctcacatagtacttggccagtgcttctcaccatgtataatcttcctacctggctttgtcaaaagcgaaaatacgtactactctgtatcctcatacagggaccccgttagcctggtattgatattgacgtatttcttgaaccattgttggaagatatggctgatttatggaaagagtgattgaaagtgtgggacgagtacttaagggaatacttcacagtgaaggccatcatcttcgtgaccattaacgattatccagcaatgtttttagtttcaggtcaaattaaaggtaaaacaggatgtgtgatctgcttgaatggaacgtactatatgtatctcccgggttccaacaagcttgtgtacatgcggcaccagcggttcctatgcacaaatcacaagtaccgcaagatgaaggcggagttcgatggcactgaagagacagatcctgcacccaaaccaacctcgggagaaaaggtgtgtgcaatgacagagaaaattgtttgcgagtttggaaaagtgactaagaaaccatcgaaggggacaaagcgcaagaaactcgagaagaatacgaaacaaggggatagtaaaaagcaagatgatagttcgaagccagatgataaactccctcccccattcaagaagcattccatattttttaagtacctcccgtactggaaagatctggaggttcgacatgccatagacgtcatgcatctagagaagaatgtgtttgacaacatagttggaacattgttggacatgccgaacaagactaaagatggtttgcaattaaggatggacctagtcgagatgggaatcagggaagagttacaccctcaagaaggagaaaaaaaatggcaaagtatatcttccaccagcctgtttcacactgacacctgaggagaagaagtcattttgcaactcactccatgatgtcaaagtgcccataggtttctcatcaaacatcagtcgactagtttcaatgaaagatttgtcggtatctggttataattcacacgattgtcatgtcttgctcaccgtgtttcttgcaattgcaataagggccataaaaccggagcatttaaaggttgctatcacaaggttgtgctactttttcaacgcagtgtcacagaaggtcattagtctcgaagagttaggaaatctccgtacattcgcacaggagacacagtgccaacttgagatgtgtttccctccgtcattttttgatatgatagagcacctcattgttcacatagtgccgcagatggttgcgcttggcccattgtacctccatcaaatgtggtcatacgagcgttacatggcggttttgaagggttacgtctgaaatcgtgcacatccagagggatcaatggttgagggttatagtactgaagaggttgtcgagtgctgtatcgattacctcaaagatggatatgcaattggagtacctgtgccccgacacgagggcagattgagtggcaggggaacgataggaaagaagagattcgtcacccatgatcacaaatcattccaagaagctcacttcagcgtgcttcatcagtttgctatcgttgagccgtacatcgatcaacatatcgaactaatacaccaccgagtggataatgaaagaacacaagcgtctcttcgtagattggttgcgagacctagacttacctgagggacaaactaccgataaaataactatgaagcggttggcttgtggtccatcaactacagtaaattcttggcagggatatgacattaatggatactcgtttagtacaagagcccgagataataagacctatacgcaaaacagcggtgtccgtgtggaggcaattgatgaagccggggaaaaacaatcatacttcgggtttattgaagaaatatgggaaatcgactatgggcacacaatgcaattccccatatttaagtgctagtgggtaaaatacccgaacgggatcaatgttgataagttcggtcttaatgttgttgacctggcgagtgtgggtcacaaggatgacccttgggtactcgcaatcgcgtggcacaagtgttttacgtgaaagacccatcaaatttgaagaaagatatagtgctacccgggaaacaaaagatattgggagtggatggggttgaagatgtcgaagattacaatcaatacgatagtataccactttatagtcagtttgtacagaagattaagaatgtcgagacatctactcagaagatcgtgaagcctcacatgcacacggacggtgtgggaaaaaatgttaaagggtaatgattgttgagtcgcatttaagcatctaagaagttagtagttatataattaaatttttagaattgatagtgtgctcaaaattttttaattaattacacattagtaatacactaaatattaaatttgagtggggtcctaggaccccactccacatactgtggatccgcccctgcaacccgacatgtgggtcgcaggtcgttggcaatggcgggccgagtgcggcggggttaagtgccagccagtccttgagaaggccaccgtagttgttggcagcggcgaggagggatgaggtttcttctccccgttgctgggtggtagggccaacagcagtgcgtcgtcggcgtgtaggggcgatgggggaggaccatcctacagcggcgtatgtccccccgctaggcacgacgcaggcaagccaagccggcaggctggactgatgatacctcgccagtcaccatgtgggtcccacatgttgacttagtgagtcaacaacggtcaactaccatattagtagaaaccattttccaaaccaccgaagatttgcactggttttcgaagattggaaaagcattatacccggttttgtggttgagggagaaaattcagtaaggagcaagaattgagggttgcaaataaacttactccatatatggtaggtgttctgggccttaagcgattatgcccaacccatgcgaggccaggcaccttgacacatgctattattttctgcgaatattagcaagtagcaaccattcggtcgtcaattcgtcattcctgcagttttctgaatcaactcctcattcgttttgtctaaagaaaacaaaaaagaaaggtaccaatagttggcctacctcgaatcaccaagagccacaagtgtcaatttacctgaaatgatggtgaaccaagcaatcgttgaaaattgcaatacatagatatagagcagccaaaaaacttggcctttcgttttcacatcttaaattttcttgcacataagtggcactttgccaaccatatatatataatatcacataactttatcaaccatatatacggtatcacatggttccgttttctttgtataaatgtgcatgcgaggatcatatgtgcgtgtatggcgaccttcccaccatattcatcaataactttgccttgcctttcctgatttcaattcaacgccacgcaaatcaccttcatttctactcatctggttatcaaatacatgtcgaattggtacgtgagcttttcaaatttcacttctacttggttacattaaaaaaacattagagtatttttgttatgaaaattcctttatactatgatttgttatacaaataaatgtacaatggagacacgaattttaagcggaaaaccctttgcgggaaaaaaccacaaacgccgaccattaatgatcactattgaggagttggatacaaacgcaaggaatacattgggttgtcgcaccctcgccgtgcggatctaggagttctagtgggcaagacttaagactcacgctaggaaactaatcctaatagtcaagttctatttgaaaacttatctgaatatattacatgcctaaaattcggatcacatatttaacatgattaattatatttttacactatatactaacgacgatgcctcttaaactaatctacataaaatgcagatccatgtccgttccatgcgtgctggtgcgatatgggggccaaatcagctgtaatactaacagttcttctagcccatatattagtgatcttaaatgtctctcagtattacagagaatttatatcctatcacacgacatcaataaaccacactataaatcttgcaaatcacccctttgaacttcatggtaaaaagaaattcaaatctaaatggatagccacatataaaaccaattaaggtgaatatttcctatataaaaagatggtaacacatttaatagaaaatatatatttttatttattttaaataatattattttttattcgtagtaactagtaaagaatggagattgagctagttttctataaaattattgttgcctatggttgtgtacagggatgaaactggtacggatacttttggtacgtccgaacgttttttcgaaatcggataggtttgttcggatagtttcggatatttttggattcagaaacaaattcggattttttttctccgtaacataaacgaatacagtaagggaaatatccgtcggaattgcaaaacggttatccgtgaatatttttcgaatatccacaaacaaggatcaaatttcagaacaaacatgtacatatacataacttttccatacgaagtcagatgaagacaaactttatatcaaaattgtagagctcaacgagatatacaactttattgttaactattttattatctgagatcatttaagggtctaaatattcattataaaatatcatatctatttttacaaaatctcatatctgtaattcaaacgatatcctatagagacgtgttccatatcaaagttgtagagctcaatggaatctaccactttgtagtttataacatttgtatttgaaaatatttaaactataaaacaaacattacaagtttcgaagatgtgaaataaaataaatagcatcttcaatttataaaacaagaccttgataagtgatatggtaagtaagctatacatgaagtaaaaggtatttggactggaaagtgaataaccatattacatgttggtctttttggggaacggttatgaaaatcgattttcacatacggttatgagaccgcctacaaaattaacgatagacatttaaatatgttgacctaaaataacaagcgatatctcttcattgattaaggaagctcaatttgaggagtttttatatcccggcaaatattcgttaccgtatttgtttcgtttcgtatcgctccgtatttgtatttgataatattcaatttaatttccatatccgggtttttgattccgattacgattccggaaataaaaaaatatgaaaatgaatatattaaagctagtttccgatccgttttcatccctagttgtgtacatttaccatgtgcttgtgtttggtgcttccttcatttaaaaatcagtgaaaccctcacacaaacaaacaaaaatgcattgatagatgattttgtgtcaatgctacaaaatatgctccatggtcctatgattaattccactatatttaaatcagggtgatgtcgttatacatgattccctgcatgttctaattcaaggtgagtactaaatgtggtgcattcacacattttaaggagtaattaattgttacattgttgggaggagcagtagttgagagtataataggaaaaaattgaatgaaaggtgataaatggtactccctctgtactcgtaaaggaaggaagtcgttttggacagcgacacaatctccaaaacacaactttgacttcttgtttctataaaaacatttattgaaaactgatatatgtatacttttatgaaagcatttttcaagacaaatctatttatataatttttatattttcaaactcaacaacttgagagttattcatgatttatattcccaaggcttaacttaaacattgtcctaaacgactttctttacaagtaaggagggagtacaagtagtatattagagtgacaagtattttgggacaaatttcaaattctagaaagataactattttaagacggagatagtactctatacttttattttttttaaataaaaactccaatgaaggtgacagtctgccaccccatctacttatattgtagttttacatattatctattgaaattcttaatattacataacacttaaatttaaatggatatatagttacaaataaaattaaactaaagtaactatttattcatttcagttaatatcatggttttttttcttttagctgtagcaattaactgagtaatatgtaacagctatatccatgccaaatgcaaaacggtgacattttgtacataaaaaagacccattagaaaaggaaccgccatccctcatttctggggaataattaattatttgtcacttttacgagtagtgataaaggatttgccactaaacctatatgttacagatagatgagattctacatatcatagataatgagtggtaaataattaattgccacatattaaaagtggcaaaaagttaaattttcctttttcttgaggttcacatctgagccgtccatctgtcaccccagctaagcgaacacaaccttgttttgttgtgttgtgcaactcagttcaaaacaatccaaaaaagctttattggaggtgtttgggggaagagaccactataatgccacgtcactaaatcccatccaacatcaacggcatttgtgtaagtacgtttagcaaattaagatcatctcatctctatccatgtattcattaacactgatgctacatctcaactcctttgatatccctattgttagataaccaattaatcaattttaatgcaataacaaaaccttccgactaacgtttcgcgtatggataataacgatgacaatattatatccaacgtcaacaccagactatatcaatgacttactattatattaataaacacaccatcgtacaccatattttactggctatcatttaccactgcggctaccggtcaccctaaatatatattcgtatgccatatgctagtctctctcggttatttattatttcggagagagttggtaccaatttttatgtagagatctatttatttttccgagagagtttgacaccccccaatttctctctggagatagataatcccacccttctatatccatctatatctatctattactatctatatcttctttatatttgacggtaacacatatggctgtgcgtggctccaccattggaaagaataaatacagcaagctaaccttgggggtttataattataacgcttccttggcccccttcgtctccatcttcttttttttttttctctctcccttctctctctctacaaatctggggctcccagtatagcttaggttgatttaattatggttaacctctcacagtaatccgggtgagaggtgggaagccaaagtgggagaagcaaaaatattctcagggcaggtaaggtaagcgaaggcgagaagagaagagacgagaagagaagagagagaaggtaaactagtctctcttgtacatggtggcttcccttcccttcccttctcttcccatctctctctcctctggttttctcctaccttttcttttgggggaaaaaataatattaattaaggcgcgcgtgcgcggcggcgcggcggcggcggcggcggcggtggaggaggattcagggtggtggtggtggtgatgatgggtttcttctcgtcgtggggtgtgcgcaggggggatgagcgcggcggcggaggaggcggctgcggcggcggcggcggaggaggtggagggggtggaggcggggaagaagggcgtggcggatgcgaaggggaaggggaaggagaaggtggtggtggcggaggaggattctgcggtggcggcgggctccgggggaagcggaggcgggaggaggacgttggtggcgtacccggcgcgggttgcggggtacaaggacgtggtggcggacgcggcggtcttcaggagggcgctcgaggggttgcacgcccagatggggacaaagctcaagtaagggatcccctctctctctctctctcacacacacacacacacacacgcaccaatctgtatctggcatcgccgatccttgcaccatgcagctgccttacgatatagcatttgatgccgttgcgcgcttagaacagttgctgtttgttttgtttctttcaatgcgcaagaattgcaacttgggagataaagtttggggagaaagagaagttttggggagagatagcgaacctaataataatggacgatgcaaatacaggcatttatatatttatatttatttatttggaatccggatacgtccggttttgactaatcaaccccatataaatgttaccctcgaaattatgtggcctatatctgccattgagtcaccgaatttatggatcgaccacatttctggtttcttatctttttgttttccccttcgtttgtgcaaattttgtccacagattgtgatagttggcttgggcctttgttgctgttgctttgcgtagttatccttgttttatgcctcgttcaatggtcaattacttatatgttgttaatgctgaggagcagccctagttgatgatgttatgttcaacacttatgttattgctcatttgtagtttgtagttgccttagaccctagtctaattgagtgtgtgagcctgtcccttgcaaatcaatgtacttgctatagctgtattatatggagagaatgacaggtatgtttgtcaatgttgcttgaatcactactgttaatattatatataagtttaagttgatgaatgatttgcattgcaacatgtttgtgtactgtggtaattagttgatctactctaccaagttatcattgagcatgcttcattttggtgcatttctaacatcatttttgttttcagggtgccaattattggtggaaaagaccttgatcttcatcagctgtttaaggaggtcacttcacgaggtggcattgataaggtgggaattcaataaaatcattcatatttcaattgtcaaatgttccttaagaaagtcttttagccagcgacagtcatgtaagactggccatatatagtaaagcaaatttttattatgcttagaagtttgccaaagaaaagcaaactaaaggcatggcacttgaaatttttgttgttttcatgatcttattattagttgttacctgtcagaatagcaggcaaataactgaaatttatttcacaggtgaagtccgataatagatggagggaagtaacagcatcatttattttccctgctactgcgacaaatgcttcttttatgttgaagaaatactacatgtcactattataccattttgagaggctatacttgtttgaggcacaaggctggtatcaagaaactggtcagtgggatttatagaaattcagtcttctagtttgtctgttgctgtattactagctcataccattttgtttcagcagattccagaagcatttcctgtatagaaatgaaagctgaaggtcaagcttcccggaaaaggaaaagaggaagcaattcttgttcttcaggtcagtttcagttcacttatcttctgtagcagtttgttttgtttaggacttcttctgtggcaggctagcagctcattacaagagaaggaaagattgtaaatgttactcaaaagtttaagtaatagtatgattgtgttaagtgttgtaactgtcaacttacaagatgtcgtaacatttcttcagtcgaagcttgtgagtttgcagcattttgtacattttggcccttgtattcttattctacaaatagaccctccaattaacttagagtggaccctttgttcaacaccattgatgaaggtgccgaggtacaacatcttggcgccaaccatacacttcggttctgagaaaggccaagctggcatgaagtccacatggtccgcgcagaaggtgttggcgctaatgtaatatccaggatgacaagctaacagttttaattaaacaatcgtagaaaaattgtgtggtgataagatgtcccccgtgccatgtcggcgagccgagtttgatccttggctggtctaacttgttttattttcttttttagtggccaaaaggtaccatatatattttttaaaagcaaacattcctcgagtcatgtatgcacgcatacagctgaccattaaaataagagaaataaaagggaaaaactcacagcttgaacactcgaacccaggatgtcgaggaaatcatgaggccatcaaaccactagaccacttatcagcttgttacctattgtaccccacaagccttttaagcttcctatatggtcagcgccaagaggtttgctactggccaactgctcacgtgtacttcatgccagcgtagcaaagttctcagcggcaacagttttttattattttcttttttttagtgaccaacaagcactcctcgattcatgtctgtatatgtagagctgaccattaaaaagagaaaaagagagggggggagggggggttaaggttgaacactcgaacccaggacgttgaggaaagcatgaggccgccaaaccactacaccacttatcagcttgttgcctattatatcccacatttaagcttcatatgtgatcagcgccaagagctttggtgatgaccacctgctcacgtgttcttcgtgcagctcgccaaagttctcagcgccaatgtgtatggcgcttagatattgtaccttggcaccttcatgatggtgttgagcaaagggtccattctcgaaataagtttattggagggtctatttgcatgtatatcaatatataagcccatttataaattcagtaaaaagcgagcatgttctataatggtgctaagataaatggagaacatttataggaagcattattgctgttctcaagcatattctatacggtgttaaactaaatggaaaacatttttatggaaattataattggtgttctttttatacatttaggtaaagttgtttaaatttatatgactaacagttagttcctttgactttgtcagacctagctgcttctttggataatgatgtacaagtgataattgatggtaagtttgaacatggctacatagttaccgttatcatgggctcaaaatcaacgaaagcggtactctataattgcaccgaagaacctgcagtgccaactgcggtgcctcatgttgcaattgacagcgctgagggcatacgtcctcgccgccgccgccgtaggaagaagttaagtacaacagaccccaaccatcctaaaccaaacaggagcggctacaatttcttcttccaagatcagcacaggaagctcaagccagaatatcctggacaagacaggcttatcagcaagatgattggtgaacgatggaacaatttaggccctgaagataaagcagtaagagtagacacggtcttttgaatttcattacttcaaattgataaagtaatcatgcaatatatgtgctttgtaacacttatacatattgtaggtatatcaagaaaaaggtgtagaggacaaggcaaggtaccagagacagttagctctttacagagaacagagaacaggccagccaatcagcaacgcggtgcctatccagcagagacttcctcagaaagaagtgacgattgatgaggtggactctaaagtcagtgaaggtgatatcctgctgtccaaccaaggatacagcagcagtaccagtagcagtgatgaaaccgctgattcgggagaaaaaaatgtggaagatgatgaagagtttaacacagagacatctcctgagccgagcatggaaacaacagattctcatggacagcctgatccttctgctgatggggagcgctttgaactgcgccgcagggagaaccctaagattgatgagaaacgtgacatgccacctaattaacgcttgtgccgagttgaagggaaaatttctgaaggatttttgttgtaggatcagattgctgttttgtttcactttacctttgcatcgtctctagagactgatgcgctatgctagcgcattgaatatcttctttttttatactgttagcaatttgaattgctctttcttaggtgaagtgatcacgggtcacttccgggcatccttgatgtccgataaattagagaaatgatattattttattattcactgtcgtcataggagtactgagtacaccagtttgttgctcacattagaacccattacaactgtaaagactggagtaatatttttaatagttggtagaattggttatatggcatcgaaagttggttatacatgtgaatgacaattctttgatggcggttttgatgacagccactgtcatcccatgataatgacacgtgtgacctattaagtcgatgatatgcgcctaggatggcaatgtctggtctaaagagtggtaaatcatcaaatcccaaagttagttatatgtaattgaacatgagagctatttaaccaagttgagaaacctattactgctgtccaacctaatactaatttatgatgtagtctcattggtatcggttagttgatagttgattataaatcgtaatgcttattagcgtgtaaaaactaatttgtaaataaatttttatatatgttcttaaggtacttaaattccaatgttgaaaaataaatcatgatgaaaaaaccattaatactaactctaaaattaagttttaaaatttaaaatttagttacggttgataagctaaagagcaaacaaaattaaagcggtacagcccgagacataagcaagcaaaacccactcctgcctgtcgaattccttttagacttgatcatatttcttggctgtataaacttacattaggttgcatatggctaaaaattaagtagacattattctgtgtatatatgatttctagaagccagctgttacaaaattaagtttatttaccagggttcgagtttcttgatgtggatcgggggaatttgaaggccacatcaggattaaccgaacaggctcttattgtttctcattaactgatgaggtcgttggcacaccttgatcttactaccggctggttaatgaactgctaccaagtgaaagttgagattgatactgagtgctccattgtcatacccatgaccatgacaagttcatacacaaaaaatctgcacaataaagtagaaacaagtaaaaacaaatccagaattatgcgtcgtagcttaataaacattgactgctggatattatgagaagataaaaaggaatgtgcatttgatttattgatacttcagcaaagagttagagcaaagcgcgcgcacacaccagagcacagcgtacaggtggcactggcaacataattctagatagcattaaaaatgtaaatgaactgggagtgagcaagtattggagaaacacctcttttttcagatatttaggtgtattggctcaaaaggtcccatgtttcttaccaagggaaataacaatactacatattttccgttcctgcatgcaatagtcaatactcaatagacacagttacaccatttatctttatctaacaaaggcgttaattataacagcaaaaccgagtcattatttattggaataaactgtgtcccgtactcaaatacttagagcaaaagagtgagccaaaatgctacacgttatattctgagttgaatcaatgctaaaaaactaagataagcaagaaaaagcggtgattgttctgcaacagtatcggacaacatatacctctggatttttctccaaacttgtaatgagaagttgataacattcattgaagacttgaacatttgaagttctgacagattgacaaaacctaagatcttgcatgttgcactcatattaaggtattcttgtcaagcaacaaaccaaggaactgcaagtctgcaacagcaacaccacggttcccaaatttagcacatggcatttagtaagatagagcacaaatgctatatatatgaaaacaacattcgatcaattcaaatgtgtaatgaaaagcagaagtcaaaacttacatggcatgtgtctcagcccaaaatgggctaaaatatgcttggtctttgtcctacggctgaactatgcactgtaccaagacaatatatggcgtggtactagaaatattagccaaataatttaacaacaaagtactgaaatggaactgtttttcccgaaattagaatattccttgaatgatatacaaaatgctggacaagatctttgctttcatactgctctctaggaatcctgagaagaacaaaaatttaacttgttttgaccaaaacaattcctcaacatgattcctccgaaaatcatttgcagtcattatcatccttcaggaaaccgttttcaatcacccctttcatcccttatcaaaattataagctctcaaattcctcttgcttatttttaaacaaagccttcaatgcggcgtaatagcagaatctgtcagtactgtacagctgtgctgcttcagacttcaggaaatagtccacaaccataggaaaatgtcattggtgagaccagtgtaccactccacgtggaagaagtgttacatacattttacagtcaaccagccctgttaggcataagtaaatgattagcatacttgaatgttacttcatttggagtgcacttattcctaagcatctcagctacaagctcctctgcatcctgccaccgctcagctctacacaaacccttcaatgtagagttataagaaatagcatcaggcttacatgacatggtgctcaataacttgagggcatcgtccaaacggccttgttcagaaaagccattgataagggcgttatatgtaaaaatatcaggtgtacttccatagtttggcatttgctcaagaacctcaattgcacgatcaaccagccctttttggcacaaggaattgattaatatattgaacgttacttcatttgggggacaatcctttccaaccatctcagctataagctccccagcatcttcccatcgtgcagctctgcacaaacccttcaacacagcattgtagctaaagatatcaggcttgcacggcatgcttctaaataactgaatggcaacctctacaagaccttgttcagaaaagccattaagaagactgctgtatgtgacaatgtcaggcgtacatctgtaccttggcatttgctcaaacacttgggttgcatagttgaccagaccattttggcaaagcatgtcaatcagtatattaaaggtcatttcaattagagggcaatcatccctaaacatctgagcaataagctcactagcatcatgccatcgttcagctctacaaaagcccttcaacacagcattaaaaccaagggcatcaggcttacacaccatgctgttcagcaacctgagggcatcatccacgcgccctcgttcagacaaggaattgatgattatattgtaattgacggtgtcaggctcacacccgtacttctccatttgctcaagaacttcgactgcgctgtccactaaattattttggcacaaggaactgatcagcatgctgaatgtagcttcgtttggcgagcaacccttcctaaccatctcagccatcagctcaccgatatcctcccatcgctcggcgatgcataaacccttcaacgcagcattgtagcaaacggtgttgggcttgcatagcatagtgttgagaaggtcgagggcttggtcgacatgcccttgctctgagaatccattgataagggtgctgtaaatgacaacgtcaggagtgcatccgtacctaggcatttggtcgagcagttggacggcgcggtcgagcaacccgttctggcagaaagaacggatctgcgtggcgaatgtcacctcgttgggagggcaacggttcctgatcatctctgccatgagctcctcggcctcctcccacttcttggcgatgcacaagcccttgagcacggtgttgtaggtgtaggtgtcgggcgccacgggcatggaggcgatgaggcggagcgcgtcgtcgaggcggccggagcggcagtacccgtcgatgagcgcggtgtaggtgacgacgttggccgcgccggtcgccctggccgcgccgagcacgcgctccgcgtcggcgaggcggccgtcgcggcagtagcccgcgacgagggtgttgtgcgagacggcgtccgcggcggcggccgccttgagcgcgtcgagcacgcgctccgcgtcggcgaggcggcgggtggcgcagagcttcttgatgagtatgttgcaggagatgagggcggcggcgggggcgggcagcgcgccggggaggaggaggaggcggagcgcggcgtcgaggtccccgagctggacgaggcggcgcagcgtctggccagggcggggcggcgcggccgggttgacccatatggaggagctggccctgcggttcgcccacctggaggaggcggcggcgaggcgggggcgcccgtgttgcttggcgcggcgagggaaagagaaggggtggtgggcggcgggcggcgaggaggaggaggaggtgatggccatggtcgtcggggtggtgaaggatggagaaggcggaggcgataggattcgtgggatggatgaggtggtgcggcggggccgcgggagtgagagtgacgaccaaatgcccgccaattctacttcattccaaccggacttcctcttttttttttcccaagtcctctcttcagtatggtgatgaaattcactgttaactcattctactgcctccaagtctccaaccaaaaaaggttcattttctatagacgaatctagactacgttttgagaagtacatatagaggtttttccctgtgtggtattaaaaaaagatggtgtctgcctctatgccactaaaaagtttgagcctctctctctgccatcgtcgaactttatcgcgccctccatgccatttcatccgttttgggttgtaacggtgggtaacggcagtgcgaaatgacctagttgcccttaggcttgaaatgccatttgatgaagtttgtttccttatgtgccattcggaggcaggcacatgcatgtattttttggcaccaaaggctgtgatgttggtggcaaaggcagggctgttggcgtgtcacgccctggagttccctttccttgtttaaaaaaatcattaaataaatcgaccaaagaaattgtttattttagctcaactaccatgtgcttgcaaaccggctcatctcgacaacagaaaagaacagcaaccgtgcctttcacaagtgcccttattttgcagtttgtgtttcattctctgctcacatattatgtttgggtttttcttttgttgtttgctcacaatgtgttgatggtttggcattcagattggaggatgtcagtattatcagtgggaggatgaaatggtggacactggagtgcaaacacctcatgcccctgctccaattcatacagttcccctacaagcagtggcaccacctggtggtttccctactactccactgcctatcaggcaagatcaagctactggagtggacattagggtgatgcagcagcttaagtggcttgaaaagatggtctatgtttgcatttttcttactttgtatgctattttcaagaagtagttgggtgtgtgtatgagtagtcatggataaatggatgtatggaaggatgaatgaattttcaatcaagaatggtgaaagtataaatggccaggttgaaacaacaccaaatgttagcacataacaacatcaaatgaaacaacataacataactagctatttcatcctttaattagctgtttcatcacataacagcactacatgatagtaccagatgttagcaacagacatgacttagcaaaatacattacttgtttgcatccacataccaacatggcaaagtaagagaccaaaaaaagagtgttttcatcacatggcagatgtttttcactatcatagaacaaaataaaagttttgccatggattaaaagaaccatagaccaaaagaagcacattttactacacctggagcttcttgctcctggtatttctagcagggctgtctgggcttgatgtagtggctgcagcttggggctttctttgggtaagcttccttggggtaagtttcctgctgatgcatatcttcattcttagtgaagcctacggcagtacaatctgcagtggccgggtctcctaggtctcctgttgagtggtctcatcagggcaaggttctaggaacacagattgtagtggtactggatcattggaaccagttgcagaccttgtgctaaaacaaaaacatggtgcattaggtggcatgaagtttttgatgatttgaaggcttgtggtaaagaaaaacatacctgttactcacactgactggttctgagattgtagtagtagtagtagtaatggcatatgccccctttttcttcttgttggcaccagaagaggaagatttcttccttttttttttgtgggatgcattggccattgcttcattggctgggaagaccatctgggagggattagccactaaactggtctctgtgttacatggtacaactttcttcaacctcttctttggtagacccctacatatcaaatgtgttttagttaactaagttattggtgatgtacatgtatatgcaaactaagttatgtacaaagtatacctttccgcctccattgtagctatatcttctaggttgccattcttacatgtataccagtgatggtctaacagatggtagatcgggcactcatgtttctttgacgttttctggctgctacctccctcaagtgatgacttcatcttattcttgtgcctacctccagctatggacttaagcaagggagggcgcatgaagaagtcatgggtagccttgggccacatggtcttgtctggtatggaaggaatataaccctcatatgcagcgctgaatttgttgacagagaagtactcatccacatggttctcaagcttttctccaggaatggatgtaatgtatgctattgcatgcttgcatgggatgtctgagccctgccaacccctacaagaacaggttctatcctttaggctgaccacaaacctgaacccagagccattagtagctttagcgcacagttctgccacaccttctggaggggctgttatcacctcaatatccaggttgtagctctcttctgatccttaagcctctgcaggatgtgaggtagaatttttccattaaacttcttggctaccttcttcctttggttccatttgatcaatattttctgccttatagtgtccagcaagtcatccaagtgctttcccttctctgcctttgtccagttattgaatgactcagccagattgttagtcacataatccatctttgatgcagtcctgtacttgctcctagtccacaacttcttgtgagtttttttgcaaatactttattgcttctggtttggctgcagccattgcttggtagtgcttctcaaatatgtatgggctccatgaatatgaagaagcccataaatgctcatcaaataccttcccactgtacctcttcttgaaattatgtactagatggtacatacattctctatgttcagcagttggaaaaacatcactaacccctttcatgactacctgtccacaatctgtgttgaatgtcaagccatctggggtacctattgcttccttcaatctctccataaaccagaaccagttctcattggtctctgagtcaatcacaccaacagctactggatacatccagttgcgcccatctactacacaagctatgcacaactgtcccctaaacctccctgtcaaaaaagtactatctactgcaagatatggtctacatcctctatgaaatacatcatgctttcagtacgaagaatagcctatgaaatcagatcttcttgtttatggtgtgatgatcaataacaagaaataatccggatttctaagttgaagctactatctgggtccatcctacatatgaacaaggagcacgtaatcattaaaccctaacacggattagtagcaatgggcactaaacatcagtacatcaagggaggcaataaatgtggcctaagacagcgaaatcaaagggggcagcataaaattcacccgtctagaaaccaatccgggcgctcgctggcgccgttccacaccatggctgctcctccccgttcctctcgatgcacggttagatccacgctcccatgctcctccccgccgccgctaggtttcgccaccgtcgccaccgccgctgctagggttttgtcgccatggagagcagggaatcgagagagaagagagtgacacttagggggatgacggtaagcatcggtcaacagacggtccaatatgctagcaattgaaagggaaagagcgacattttccctatccgggcccatatgtgacatgtcagagctgccaaacggttatccccaaatagaatagcgatggaatgatgtggagggcatgataaagttcgacaatggcagagagggaggctcgaactttttagtggcaaagaggcagacagcatcttttttaatgtcacaagaggaaaaacctcacatatagataagtaaccttaaattattgagttattactgttcatccataagatatggaagatcaaaattcctttagagattgtccggcagatgcgcaatagaatttaagcaaattttgctacaggatctcgtgggaatgcggtttcaattgttggacacaggcgtagtaaaatgttgaataaaatcactatgtaaatatggtaatttgctcatggaacccgcttatattattttaatatttttggccatgtgtacaactgaagagaccaaaacactcatccaaccaggttccaaccaaaccaacaacactatcgaaccccatggcagtcgccgccgcaacggtgacgtcgacgatggtgaggaaggcactattcacagcaacttcctctcctcctctgcctctcgtagctggtgtagcctctcccgctccatgcccagtgcttctgccatgccgcacatcgcgctttatccatcggacctactctgatgggtgccccactggcacagacacaatgctcattttgctaccagaagttgtgctaatggctttctcaatcctggttcaattttgggttaattggatccatgccattacaaatatgccgattcagataaataactttataattcgtctattcatatacatgtcattcgaattcgaacaaaattaaaaccatgccatcgccatcgtgttttccatcaccatatagatcaaaatacccctaaacgtgggacccacatgtcagttccatcctcttcctccatcctccctctcttctttcttccccatctctctccatcttgtttcaaatgtgcagccagcaagaagggcacgcctctcatcaccgtcggcatagtcattagcgacgacagcggtagcggggtcattgccgccaccgtcctctcagtccccatgccctcccccctctcattgccactgaggatatgcaagagcgacagacttgctcttaccgactagacacagctgcctgagtgcgcggtggatgcagagccccacctcccagtgccgtcgagctccatggggcatttaaactttttgccactttcagatatggcaattatgaatttgccactcacagtctatgacatgtgggccctcatgtgcatatgacatgtgggtccagtggtaaatccttaattgtcacttgtaatactggcaaatagttaaatatctccctcattgtggctaacacccaccttgcatcctagcacttgctcccctccggctgcaacccaacccaacccagattcaattgaagttgcgcggcatggagcggcggatatagtatataggtatatacagcatataggtagagggagaccccaacaaaattggattggaccccagcctgtctccaaccaaataacttattaaagcccaactaaagaaacaatacatcaaagcttaggttagcccaactagagcccagctattcgtgggaaggtgaaaggaaaaaagtacaccgaaaaaccagatatatgacatccctcaatttacaaaaaccattcactttaggtccttcggtagttttgaccccggttttatcctacgtggcggctgagtcagtgtgagatccacgtggtcaccacatgtcatcgtggccacgtttggcctcctatatctttcccctattctcttcttcctcctctgtctctctctctctcactcttctcttctcttctctaggcaagccggccggcggttggggcggaggccgcccgggcgaggtgggagaggaggaggcggcggcggcggctgcgacgcgggagaaggcgagggctgcggccggtcgcgaatggcatcgacggcgctgcgtcgccgcggtggtgggcacggaggcggaggcagggtcggatgccgcggcggtgggcacagaggtggaggcgtggctgccaggcggagatgccgcagtttcagaatgcgtcggagccggcgaaatggaggtggcgcgcgacggctcccgtggccacgacgaccgtgtcggcgtgcaaggattcggagttcaacgccgacgatgaagattggcgatgctgaaggggcacgaggaggggtcgacggcggtgacagtctcggagaggatcctggtcccgaagcgtacagactgtgcgcagctgtcgctgactggcagcgactgcgggcacgaactggcgggcagttccctccccggccgtcccctcctctccctgcctcttctctctccctctctcacttctctcctcttgggcaggccggccggcgggtggggaggagccgaggagatcctgcgtaacaacgcctagcacgaggcggatgacggtcagcctgatggcgccgtcgttcttggcgaggcggcacgcgaagttgccgacgaaggagacagtgacgagcagcagcactagccatcgaccttgtcgccggcaacaacctcaccgtcccgcgccgctgcgccagcccctcgctgcctcaggtcactgtggtggtggccgcggcgctcgacgcgtgtcacggtatggcctgcctaagaggatagaagtgatagagggagagagaggaggaagggagagagatgacgtggcatcctgatatgtggggcccacatgggtcccacgccgacttagctgccacgtaggataaccggggtcaaaaccactgaaggacctattatgaccggttttgattagttaaggaacgctggatatctgggtttgcggttgggggacaattttgtaactcgatgaccagggaccttccatgtactttttccaaggtgaaacgatgctctgaagtccaaaccgtgtatctcaagactgaattaactgcgtctccggctctccgctccttttcctcgtcagtcgtcggtactcttgacttgagacactgaatcgctgctcttgctcgatccttctccttcgctcaatcactcctctactcagatcaagatcaagtgctgcgcacccgcgcggccgactacacgctgcgtgtaggccacggcgagcgggcattcgcgtacgctcgacttccagtcttccacaagttgcaacttgcaaggtttgtttcctgccattagtccagaattcagattattggattaggccattagttcattcaatattctttagtgctgtcagagtaggagcatcaaatcattttgatttattcaatcattttttttttggttgtccacatgctgcatcgctgcttactgcttgcactagaataactggttggcagtgaccagtgagaagtggttagctaacgttggtgatattgatagtgttcataaccaagcaatgagggattgtgatgctttattgaaaaaagagcagcacattgatgtttctttgaacagccaaagtaatgctgagaaaattgcttattatactcgattaaatggctcaattgatgttactagactcttactgaagcaaggtatgccttttcggggccatgatgagagtgaggaggtctctcaataaaggaaatttcaaggaatttcatgcttataccgcagagcaaaatccagctttacacaattttttttggggaagctttacacaaggttgcaggtaaaaatgctcctggtaatagtaatagtcagtatacatcttcatagattcaaaataacatcatatgttgctttccaaaagaggtactgtgttctattcttgaagaagttgggaatgatgttttctgtttgctggttgattagtcaagggatgtgtcttagaaggaacaaatggcagtggtcctgccttatgttggtaaatgtggcagtgttaaagacagactagttggccttgttcatgttaaggagacgacatctatgtaccttaagtctgctattgatgatttatttgcggagcataagctaagtttgaaacaagtgagagggcaaggatacgatggtgctagcaacatgagaggggagttcaatggtttgcaatcactaattatgagagaaaatagctcagcatattacgttcactgctttgcacaccagcttcagctagtagttgtgaccattgtaaagaagcataaaggaatcgggaactttttttgatatgatttctcttttattaaatgtggttggtggatctttcaaaagaagggatatgattcgagatatatatgcagaacatgtgcatgatgctttagaatgtgggttacttataactagttcagaggtctggagatactcattggagctctcactatgagacactaaagagtttggttcaattgttccctacaatagttaaagttctagagtatatggaagagaatgacagggatgacaaaaaattgtgttttatttgcagcttatgttgaatatcttggcaatcgcaaacaccttgtctgtaactttacaaagaaaggatcaagacattgtcaatgctattaattgtgtaaaatcaactagaaatcgcttggatgagtttaggagttagaggacgattccaactcatcctcccgcctttatatttcccttggccaccatagaacaactcgggttttgtttagatcaaaatttagctttggtatttttccgtgtaatcctgtcatcgattagaacaactcgggtttgcttgttacggaaccccatctgtgatatttttgctgattcaatcctacatctttatttgcaaatcgagttgcctgttcatctttttcttactagttctcgattgcttgcaggaacaaatgccctcgtggttgggctaaccatgcatccgtcgagattcatgactgcctctagagttggtgtaacgattgcaaaggtgtaacgtctctagatagttatagtcggatctccaacgtcgctccattcaatcaaattgtcctctcatcgaaagatcgggacaccctcgtgcgcatcaccttaagttgcattgtgcaaccagcccattaaggcctaatagaggagaaaatatctcatgggcccgaaattctgtgttttacatccaaaagttaggtttacaagtatcctatatattcttctaattatccctaatatctacactaaatgttttatttcatttcttaatgttgttctgtttagctacacaactcacggtcaccgcacaaatatcacggttaccgcatcaaaccgtgcggtaaccgcgaccaaaccatgaaactgcaaaatttggaattcaagtatttgctgatgaaattcacacggttttcggcggttaccttgtgcgataacccccctccaaatggtaagggaaaccctgctcatcactagcaaggcgagagccgcaagacagaatattatagtaggattcagaatttgattacaaataaaacaacaaagggcttgttggcttcattaccaaaaaaacattactaccatttttttaatgctaaagtttagtagtgttttgtttgaggtctttctaaattctaaattctagtataagttttgttagagttgcgttggtaattatatgtttagttgttaccttataattttggtattaacaaaatttaaaatggttgaaaatcattataaggtgaacatgaccgacatgatctacttcatatgtcccaaattaagttaatccaatatggtacgtgatatatctagtactacgaatttagtactagaatatgtcacatttcatacgagattaatttaatttgagacagaattcgaagcaatagcatacgtactatctagctggggcatgttgggctgctcagctcaaacctgggccaactaaaaagcttccatttgcagttgtacgaatttaggaagaagtttatttaggtccctcgtctaaggatcaagtttagaccacatctctaaacagagaaattgggtagaacacattcctcatcttccaaaaccagtgtcgatatagtcccacaggtagtttcggctgacgtagcacccgttgtgcaatcatgaagaccaagtcaacatgtcaagtgggtgccacgttagttgaaattgccatccaaaccgcctttgggctatatttgcactaattttgaaagataagagatgtgttgtatcccttttgcgattaagggacgtgatctgaacttaaaccttacgagagacctaaaatgaactttcttatggatttaaaccaaacacctcatgtgcggatagtgggctgcagtgagaaatgctccaatgtgtaagatttatgataggttaaaattcaaaataggcatcttattatctatataccactttaaaagcttagctattgtcacccacaactgctttcatcgtaaacttttcttagtattaaaaacaactaaatataagtggatagttacatgtaaaatcgaaataaggcaaatatgtcccacaacaaacaatgggcaacacacttcgtgaaaaatacatttatccataccaaagtacgggtagctagtcataattaaaacaagggaaaattccctacgtatccttaaaattttccacaatctcttctatacctctaaattttgcctcatctcctacatgctatgaagttttcattttgatcccctctatccctattatgttagttggccattagtttttcaaaatgacgatattgcccctttgccatacttatttgctactacttcatcataaatctcatgtgaaaatttgcaatttacaataacatcaaattgagacaaaattatttgatgtaaaagttgaaaaaaattcaaacttttgaaaagaatttttttttaattcccatttcttggttctgctggtttgctcattcatttcgaatccgtataagagtttcatctagaaattgaaaaccgaaattattaattttggggttttaaattttagtgaaatgctctacgaattccatgagtcaatttgaaatttattaattttttttaatttatttctaaaatttgtggtgaaataattaattattccgtttgtgttcttacaaataaattctttaacatgagaattgtgttttgtgattaaactagaacataagtttgagagaagggcaatatagtcaatatgaaaaatatttaacggtgaactcatggcaactaacgagatggatataaagaggagattaaaatgaaaacttagaagcaagggatacgagaaatttttgtggacacatagggaatttcctataaaaatatgtaggaagtataaaccaaaaactaggtgtaaacatgaccaaacgtacttctttctaattgtacaatttccattaactatgtgcatgcttagttgatgtagaggttggatatatgtttatagtctactgaatattaaaaaaaatatatgcatttccatcttttaaaatattttggcccaacagttggcaaactatagatgatatgtcaatttttatggactacgttgcgagattttgtgtaaaaactaattacaattgaaaaggagtgcaaattgcactctgggacaaatttcaaaagattttgctttcaaagagtcagcaaacattttttgggatatatagaaaccgcgccaaacgattttcttgcaaacatttgaagacctctcaaatccttgcttggggtaaagaaatggccttgctggccatgtaaattggaccgcccacttgcattatacatatataaaatatatctacaaataaagctcttgttgcattatgactaagactgctatatcccaaaatttcacatataacacaaaaatttacaacaccgaattgggtccgcctaaaaagttatatatgcaatgcactggtatgtgccttcacgttctgaaatatccatacaaacaaatcggctctcttgactgccaactagtcaaggtgagcatgaacctgacaacacctgcaaaacgtaagccaaatgaacaattgtccaatcaatcaatatctattactctccgcgtcccataatataagtgattttgacttgtttgcttcaactgtttgaccattcgtcttattaaaaaaatttaaaattattatttattttatttctgacttactttattatccaaagtactttaagcacaacttctcgttttttatatttgcataatttttttaaataagatgagtggtcaaacaatacaagcaaaaagtcaaaatcccttatattatgggacggagggagtagcagcaaaaaatgagttgcaaatcatttaaagacctctcaaatccttactcttttgggggaaaatttgttaaaccaagaacaaatcccaccagaataaggccaaaaacaaatatcgcaccagaggctcagctcagctgctcttaacgtttggtatatgtccctcttataacattttccttagctttaagagaataatgataggtgtgcccatacctctgcagtcgaagagtagcacggcattgcttgtatcatgctcaagcgcaaatattaattcaaaaataattttctgagacatcatcatgcaagtgtatctagtgtcgatcctttgatgagagcatttgtcatctaaccatatgataagtcctgaacggtacgaccactagtgttgcgaggggcatatggtcttggtaccttccatctcagcaattcctgaagaatgttgacagaacccttcatattaaccaaacgagactagaaaacttgctcaatactgtaacaagtagttagctgaacatgtatacatatccggatgactaaaagaacaaaatgccattcctctgtacaacacggagaccttgataacacaaagctaagccatgttgcacgtgataaaagaacagtacgcatgacatgttattatatgtagaacagtacaagttgccattcacacgctcctactcacaagaagtccatttacctttgttgattttggaccataggccttatacgctccgtcaattgatgagtaaatcagtgtagcttgatcagacccacgattacacttgaccaaccgaacacctccctagaatttgtgggcttagctttcaggtacaaaataagctttgaaggtaaggatcctggagcatcctttttcccatgggtcatttctacagtcaccaaatcatcccacaatacatcccagattacaagcacggatcctttgcaggactgaactttctctgggtcatcattgggacctgaaatacaatcatatgataaatagaatgaacagtacaaaccgtaatgtaactagaatctacgtttgtcttacctgaagcagtagtactcttctgtgagtaattaaaagaattttacccttaggtagcataaaatgatcctcataagcatcagtagatgcaaactttccccggactttgaaaaggtcaacttggccaagaaatgtagcatattcagctaattgtaagatagcctaaaaagcaccgccaaaaaggattaagaataccatttgaaacaaatgagatcgccaccggcttgagggagagaatgctagttacctggccagctgctttatggtcgtcataaggatagagcaagctatcaccaccaatggctcgagggagacgcctacgagccaactgctcctcagccattatagctgatgatattttcattttcacagcatttgcaccttctgtagttttcgacaaaagatcaagaactccactcactggctgagcggctgcaccaattaaaccttttccgacaccttgcacaaagccctcaacaccagaagattttgcaccctcaatgggctttgtcaatatgcctgtaacacctctgaagatgccctttgcgagagccccacctccatctcgtatgacatcaccaaagtcttccactcctttgctatcctggagaaacattacgaaccacaaagtacatgttatcataacatactacttttatacagttcaatacatgcatacgtagaaagaaatgaacctgtctcattcggccctgaatgaatttcttgtccatggataatgctgctatacccttactcatattactcaaagcgctacttgcattgccaagaatgtcaacacccgaaagtaattgaagaggttggctgagaatatctttctgaatgttagacatagcagaactcattagtgcactttgtctcatgcacaattcttcccgatacctttgagctatgcggaccttcattgttaagataaaggaatcagtgcttaaaataattagagtagcgtacatcagcgtatagggacaataatgtaccatggcatgaaagtttttctcaaacatgcataacggtatgaaagtttgcagaagataattgtaatggaaaccaaagagagggagggagatattataaaaaagaaagactagttaacaacatttaactgattccctaccggcatgtgctccatgtttcccagtgccgtcattaaggaagaccagaacccaagaacccctctcggcctctgggtaggggacattgccattgagactctaaatcgtatttcagaaatattaagaagcctgcaacaaaagatttagtaccaacaacagggaaaaaatataagaaaaaaacacaacatgcaatagtgtgcgtacccaatcttcagtatagggtcaactgagacagcagaagactctgaactggatatcctatcaaattttaggttctgaatcatctcatggaggcgccaaataattggctcatggatattaacaaaaaacacacagttctcaggaacctacaagcattacataattattatcgcaacaaatatttaaagacatactccctccgtttcaaaatgtttgacaccattgactttttagcacatgtttaaccgttcgtcttattcaaaaaaaattaatgaaatatgtaaaattatgtgtacatgaaagtatatttaacaatgaatcaaatgatatgaaaagaataaataattacttaaattttttgaataagacgaatggtcaaacacgtactaaaaagtcaacggtgtcaaacattttgaaatggagggaatatatgataacttcatgtacaactaggaaactgtcatgaataaaacccaagcaagaccaagtaaaaaaaaacttactcacacggctgtttgataaagctatgctactcaaaagacaatctcataaggaaaaaacatctatgtgaaaatatctatgttaaaataagatttattaataacccatgtagacagatcacctgcacaccaagatatggataaacacaaaattcgagagaattattggtctgcaatgtcatagagaacttgatgatgtagtctgattgattctccatcctttgaggacaaaaaaggacaggcataagaacgaaaggtaactgattgtccacttgaatccaatgcatctgcattttgagcctgccattaaaagaagcaacaaattgaagtacggaaaaaagtagaaaattttgagcggaaaacagcaacctagcaaataaccaaaaacacatgattgtcacctattgattccagagcccattccagatgagtaggctagtaatagttgctgcactgagaggaaaagaatttcctcaggcatatggtcaattatggaaagtccaaactctgttagctccaaagtaacatgaaattcactatccagatctggagatgactgcccactgtcgacctctgatggctgaaatattggtgataatagcctttctgttgtctgttcccgagttctattatcaggcagccaatcattaatttgggtaacatgaaactttccctccttaagaacagtgacacgcaaagccttcttcaccctgcttgatgcagctagcggttggtgatccatgacaacatcaatgtcatatgtcatggaggttgtagggtcacttccatctactaatacttccaaaagacgccttctgccaatatcctcccaaaagaaggaagccgatgaatttggaggcagactacgccatgaataatcatcaccaccaacctgccgaaaccgtacaggcaagaacatggagcggttctctaccctgcatgtattgtttatattttattttagatatgtacgatttatgataaaataaatttcgtgtaagtatgcttacctgtaagggctggaccagcaagcgagctgaaatacaacttcataacgtgaacattttgttccacttctaacgtttactctcaccaaagcttgatcatttcctgtagtgttgttcatgagcacacacataaccccattagcatcaatgctaaaaggtgtactccatttgtatccctccaaccgcaactgcaagcgtaaagaattgtgaggttgagaagtagaaaagttaataaccaaaaccatttatatgtatgcaggaagtagcagttcagagtataaaagttaacctttaaaagttcgttcccaaattctgatcgccattgaaacgcttgaggaggactacttggatgtaaatgctcttcagtctcactatgatactcagataggataatacttcttccaattctattgataaaaagtgctcgtgggagaaaatttataacctgcattatcagtcaacatttttctgaaaaccttttatgttattacataatttaactaaacatagtgaacaaggacagaatactctttaacaaacaattcgaggtgttgcatattgcattcccttgagcagtaaatgaaaaacttgaaaaatcatatatgtaaaaatttaattgttgtaaatcatatatgtaaaaaatttaattgttgtttcctatctctgaacatgtcctaacacaatattaggattaattgctttacttgcttccattgcaacttgctggaactttgtcaacatgctaagtaatatggtgttttaatctttcaaatactccatagcacagtagtatggtaaatgacctagtttccatctagtaaattcttttgagacaacattcaattgctgaacaactttaattgcgaaaaataatcatgctgaaccaaagtatgaagcaatgaagatgtgaagacacagaatcaaaccttagttctgtctgaagtcatcttcagctgagccgagaaccagtaatatgacccatcagaagtaaatgctttgacatcaacatgctcctgcaccagatgaatgacacttgaagagaagataagcaatagttcaaacgtgtgtaaaaccacaaactataccttgttctcaagatcaaaaagggacactcctatactgtattgtttgcaactgccaacagccacacaaatcgcaactcgtgctgggctggaattgttatcccgagattcaaagcgcacacctgcagagcggttcatgtaatcctgtggcgacaacattacatagtctgtactacaatcttctataacctccaatatgtgcatatttctctgtgccactgggcctcttctgataagagattttgaagaatatctgagggaaaattttgaagatttagctgctctgcttagtgagtctggtctgctaagtgactctgcatctgagttttctgttggttccacctcaacgatgcgatatgatagtggaattgaagaaatattttttatccaatatggaacaaataatctcagtgtcttcggtgcagcatcacttgctcccagatcatgttcaacactaacacgaagtctcctaatatttgacacaagtaaaatgactagaaattatgacatatcaactaacaagaaaacatgaaacagtagatcaactgcactaacactcttttttcaaattgtgtcttaagaaatatatgagattaccatcaataagcctattaaaaccgtatctttcacaaaggcataagtagctaatgaacaagagaattttggaaaaggacccatttttaaattggaataataattaattataacagtagtccctagggccctccttcacctgacgcttttctactacaatcattttgtatgacccctgtaataaatgtatacacttgctcttaactaacattcaccaaaaaaaaaaggtattagagcaactaattttgacccgatcatgcatagagaagaccatgactaggagaggaaagtcctaatagtgaagatcctgaaggtgacaagtcaacagaactacagatagagtgcagtgaaagaaaaaagtagttcagaaaaaatggtggctaaatactagataccaccaatggttcaaatcaaatttgcatagtagtattgtatatgttacagattagaaaatgcagtagggtctattccaaatatgctggtaaaatgagatgggcaaatatgttggacatgactatgttgtttgtttgcactgttctggctgtgtttagaaacttctgtgttgaattgaaattcatatcaattgtttagataaccacactaagcaaatgaaacactaggggtactgttaaagcttacaaacctctggctcctattttgaaccatccagaatgaagtaacatgttccagggacattaagtccagtattaatacagtgtcctaaaatgaaaatgagaaacaaaaggttagagaattaaaacatcattttgtgcgttgagcaactttatgtgagccaaggcaaacatgttcagtcttgccatatagataaagcactctttaattccataagtaatttatgggaacaacacttttcctcagaagataaaacaactagtgatgactatcaaagcagggaagcacaatgtgcattccagcagattcatcacatacgtgtagtctagaactctaggcacattatgataacaggcaccatggttaggcttccaatgtttaagttatattaccttctctataatccagccattttggacaaacatagttaggtaaattggtttccggatatctgctgaatagataaatgcacttccaccagacgagacaataccatgctgcctttcaaccatactaccttccgtggacttctcccagatagcatactcggcttcatatggaagcttattttcgagtctaagaattgagttgaaacaaattttccagtcataaataggcatatttaagtctgtgtgaagaatggaagcatcaattccaacactaagccagaaattttgtttaatgccaacaggaggacagcaatatgaaagcatatcctttttctcaagatcagccagtctaagaactgaattctttgagggcacagatgactgctttaaggtgctttgccttgaaagtgaagattgttgttgcttgggaatgctctcagaacctagtgaaagaacctgactccaactatatgattcctgtgatttttcagaaaaagggcgaacttgcaagcacaaatccatatccttgatcatcgctgtccaaggcaatgcagtagatgcatgaggctccataacagcaattattttcctaggaatttctgcactttgttcttgcattgactgccgtgaacgcacccaccgccttcgcctaacaaagtcatgtggtgatttggaagatttccaggaagatggccagttcaaattttgaaaattggcagcatacgcccatccatcactatccacggaactagatatttcaattttccatggtgacgtccatttccagccaggtggaagacgaggttcaaagaatgccttcaaaataaatcacacatttctctttaggaggcaaccatttatgatatatttaaggatattttgcatcacaaaaagccaaagatatcagcagaaccttttattaatcaagcaaaaagaatttcagtggccaattagtctgaaagaagttaccttagatgagtaagagccgtcctttgtgctccatggccctacatcacaaccctgatcactagcagggttacttccccaccctgaagttggtcggtaccactgattttcaaatacttcatcaataatgcttgtggaactggtggaaccagcatttgacacagagctactatgcatggttacaggacagacagatacttcaagctttatgtcaaaaccatttgcaataatagcaagagcccttaagcttgcatgtttctttccattcctcatggtgacctcaagtgcaaaatggctgttgttaagtgatttggggatggttgacaatggcaaagctgcagtaaaacattcccatggaccatctgggccaagccctatccagaaaccactctttgcattgcttaagctgtctttccagctctggaagttcgtctgcgtagatctttctacgtaacaacttgaaagtactaacataccacagtgtttcacattttcatgattgagtgcttggccctagaagttgaagcaaggagctcagcatatgaagtgacaagcagaattaacccaaagttcagcaatgctatttgctcacaacattgcctatataaattagcagtttaaagaacaaaattaataccttccttgtaagaggacatgttagcacacgcttgacatcagcagcttgctgaatgatcctcatagaagcagctcgtttcaatattgttgcaccccgtccaataggaattgacaatgaaccaagtacttcaccttatgcattgatggaagatgttaagaaaccctaatactattggatcaacaattacaggagataacttaaatactactatattacagtaggtgtatccttcaaataattcaggttctaataactcaagaagttacctttcccagcctttgatgcaagatttgttacctcaatctctaaatgagcggatgcctgcaaagtaaagaaaatgaataatgcaatgctgctaacaattttgcaaaaaaaaaaaacatagagtaaactggaatggtactatgagacgtgaataaaaatggcaggtcaaattacctgctctggcacttcaaatataaaatgttcattccacttagcatgatgtgtctgtgattcacaagttttcaaaggttttacacatcttgtcctggcactctgagggaatatcttgtactggtcagaaacatcacttccaacaagcaagcgcaaagcacagaagtagctgtgatcattgccatcatccataataggcaaaccctacatgagaagaaagcagttagttcatatcaaaagcattgtatttgaaaagcaaaacgcgtatctgagtatgaccttggattcaaagatctgtatgataacataatatcttgattccgtagaattggacagtacacttagtttatcagaaaacctgggaggtggcataaacaatgagacttgattctcatgctgtagcagctcaataatgtcttcattgtcttcaagtttcttaacataaatatcacatcctaatttgttctcaaaaactattctctgaaaatcatcttcatccaaagcagagcaggacaaatcatcagcatttttcacactgtcaactgtatcctgtcaaaagggtacacatgctatcaaccatgaatcatgctgtcaaaaagcacagaaacagaatcatgaataaactggagggataagttgaaacctcattctttattgatgattttttttccagatcgatttgtcttttccatgaaattaaagtttctataagcaaatcaagatttgcagaactcaggttgacatttagaggacttgtggcagcaacacgaatcctcttaccgacttttgaaggagggtgtttactggtatcatatgtctcaaaccttcaattatgattaaacaatgttaagttagtggcataaaaatctagaagataatgcaactttaagttaaaataagcacaacttacttgaatatcccatcaaatggctcaacaaaaggttcccatgcttccaggtgtctattgaatgttgatgcagaaatcgaacagatcaatacagcattcattgtctcaaattttccatgtgttgcaagatttatatttgcgattgtagtgtcaaaaattggcgtgacctaaaattttggaaatatagttggcatgtagatagaaatatttgaatgatatatattctcagtccaaaaaagaataaaatttagcatgcgtacacaccattccacaggaactgtcaagaatgctgactgacaagcatccaaacttcagctcagcagtaatattttcccgcacctttggtttagcatggtctgctattctgtatgccatttgagctggtggttttttcgtatcagatgttgccaggaaagtgcagccctaaaaacacagcaaattgattgggttcctataattacataagttagaatgatgcaggtataatggattacctggtttgaaactttccaaatgctccagcagttaggtcccttcgagctagaggacctggatataggatcctctaagatatttgcatgattcaccagacccatcttcggacagcaaacggaatcattgcttggcatttcatctgtttttgttgcaacacatccaagagaagcatatccaggaggcggcactggataccagaagaataatatttcatcagaaccctttctatcaatctgggctacttttttaaactgagtaggcctttcagaaacaattgcgctgtcgcacttaaaaagaataccaagagtaggtggttcaaacctgaaagaagcatcaagcatattaacaacgtaccacaaagaagtacctatgtgtgtatataaagaaatcattacccttcagttatacaatcaccaactgaggaaaacccaaaacgaggtattggccgccatatagaaaatggtctttttgtatctccacctttgtcccaccatattctttcaaagtgtggagtagacatgcaatagctgcttggccttgacaaatttctaacagcatcccaaccagaagtactcttgcgatgagttaactgatcagcaggctggttactccgaacagaagaatctgcattcaaatctttaacaatatagcagttgggattccggagaagaacatggtgcaaatcaagagcttcaactctagtgggttgttcaatagaattgtgtgcatggaaggaagcaatcacattgtcgacacgccagatgctaaatccaggagttactctgcacaaagaatataaacacgatgaccaactacatgttctcagtgttcataattaaataataactaggcactcgacactttccagggaaagaaaataagaaaaaaaaatattgcacaacaaaacaataaaaggatgttgccatacccaggagtaggtgagagagtgtggatacaatcagaaaaagctgtagaagtcacaagatctgagcgaaggcagtacactacgtgatttgaaggtggttgtcttccaatattgaccacacaccctagagctatgtatccaggtggtggaacaggaatccagatagaacactcattgtcctcagctgcctgagatgaattcatttgctctagagatacaggtaatacatgaacaagcctaaatccaagaggtttccgtacacggccataggtattacttacagcaaccacaacctgagaaggtggcacacacctgacaaggtaaagtatcagctttggcaggacaaaaggatctccgtaaaagagaaacatagttcagcgtatggaaggcggtattaaaaactattcgcattcaattagacgcaagccctagtattcacctgggattccgaacattatacacatgactacatataactgttgcagtagctttaataatactcaaataacagttgacgatataggttctcaagtggcaaaaattaccttgaggacacacaatcacccaaaataacataatttgaaggagcttgtggcctccaaaaggtgagattgtacccaggcaactcacctgtggaatttcatcaaagaaggtaaaaattggtgtacccagaagagcaaacagaaaactactataatacaaaagcagctaagctaagttgcagaaaccatgaaaaatagtaagagttagaggaagtagcacacaagtaccattaggtgatgtccaaactcgcttaaagttaatacaagaaaccaatgggttattattgccaaactgcaatgcagcaagagtttgattttgcagtttgagcaagagagaagccacactcagagaaagatgaatgtatacatcagtagatgcaagtactatgtttgtcttttcactgacagaagtatatttccatgaaacatcaacaggttcaagaacaagaagaccagagccagcttcgatcgtaaggtctttaacaactgatcgagcccatatgtctttttcctttgaggcatacctgttaaaatgcacaacgattttatcaatcaacagagaaaactgacatgtatacaacaataaatcgacatattgatggcttagcagaggtaatgtaatgaagacaaacatgaaactgaaatccatcttggcgcgaagaagcttctcgatgtgcaaggaatcatcaattgataactttgaactgtcgtaaaaggtaaattctggggatacaacctgaatattccagaaatgagaaatgtgagacattcaacaccataaatgtgcataagtccagaatcaatacacttacaattcaacttaataagagcaaccggatgtttgtttttaagtaaagaagaaatgcacataatgtgagtagggaatttattccatgaacaaaacagttggtgaggagaaagaaacttgttaatgcctgtttgtagactaaggaagcaacttggtacactacgggtaattgtccaatttataattatttaactaccttttcttatactcttcctttttcataaaatttccagaagcaaacagtgctaacaaataatgaattaggagttaacgcaacaaacattacacgctttcccaaaacctactgtggtgacataccacaaatcctacaactctgggcactcttccagatagttcatgcaccatgctagttcaccacactcggtcactcaggcttatatccaaggtttcaattgctaaactttttgcaggcttgtaagttttaccgtcttaagaaaaagaacagaaaaaaggtcctaaaattacagaaatttaagcagtatatactatttagcaactctcaaaaatacattagaggagcttgcgtaaaatctaattatgtacctgagcctcaaatgtaaaattcagcatttgggccgagggggtatctgcaccaggctgaagagcattaattctcttatattcttcattttgcgtattatcatcttcattatcatttagagaactttctaatactgaaacttcaacgccatcttcagcagaaattgagtagctgcttccagcattcaaatatacacacctccgcagtaatgcaccgttcttttatgaaacaaatagccaagagatgtgtaagtttggccaaagaataatagtgagactggcaacaggacataaaaccataaaaaaaaatcactgagcagatacctcaatcttaacatttttgaatctaagttttttgccccgccccaaaataattatagtccctgagtataactggcccttcttgtcatattcgtcacataaagatatggtgcctccacagccatcgtaagtgaaatcatcaatatcgcaaccatcaactattagctgcctcccaggagatagttgaataaaattctctctctgaagaaaacaggctcacaaagtatgatgtcatctgacttaataagaggatcattctttggatctagactttcctcccggccggttattgtgcctagatttggaacaaaaaactcaacaacaggcagcagaaaatccaggacaacaagtacacgaggttcctgaattcttataacaaatgactgaaaggaagaacgccatcgataatccaatatcaccatggtgaggttggaaacccccacatcagatgaagggtcctgagtactcagcttagaagtctcagaataagatccaagcataaggcgcatctcggactttgtatctggcggatatcatggatcaagaattttagtatagacaaataaaggtccatctcaaatagtgaagttgtcctataagaaacccataaaccttccagctattaaaaaatgaataaaaaagtgtcagtaataaccaacatgatattaacacacaaaaaaaaaggcacacaaaaagtagtacaaaaatgcagatgacaaaggaatgatatatttatagtaccaaaaataaaaatttgcagaaacatttccctctgcaacagcacaagataactcaccacaagctctgctagaggtgactcagcatctggaccattgcgaagctcaaacaatgcatactggacatccacagtcattactacaacagtacgcgatagtaacaaatggttgttgagattaactttatctgcaagtagacgaattgaatcttttgtccgatttacattatcacggaaacctggggggaggttgggcgcttctgataggtttgtcgaaatgcaacttgtgatgacattgtattccttatctgacatgataccatggagcaaccctatctgcataagaaaaaaaatgataatcatataaaacacttgttttttttgcatttttccactatatatgaagtttatcagcccagttcttttctgacgaatggattaatgggcatgcttcccgagctcctaaacagtgcgaatttttgcaaaaactctctgaatttcttagaagactgttttaaatccattttcaatttttaacagttaattcattcaggtgtactcaatagaagagcttacatttcagatctaatgcaaaaatgaaactgataaactgagtaaatcaaattatttagagtaaattccagaaaaaaaatctgtgttttatgttcaaagttgcacttgcagaaaagcacatatattagaacttgtggcacataatatactcattttttacactgaaccagtaacaaaacctttctggagattgatgctacacagtaaagctattctccacttttaatagagcttttaaatcatggcctttgaagtgaatcattccacagataactaagtccaatctaaagtatgaaacaatggtgataaaaaagtgagataatcagcaatataaaagtactgtcacgtcacaagaaaacacttttaagtataaaaacaaattaatcacctgaaatttcatgcagagcatcgggacccttttgaaaacatcccgcaagctacgtcgcacttctatattgatgccatgaccttctctaatcatactctttcctagaataccattgactccaaccgccatgttgattccattaatctatttcagtatcattgaagcagaagaataagaaaactagataagcatactgagattagtaaagtgaccaattttccattccaatacatacctctgcttgaagaatatcaaggcgtacagcagaaggatcactctcttcacctccacgccagcaaaaaccattcctaactttcagttgtcccagatccagttgtatatagctgcagcatgatatgaaggtgatgtcaagctttctaagtattattaaatcaccattatgcttcactaaacttgcccacaatcaaaataaaaaagtgcggactaaaatgaacaaattagtatatgtagacacaggtataagaaatgtgcacacaaaatgcaaaaccatgtgcctttctccactatgattcagaattgcacacctacaatatatggtgtagatttagactacaaacaggaaatttcttatctacctgatcctaaagaactaaatcaactaataaaaccaaaaccaaacacatgtactggaaaattgaaataagggcatactctttgctctgggagttctttggaacaataattatgggtgtgtcaagtgaaagatccagctttatagcagaagcaccatctatttcatatttctgaatcaaccactcgaaacctccaactttgtcgatgaacttgattgcttcttcagtgtgaggggtggcaagctccatgaagtaagaggtgaactgcaaaatagaaggcactttcagaaagatgtacatggtcatggataacaagaacaaacagcttgcaagtgtaacacatacctcctgaacaaaacgataaaggaatacaattcgcacagcagaaagttgcccaatcagactatagttgtaaccttcatagtcatcatcgtcaacgctgtaagactggaacgcaaactgcaacagagaggaaacattaagatttcagtattttgtcggccacaacacaagatagtcttgtttagtttgactgccacaaccaaataaattatagttagctcttaagaagattaaaatggtaaattagtttgcatagagtacaaagtttgagatggaaatctgatgcactgtcgataaagagagaatcaaggttaaaacagaggataatcaaccattctaggcagattcactgatgaggtaaaaacccaggtacttgaacagatgatggaacacgagtagggataggtgacgaaatcaatgtgctattaaacaattaaatatatatggtcatgttggaaaactattttaatacgaagttagttaattggttgaaagcctttctttttcaatatcaatggacaaaagctctttgataatctagtcaaatctactatttgaatctcaaggcagcaaatatgattatacatgtccgcatcatactcttcatcttgctaacctttacaaaacaaaaagtaagcatcaatatacatatttgatagtaaaatggcatacctgacagcctacaatgtactaaagtattgaagagatgaactatgactactctattggtgcagctgtctgggaatgaacaactgacacctgtataaaggattgcaaaccaatgtcaataatacctttataagagattcaacacctggtttccgtatatcacatagccaaccccaacgatgttctggcccaagagacatgtcacaaaatctcatattacccagcataccatcaattgaaaatgaacctggatgaacctgatatataaaaaatcagaagaaacaatataaaaacacatatgcatgcagcttaacaatgaataaaaagaaaagacgcacaataaaattctaacaggcaagtaatcaacctaaaattttaaatgcaacaacatagcgatcttgtcctagattgctgccttcatggatgattttggggggaacatcatagttttaattactttagtaataatttataaattgaacctttcatcaactaattacatatgctatcaccatatcctagataatgtcctagattgccacgttcatggaaggttttctagggaatttcatagttcttgaattactttaataatattgtatacattacacctttcattaactaattacatattccatcaccagatagatgttctagtatattactttgataatttcattatttagtccaaatacattaacctcaccttcagatcaaacagaaatttctcctgcacaaacatcgcaagctgagaaccatcttccttgttaagaaacatagatacccgatccacatccatcttcatgttgaagatagttcggcgttttccatagcctagcaaacctttaacaaaattgcgagcattatcttccatccctgtaggtttgacgttgcgtactgcaggtgttgtatcagagtcaccctttggggcagaattaaccatgctaagatcaaatccaaactcaatcagagcaacaagagttggtctgttacagtagaattccagtgcagacatacggatacacatctgtaaaaagcaagatacaaaaataatcaaacttcacagagagatttacaatctaggaagttaaacatatcaacaagatgtacattttgtgattttaggactagatatattgcttctatagttctcgcttggaataaatctatgtaacagtaaaagatgaatatattaaattacctgcgaatctataccatcataaagacaagaatcaggagtcctggtcaaaaatgtaaggacaacaaaatcgttaatattattgtcttgtgcctcgtaaaatacttccgtaggcttcactttctgctgatccccatcaaagcttaaaccatctttcgaacttaattgagtatgcccatctggatcaaatattgagttggaaggaatttccaaatcttgaagatttggactttggtcaggagtgaaatctgtcagcgcatccatgaaagaatcttcctcaacagagaaggattttcgatgatcctcctcatcaggtgaactagaatctacagtttccaaattgtcattgataacagagcatgctagataatttgaagacatagagagacgaccctgaagctcatcctttatcttcaaagaatgcagttttgtttttacactcaaaccacgagaagattgaacaacattaacctgcaacattatatgaaatataagtgatggataaaaagaaatgaagacaagacccagtaatctagatctataacaagcactgaaacaaaaagctgtgaaataaaatctatcatcaatgcacagatctagaaaacaagcatcacattcatttgatagaaggaaaataactctgctcttgtatctgttgaattgcatgtgccagcccagtggtcccagccagttcaacccaaaagcttaagctgatgagcaaaggtgcgattcacttatacttcaacactccccacgtggaagctccctcaggcctcagacatgcaatagaagtggactacattttttttatttaattgtgtcatccaacattcaaactcgagacctctagctctgataccatattgagttgcaagccagttcaacccacaagcttaagttgatgagtgatgaagcacgcaggcaatcacctatacctcaatataagcatatgaaggcacaccagactgaagttaacgagaagagcaagcaggcaggactatgttgtgagtctgccacaacaagaaggcgagaaggcgaaagaaggcgaaacatcagtccacctatacagaaggcgaaagaagactcacaagaaatgcagcatgccaatctagcagcaataaagaagtctgtctgaaaggcaatgtcacaactaaacactaactgcaagagatgaaaaacaccgaattatggcaaaccgtctggcgcctttgctccctggtatggtttctgtgaaccaaagcgcttttgttaagcgtagaagcatacatgacaattttttgcttgtccaacaaatggctagaaggctgtacagtaagaaagaagcccatgttatgcttaaacttgatatttcgaaggcttttgattcggtcgactggtcctttcttcttgaagttttgtgccatttgggttttgggagacgatggtgtaatttgctttgccttttgctgtcaacctcctccacaagagttttggtgaatggagagcccggcaaggatattgctctttgtagaggcctccggcaaggtgaccccttgtctcctttgctttttatcttggttatggacgtgctgaactcagttgtagtgcatgcggatcatggaaatctactagaacctcttgctgtcccgcagacagcacaccgggtttctctgtatgcggatgatgtggtcatgttcttgcgtcctacaagcggggacctatctcttatcaagcagattttggaggtttttggtcaaatttctggactaagaaccaatatgacaaagagctcatgcactcctattcactgcttggaagatgatctagaagtgatttctaatgagttgtcttgtgaagtgaagaatttcccttgctcttatctcggacttcctcttacagtccgaaaaccaaccaagacagatttgttgccccttgtggacaaagtggcagataatttaccgggttggaaagcctctttaatgaacaaggcaggtcggcttataacagttagggtggtcctcttggctattcctatttatgcaatgatttcgttggatcttcctaagtgggtggtcaaggctatagataaaaggcgccgcggcttcttatggaagggaagagaaaatactaatggaggaaattgcttgatatcttgggaccgtgtgtgtcggcctttgtcctatggaggccttggtatccttaaccttgaaaagatgggatgggcactacgcatgagatggttatggcttcaaaaaactgattttgctaggccttgggccagtttgtctattcatgtgcctcagaatgtccattctcttttcaatgtggctgtcaaaactgtggttggaaatggagaaaataccatgttttggagtgataggtggctgcaaggtaaaacagtagcagagctggcccctaatctctttgcctcgatctccaagagggcaaggaagcaatgtactgtggcgcaggctttggaaaacagaagatgggtggctgacatacatgggggactatctgttcaggtcctttatgagtacttgaccatttggtctttggtagacacaggtggttctgctacaagatgtacaagaccagcatgtttggaagctaaccgccgatgggatgtatacttgtaaatctacctatgaagcttatatttcctgggatcgatcaagtttgctccttggaaacgcatttggaagagttgggctcctcttcgctgtaagttcctctggttggccatcaataatagatgttggacagccgacaggcttgcgaagtgcagactgcagcaccccgcggccggtcccctttgtgatcaaagtgaagaatccatccaacacattttgatctcttgtgtcttttcccgccaagtgtggacacctctgttcttgaagctagggatctctggtatagtgcctcaaccttcatccgattgttttttgaggtggtggagccaatctacaaaataccggccaaaggacgtgcgaaaagggctcaactccttggttatcttagtggcttgggagatttggaagcatcgcaatgactgtgttttcaatggcactaagtcctaatgttgcgacggtcttgcaggtggtcgagaacgagggtaatctttggtgtttagcgtgggcgtctgccctccaaagtttcttagtggttcagcaaacctaggcacctaattggccggggttggccggggcgtgggtgtgtaggaaggttttggtatctcctactttttttttcctttatttttcttccccttaatgaaatgaaatgaaatgcaattctcttgcgttttcgagaaaaaaaacaaatattaacaactccatagttttcgagaatgctttggcacactaggccactatccattgacaagagagtaaactgggctgcaggtacttattcttggtgactgggtatgatatatacaatgcaaattgcaaactgggctggtggagaaacttgacaagtgtgtttttagccacatgatgtgtcatcagaaattatgggctacattaactgaccacctgggcaagaggcacacgtgaagcttgccttgtccacatcgcaaatactcagctattgcagcaaacctagcacaacccactgacttgctttgcaacttcttgtactaaattgcaccaactagcttggcaaattattggaccaaatcacacatactcagctcataaactgtcttatccaccacaacgctaaccaatttgccattaacatggaaaaataaagaggaaaaaaaacacctatcaaacaagatcaaaatgttattcagaacttagcaagagtgagtaattcataactagatacaagcgcaaaaatatctacgaagtacacatactagatatctatctatctatactttcaataaagttacaacccacttgatggaataagtcttagtctagtctttgcattccttttttgctttttccagcttttaggatgtcatagcttttcagcttttagtcggtgttagaggacagcatcctcactttctgttttagaggacagcatcttcactttctgttttagaggacaacatcttgactggatgccctagactagctgcagccagctagctactactataaatatgtatccaagaaaatagacagaaaattgccccaactctcctagtgccatcctctcaatgagagtaaagattttgctactaacaccactaactctaaagctacatgcaaacatgccacatcatcacccactagcagtaattacatatttaacttcatgcaagcatgcaacatcatctacaatctatttaattctacaaatcaacatgcaagcacatccaatcatcacccctcacatcatttccataatattttaacaaatctatctatcatttttataatatttaacatatacttatcaatatgttccacattacagcacgggtatcatttgtttatttcatgataagtactaatgaactctaatgtttcattattatttttctatttactcctagctcgattgtcgaaaaaaagtatatagaaaattgcttagtaattcctgtagcaaagcacagggaatcacctaaatggaaaagatgtacggataagtttaggatagtgagatgcataaagccttccgttactttttgctataaaaaagaaacaaaagaaagtgaatagaaactctacttttggaggggaagttggggggagggcagagtttcatttcaacaaaggtgtggcaaacattgtttcaacccagtctggtatcttaaccaataccacatcaaaacttgtgctgggtcaacctgttttgggaacctgacctactcttccaagcctagggtggattgcaactgacgaatatcccaacatctcacgatatagaaccatttcctagggaactacagtttcaccaagtaagtttattcaggaatcaggtttagttaccaagtgttcccctcgtttgtctatgcacatgttagcttttgaacttatagtgcaaaatggaggtgtaatgttcaattccttttctgtttttttgttgaatgcaaacaaaaatagaattgaagcaaatcaccttgcctccacttccaaggagctctaacattacaacctcttctggatctttcttcttcctgtccaactgaaagaaatgcatagataacaagaagtcaatgaaacaataagcattagaatgactagaacatgacaagtccagtaagaacaaactatctcatgaacaaataagatgtcaagatggcaattcaaaacaaattagaagtatacctttgcatacagcgaaagcttcgtttcaaccacagaaccattcacaagaagatccactgatcccaagctgctcagccttggagtgcttggttctgttgtactgacagggtctcctagtatgttcacttcaggaggggcctacaagaaagtggagaaataccatcagacaaactatatacaaacttcaggtcctatgttaaacattataaagtaaaggaacgcttacagaagcttgatatgttgcttggacaagcgctttcatccaattggccttctcgatttcattatggtattcaattatcagtgtgctagttgattccagcgcctgcaaatggaacaatgctcagatcaaaaagggaataaaaaacaagttatacggcaacacttcaaaagaactaagtattccttcagtagattttgtcaagacaatggtaccccaacccgagcttttgactgttaaacttccttaggtgtagcgctagctataacatggcccacctgatccaactcatcatcttcttcttgctactaaaactgatataccatggtgagaacgtcttctttgactgattttgttgtttctgcttcctcgtctccattgttggcacatggcctacttgactcataattgccaggatcagatgtgcacttctctgcacgatggtttatcaacttcttcctggcacttcagttctacattccactgctcggcactacagggatctccagatgggcgtgactcatcactgtatgacatcgttgttaaatctggcagttttagaacttgatcaagaactagtaggaagtagctattgattttaccatcttctctcgtttactagttcattggatctcattgtacccaccacccagacaagaggagagaacggacaggtcgctagacttaatcactaacattactacatactccatccgaccgaaaatataaggacttttggagttagacgcaagttaaggagaaagataaaacaaaatgaggtgagatgagaaagtaatgaaggagaaagataaaataaaatgaggtgagatgagaaagtaagtggagaaattaaatgagaaatggttgtgattagttgagatgaggaagtaggtggagaagtactccctctgtcccaaaatataacaactttgccctcaggatttgtcccaaa

SEQ ID NO: 68973 - DNA, 16449 bp, Oryza sativa
aattttgggacgaaattcaaatgttaatggtagctatatttggggatggagagagtactgttctctgcgcctactttcctaccaaaggcatctccatctgctagctctttcctaggattatgtaacgatctgtttatcatctataataaaccatattgaacactttaccagcaaaagttgtccagactcttcctttatatgctacagaatttttttttttgtcattgccatcaccacactgttagaaagctgtaagagagaaaagcctttacgttttggggaaaatcccctctcattcttcttcacctagactcctacaggatccccccccccccttttgccccctgttgctgcatgctatacatccatggatgatgcaccttttcctcagaatttcgtggtgagcattacgttcgtgcattacttccatagcaagatttgcacggttgatgatatcagcccaagtataaataacgcgaccttggctatcaactacagatggttgaaattgaacccatttagattgaaagccatagtcctaatacctaaagcagtgaaccaaatctctacctagttgacattgataacaacgatctaatgaattatgagtttaatagatcctctttagcataaagatgtatatttcttactcatcacttattcccaaacctcgtatggggcaaatcgttttcatttaccatctcagggaaatcctgcctcccaaccactagcatcctactaatggtgtgttgaaacaagatgcagccttttcttctattcctcatgaaatctattgaacaattactaagcaatttggcatcaacagaattgagaagggagggggatgaagaaaacaggaggcaaatcaggaattcagcacttgtagattccataggatttcttataatttggatctgctgttttggtatcattcagggaagtaaactctccagtgagtggaattagaagaagccaaacagcacagttgaatagtataccttctgcataggcaacccaaagtaaaaataatacccggaaggttaaatggtataccttctgcatgtccacacctctagaacacacagcaatactgtaaagagacccaccaacactagttgatggaacctcaattacttgacggctagccatgctgcaacatcaaacatcaaaaaatacataaataaaaaacagagcaagcattcgcaaatgcagaaaagggaataaacttgattgtgtaccactagaagggtatgtgcttaaaattattccagtaccttcagccttttctctaaaacaggaagggagaattctacccacatctacggaaataaaatcctactatctctaatgttccaaaacttctcaaaatgacttcttacactttattagtacactaacccaaaatattcgttcattaattaaaaaaaatcaataccaacaaatgatcacatccagaaacaatgctgcatagtactatgtcaatcatagtccctaccactcatgtgcatagacatgaagttgcacatagtttagactgagaacaacagaggatttcatcattgcttcattcaacatgaagataatgatgaaaagattgcagtacatacctacaacacctttggtaatcctgggacacttcagactccaagatgtacagatacatcccagataatacaacataacttgtatgccattcagctagcgaataaccaagacccttgcatccaaaataaaatatacaaaactctgttactgtactgcataaatgcatcatatgagaagagcactcaagaaaagaaagacaaggcaataccttccaaaccaagttctagcatcaccagctagatcagcaggataccaaggtgccaggttacaattttcacagctatcagaatcttcactatcacttcccttcaacttgcaaagtacaccaagtagttcaacaatcttgccgtatctttttggtgagaagtgaatatccagattcggcacttgaaaagaaacacgagttgatggataactcgggtgtggaactttgatcttcaagcaatcacagaataggacagtcaatacagtataacacccgtacagaataatttgcattacaatcactaaaaagttaacagcgatgcatccctaagtgtctacgtagaagtataaaacagtaacagtatgaagtgcaaggacaatttatttcatggagtttgttcccactatttcctcccttagggaaaaaaggaacaaaacattaaaaacatataaattgtttctatgacaacagcatgatgcactgctccaacaaatagttctcaattctagctttctattctttgttgaagctattagattctttgctgaaacatataaaatgttccgataacaagagcaacttaaagtatgtgtgcaagccattagatttactcagcctacaaaaatatacaattgatcccctcaactacaataaatgctagctctctcttctttgctaaagccatatatgccctccgtccgataaaaaaccaacttagtaccggatgtatatcttagtactacgaatctggagataagtccagattcatagtactaggatgtgtcacatccagtactaggttggttttttatggaatggagggagtatctcttattttcagccaatgatgactgtagtaaggtacagattgtttgataagtgttgtaattccatatgtcttagcccaaagcctaaccagataccccaagtctacattgacatgcagtttagtatgtggtgtccagatgttgaagttcaatgtatgcctccatctagtggttttagatagctatagattgtgaatagaattatagaaccaatctgaggcccgctagtccactgcaaccaccagagcaactatagcttatggtatacaatagagcatcctacaagcaaatgttacagcatatggtatgtaacagagcatcctacaagcaaaggttccaaaagaaaaaaaaaaaggatcaatgcccatgcaagggggaaatgatatgacaactcccattcttcagtaagccaaggaataactgagtatttcaaaccacaaataatcagtacttaaagacttgacaatattaaaatacttccatttatgttacctgatcaattatcactgacattccacaacgatctagaagagaacaaaactgattagcatcaacagtaggacctgacagcacacgctgattttctggtacagaatatatgtcttcagctgtatcacaaacaacaaaagcagccatatccctcccagcaatataaaaccgtgaatataaactgcgtctttcctcttcacgtgtgccgtcctataattcaatggcatggggttaggaaaagaaacagcacttgcatcaagaattcatgaggtaacttacccttgtatgcaacgtaaaatggcctaaatccagaacaaaatgttcattccccagcaaaggttgacaagtgattaaaggaatcctaacttttggtgcatccaaatcaatatcaagtccaaaactagaaacagaacaataaacagtcagccaacataaagacatcataacactgttacaagcaagttatggatattggaaatttcttaaccataacaaaataagattgcaagaaaaaataacaacttggaaaacataagaaagcaggatgaaagtaacattttgtcaaacaattaggacacgaacaagaatgcttaattattcatggcagttcatgaataagtaaagaaaactgatgtaaaaagtcttcctttcatatatgtatctcacatttaaacagatcatgcacactaaacaagagtatagaactcaaggccattaagattgagcgtagataatgagaatacatgtacctgctctgctcttccaataccatctgaagctgctcctgagctctacgtgtgacctgctctatcttcatctgcagttcaaaagatatgatcaatcattatgactatagcgtcctatatatccaaatagtaacgacgaaatatcaaacaaactgttccacaacatggtcatgagtatccaaattcgaaagtaaacttgcctgtagagcagttgctgtttccatggttactgttgggctaacagctttgctccgtttaatgaactctagaaaccgttcatagcttcccttcaaaacctaccgaaaaaacacattattatgccatgtacataaaaaaaatgcaatagcctgataaagcatgtgcattaaggaatagcgatgaaagtaattcacctccagagctttctcaaaatcctactaaaatgtgacatgaggaagtgaatttagtcctaaaagcataatgaacacaagatacaaaccgtaacatggcatggtgatatctttgccacgagctgccaatccaggtccaagccgacaggcgcacgcacaaaactgacatctagagcattactctttccctcactgacaacactctgcaaaaatagatattattccaaaacataaatgtagggatagaaggcattcatgaaatgaaaaaaaatgttgagcaatgtaacactggaaataacacttcttatttgcaacatcatagctcatgcaactgcaatggccatcagacacccaaaaataaaagcaaggagtaatacttagtaattaagtggatagccatcatctataaggtcaggtgcaacctaatttaaatgtttgatggctagccacctagaaccttgtatataataatgtaccaattgcggtttgctaattaaacaatatggttgacgaaaacttgcattcaacagataaacaatatatttcgtgctacagatgaagtggcatttttctgagtcacatcctagagtccataggaggtttgcagcaagaaattcaaacaatcgcttcatattcactgacctgagcaagagaaccttcaggagaagacaaaccacaatatctcaaagtaacatcacaccgcgtactcttgggatacaatttcgtgaccacttgaagtttctcaaatctaccacacaaaatttctgtccggtcaatattgatgatccttgcagcagcttggccaatagacacatccaccaagaatcgggttgtattcggggagactttttcaaggggggaagacagatcatcttctggttggtaactcaacagcttattaatggcctgccattcttcttttgttaatctctcctcctcatctaactgcggttctagaagggcattctcttcagaaggtaattcagccgagttccttaaacaagaaaacaagcataattatgatgtgacaaaaaatgattcatatgcactcatgaaactatccattgttcacaaaataaatactagtaataaattactcccaacaagttaacaatggccacattgatcatctatacaatttgctcgttataatgtcactaaaccgaaagatatatgtgaaatcacactcaatgaaagaaatgatttggttgaagttatatatgaaatgaaaagctgctttctgagcaacttataactgtcctaaaaacaaaattgtctttggcaacatgtcaataaagtactttcctttcatgtatgtacccatcgattgcctaaattcaggggagcaataagcaggcactttaattaaattagtatttttaagttttgtgtaaatatcgctactattataaaaattgataacgcttttgcatgttttttcgtctgtcacctctgtgatcgagtcggtctcataccccgcacgctcgcataaagatgggcactctctacacatcctcccgtacgtaagacggagcctctcgctcctccctcaaccggcatggccaggtgaccttcagcccatcatcaccaactgagcttgcacctctagctaggccactgccctggccagtcgtgccccactggcctgatgggcctgctgcccaaaaccatgcagctttgaccacttatgtgtgtgaagcgacaaaaggtttccacggaaacagtaacccgaccggtacccctaggtgaaacgctatcctcttataatttcagttggatctcttctcttctcttttcattttcgatagttttctctttgtgatttttggcacctgtacttatcgacttgcgtacccatcacattaatccttccatccagtgcttgtgtgccatgccttggcttctcattcagcataatccttacccaaaccattaatcaagattgacttcaaacctctaatatcagtagacgaaataaccatctaactaatagattttccgtgacccaaccatgtacacactaataaattaaccaacacaagccatcacacactactacaaaaaagaattgtgtttcataactaaacatgtacaaacaacgctaatttcccttcacaattcatcaaccatacacactaattttccttttacatgtagcatttgttaccctaagtatatgagaaattattgatgattagaattttaaaaagttgaccaaatcatatcataaaacatcaaatatttacgactggattgagtaattttgttcagttattttaaaattgtctttgcccattgcaacacatggatattttgctagtaccttataaaattagtataccgttggggcctcccctactgtttcaaggttaagaaaaaaggtatttttagtagcaaggctgcttcacaccattgttattctgcaacctgcagtaaactaatggcccaaaaaaaagcagtaacagcaaaaattaggcacgagaaacgcccaggggtcttccggctagctcgacaaggtggtgggctagacgacctaggttcgaagcctcaccccttctaattatttgatattaggtccttccctaatattcgcgtcttttttgcaaacattaggcacactatgcagtatcactaaccaacaagtagcaggtgttgcaatgggccctagattccagcaggccaataagccaaagatatacgattggcttgtaggtaaaaatgcacagataaccatataataggagataaatgtactgctatacacacacctaaaagcaggtataaggattgcctacatatagttgcttattactgtattgttgcaaaggaactttggaacctgcaacttgaaactaacagggaaaaagaactaatggttgctagaatgagtaaaaacttcatttgatcacgtattgttacttttatcctcctccaaatttaactaagtgatgctcccatgtgcaatgcttaatgaaaaagttggcaagcattggcatacaagtttcattagtcctaccatctacaaactaaaccatttaagttgcacagaagttaccaacaagattgggaacctaagttaaaaagaatatctttctgcctatttctatgagtacacctcaaaggagcaatagtacagaaaaatgagaatagctgccacaatgaacataatatagaatggtaccataaaaaaattagtatcttaaaaatagacagaagcaatgaacaataaaggtacagatattattatcaacttattggacaaaccatccaaaagtccaccatcttctctttgatgcccccttcttatgtaatatttcctttgatttcacggtctcaactttagcatgtcccaacaacctgaaagtatttaattatagcaataccataaccagatgaatggtgacccaaatgaaagcaaaaggttacaaaagatacatgtacatgttctgtaccgcacctccaaagtattatgacttttgtgtccagaattttctctatctgccgaatttcggacatatcaacattagatgcttgttgcaataatgtggcatacaagtgaacatagcgtcgacgaagctggcagagatgcctagttctctcccatgagaaccaatagctgaaaaaagaataaacaaatttcataaggaagaaatcctaatttgtaaagaaagatgacagcatatataattttttgcatcaaaatatctacacaattcaagtaattgcctccaagatgcaagaaaaatgcaacacacagtccatgatgatataatcacacatgattttgtcaaaaattgatcaatgtagcgccatgaaaagaaaaaaataacagttgacagactgattgtagcaaatgttctcaggtgatgctaagagcctaaagtgtagcttgcaacataatcccaatccatccttacaagggccaattcgcctggttgacggaaccaattctgttagacagaacatagtaattgggttcgactggcatttagaaagaaaaaagtcaaaaaaccacacctccactttttataccactaaaaacccaaggccaccaagggtaataacatggaatgcaaacctcctacgcagctacgctccccccgagttccttgtaccacttgtgctgtacgttgttgtaactccatgctgtcctttaaatgcactaccccacagacatgggttgcttcacatgctgtatcaactaccatcaatgcaaattccatgtgccaatgagctgaccatggcaatgggtttgtcagggaactgatgatctgtggattagcacagattcttcacggaatgtaaatgttttacatccattagaatgacatgatgcacaaatgttccttcacccacctacgcatacctggggcccaccaacagcaagcttcacctgctgccagcctgccaccaagtacgagtggcactggcaattagcatactgctataaagatagccacctagctctcccaggcaacaatacttaggcgctaggcatcagtcatctttgaagccaatgtccagttactatcactaagtagccatcaagcttaaataggcattaagcaccatccagctgaagtagggggggaggggcaaaaatcagccacaaccaagcttacttggaacctgatcaatgggattgaggggcaaaggccatggatgattgaaaaggagggtcaaagtgggtagtgcagtagtgttcttcaggatgctatactagttcaagcagggacataactccagtaaatctggggaagatgttaagttcacggtcaataattacttaattagatgagttctaagctcctgagcagagataggctagttattcagttagatgaattatgtttgttcctcgagtaattaggtagaaggtgtttggctagttcagctaggttagctgattagttagttcagacagtgttagcctaagagtccaagtcagcatgttgcctaatcattcaacttttgggccaagttattgtggatgatgtgtttggacaattatggagaattaatcctgcgtcaagaatgccagcaagaaccagaacatcattatctccctcctcattcctgcacatggcttatggcaagtcgagcacattctattgccgctcgttttttgttctaatctttccagagtttaacaggaagctgaatttcgaataagatcaataccataattttttctgtcgcagaccagccagcacagcataacgccaccaagcacggcaatccactttaactggcacaataggccgtaaatgggacacgtcaacacgtgtcctgaaccttgaaaatgtttccaacagtttaatgccatcataatactgggcctggtgcaatagtgtaaagagagtaagcacttggtcaatttcacaatttaactgatggagaaggcacaattccaaggtacctcagtaacagttagtgaaacatcactaagaacaagtgatgctttctctaaagggatatctggaccccctctctcctgctttccaagtcgtttgtagttaagagttccatttatagggtaaactaaatagttcctattcattgcccaaacagaattgccagaatgatcatcaatgccatcttgaaatatctgtgggagatcattctaggataagaagcagcgaacaggtactgaagaatgaagttgttatgaaagacaaatatataacctcgccccattcagtaggatttagatcttcccatttcttagcaagcttccacgcgctgctgtcagaatcatggtagatggctagcctatgcagttcgaccgactaaataagggccaaaaaagaacataaatgcattggttataaataaagataataataataataaagcaaaagcagatgatcagatggggaataaactaaaagaatatcggagtttatgaaccaattgattattaatattgtgtttgtgaacttgtgatataatctgtccaaacaagctcaaaaaatggcaaaaggccaacaatagcttcacaagtatcacataagcaagcattcagaagaaaagaaaaaggtccaagagcacaataacaatgataaacaaaacataaacctggtgaaaggccaaccaaatttagttccaatgtacaccatatcgctgtagaaccatggtatataaggaggtattacagaattttactcaagtcttgatgaacattatctaacccttattttaatttgatcaatcagcgcttgaattttgacaccaccatgttcatgttagattccctatatattccctcaatcttaataacatttgggacctccttcggtcatcccggcaaaaaagatgccctatataaaaccatgcagaagggcagaaaatggtcgaatgtctcaggatcagtaacaagctaggcataacagagctggagtttaagttgaagttggaaccaagaaaaagagaatggcaatatgttggaacttataatgatatatggctcttaatagttctactagtagcatttacgcatgatgatccactgatccacctcagttttgttactaatttatcacatgatgatggactacagcagcgcaaccttaatactgggatcatattaaaaccctcggtggctcaaagggagcagattatgcattgagatgttacatttcttcgctatttttttgacaaggctttcttccctgatttctcatagttgtagctacgatttgccaattccaccattattttttccactcaagttctttcacttagatctagaaaatcaattcaatacattcacttgcagctttgatcattagaattaattgcaatatattctagtaaatacaatattatagggttagttttaactaaatatttgtgtgcagttctgtactggtggttgaaagtcaaaaggtgcacgggttctaaaccatactccctccatactcataaaggaagtcgtttaggacagcgacacggtctccaaaacacaactttgacttcttgtttctataaaaatatttattgaaaagtgatatatatatacttttatgaaagtatttttcaagacaaatctattcatataatttttacattttcaaactcaacaacttgagagttatttatgatttatattcccaaggtttgacttaaacattgtcctaaacgacttcctttatgagtacggagggagtaccaatttagggacagaggagcatttatctcaaagtctaaataacaattgtatgctgatcatatgctatggccaggtaaccaagaggcaatctacatacctttgcataggagatgagatgcctatcgaggcaggttaaaaaataacagaacatacagttaaatgttacataaatttgttctcaccttccgcagcttatctaatgctacaccagcatcaaatgtctcgttaccgtcttcgtcgactgtaacggctgcaagtcttgacaacgtgaagccagatgcaaatggatgcccagaattgctggtagaaaaacaaagaataaatttacggaagacattgggataaaagaaagactaaaaaagtgtgcaaatgacttagcatacctgacagaatcttcatatctgatatgcacgttgctgatggtgactttaaggtttccaataattgttgatattaaattgtatagccatgaattactccctggtacctgcagcatccaacaagcactatcaaaaaacaagcaacaaaaatgtgtgtaatccatattaaacaatcgaacagacaaataagagaaatgacagaaaccataataggtattaaaaacagtaatggacatccagaaacaccaaaacccaacttgaactttcacagctaaccttttagaactattgacctacaaagtttaagacaaagtgcatgttcagatgctataatactttaaacctgtactatatgataaaacttagtgtcatggagtcaaaggataatccaaaaaaaaaaagttgtttttttcccatcatcacagttagagctacagacagaacaataacttcaaatggacaaatatccccaggaccacaattttgttttccactaaaacagcatgctttcatggaatcgactataatcaagtcatcaattagtcattaatgtgtagtcacccgctggcagacaaatagcaccataaccacaacttcaagtaagtcaggacaatggactaaaagtaacaggctagcttcagctggacaggagaatcgctgccttggcatgcaagagcagccagatagagtgacaacaaaggagcaagatcaaattcgaattgtcttcacaaaattatcctcccgggtaacactatttatttgttttaagttatgacaaaaagaaattgagataaacaataaattcttccatcaaatcattaggaaggcaagcaatgaacaggaaatattcttacatcaaaggtataggtacttcaatatttatcaaatttaaaaatacaacctaaataaaaaacacgtctgagctagaatatttagccattaatgaatgaatgaatgaatgaatgaatgaatagggaaattggaaagaattggcacacggtcaattaacaggagagctccagcaatattgtttatgaaaaaagaaattaatatcaaaggccatcaacctgaccatacactcgaatgtaatattacaacttcaagaagaaacatgatatccatctatgggcacctaaaattgctctaatattgtgcctcaagaagtttgtttttatatgattatgattgcacttgttgacatcatcttttactcttataaaatgaggtgaggtgatggtgtattcaacatgtcactgatatatgtagcatgactttcatgtttgcatgctcttttgtaatatttgtattctttgcaagtgcatatatattcactgattgattcagcatatgttttgcattttgatcttcagactatagggcacttttttttggcatccattacaatggggaagtatgatgtaatttccaaatgtcataactgttcacaactatcagagtattgcttgccagaatatcgaaatagaatactagaattaagctttgtgagagaaacaggagaaaaaaatcatacaggtcctcctttcgagctcctacttgttgcttcaagagttgctgcctctgcagcctgcggataagaccattagagcttgagctttgcataaagatgatcgtgagcattatctttgaggggaagcagagaaataaaataggtgaagcagaagataaaagcaagaaaacaataaaagtaaaaatctggttcataaagctataattccatataatgattgctaaagcatataatgcaaatatgtggaacagtttcaactctcgtatgattgcattacagatcactatgaaacatttgactcttggaggtcagctctcacctcagtcccatctgacctaaattaacctaaatgatacacactcgtcacttgaatgtaccacacattgcatgactacttttacaaacactattgtattgtaccagctcctggaagccaataaaattgcaatttctcacttgcaaattgtgcataaaaagttcagtgctccatgtttaattttttttcctcgaacatgcaggagagctgtgtatcattgtatcaaaagaagaaaccaggatataaagccttataaaacccgccacacacaccacactgagactgttgaagttgcatccgtacccgagactaacaagcaccagacaaccttggccaacatttctgctttgcaaatgccgtataatatatgttaattaaagaataaattgagccataggtacaacagatcgtgctgtgggtgcacataggccatataatttgatgtttgctccccttagtcacctttcttgttttaagcggagcattcagcacaaaatattaccctgtgacaatgaaacgcacaagtagcattgactcacccatctctttatgtgtcccgctctcagattcaccctcctttctctttgttttctctctatcccgatattgaaaataaatgtgatattatgtttttacctttctgttctgcaaatacatatgcacagttgatgcttatgaccttaagttaccatgaccatgaatgattacaaggcagcacaatgcatgtttcggccatgtgttaggtttttattaccctagtgtgcaccacctaagcaagctcagtgattcaaatgagcaattctcaagcgttgcagcctgcatgcactcaccacccacaagtagtattataactgcattttactcgatacaagtgctatgtttcatatacagtgaatagtcaacacatagtcttgtacgcacttcttgtttccttctgttcaaataaattcggagatagctatattttgtaaagaaaaggtttataaatgtacttgaaaggagtttggaggaagctgcataacctggtttgtggtcaagcggaaccaagtttaaaataggtgatctgaccacccaactaacatctaacatgatctcacaagtcacaacaaaagaatgaacagaaaacaaatattatacattaagcacctaacaaataaacaatatcatggtgaaaatattgctctgctacatcaattaggcatgttgatttcatcaggtggtcaaatacataaaaaaaggaggtacactaccaagtacaagtgcctacaaaacatacattatgatgaatacccattccttacaagaacacattcaatttaaggttatttaacttatttcaaattaaccaaattgtctcgaatggaaaaataacaaaaaatcagagttttagttccatcataccaacctattgaagtagagcctaaagtaattaaaaaatgccccacatataattgtatttcattattatggtgatcaaatattcctacagtggtactgtcaaaaataaatacttccaaaactatacttctgaacctactagtctacaagagaccttatgaaatggagcaattaaaaccaacaaacattttcctcggatatggagaactttcagaggtattgacttcttgttaacaacatatagtctcaaatttaactaataatagatagttctattgactgttcaaacaagggggtaaaaaactcatgagagaagttgcaaacaaacctcaatctgctgaagttttgcttcaaaaagtttctctctatcttcttcctaacacaaaaatgtgaaaaatattaagaataagggacaaagaatgacatgcatagaatagaaatggcatcaccaataacacaataccaaattatagttacataccttcagagtctgtccatcaggggcaggatgagcaagaacaaacagacgatcaataagaacaataactggctctttacccaagcttttccatggaacctattaaaaatcaatattttttgtgtgtgaacaattaacaggtacaagataaacaaatacagtagcaaacttgatattataagctgcaggcagcaaaatcatgttcagcaattcaaccacaggatgttatcatttgctatcctgccaaaccaaaaacatacaacacaactatttgtttccgttttaaaatgcttcccaatgtacccattagatgaaaagaatgtaactgtacattcatcaataaagctagttgctgatggttccttttatgaatccttaaataaagttttactaaggtttgaggcccatttcaactgtataacacaagaagtgattgactatgtaaggttgctgctgtgaatgatttggtttgctggccaatctgaaacttgaatgttcatggaatcctctatctgtgcttcctccctaggaagcctcaaaatttactgccgtgtcctttgttctcactgtttggtactttctatcaatgaggttctttgctgtggagctgttgccagagagaaaaatgagcgctgcttcattagaaccaagaagctaggggttaagttgtctgtgcgcatattcacatatacctcattttgatgcttcctgatgtttagttaaagcaacataggaaattatttgcggctatgtttagttaaattgcatgattctagtattctgctagtttttccatgtcagaaaacttagggcaacataagtcaggctcagaaaacagaaaataacaagtacctttaaagttatggtgccaacaaacccagctttcactgttactggaagccgaagagaattcagtg

SEQ ID NO: 68974 - DNA, 1836 bp, Oryza sativa
tggtgttaggcgactcccactagttgttaaccaagtctgtaaggagtaccggtgctctgacccgcagatggacgcttacgtacgccaagtgcggcgtatggagcgccattttgacgggatagagcttcggcatgtgcccagacgggataacatgattgccgacgaactctcacggctcgcgtcctcgcgagcccagaccccaccgggcgcctttgaagaaaggcttacccagccgtcggcgcgacctgaccccctaggggagacgggtgtgcctgaccggcccccgaggcccgtcggagtccaggcctcgggacccgaagggagcgctccaagctcccttagattgattgcttggatcgctgagatccaagcatacctcacagataagactctacccgaggaccgcgaagggagtgaacgcgtccatcgcatatccaaacgctacgtgctggtagaagggaccctctatcggcgcgcgggtaatggaatcctcctgaagtgcattccacgggaacaaggcggtgagcttcttgctgatatccatgaaggggagtgcggagccccattccgcctcgggcaccttggttggcaaggcctttcgtcaaggattctattggccgacagctctcaatgacgcggtcgacctggtccggcgatgcagagcgtgtcagttccacgccaagcaaatccatcagccggcccaggccctgcagatcataccactttcatggccatttgctgtctgggggctcgatatcctgggaccgtttaggcgggccccgggcgggtttgagtacctgtatgtcgcgatcgacaagttcactaagtggcccgaggcttatccggtcatcaagatcgataagcactccgcacttaaattcattaagggcatcacggcccggtttggagtgcctaaccgtattattacggataacggcacccaattcactagtgaactcttcggcgactactgcgaagacatgggcatcaagctctgcttcgcctcacctgcccaccccagaagcaatggtcaagtggagcgcgccaatgcagaaatcctcaaaggccttaaaaccaagaccttcaatattctcaagaagcacggcgattcatggatcgaggagttgccagcggtgctctgggcgaaccgaaccacaccaagccgagcaaccggagagacgccttttttcctcgtctacggcgcagaagcggttctcccatccgagctcaccctgaggtctcctcgggccaccatgtactgcgaggctgatcaagatcagcttcgcagagatgacctcggctacttggaagaacgaaggcggcgtgcggccctccgagccgcacgctaccagcagagcctgcggcgctaccatcagcgccacgttcgggcccgatcactctgcgtcgacgacctcgtcttacgccgcgtccaaacgcgtgctggattgagcaagctctcaccaatgtgggagggtccgtatcgagtgatcggtgtcccccggccgggctcggtacggctggccacgggcgacggcacggagctgccaaacccgtggaacatcgaacaccttcgtcgcttctacccctaaaggggggggggtcgggtgtcagattttggctcgggccaaccccacacccccctcgggtgtgcaggattggccgggggctaccacacatgcacatatattccctttttccttatttcagcatttcaatagaagcagtttcaattttctaaaggttgtatctgtgccgtttttccttctgaagaattttaacttgaaataaaatcactcgtgctcaaccttgccctagggggctcggttcggtcagcta

SEQ ID NO: 68975 - DNA, 924 bp, Oryza sativa
tgtatggtatgccttttggggggggagagatgtaatttatacccttgataaatcatccaaagcctaaaaacaatttagataatgcgaagaggtgcaatttacacccttgatgaatcatccaatgtgacggagcgtggggctcctcaccgggagaccgcacgggcccccctttgccggttcggccgggggctcagggtgagatcccaagctctctgtgtatgtggaaagatcgcgacctattgaaagagcatgaagcacaagcgatgtatacaggttcgggccgctgagaagcgtaacaccctactcctgtgttttggtggatctgtgtatcaaggagctacaaagtgtgagccaacctctcccttttcttctagctactgaatctggaaaaagtcatcccccttccctatgggcaaggtcctccttttatacttcaaggggataccacatgcacccctctctttccaaactggacttttcttctcttcataaatggacggagatttgcacggttgtcctccgaacatccttctgacgggacggcacacacctacctccacttctgccggaggcaggcgcgtcgtgggaacgtggctgtgtgctgacgacatgagcagtgtcagaccgatcacaaatcggtcattcttgtccaccacgcgtcagcttagcaacgtgcatgtttgcccttcttcacacaacatcttgcctgtaatggttaggatgaagcctggcatatatcgaccggggctaacgtgccatctctgggatgtaacacgctaactccagctggggacgagtgcctagaagctctcgtcttgacgggatggggcgaagcgtgcgtcagaccgcctgtcgccacctaacccgcgatttgaccggtctgtgactggtcacagaccggataaacgagtggagtgcactgta

SEQ ID NO: 68976 - DNA, 960 bp, Oryza sativa
ccaaaggataaagcatacatcggctagaggtccgatgtcataaaatccataagattagattgaacagtgaaatctttattgcaatcggctaaatccaaattgtatgtaatccttgtaagccgatacaacgtccagatacctcatcggctaaagccccgatgaaacccttattggcagtcaacaagcatgctagatattacgattctaagcatgacttaatagatcaaatttagttgatgcaacactaaatatgaaaagaaacataatatctggacaatcaagcctatggctgattttaagggtggtagatgtctaagttaatctaatctagcaacacaatttagccgatgccggcagaaaccctaaaacgagaagcagccaatagagctaaattgatatgctaagactagattaacagagacatctgataaataggtaggcaaatatatcatccaaactagagcaattcaagaggtcgaatgtactgatgcagccttgaacgatgccgacgtagacgagacaattgcctaggccggtggaacgttggacttatcccttcgctagagatcgaactgaactaatgcagccccgtgtcaggtgccaaattccactggaggataagtaaaaacctcggtaaagagggtggcgatgcgcttagagtagtattattgatcgtggagataatttacaatgacctgggtgtacatatttatacccatggggagtgttcgcggtatgtcatgagtcccttcgaccagacctaccgaaaccatgcaaccagcgaggattcaggcccaggacgctaagatcatttgggcgaagtcccatggcgaagactatgaagtagaaatcgcgaaggccgaagaatcgcgctggtatccggcaagaccaaatgcatcattgggcgaagggtgtatgccggaagatggggtcttcgccataacaagcccaactttgaag

SEQ ID NO: 68977 - DNA, 17054 bp, Oryza sativa
  unsure (1)..(17054): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttggtttgaataaatactttttggtcttgacaaagaaaaataattttagcttcttttcagggccagaagattcagatagaggcaagctgtttaacatgccagaataaaatagtaaacacaaacaggaacagaacatagaaataatgagaattgcttatgtacaattaattaacaggaggtgttcaattgtacataattattcgagagtattattcaaacaaaattgcatagaatctggcaaaaacattaaacttctcatacatgcaaccagatatgacttgcttattaattttttttcacgtgtcaatattcaccacacatccgctcctgcctaacagacatcggacaccgatacctctcaccatatctcgcaggcccacagcgctgggtaagtgtcaatgttggctgtgccaaggccattcgatgataacaatgcatgggccaagacgttataggaagcagttgatctgcctgcatcatcagcgcagaggcaagggatgcagcgaaactgggcaaaccaacagcgtgctggcggttctggtcttggtgggggacaacaccagatcaactcaactcttttttaagacacgtcatggaactgcctaaaatcaaaaacccaagtacagaggcctctagtggtcgccggtggcgaggtacgccatcatggttgacagatttggtggtggaattgttgtacgtgagcaggagggaagtagatatagaagattggaacgagatatgttcggtggggaaggagtaactacactatacttcgctcctttgttctttttttttttactttattcgagtaattagggtattgtaataaggaataataatatattgacatgtggttagaggagtgcatggcaggcgggcagcaagggatcctttgtgaatgaaactcatggtgtgaactcaatattgggcataaatgtaattcttgatcagttgaggaatcctgtttttagctttgttaagtctagcaaaggctaccgaaaaatactatcttcaactcacaaaaaggtttgctgatggttcacctacaggcgcaggcagacaaccaaggattgccggctggcagatcaaccagtgcttttaattgaaacaacacagctcgaaactaagggtaggtttatatcttattatcagttcgcatcacatatccagcacaaattggcccagcaatgccatagctcaaagaaactaagcacaacatttggctttgtagcctagcatgcatcaactgtcacacagaagtgccttatgtccttcaagctgggcaagctttcctgggcagttataggcaagctttcccacagaagtaagatttttattgtcgttagcaaactgctgtccttgctaagctaggataagatttctcttgcctaggatccaaacataccctaaaagatgtatgcttgaacttagttctagtaccacaaactagcacatcatgggcagatatagatacagcaagataagaggtgtcatgtggcatgcatgaaccgatgacaaagaactaagcacctattatttttctcgtgcaatgaaaatattgcatgctaattctaaaattcatttttttcagaaaaagaaaaaataggaacaggaacaggaacaggaacaatcaagtaaagctatgagagaaagcaatctctttttttcttgctcagcaccactccctccaccccaatatatagggtgtacctgtattttactcaaatcccacaatataagacggcatctcctcgacagccgtttattcgcatgcaagcatttaagttttgctcgtttccattcatatgcatgcaagcattcaagacatcacctcctcggcttccgtttacaagcatgcattattgctgattagtttgcttagggcacccacaatggttatctataggctctctataagagatccatgtcagcatattttcctacttagaagagattaaatgaagagagagagcaaagctatctactaacctggagatagtctatagagaaaaacgaggcaatgtattagagagctatagatacccatgtagacatactattgagatggtttactattattctagtctattgctgagatgtacatgttttatagatagcaccttactttaccattgcgggtgctcttagagcaagtttaatagtatagccaactactagctccaaatcatctatagtcaatttaatagccaattcgtacaatagttacatactacactattaatatatggtcctacttgtcatacacactgcgtcttggagtccgtgctacagctggctacaaatctgtagctcgctgctcttctctctcctcttttatctccttaaaatatgtttatagctggcttatagcctgctattgtacctgctcttagttaaaaggcctctctctcccagcaatacgtgggcgtggcctgctgggatacacactgtgaagatcaaggtccacggatgaagcaaaacttcacgtatcggggcgaacggaacagttgaaaatccttggtctgtgcgtctagagcaggtacgccctatataatgggatggagggagtatatgcttacggtgtaaacttgatttattctatggtaggtaggtaactaccaagataccttcatttccatttttatggtgatacatgtgtaataatatggaggctttacaaaaaacatggaggcacttaaatgtggacagtaacagaagcaattaatggctataactcacaacaaaaagatcagtttccacttttggtttctatttttgatgcaccaacaaccgttagctagggtgagcatccatacatacagaattaatctcgattaacctagcagctagagagcagagcagagagacacacatcagcataacactagcaaatatcgtgagttcgcgaccaaaccctagaagccccaatttatccccccctaaccctacaagtcccgattcccctttggaagtctgtgggcgaggagggattcgaacccccgacaccgtggtctcgtagccacgtgctctaatcctctgagctacaggcccgccggaaatctccaccggatctctacccgtggaagacgaagctcgataagcaatccccataaactcacctacgcagtaccaatcgcaataatcccaaccccaatcgacgaaaccgtttcatgataaggcgacctgttcgctcgaaaccctagaaattgaatcagacccccccccccccaaccccactccacgaaaccaccaccacaccgaaattgcctagcggaacgaggacaaggaaacgagtagcgaaccaacctgatggcagcctcagcgccaccccgggatacggcggccgggctgtacggacccccaccctccccgcgcaaaatccctctcgcttcggggttaggaggcagatcgagacggaggagagacctcaggacctcaagccctacctccgccgcgcgccgccgccgccgccgcagccgcgcttcccccttctcttcgccggcgagagaggcggtggtggtggtggggaaggggaaaaaaaaaagaggagtgcgtggttgtggtggctagggttttaacgcgacggggtcggaactcggaagaggaaagaggaagcccttgacccggtccggctcgaaccgtctggctggctggctccgcggggtgctcgggacgctgacgcgcggggcccacatgggggttgcgggggagaggtgtggggcccacctggcagagggagggtggggggcgcactcgataagcttttctctctctctttctttctttcttccttcccctcccgaagattttgctcgctttctccaacctctcctccgctccgaagcggaggtcggcggcggtggcggcggcggcggcgcgtttccccggcgagtaaggtgaccggctgctcctcccgcacttcctacgcctcgttccgtcgctacagtagcggaggagggcctgcaatctcagatcaggggtacctgtaacccgtttcggttcttggtgggtgggttggtggtggtggttcttgatccatccatccagcggttttggtgcatctgtgcgagttccatggtctaggttttttttttcttttagcatttcgtagtacgtggcccgtggtagatggcttgggggagtgcaatgaaatgctgtgggaaattagcgtgcgtttagcacatagcatctgttcttagtactgttttttttctggatatgttgtggccttgagggtatagattgttgttaatttcgatcactgaatgtgtggcagcgattaatagagtgccatgggataaactttcatggaagtagagtggttcctttttttttctcttttcattgtgctggagcatcatgatggggctaagatcggatgtttttctggttgtggttatgcttgaatgtgcgggtcttctcttggtttttcaatggtctgaaaatgtgggctttgtgctggactgtttgagattttgtgtgctatctttacacggtgatttttcataaggctgaagctgtaaagccgaatgtcgattcttatgatcggcaatataatttatagggtgcactagatctaggagagatggagacaattgtttatactggttcagaccctcgacgtgagataataccctagtccagatgagtggattagatctgtattggagtgcgcagcacggcgtaggaatagcacgtggcgcttatggaagaatgagggtttcccggtgctccttatataggtgcggaggcaaccggctagatatggtagtgtagccttcataatccgggtacctaccatctatttacaagggataggattggccaacttatcccttatctctttcttagtttacaagttaaccatgtgggcctagggcactcggcccacctcatgccgcatggcccaaaacgccttgctatgggtatctgggtaccatgtaccccacactgaactgaactgaaatccatacacacttaataacaactggagctatttttttaaagtgtatcctggaacatttattgaaaataaatagttagaatatttttttctaatttatttgctggatagctagacagatattaggatgagaagggattagcattggtagatctcaactatcaattacttaggggtaaaattcataagccaatgactctgtcaaaacctctctgccactgtttacatttcttaataaaataataagagtacaatactgaagaatgtaaaaaggaaacactagaaatggatgatatttgtttttcctgctttcctttttttacccctttccttgtgttaagcgatcgaccttactatatactcttgcattttgtcattattacatggaaatatcaccataatgtagtatgatttagtgcatggcttcctattttactacatgatcttcatttgccgacagttgaggtacatagaactgccctcacatgctattttttcaagcatcacggcatcccccttttttctttgatgtgagcatcacgacattcttatccaccagactaccactagcatttatttactattagaacaggctgaacagaagccaccatattctctatcaagggctagaaattacaacgttatcaaataaaaggagaaatatcgtcactgttcatcaggatgagctcagattataatggtgaagatttattggatatattttagagctttctttactatacctgtatgaaagttacaattgtgtttctagaaataaacctaagagttatatagcaaatgcatttctactttcaatagactataatctagccctgcaaattgcatgaagaatccggctatctctttattacaagagatactgcacacttttgtgtggttagttcttatatccagctattagattggcagtaagcagaaaaataattcaacagactacctgaattcgtttgctcttgactctctttgtgctgacaactatcattatcttagcaaaatatagtaaaaaattgaacttgtcaaaataattggtcataaatggtgtgcgtgaatttacttatcatcagctatcactgatatcgtaaacaagtatgagagagcacttttttgtttttgcttcattatttatggactttgttgttctggttgtgttgatagttccttttttacacactgttttattaagtattatccacacaagttacaactgccctttttctttttttccttttttgtttaacaatggaccaagcatcatagaacaattaccttattgtccctcttatgttttccaggagaaatggaccttgcatctcaaggtgtggtaacacaacaacaaaaaccaagtggacggagaccggttggaagctcacaaatctggacggtatgtagctgcttctccctttgttttcacttggccatcgtgaacaaaattacatgcagacactcaattttccacagcgatatggtgttctgcttcccagccagcagacacggaagctaaaagaatgggttctaactgacgaacagcaacaactagttaatgctagtggtcttggacatcttgccctcaccacaggatttactattgatcgttctttgcttacagccttttgtgagagatggaacaatgaaacaaatactgcacatttcatgggatttgaaatggccccatcactccgtgatgtttcatatattcttggaattccagtgactggtcatgtggtgactgctgagccaattggtgatgaagctgtgaggcggatgtgtttgcatttcttaggagagagccctggaaatggagagcaactgtgtggcttaatcagattgacatggttgtacaggaaatttcatcaattgccagaaaatccaactatcaacgagattgcttacagcacccgggcataccttctttaccttgttggctccaccttatttcctgacacgatgaggggatttgtatcaccaagatatttacctcttctggctgattttagaaagatacgtgaatatgcctggggatctgcagcccttgctcatttgtacagaggactatctgttgctgtaacaccgaatgctactacccagtttctcggcagtgcaactttgctcatggtactgttcttgtttgaataaatttgaatgattgtcgatgatatttggtatctttgttaatgagatttattttgttctctcaaggcttggatttatgaatatcttccattaactcaaccccaacaaaagaatcagaacaccttgctgccccgggcctgtcgatggaactttggaggagcaacgcgtggacagagaaagaaagtcatggaatggagaaaagttttcgatgagcttcaattttctgatgcaagtgcaagtctacctattttatagatttataacaaagattttaactgctgttgtgttattttatattaattaattatattttcaggtcaactggaatccttacaaggacatgaatcctgcaattattccagaatattgcattgcagcagataacatctgctattctcggacatggctaatcagctttaacataaaagaggtgtatgtacctgatcggttttctaggcagtttgggagggaacaaggtcgcctccatggggtgcccatgtgggcaagaagaacttggagcaagtggaaggactggagggttgagtatgctcgtgaaatcgaggagttccatcaattggttggctgtcgtttcactcctgcagaaaccaatatcaactccctcccaattgagtctataactaaacaagatgctgcaggatgtagtcggagcacatctcagaacttctcttcaatggtaagctacaaataagaagctaatccttcatatgtttttgcttgcatagtggtccttattgtaattgctgtttgtgagatgcaggttgaagatctgaggaatgattttccagtaattgatcgttacctggagggacagttactccctgtggaagttgcaagctttctagagagagtgggtatgatgatcaagagttactccccaccacagagtagccgaaagaaagatcaagcagggcagggccaggacagcaatgtcaggtcaaagaacccaagaaagagggggaagccgtcattctttcaagatccttcaagccctccgaactcaagggcggaccgattcccagccgtgctgataccttatcaggatagcaagtgcgacatggttctggatggcaccgtccctctgctcgatggagcggaggagttcaaggaacaaggggtcatggacctctggcagaactcccacctgacgacgccgtcctgttcctcgctggactcgagctcgccggaatcaaggaagcggaggcagcaagaccgcgacgaaatccggctccccagggacaccgagaacctccgaaggagcgggcgtctctgtgtgcagctgaaaatgttcaagcacagggacggggtgggagccgaggcgaccaacccgatcttcctctgatcatccatggtttatgtacaaagtagcagaaaaacttgggctgctgacagttaactggtttatgtagcgtcgtagactttttgctggtagcgccttgccattcactgcgcagagcttgcaagctttatctccttgttaatactatctctctctagtctctaccatgtagttgggcaaaatgtagatgatgccaccaagacccttttaactgtgttgctcgtgaactggattgtgccctctcccgtttaatctgcagctcttgcaacatggtgaattggtgattttataatgatgctaagctttgactgcttgtagaatgatccaagtagagatgtagagagcctactgtgctatcacatcaattcatcagccttgtacgcttggattgtttgttgcaccagctactcctgctgctgttgatcctaaaaccagcttattgatatgctggcagtgcaccattgaaggctcctatagccatatttggcgaggcagtggctagccgaggacagtgttaccatgtgatcagtgatcattctacatgggaaagctaccagtgatgagagcgccacgtttcgccctagcagcgacctctggcacggggggccccacacgtcagcggtggaggcaaggcaaccacgaaggcaatcgccatcgcctgccctttcattgcccaaccaacgctcgcctgcatagaagaagctcttcgccttctttgctgtgctcttgttgcctctcgctcgctgctgcggctactcattgatcctggttagtttgctctctcttttctatcactctcatcgtgtgatatgatatgccagtatttttttttccttgcatctccttcgttcatggtgaatcccggatcgctttgtttgctcctgcattttggtattctttcatcatttcatccttgtgcttatgactgggaatcgcctgtgtggggtgtgtgtttctgttttcctgctgaatttttcaactgctatggatggtctccagcttctgtgtaagggttccatctcatctatggtcttcagttttttttttctcctttcccctttgttttctgtcccgatttccatatttgtggttgggttttagaggatagcggtcaattttattttgctcttcctagtcagttttagaaggaaatggatggttatcggatgtatttcttcgatattttgttccccctcttttgtgtgatgttttctatgattaaaatggtataccatcttcttgatcaagtgtatactcgttaatttagtgctggtattcttcctcatctgctgcaatattttaagatgatggaaatggctgctgttaggcgcacaaccaacttcatctacgtcatttcgattcaattttcctccagattttgtttctttatttttacagttgattagatgagtagttcagttcctgtttcacaacgtatcttttttgttcaggtaaactttgatggtttcttggctggttgctgctgtccttttgtaccttgtatgtggccaatcctggcattttgctttctccttattctgaagaaaatttaaagcagttgttcctagtgcttttgctctttgtggttgcagttctcttcctcttaagggtagagctcacgtcatctgtttaaaaacttctacagttttttggtgaactttagtgaatcaaacctggtatctacagtttttcccagccttattatcatcatgcctgatatatacagtccttttgattaccaatgtcaaagtttccagattctgtgctagttaattttttcatttccttgaggggaacaaagtctcaattacatgttcagttgctcatataagcaatagaccgctcattgaggacttgttaagttgttatcaaacttatgcaaattcttgccgtacttaacctggatgcttaaactgaaatttctctgcgagcaattcttggattgtatgcacacttaccacataacattccttctcttaatggaaccagatggaatccgcagaggcagaaccaacaaacaaaagcgtcattcaggtaattattatttatcaacaacgagcaagcgacaccaatttgctgaaccttcctttggctcttgtgatatatagtttgtacctaaatcataacattttgatgctcaaacatacagggaacccatgaactaaccgtatgccagacgacggagagactcgacacatggaagctgaatgagcagcagcaacaattggtcgatgcaagcgggctcggcaacctgatacacacagcaggcctagtcatcgatcgcatcgcgctcatggcattcttcgaactgtggagcaaggagaccaacactgctcagctcaatggctttgaaatggcaccctcactcagggacgccgcctacatactggggattccggtgacaggccgtgtggtgacaaccggagctgtgctcaacaagtcggtcgaagacctctgcttccagtatctggggcaagtgcctgattgcagggactgcaggggcagccatgtgaagctctcttggctgcaatccaagtttagccggatcccggaacgccccaccaatgatcagaccatgtatggcaccagggcatatctcctgttcttgattggatcagccttacttccagagagggacaggggctatgtctcaccaaagtatttgccacttctgtcagactttgacaaggtacaggaatatgcttggggtgctgctgctcttgctcatctctacaaggctctctccatcgccgtggcccattctgccagaaaaaggctattcggtagcgcggctttgctcatggtatgtttaacaaaaccattgtataggaaaatatcacttgaatttcgagtaggaaatgatcttccagttctatgaaactatcaaaaaactattttgattgttatgatctgttcatgttttctgaaaaggattaatgaacttcaacatgagaattgtaattgatagtaaggcataaagatgataggaaataacaaaattctccatttttgtttctcacaaaattttaccttacagaccaagtttgtgacttgtgccttcactgtgtccattgcgaaaatgttctgatatattctgaatatctgtctgtagggctggatatatgagtatattccggcattgcgccctgacatgtatgatcctccagaacacatcttcccacgagtactcaagtggacagggagcacgatctctcaaccggccaagaacgtttcagacatcaggaaagccttcggcctgcttcaagtttctgatgtaaaagtctatccatctgagttgtgattctcatcagtcatcaccacagttttgtgttcagcatttcatcctttcccttgccatttgatttgagaccatatgatgatatgaacaacaacttcaggtcaactgggagccctacaagggcgttgatcctgcatccattccgaagcattgcgctgctccggataacctctgcttctccagaacatggctggtcagcttcaacctcaaggaaatctacgccccggaccggttcgctcgccagtttgggcaagaacagcatcgcccgctcaacgatgtccccgcgttccagcggcagctgtggaacccggcagtggactggagcctgatgtacgcttcagagatcgaacggttccagcagctgatcaacgctgcagatggtggtgatcatggtcatacagcagatgccgccgccgccgccgccgcagatgttttcactccggcgaccatggcgcgagcttcccttgggctcagcctgatatccgtggtaaaactacctgtcggtgaaacacttttaatcacttaggtggacatctacccttttgctacatactatcaactaaatggttataaaaaaattaaaaaaaaaataacaaggtagattcatatgtaataatatgttatcctacaaatatgcaagctcaaattttacttatttaaattgtaataaaagtagcaaattaaattttaattagtatagatatattcgcaattaactttgttatcattgttacaacttacagaagtcgaatttgctggcatgtttgttatcaatctatcttgtcattttttttaaaaaaatcatagtcatatagctaacgtataataaacgtgtggacatgcaccgagtgattagattagaatccatctccctaacactcgtgctgaggaagctgtcacattgacgtgagcgtgtcatcgcggttcagttcgggtgattgcatcgtgcgtttcgttgttgtgatcgattggatcggttcatgcaggtggagggcgtcagggaggagctcccgaccgtcgcgcggtttctggagcaacaccgcctccccgccgagctggcgacgtccctgtccaggatccgcggtctcatcgaggcctcccctcctgctccgccgcttaagcgaggcgacgccgcgccacagccccagccccaggtgatcgcggtgatccctcccctggctgtgatgccaccgcgcgagcaggaagcgccgcatggcacgggggacgcggaggctccggggatcgtgcgcggcgacgccgacgacgacgacgccgtgccgccgaaggagcggtctgatgagcagcagcagcaggatgaggaggaggaggaggaggaggagcagaagtggcggcggcggcggcggcgggaggaggaggacggggcggcgaagggatcaggcggcggcggcggcgcggtgcggcggagcagccggagctgcgtgcaggcgaagaggttcaggcgcgtgggagggaagggctcgcagtcgtccgaccccatcgtgctgtgaatctgcggccgctgctctcatcagctttgctactagcctaccagtagtgctacctttgcagtgaactacggttgtgttcggtgtccatgtgtcatgtgtgttaggcttaggcagacggtcgaagagctctggtactggtacttactcctatgtatgtcgttgatcgttgaattcaggttatgtagcatttgatttgactactatggatttgatgactacgctagatttaaaaataaaataagcattgaatttaaatgctactccctctgtcccaaaataaaccaacttcgtactaggacgtgagacatcatgttcatttatactaggatgcgtcatattctattatgaggttagtttattttgggatggagggagtagtttgctagcgaatctcataagaatctaaaacattgtgggcttgatcgaccgggattgttgttgcgactgcatcaattgaacaccgtggtaggttatagctatttttcaactgttgcaggaacaatagttgttgataacacctgataattcaaaagatgatgtgtttgaatgactaacagaaaaataatatttgaatttggattgattctaaaggagagagagacagagagaagacgcaattgacttcttaagagcatatacaataagatgaatcagcaggctccaaaaactttaatgtcatcatattcctaggtggagggggagataattaaggaaagagaagagagcgagctataaatctggcaccgggcggtagcacaacttcacatgtcaaacaacttgcatgcagccagtactagcgattaaaaacatgttttgtgggtcccacatcacccccatttgatcccatgtgcttcgtctcacttcgcccttgtgccagatccacatgtggcgcacacaagatgggtgcccctgatgtgcgccatcctcttcgctcctctggcgtacgaaaaaaaaaaaatcgttgcctcggcttcagtagatcgacgttggacgcccgccctctcacaccgacaccggtcgtcccagctggcagttcaatgtcgctccagtcgatcccgacctccgtcattgctgtcaacaccggggcggcctcaaacccaaacccaatcaccacgccgccttgcccaacgtcacacctgtatccccccacactgtcgtgatggccggcatcgtggctctcgccttcccacatatatagctcactcgttcttgccattcttcttctagtgtgggtgtaggtgactgatcgatcaagttgctacttttcaccgtgctaactagcttctcggtcaaatagggcgacgactttagtgtggatggtggtggccacaatccctcatgttactcttccaccacagccaataagagctccactagtggtagtcatcggcactcacctacgctcgctcgttcattccggcaccccgtccgcggccggggcccacgctcgctcgttcattccggcaccccgtccgcagccggggcccatctcccgcgtcttgcagctacacaagatgtggaagagaaaacatcacaaagaaaaagtagaggatatgtttatactaggaaagctgagattagaaaaagaaaagcaatcaaaggaaaaaataaaaatgaggtttgaggtcatgggttaaattcatatggaattaacgtataggaatgtgattcaaaggaatttccatacttcaatcttacgttaacaacctagataagaaaaaattctaaggatttggattctcaaaattcatatgaaaattctttaatccaaaggtgccttaagtttgttgtatctcctcaactctttttcccttgagagggagttattttatacggttgtaatcacattaacgctgttgtacgatatacacgcacgtatgtgtcgtgcgtgtaatttacacacatttaaatattgtttgaggcacatgtactcacctaccaaacatgcatttgtgtaattactcaaagattattgatatataccggtggtaaatcggatttgaatctttataagctagatgcacaaccacgatatatagacatgaagtcatgtaatcacatcttagcttttgagtccatctcaacttgtatttggaattgttgtttgcttaccaccttataggatggattggaaaatagaaatccatcattgaaggtgcaatttatgtccagccacaaaaggaggaccattgtacaattcaaaattcaatccaactactcagtatctaaaggggttgatgataagtcagcttcactttttctttatctttgcttgaaatggtttagtttggttcatttttttttctatacaattagttgagaccaaattcagaaaggagctaaagaaccgatccagtcaaaaaatcaacaaatcttaatttgattaaaggaaatgttgttactagagcatttttaaaccaaaccaccgatcgagctagccaatcttcttcatataattttaatggatttttgtacaagcactttcggggggcaagccacctatgcctcctggtatgctaatgtttaaaatatactaatatacacattgaataattttttagagcctccatctaatatcgaacttttatactgcaagtgtaagttgtaaatttgcaagaggtagtttgagtcaaagtcacctctaattccccttaggtttggttgattatggtatttttaccaatgttcattttgaaccacccatatttaacgatattacttcaagctgtgtatgtttgtcaattttatactatgatcatccttaatccatctctcttctctaactccaattatgcagcaccaccaccatcatttacatctcatcacctcccctaagatcaagtttaatctactcatcacctcccctaagatcaagttcaagatctacctataccatacttgtagctcgagcgtctctgccagtgccacccaaggcttgagctcaagcttctccatagaggaaagcaacgacggttctcgaattttgcagccgagagtctccacaaattatggtgttgccatgttgttcctatttaattcttagatccagctggttggagttcgaaaaaggttgctgccatcctactcgcctccacatgagacatcggcgctatccacccacccatatctgtttagttggagttagagatggttgcaccacattgctcatgcttcttcatgagcttgtcattgccatcttacatttctactcatctgtcctccaaatccgctccatgcactaagattaacgacatcgatacgaccctgagctcgatctctatttgcattgcctagagtgccatctcaagctcgagctccatttatcttcaccaatgctcttgtggctcatgagtttgacttacttcttttttgacgcattttattgctgagttgctagtaggcatgatggacaaacataattaggagagaccgccactttatccatcaagctttaagcggtggaagtgggaaaccgaagttgaagaaaa

SEQ ID NO: 68978 - DNA, 1208 bp, Oryza sativa
cgagttcgaccgccccctgggcgaggtccctcgaggatgacttgatggtcttctcgagctcctcggggagtcgttcgaggacccaggccatcctgttgaggtgcggagcgaggccttccaggttgctagggcgcgtcctcgtctggcctttccagaggcccgcttgccgaccggcgcgatccatgcgggagaccgagtcccaaagcatgtcgggccccatctcgcccgccaagcggagggcctcggcctccccgatggaagaatccagcgcgcgctgcatgtcagcgacggtgtgttcggcagccgcgaggcgagcggctaagtcgctttcgcccgcagccgccccaccgatgcgcgccctcgcggccagctctttctcccgtgcctcgaggttggcagcccgctgctccagcgcggctctctcggcacggacgcattcaaggttgcggcgcgcctgctcctcttgcgccgcctcgtgatgaaccctgagttcctctcgacactcaaggttgttgttggcccgatctttcggtgagttgatgaaaactacgatttggaagaaacgttgacgacccgactacaaccgtacaagacgttgcgttgcgccttagcgatcgatacacctctccgtgggttgttgatcttgccggtgcaaatcaaccttattcctgcaagcaaatcgaagaaacaagcaagaacaagataaaagcaatctgaattgcaaataggagttaaatacgaatgataagttggggttccgaagaacaagcagacggacggtctagccgacacgcgcgctgcaagcaagtagcaatggctaaactttaatctaacaaaacccaagaaaccctgaaggggtacctaactatttatagaggtgggaggacgaccaagagggtccaagggtcgtgctccaccagattggggcgcaccccacatgggcctcacatgggccagggtcccaaacaaagttacaagcccattggcccaatacaggagacgcagcaccttggttttgtgattgcggccaaacgagatagatttccgagatgaggctggatccgttggaaggaggacttcgagagctttccatcaagtactcacgggcccaaaacggagcacgtatgtagatttggcggccgtttgaagtcagcaatgtaacacgtggccgaatcagattgcagcacatggaggacttgatcttgatg

SEQ ID NO: 68979 - DNA, 1483 bp, Oryza sativa
cgctgaggggaagtagcacctgtatgctggattggggagaccgtgcactgccccgatggccggtggtgccctgaacggaggacccgcgacgccctaaatcatcgatgggacgccaggccctgggtggaggatcgccagcgcgctggatggacggaaggacggaagggaagacggggggaggagggggggtgctgaacggaggggatggcagaggcggcacgagcgaggagatgacgcggaggagaccggcgcagagtagaccgccgaggctgccgacggtgttcttgcggtggagataggggacggcgaggtgggcgacgattcgcggcggtcccgagcgggtggagacggcggagaaagacccgagcgacgaatacggtggtggcggcacgggacagcggtgcgtcggcccggccctgagcagcggaacgatggcggcggtggcgagacggacccgagccgcaagcttcgtggggggcggagacggcgcatggtggctgacgggtcagacggcgaagagagggcgcggtggggtgagggaggtgggagcgacgtgggccgttggattgatacggagggagctgcaggagaggcgcgatctgcgtgggagcaccggtgccatcggatgtaattcatcgggtggttttagatagttggatgtgtcacataatgaatatgaactatatggtagattggatatttcggatctctatattttaccttgagtttagagtatatttattgctcattgatagtttgcatcgctaggagtaatctatttttggttaagtaaattctgaatagcatgaaactaatttcaccttgaccttaaattctgctaaataattttgagcccattatgtatgaagatggatgggtactagattaactttctataggcaaacgatcaaatcatgcctaatctcacagccacgatgtctcgtccctctcgtcgaactttccgccgcctcatctcacaaccacgacggaggcgtttcgttgtccagcgttttgtgtgttcatgcggtggccgcttgatggctgccatcggcttccatgtgcgttacgcggctatatttgcatgcatgagcggctggtttgaaattcagtttccgatatctttcgctttggttcgacgtcaattatagacggtgatgtgtgtaagttctaatcagtagaatgattggactctaattttgagaatttgtttttcactactagaaaaggcatttttggaggcggccaaaactcatttttgcaggcgagagagaggtccgcctgcaccacgacgactgcgcagttggggcaacggcccgcctgcgaaaataaaaggaacgaacaaaagaaaatcgcgccaggagccgccgccgccgccgccgcccggcccgcgcccgcaccgcccggactgcacccgtcgccgctccatgccgccgccgccgcccggacagcgccgtcgccgccgccgtcggcctcccccctccct

SEQ ID NO: 68980 - DNA, 3958 bp, Oryza sativa
attctataggtttgacaaggaactgcataaggaagttgcaataaaagttatcgatttagaagaagcgtgagtctcttcactgaagttccctctgactccttatttaccatattatatcaggttttatggcatataagccaacatgtttcttgccatttgcaatcatgatatcctttttttattggcttattgcaagaagaaaaggtgtattgtgtactggtgctaatatatttcttgtaccagtaacaaagtggtgtattctgtttgctcttttagatttgcctggttcttttgatatagttttctacactaccagaattttatattagttacttatatgtcctttaattctatgcagtgaggatgacattgaagacatccaaaaggttgttctttcgccttatacgctgtatcaattacaggatatgatgagatcaaattgaatgtggataatttatttcctaattcctaataggattaatttcatgttgcaggagatatctgttttgtcacaatgccgttgtccatatataactgactattatggctcatatcttcatcaaacgaaactgtggatagtaatggaatatatggctggtggttctgtcgctgacctagtatgtgtttattttttatattttatttgacacggcaaaatcttatattatctacatacaagttaataaatcatttcagtttcaagaatcattcaattggttcaaaatttgaagttggtatgatttctgttttcatctgtagctccaaactggccctcctctagatgaattgtctattgcatgcattctgagggacttgttacatgcagttgaatatcttcattcagaaggaaagattcaccgtgacattaaaggtcttgattatttctctccctttccctttttattgctggatttatattgaatatgagcatttaataaagcatttgggtcatcaaactggaaaaattggggccatgtaacatgtcctgaagaactctacagtctatacctccctttgtacagcatttgttatcatactggtatattctgactgcagtacctcaacccctggttggttgtgctgtgttcctaataactacgggccagataaccctcatatctactgtcctgtccaccaagtacaatatccacaaaaccattataaaggaggctttctggacagggctaacactcctttctttgagaactaatgcgttaataccaattgcacatttatctttattgtcagaactcaaaagatgttgataaaggtcaattatatcatgttactagtattatactattattcttgatttatcccatctttaagttggatggtttagtaggatgtggttcaagaggcgacacctctttctcaccccatccactattgttacgttgcatacttacacctattattttctatcaagataaatcgtcactcactgtttttttattaaagtgaagtttctttttcactaacttgggaatcctcagatacacagaacaattagatatttgctgttgtttaattaaaatctggcagattaagatgtaagggctggtgaaaaccttcatttgccattgcattagtattggcgctagatgaattgaaaagtttagtgttgctggtggatatggagggagaacaaaaccccagcaaaccttgcataatcttaaacataagattgagttctggaaagtctgcaatgcctttccacacttccacaggtacaatgatgtggaagatcactgtcaaatagggtcaaataggtctaccattagagtctgtatgaaaagataatggagagttagcaggcagttgtatgggttgcacatttaaattgttcttcactacacagaagtaacataccaatacatttgatgctagtattttcatagcatttgattgaacataaacgaatgaccccactattgtgtgactactgattagtcctgatatattgatgatctttgactcatttattttctttcctattttactaatgtgaacctgtgaagtataccacacattctaatatacacattctgtgatattttgcagcggcaaatatcctcctgactgaaagtggagatgtgaaggtataacctttctacgatttctcaatgattttatgttccattgtcaggatggtcctgagttctgttattaattcttagcttacaatatctatgcaaacgtttatatttttattccataggttgcagactttggtgtttctgcgcagctgactaaaacaatgtcaaggagaaaggtgcgatcttaaccatgattcttcaatgtcaagttactcgatattgctgtatatgtgcaccaggaacctagtgactcatctacaatcatattttggctatatgcatacgttacttgtactcaaatggaaaacttttggagggtgataaatctaatcaagcatatcacaagattattatttatgctttagcgcaattcaaaatttgaattatacagccataagcacttatcagtattaattaagatggaagctccctgttctgctagtatcattcggtagtgtttttagctcaaggacaaacctttgcttttggaaggtaatattgctaatggcttttaattttgaattgtgtagacatttgttggaactcccttttggatggcacctgaggttattcaaaactctgacgggtacaatgaaaaggtagctgtgcgtttttctttaaacagtttgctgcttactgaactttttacccaagtctgtgtcctgatgcaggcagatatctggtcgttaggtataactgctattgaaatggcaaaaggtgaaccccctttggcagatatccatcccatgagagttcttttcatgatacctcgtgaaaatcctcctcaggtcacttggttaatcttcaatccctgttctttaatgcttaattgcaatatacgcaaagcatttgctttgatccactagaatatagtatattaatttttaaaaaatgcagcttgatgagcatttctctaaaccgatgaaggagtttgtgtcactatgtttaaagaagaatccagcagaggtaatattcttctttcatgcttctacctgttccattaatcacgtcatttgctcttgtttcccaaagatattcatgaaaacaagaatgttgatgccaactgtttcctgatttgccttaccgttgctgcctttgctccactccattgcatcttctgcccatagtcaagtcgtgctccctgactgactttaggactagtcgtaggacttgattacagtgaaacatacacagtatcgatgttttccttttgatactaaattaaatttggacttccacctgtcatagttgagatcatgatttgtgactagaaggggaacagaaataaaatcttatgatatgttgtacagaatgagtatcagggacagtacaacagctttctggatatttaacatgctattgtggacaaaacatcatatgcccgtttttccaacaaatttggcatattgtaatgttgggggaaattttaatgctttatgctttttttatcaatcgcatttgataattattgatgtctaacctgcaaaaaattgtgttttaagtccttgcccttaacgccttccctttataactttctcacagaggctaagtgccaaggatcttcttaagcaccgctttgtaagaaatgctagaaaatctccaaagcttctggatagaataaggtatgtggtatagtacttctgttcataacagagagaagagttaaaagcagtcttttgctgataattgagacatctcaacacctatctgattcccttgttcctcaattgctgttattggcagagagcgaccgaagtttccagtaaaaagcagtgcggatgccacacaaaatggtcgaacacatgttgaagaagatgatggtactggtactatcaaggttgagagggctacaagggatg

SEQ ID NO: 68981 - DNA, 9212 bp, Oryza sativa
tcaatggagaacatcatggacggggtctgaagagtcgatctcaacaaacccgtcgcagagagatgcacaaagtgaatatggaagactagagagttctacagaagatgtaagaccttttttagatatgctatttgtctaattgttagtgttgtttctaactaatggttatcttccagaatgaccaatctataagtgggtctggaactgttgtactgcgctcgccaagagcatctcaggtgtaccctgcagctactaaccacagttccaaggtgtgttttagattcctaatatgaatgtcatagttttcccccaaaacaagacagataagtatgtcctcccaatccgattctgaatataggtcattttagccttcacaattcttttctaaatgtatgttgttttggtacttttaagcactttttcatcttttactagcctagaggccatgcgttgcaacagaaaacaaattgagtttctagcttattaaatcaattataagcacttatttagtccaagtactactattatttttcttattgaacaagtaggattttgaaacataggggaagctaatagtgaaatgggggaggacttgttgtagtgctcagatgttagtggtaggggtggtgtgggaatggacaccacaactactaacattttcagttatatagattctttatttacagatgctaaataaatggtactcacaaataaatgactagtcttttcaatgtaatgtaaatgaagggcaataatgtcatctgtgctgtttccttcattcttggcataagtctaaaactacttaatattggaatcagagggagtaagcaacagcgtctgatacattttatttattagcctcccagtagattctcctcgtatgaagacacgtctatcagtgggacagtcgttcggaatcaaattgaagaaccagaaactccacgatcttcaaggtcgagactgggaatccaagaaaagtcaccaaatgcttcactggaggacagtgcaactaaccttgcagaggtgatgcacatgaatgttgttggcaaatttctcaattgtggttaatggttgatacttattcatatatttgggtaattaatgcaggcaaaggctgctctccaggctgcgtttaaaaagggtaatgctcgtgaaagacatgttatcagcaaacatgaaaaggaatcacatgaacccagaatttcggcagtaaacagtcatgatgccccaaggtattgcaagtttggttttagttttgttttgtactcgggaaacttttctgtccatttcttgtaacgcttcttaacagattcttttttttttatcctagtgagaatgctgacatggaaaaaggtcgcaaaccacgccagatacatgatggacaatcagctcctcaagcttctggttctgtatcttcacctgcactctcgtcattgataattccttctctaaaagaggtacagtatatttaactcattcccttttcaatctactgtgtttgctattagttgctacattgacactactcattatacatttgtttcttgaaaattctttataagccccaaaacacatttatttacgctcttaacatttctttataagaattaggttgaatttgaaggacatttgtgcttaactactcagctgcatgtataacgagataaaccattagcacatgattcattgagcattaattatttcaaacttgaaagatggattaatatgatttttttaaagaaacttctatatacttcatttagcaatttgagaagcatgcgcacagtgaacgggggaaagtttcagccaacattctgaaacgaatgaagccttaaccttaatattggataatccaatctcgaatgagttgtgtcatcaccacattttatcagtttgatctttgtacaactcgagacatgccaaactcttcactgtattgatgacatgctgcaggctactggtgacaagtttaacggaccagttgttcatacattccttgattccttgatgcatctcgaaaaagagctacctggatcttgtgaggtgctgattggcagaatgctccatcggctagggaggtctgagtttcacttgtgttctctcttatgcgctcctctgcttaccttacccctgtgctctcctctgcttaccttacctctgtgctcagcttgtagctcatgatacctccttgtttgcagctcgaaggagtcctcgctgcaaagtcttcaagagacggcgacatcagttttcgcaaagaaatctgaacctccctctgaacctccaagtaacaagaaaatggctaatacaccttccttggctgcccctaccgtaagccctttggcgaggttccttcttacaaggtttgtttagagaaattgtttcccttttcttattattgctttcccacaacaaagagtgagttgatgccattggtgcaggtggcaaaaccaagtttcccaagatcttaactccgtctgaagacaatacaaaaaaaaaaaaacccgtcatgattcaatgtataattaattttgagtgtacataacgctatggttagaaatctctttgttgctagctgttctcagcagcttgtgctgctaccggttgtttcatttgtttgtgttcgcggtgaataacacattttctacccattttataatgtaactttgcacccactgtacctgtatatcacctgaggaacattaataacacatcaatttttttccattttctgatgcccgagaatttatgaattaatctggcctcctatatctgttcggccctgtttaataggcaacaggctggcaagaaccggaatatttgtgtcacgctttgaaaactattattcctccaaaaagaaattatttaaactttttccaatttaacttgttactccctctcctaaaatataaggcatgtaagatttttattctccaatgtaaaacttttatcatatagaagagatagaaagatgaatctaatgtatttttgtacaattaagtagatatatggcacattcgttgtctttgaatgtcacatttatgttaggccgcacttatattaggacgaagaggagataatttatttaaacagaccaaacttaagattcttcttctcagctataagaataatatttgatttgattgagaatgtttttaccgaaatgagaatgtgagctgactccagtttgagataatgtagaacatgacaggtaggagtagtaattagtaagactcgcctctcccccacagtggcactaatctccctgggcctagcatgtcagtcacaccccacaaaaatagccgttgcgaccccgcgccggctccgagccgccgacccgttcacacacaagcgccgcacacctccctttgttaaaccgtttaaaactctcccgaccgttagagcctcctccccctctatccccccaacgttcgtctcctcttcccccgatccaaccaccaccaccttcttctcctcctcttccgctcgacgccatcaccacgcacttgagagagagagagagagagagagagagagaaaccctaagcctcgcccgctatccagccaagcaccgatggcgacggacgcgaacccggaggcggcggcgccgccgccgcagttactggtggacgagggctacgagttctgcgcgcccaagttcttcgacttcgtctgcgacgagacggaggaggaaatccgcgccgccgagcgctggttcgaggcctccgccagccacgccccttcccgtacgctccccaatccccaccccgccgcctcgatcatccccccctctcccgtgttttgctttttttgcgctgattagggctcttcttcttttacctgcttgcagcgttcgctccgaggatcaaggagtcgagggcggaggtcaagatcgagagcctctgcgacttcaccgacgcggagccgattccgaaggtacgaagcagaaagctgcgggaataaccccccaattttgccctaatttctgtaaatctccccccttcttattgtccgttggcctctgcgttcgtcatgataggaggtagcagtggaggaggcagcaggaagcgccgccaatccctcgcagaattctgatgggtaagagttggagaactaaagaaattgtttatgatgattcgttgtgatctgatgaagttaatcgatttctcgtgtgtttttcatcttcacttttggatgttcaggaatgtgcaacagaataaggacggctccatcaaacttgtacgtgatttcttgatgttttcatgttttctatgttctcagtttcagtaagtactagtgttgggtttctagcagctcacatcctgaattcttcaggtccatgaagcaaatcccagtgaaaattgtgtcactgacggcgatcataagcaccaagaaaggtgcatttcaagacctcaatttgttggttcattccgtttcttgctggttttggcatgtgaatgactaattggttgttttgggcagtgatgcaatgttggagtcgccaccagcagaggaggatgagaaggaatcgccaaaatccttcgagtttgtcccttccaatgcaaaatgtaagttgctagttatatatgagcaatggcagtggggaagaactctgatccctggattttgatatcaatgttgcatggctttagcagcagatgttgcttctagcacaccgaagattcagaggcctccacccgtcaaagctgtcactacggtgcctacctgtcccaagctgacagtgaagacagaagccttcactccgaaggtgcaggcaacgaactcctccagaggtcttgcacccttgactggctcaagggcacatccatctgctttgaagcagtcgatgagcgtcaagaggagtgtgatcaagtaagagtcatgctcactcataaaaaaatatattaatctggagattattttcttactaatgtctgaattgttggtttttcagatgccctcgtgagttgctggctgggaaggccgctactgctgcgaatgaaatcgcacaagaaaatcaagctgtcaagagacagaagcttgatgatgggaggacaagacaggtaatactgggatgagattaaagatggcacttcaaatacatgtgtttgcgttgcgcgagatttctgagaaacattgtgtttgccgtcgtggttagatactgaacgtgaagacaaggaccctgcctcacaaggggagaggaggtggtctagcaggaagcaccgagatgagcctgtcggccatgaggaagcaccgtgacgattcacactctctcaaggtagctcccaagttgctcttctgactcttaaatgatagacttaattgtaatgtttcttgtgagaatgcaagtataatgtgattttgttattgtgagcttggcacttagcaacttttgtttctgccatgtgcaggaagtgactcactatatatcggcagcagagatggtaaagaagttcgagtctgggactagagagttggccatccctcacaacagatcgctttctcatgttagcactcatgtgccctttattattaattttaaattgtgtgcatttctccaattttattaatatacatgtcttctcagtcttgttgtgggtatttggttccatacaaagaccgatgtcctttttgtgatactgatatctgcatatcaaatattgcacagttattacatctgaaccgttgacgacgaaatcattattggtactaagaattttgacatattgcaatttgtgcacaatgcaggaggatgcagcaaccgcattacaaagaagaacaaagctgatgctaacaaggccaaaggaacctgagttccagacctcccacagggtccgtgctgtcagagtgaaaagctctgctgagctagaggaggagatgctagccaaaattccgaagttcagagcacggccgtttaacaaaaaagtgagaaatttgtttgctttggttttgattatactaactactcaatccaggatctgaagactaactatttgtttgcttctcctttcagattgcggaggccccttcatttcctcctcttccaaggaaagctccacagcttcctgaatttaatgtacgtcttgtttggctgattcagaaatttatgagctccacagctttgtttggctgattcagttattcctttccaacacctacaggagtttcatcttaaaacgatggagagagctacacgacatgcagacacctgttccgaagcttcttccgtggggactatcagggtaagctcccttcacttaacctggttgctaatatcagtatgtaaattcttcttcttattagtctcctaaaaattaaaattcttggcattactgaaagtttaatcaaatcttgcagagtcagagcagtaagccactgaccttgacagcgccaaaaccaccccaacttgagacagcattacgagctagaccaccaaggtttccctttgccacttgcatcattcagaaaacaagccattttatgttattgattattttcgattactctaacatcatctttctgcagggtgaaaagttctcaggaattggaactagaagaattagaaaaggctcccaagttcaaggcaaagccactgaacaaaaaggtctccttatcttcttgaagcttgtacatttgatacattgattgcattgtgcttcaaaacatccagtctgaacatcatttcttgcagattctcgagagcaagggtgatattggtgtgtttccacatctaaaggctcaaccaacagcccccaaggaattccatttctctaccgatgatcgcttgggtcctcctgcagttgtggatctatttgataaggtgagggttctaagtcatgctagtaagctcattattttttttccagaaacctttcttctaagtccttttctattttgtagctctctctttgctcagaatcttcatatcatagcaagaaagatgtgcccagattgacaataccaaaccccttcaatttacatacagatgtaagcagtatgaaagttatttgttttcccaacacattgcatttacctatctgttgcaggcaaataactttgttatccatgttacaggaaagagggcatgagaaagagaggcagctagctgcacaactgctgcaaaagcaattacaggaagagaaagccaggattccgaaggctaatccttatccctacacaactgactatccagtggtacgtgcaaagtaacataccgaatattacatgtcctggttgctgaccatctcatattctgctagccttaacattttctctctcttcagataccaccgaagcctgaaccaaaaccatgcacgaggccagaaggctttcagttagagagtttggtgaggcatgagatggagcaacagaggataatggaagaaagagagaggatggagagggaagaggcccagaggagagtagtgaaggcacaccccataatgaaagagtaagccttcacattacggtttctcttgtcccaacagttcctggtttcccttataagatgcatattaatactgttaattttgttgcagggatcccattcctcttccagagaaagagaggaagcctctcactgaagttcaaccacttaagttacatgttgatgaaagggcggtccaaagatcagaatttgacaatatggtcagcaaagcaagcttgttctattatctggtttggaggagcctgccaaattggctgaatttactgagcaattcgttgtcgtgcaggtgaaggaaaaggaaataacttacaagagattgcgagaggaaaatgaattcgcacaaaaggttattattttcttatgccttcttctcaaaatccctacattgttggatgcattttcatctgttctggcaactaacttgctgtgatcttttcatgtgaagattgaggaagagaaagcgttgaagcagctcaggaggaccttggtgccacaagcacggcctctcccgaagtttgacagaccatttcgtccccagaggtaagagcagaaacggccaagatttttgcctacaatgtcatcgacctttccgtttcatctcacaaacgtgaactcgttgtttcgcacacagatcaaccaagcaggtgacgaggccgaagtccccacagcttcaggtcgaccaaagaggggcaagaaggcacgccttcatcagatgatccaactctccggctcatcttgttgtcgtctatcggttacccactggctgctgctgttttctcttctgttcttgacgtcaagatcatccccaattctcgcagcgattctttctgaccaatacataaataggccgatccaatcctgttatatagtcagtcaacacagctgacggcgtgtgtatgctcctttagggttctgctgatgcttgactgcattattgtaaattcagtttgtgtgctgtgtgtgtgtgctgttcgatgaacgacaataggatgacaccctgtcagtgtcctcctcgtctgtttcgacgaatgcaagttgtattcattatttgtttatcatctctgaactatcctggagttctgtcgatgttgaataatctaattcatatctcggcacttggaaaactctcgtgagaaacatatgtaccaagaaaaactgattcatgtcaacaacctagcattctactccatcatccgtttcgaaatgtttaacgccgttgacttttttagcacatgtttgaccgttcgtcttattcaaaaaatttaagtaattattaattcttttcctatcatttgattcattgttaaatatatttttatgtaggcatataattttacatatttcacaaaagtttttgaataagacgaacggtcatatatgtgcttaaaagtcaacagtgtcaaacatttcgaaacggagggagtatcaatgttttactcatttggacatatggaagttgtactcattttgtttatcatttcagatttctatcaacgttgaacaatatgtaaggagttaaggacggcggctggaagcagaaatctgggcatttgaaaaactctcccgagaaaatagacgaatcctgtgaaaacctgtccaccaaattcacatccttctcatgaatcatgtaaaaatgaccggtcaaaaacttagatgcatgatcacacatgcccgtatttcatctaaattttctcccagaataccgttcgcgattctgttcgttgatagtacgtcaatcacattgtcacatgctttcccccaactactg

SEQ ID NO: 68982 - DNA, 8749 bp, Oryza sativa
  unsure (1)..(8749): unsure at all n locations
tccaaagatactacgatttggataggccggtggtctggatctggacacaaatcccatccgtgtaattctagtatttctctccatttccaagattgatcgatgcatgtgtagcagaaaataatgatactataatccctagcatttgacatgttctttggattgaaaatataggtgaatccgctcatgcgcttgagctttctatgcgaaaagttcgctttgtttttgtcaaacttttctttcgaaaagccacatgctttcggacaaaatatatccctttacgttttgtgccaaacatttctttttgtcctcttactatcagacggaggtgatagcacttcgtccaaaccgcgtttggttcaacgttaagccttaaggcagtccgggtaattaaccttaatgtttcttttgttttaacatggtaccttaatatttcttttgcagggatgattaaacttaaatctagttgggttaattatagcttgggaagcaccgttgattcatgtgaacttggttcaatttttcttaaacaacacatataggtatagtgcgatatttcgtatggatagaacaataaaaaaaaacaagaatatagccttgggaggctatagcctggaaaaaaaagcaaccacaccacacgtttacaatcagacctcactactaatgaactactaatgagatagtaatacgacatctcgaaggaaaaggattttccaaacgacgacttcaagaacgatatgacactgagatgccagcaccgtccatcctaggttcaagacatttcacctagaggaatccatcagggggcaaaagagatcactcaataataccctaaggggaaaagtggcgctcgcaagcgtcgcccttgctagctcaaagaggctaggctttcgtttgtaatcttcctacttcctcgtgtcaagatcttctgctggtcatagagaacaccaccaaccacactccttcgacgcacagccaccgcgccagcatcttgctgccagctgaccatcgagtagaagctcgacatccgacgcattccaaatccatccacacggttaggttggagggcgagagagaagaatggatctcctctccgcactaatctgccaacgaggccttcttatggtgtcgtcgccacaagtggccttcttatggtaggcctgcaacgcacacctcacaaggccaccgttgtcactgccacagctagactgctagcgtcatctcaggccgcccatccgcatcactgccaccttgtcctcgccatgcaccgtaccagctcagtttgccgctggccggcctgcgcctcgctgctctcaacctcgtcaccgtgccggcctcctgccaccgccggacacaccaagcttgcgtcacataggcctttgctgaccgcaacttgcttctatcaccaaccacgtcacgtcagcctcctactccaaatgtcgtcatctacccgctgtagtcggctgcgtcaacctccttctcatccgctgtcgtagcttccagcaccggcctcttacttccgccaacgcaggcgtcccgcggccgccgacgctgtcggcccgtagccgtcggccttctactgaggccaacgccgcccatgccgaagttcactgacaactttctgagctttgcgtcgcttcccccgcgctgtagatggagtgtcgtcgggttttggccccgccaccgccatccttgcttgtcgcccggttttccaggcggtgagctccggtggcagcgaggcatcgaggagggtgggagggacggcggcgggtggctaggatttcgcttcgagccgtctgtgcgtgggtgacacggatatctttcttccttttcggttcaaattctgatccccacaattaagaacacatgggaccatgagttcactttgtgtagaagtttcaatggggttcacgaatttatccatggccccctccatccatctaatgcgttaaaaaaacacacatttacggatatatgtaattgttatatacatgtgtgttgatgtgcttgtgtgcatttcccattaatataaagtagctcgaccagaatctcgtgtgtggcaactaaccttagctatcatggttgtcgtcggcttctatttaagatgtaaattgcccatcatttcattaacttatggacgttttgcatgcctagccaccttttaacaagaataaaaatgggttctatgggaaaagtaggcgtagtggtgaccggtgaagctgtcacccatgggtgcaagacttaatactatctgcgctttcaatagtaatttaacgagggcaaatatttgctactgacactacttagaaaaaaatgttttttcaggcggtcaaaacatgttctcacacccccccccccccccgagggggtctggccacgtgggtgactgcagctgccccaaacctctagtcaagatacccccggtcccatgtcaccgacaatccccatgtttctaattatatagttttaaaagtcacaccagttgctaccacttatgtcatctcctcctttacttgcttgctcgatctaccactatttctattcattctctttggaatttttaaaaattggatcttatagttttaaaagtttattgtcacgttgggtttcgtttttttaatttctatatgtcccgtcaaacgttgccattatactcctctatggcctgtccactatctcttctctttattatcattgagattttaaaaatcgaatataattatcgtttgggttcatttttacttctagaagtcctgccaaaccgttagcggctttgccattgtacttctctacagctcgctcgctgcctcacttttttattgtcattgagattttaaaatcgaacatgattatcattgttttttttttactttttagaagttccgaacctttaaaaattagggtttcattttttataatttttagaagtcccgtaaaatgatgccactatgcttctctatggcccgtccgccacctactctttattgtcattgtgattctagaaatcaaacataactatcgttggaatttatttttattttctagaagtcctgtcaaccgttggctgctctgcaactatactcctataaaccccgctcgttgcttctcctttttatagtcattgagattttaaaaatcgaatatgataatcaaatggggtttatttttttttactatctagaagtcctggcaaccgccttgctcgttttcttcatggcctgctggtcgtccctccttttaatcgtcattaggatctatttggtgttttatcaacagtttttatatgttgtatcaaccgtcaccactctactcttttataggtatgttacttaatttatctcgtcatgtgttttagatggtcttttctttcaatagtctttatttttatcacaaattttagttatttataaattttattcctaattgaaatcttatttttatttttccaattttagaatttatttttttttcaaattttaattaatatcatattgtgttcttttaatttttttatttttttattttcaatttcagttgtttcaaaattgtattcctagttgaactctcttttaatttttctaatttcagatattattttattttttattctgaattttcattaatcttgtattaggttcttatatggattcttctttcaatattgcttatttttaattctgaattccagctaattttaaattgtattcctacttgaaactcttcttttatttttttgctaatttcgaatttttattttatttttattcccaattttaattaatctcgtattgggttcttatatggactcttctttttaatattccttatttttaattccgaatttcaacttttttaaaattgtattcctacatgaactatcctttcttttctaattttggattttattttatttttatttcgaattttgattaatctcgtattgggttcttatatgaaaacttctttcaatattgcttattttaattcctaattttagctatttttaaattgtatttctacttgaactctccttttctttctttttcttttttccgattaatgtgagaatttctagctcccagagtgaacgcagtggctacttttaaagctgttttaataatataatagatagatagattcggcatattttaataaaaaacaagatactaaacatgacatgtgaataacaggaggatgatcaagtgatagtactaaacacaaacatgctaataacaagaataatatcatctagtaacatgttaacactaaagtgaatagagtgatatgcggagaacgctccggattcaaaggcgatggtgttggtgttgtcgctaccgttgccattggcgtctcctccattccattgctagtcgacgtagaggaagaccgttgctgttggcgtcttctcctccattgctgctcgacgtagaggaagaagaacctggcgtagaggaagcagtgtagagagcttattgtctatcggttccgctttctcataaaaacagaaaagacaagaaaacgagcggctggctcgccagccccgttgctccgctccgctaactcggcccggttggctcgactcggcgcacgagcgcgcggtggcagttcgaccaccatcttaaccgctcgacatgtgctctcatttagcaacttacttctcattggttccaaggtgggattaatcttttaacattaattgtgtgcctttgaaattagtatgattaaatcggggctagcccatttaattctaacaataaatatgcagattacaaaatacagaaaaataaaaaacgaatgtttgaatataatgtgtaaaagagtaggaattagaaaaaataagtgcttaaatatactgtatagaaagaaaagtaggaatttgtcgacgggctatacccgcagacgggatttgtagagtatgggaatcgttggaacctgcagacgtgagatcagatcgagcagacaaggaaaaagatttatactgatttggaccctcaaggatagtaataaccctaatctagattatatggatttatggatggaatatcaccaagattacaatgaggaatttcacgactagactaatccgccgactagaaactgtcgaggacggcccgaggagatctactcggcgaatacggctatgacttcctctggattgcttctcaatgtagctttggctatggcttgtaattcgatgcccttccctgaatacgggggtcttgtatatatatagtgtagatcatatttttccctgaataggatttgtcggtgatatgggtccaggggtatcagggccatagagaggaggctgcccccgggaggctgcccccggtagccacatggccctccccctgaggggggtcgggcccgaggcagggtggcgaccgccccctccatgccttggggtcgggttacctcgacacccttcgcacggtgccgcgtgtgctacgataggtgggcgcccccagcgcccacctaaccgtatttaaggcggtgtgagcgagcacaccatggcgcattaaatgcacaccgccttaaatgcggcgcatggtgcacctgactggactgtgaccggtctgcgaccggtcgaatgaccgatgtggacagggtagtgcgcctgcgcactggttgcatattaggcggtgtgccgcctgacaccccccgtcacgtcgtgatgaggagaggctgcttagactctcatcaagaccggagacggcttgcctaacccggtcagggtagaatttccgtttcccagcgcaagtgaagacccaaaaatcttcactcattaaatgccgaatgacatgcgtgtccccccgtgtcagactgatagatttgacgggccccacgccatagcaaggcatgccagagacttccaaggcaagcaacaagacatgcatttaatgtgattatcctccctgaataggttcggtgggcccatgtggtaacccctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgacgatgaagcttatcccccatcgtctcactggccgaccttggcccctgttatttttgggtcatatctaattcgttatactcaaaatacacctttggtacaaaattaataatctcacaaggatgaaatatcagtaattttctatttactggttgatcccatcttttacggcatcaattccttttttgaacgtacaaaaatttggggagctcagcgtgtctggaagcacgggagaacgttcttttgctgatattattaccagtattcgatactgggttactcataggaaaatcagcctttccctatatcaggcactaatttatttttaacgtctaattagatcagggagttcttccaattaagaagttaagctcgttgctttttgtttcaccagaattggagccaggctctatccatttattcataaaaggaggtccaggcctacttagggaggggttgagccctttttcacttgaggagttctcctgcccctcattattaacaccttctactccaacaaggagatcttgtaatttctcccacaattagctaagcacaagagtagggtataacgcttctcagcggcccgaacctatataaacccctcttgtctcatcgtccttgaggggcctgacccctatgcactgaactatccaccgagcccttgagtctcacctgctgcccctggccgaaccaacaaggggctctcactatcccctgcttgaggagttcaccctccgacaggattctaacacattctattccgataaggtaattttcttctttatctgtcgtatttcgtaatcaaatgatacattgtcgtatataatcaggtatatggtattgcggtattccatgaatccatgtataggaggtatgtcttatccttgacactgacataattaaataaaaaagacagattcaagggaaatttttctaaagttgtagcttttacgaattttcctccaaaatctatgtagtattttccctagaaaaaagatctctgtagtatcgtccattatattagagtttcaatggaaaggagatgatttaattatttgtttcaaatatgcttttaggaattttttttcatataaatttgaaactccctaatttttctgtcttttttctgttcgagcctgattgatcttgaccatgtcgtgaactactgttctccctgctctcaggatacagagagatgttgtgcagggctcattttgagttttcgactgtatatatatcgagatatatatgtttttcagctgtatttagcagcttaaacttgagcctgcattggttggtgattactacaactcgaatgggactaggagatgttaaatttaagaaaggtactacatgaaattgcccactgggagatgttaaaattaagaaagatacatgataaacagccgctaaaaatatgagctaaccatcacgatttggggttggtatgataattaatgcattttactaccttagaaaagataaagtacttcttggaactccggtcataaatatttgattttgatgttaaaaattagatttgatctctgaccatagataacttctcaagtgcttaatttataaaaaaaataaaaaagtttttttttgcggggaaaaaataaaaaaaataaaaaaatatataagtttgactaaatcttatctaaaatttaatcatttatgactggagtgagtactttttatatgctaataaaaacactccctctcatcatgaaagttgaggacaaagattctatcaaacttttgaaaaatttgaacaactttatattaaacaagttatttaatctactaataagtttgtaatattatgatagcacttttcaagcaactaggaaggaagcccgcgcggatgcgcgggcattttatttattgttttatataatagtgctaaaacaagtcatatctcactatttctacgtcgtgagatagatcgtagacttcaatatacttaaattataagaacgtctcccagaattaaaaacactttgtcccaattacatataaattctatcgtaacaactcattatcactattttaaaagctcgctaactatcaatacatgaaattgcgcataataaaataagcctaatatatcattaatacactacttagctaagtgtttatgtctcacttatttccaaatccacatataaatattcttaaaaatatcactaacgggtgaagccggtcatagccgtagatactttctttctctattaccttaaaagttgggtagctgtgtcccctcaagatcagcccgaagcacatattataatttatctattatatattaataatatattaaatttcctactaacgctcctacgccatcacgtggtactctacaaacgttcctacatcaccacatgacgctataataaattagagaaaatcatagatattcggagaaaaaaataatatgtagtatttatttttacttaaattgatgggcctattattttataccattatattagatcttacttaaaaaaataaaaatgtaatttgtcttcccgtcataatccccatccacgtgcgagagaaaatgcatacgttcgtcatgttcactaggaaaaatgtatgtacataaagttcaccaggtacgtacagttcatcgggaaaaagatacagccgcaagaaaaaaaaaactca

SEQ ID NO: 68983 - DNA, 5434 bp, Oryza sativa
ctccatgttagagaaagctaaaatatattacttccttttttcttataacatttgaccatttatcttattaaaaagttgtataaatatgtaaaattataaattgagattatagattgttgatcataaaacaagtcatggtaaaaaaaatatcatttatattttttaatacaaatggtaagatgtcatatcaaaattcaatggcatcatacagccactcaactcggccatttgtacgccacgttagagggtaaataacgagtccaccaatttaaatgaaaatcgatggtgagattatatagtaccatgtgatggcctaggagcatttgtagcagcgtcatatggtgacttaggaatattcatataaagtttaatgaacgtttagtatataatagtttttcttgctgcgaatagtagtaccgaagctttatttctttttcaatctaacgtacgtttgtatatgtacttatgtttttttcacggttagtatatatatacatctaatctcatggtttaaaataacgggtccgctaatttaaatgaaaatcgacagtgagattatatagtaccacatggcggtttaggagtatttgtaggaacgccaatatgaagacttagtactgttttgtagatcacaaattggatatataatttaaaaataatttgaaaagatgaacatttaaagatggttgatttgatatttatattatagatctagtttaacactgcatctatatatttgtgaagtaatatatttcatctttatatcgttgatagttctattttaaagaccgtcgatttttttgatggtactaagtacttatattttattttggcttatagtaagtacgtgcatatatattttttcttccggcaaacattatgcacatgagaaaggtattacatatttaatagtaaaaaataacaggtccaataatttataaatcgataacatatatggataaaataatggatcgaaaatcgttcaattgtatgtgtatatttgtgggccaatatatctttatattgtagagcgatatttgcttttttgatagtactaagcatgtatgctttattttggttgtcgtatgtacgtacataccttctattcctccggcaaacagtacagagaaagttattatatatatatatagatataatgtattaactgaaaatcgacggcatgtatatatctaatctaacggtataaaataatgggtccaccaatttaaatgaaaatcgacagtgagattagactgtgccacgtggcagcttaagagcgtttgtaggaaatttaatggacttttagtatataatagatagatagatagatagatagatagatagatagatagatagatagatagatagatagatagattctacgcatacccttttttcttaaaaaatagtaagcatttgagaaattatttgtgttcaaagtttcaaaagatacgaccagctcatattctaaacattaaatatctaatgtacatgtccatttcttataaataaaaacgtacaataatattatattggcactgcggccggtagaaaattctcttgggaattactgcccattaattaactgatcattaattgtgcagataagatgagtgagatagagatatggctgcatcaacgacggacaagtatagctttgccgtgcatcgagagcgacacgctgtcgcgtacgagagtacgtagcgcgaatatttaagcagcccggcacaaacacagctaatccaattgctgtcttccacaaaaccaactgattacttagtactgtaacgtcattaatttacaaaaaggaaacgtccaaactacgcacaaaaacagaaattttgtgcacaaaattcgcaaacaagaaccggaattttctttaaaacactgttcaaacgagctcacaacttgcatatatacacacagatagtatactaacccttagaaacgctcaaatatacaccatacccttatatattacatcttcaagagattagatcggtttatcttacgattgataaaatcattataaacgtctcctctcgttatcgacgggtatatcatctatcactaaaaggataattaaccgtaaatacgagctacaaacacctgtgtcaagtttacgatttacccagcataatcatcatcatagagttatgctgacacggcaatttaatcaggtcggcatctttgttctagcctgaaaacgccctacaagcgaaaatctgggtcgaaatggcgtcgagaagtgcagggtcacgatcgagtagtcgttttcaagtgttttcttttcttttgtaataagtaaggagacaatcaaacatgtactactaatattaatcgattccggccggctatgatcttcctcctaatcgtcccaaccgatgacgggatttttgacacgtattggctgccaaccatctcatcacctctgcattttcagaggttttatgaaattattatatatccacaaaataattaaagcttagggagttgggatccaggtactcggtttaatttacatccatgggtgacttagatcaagtttagtatagctaactaatagctctaaaacatatataattaatttaatagttaattcatacaatagttacctgtaaacatatattacactattaatatctggttccacctgttatatacatattatatcttggagtccgtgctatcgctggctataaatatgtagtccactgctcttctctcttaccccctccattccaaaatatagggcacaactaatttttaaagtggtttcataatatagggcgtgtatgcatgcatgtaattaattagcacattctctcctctaaattattattattttaaatcatatactcacaagatccttaattctattagttgcatgtattgtattaattaggtgattcatgacaacaatgagatattaattattttttggtctttgggttaagggtggttgtgtcttatattttggaacggagggagtattttttatctttttaaaatatatttatagttagtttatagtagtttgctattgtatctactcttaggattgccatcagaagaaggcgtggacaaatgttttaattgcgagagatgcttgatggtgtgtgtggatgtgtgtgttgtccatcatttaaaaaaaaagaataaatgtaatgttatactctcgaatgattgtgcttcacctcattgcatgtatgaaatgctcaccatatataagcaaacaaataatatatattttttatatgtccatgaaatttcagccaatgctttttacaggctcgctccgtcacatatcgtaaattttggttttgatctttctatacccacactaattaatacgcgtagtgtctcaagccatcgttacttaattagttagttaaacagataaggatactttacacatcaataatgcggcaccatgcatgtacgtacatcaccacttgctatttattttgtaggttttaataagaaccaactgcttagttcgaaagaaaattaaattagctaactaatgcatcaaatgatgttagactagtttagattatattagagcgtgggggtcacggttcagattgtagtgtgtcattatgtgcatgagtgtaagtcccacgttctgtcagcgttcaattttgagtcctatcttcttcgtagtattatattacgacaaaagagaattcaaatgacttgaactaactcaatcattcaagcgcggaaatcaggatttaaaacccacctttgtttagttaattcctcattaaaaaagtaaaaagattgagaaagatttattatatatccatcgaggtgtgaaattaattctttttaattcccttcatctcataaggagtaacccagaacaatctcgataacgaattggttaattttgcgtctacgatcaataccagttttttccttcacctgggctaggagtgtagattctccgacaaacaaacgaaattcatgttgaggaatgcaaattttgtcccccactctgatggcctttatcgccattggattctgttctttttctgatcttaaaggtccagccaacttgtagttatgctgtactctagtagcctttcatttgatagagacggtttataatagcaaatccaaatcgcaataaatcaaatagttgatgtagatggcaatctaaccaaaatttagatcaccacgagagggttttgaagcgtcaatagaatccaaacagtttatgcatagctggcaagcatttcctggcatgcgtatcatataattggccacaatgttttacagaattttgaaaaggaaatgaagttaaggacacaactgttgaagacgtcatttcttccagggtttcatttgcctttcactgttacaattgttcaagcacatgatttgacttctttttttaaaaaaagataatagaattcattgtgtcctttatttcatccaatctacaactcgttattactgcctccgtcccaaaataaacgcagccatgagtttttgtgctcaactttgatcgtccgtcttatttgaaatttttttatgattagtatttttattgatattagaatataaaacatgaatagtattttatgcgtgactattttttttagtttttttaaaaaaataataaataagacgaatgattaaagttggaaaaaaaaactcatggctgcacttattttaagacggagggagtaccaagtttgtagtttgaacgaacgcttattacttatcacagcttatggatcataagaaacctaattgaaacaccatcctaaagacatacaaagataacacacctctactttcctaactcacctttctcgtttaccgcgtgcacgcttttcaaactgctaaacggtatttttttaaaaaaaaaaattctatatgaaagttactatctttcaaatttattttaactaatactgaattaatcatggacttaacgcttcttcgtttcacttgctatggagtgagggttgcaacacaccttatatatgtttgtcctcctcaaatacgatacctaaaaacagagacaacactatatgtttgtcgtcctcaaatataaacactactataaaaaccatttttcctaacatagaagatcttattttcgaaggcggacatgaccctcagagccaaatgactatctacaaaaatataaatcggggtgaaatttaatgtccgtctgcgaaaatattttcgcagacggtccacttaagcggcgcaggcggaccacttcacaggcgccgcttaagtggtacgcccgcgaaaatagacttaatataaatagacaggcgggcctaaattttttctaagtcccctcacatcttctcctctcccctcccctgccctcacctctcctcctctcctctcctcccctcctctcccctctccccggccgccggccggaggcggcggcgtgtgctcc

SEQ ID NO: 68984 - DNA, 12838 bp, Oryza sativa
  unsure (1)..(12838): unsure at all n locations
aacaatatagtgcaataccatgtgatgttctatgaaatatcctacatccaattttgtagtgcttcccttatttatactccctccatctatttttgatagtcaaaatctgaaaaatttatttttgatagacatatttcaatccaacaacctatcatcttaatgactttctcggattttatgcgtgactctccattcttccacacaatattggctatatgggcatcgagaaatgtaaatattaatgaatcgcttgtttacgataaatgactagtagcatgtttaaatagatgataaatagaattacttatcattgatttatgtaccaagatgaaatacaatactatcaaggagctctccttttaatcgaaaagaaaaaaaagtacctctcttttgctgggccccacgaagaaagggagccgcttctgctgcccatggcaatggtggcagtggcgaccggccggcctgcaacccggcggcgtcgtctcgtgctgcgacgcgagatgtatgtatgcatcctccaaagtcttttttcgcggcatgcaatcctgaaaagtaatacctctgtctcacaataaatattcgtgcccaacatttgaccgtccgtcttattagaaaattttgtgaaaaatttgaaaatatttagttacacataaagtactattcatattttatcatctaatagcaataaaaataataattattaaaaaattttaaataagatgaacaatcaaatattaaacgtgaatatataaaactatatttattttgggacggatggagtagtctgttggctcgcgccttgatggcatggcatctttttctctcttgtgctgatgctgaccaagacggcacatgtgctgatgtgcctgcgtgcagtagtttctttggctggctgctggttttggctacatcaggccgtgtaatggcacatcatgcacacgcacgaatctgatggatacagagccgctagtccaagcagtactgctaatagcgggcctatctcccgtgctttcgtagctcctccctcctactactactgtgtaggagtagtgtgtggatggataggatacggatcgatggcactgtgcctgtctgttctgcacgacggaggacaagttgtgggttgcgtttccgcgtcatactccgtctctgccaaaataaatgtagtttttcatatcttacgttttcgtttgaccgtttattttatttgcaatttttttacgattaatatttttattgttatttgatgataaaatataaatagcactttatatgtgactaatttattttaattttctcataaaatttttaaataagacggatggtcaaacgttggatacggattcccataactgcacttattttgaaacagagatagtacgtacctagctagagtaagggcagttaggccttgcagtgagcggacattggttttggttcgttgtcataccggagctaggtcaatttatcatacccattcccccgcgaggctcctcatgccttagcaacaagctaagatagaggcacggtttgcgagccgtgttgggcgaggccatgtctctgtgacatggtctcgcccttcttattatgaagcttataatgatgtcagcttaattcgtcagatctaaaatgatggcgcaatggatgaaatcaggaaaaacggaacatgtatggtggagaagaaagatggacctaccaccacggatatcaccacatgaatgcaaaggagaaagaagatggatctaccaccacaggacactccacaacctccttctccctcctcacccctacccccaccagccggaaaagaagaaatataaaatgtcaggggctgacatgaaaaattaaagctaccacttaaaaccaatttgtcttatattcgctcaataaaaaaaccatttctaggatggagggtttttttaagacggagggagtagaagagatatggtactaacctacgtggtgcacactctcttctcagtggccactcataggagtagcctcgtgtagttatctctagagagatggtatagattgctcccatagtgcaaatatagcttgagcccgtaggaagatttttatttcactttgtttatttgcccatcaatccttccgttgattttatttacaaccttatccaaaattgtgctgttagcacccttaattagacaaaataatttataaaaacctctaaaataaaaataatccacattcttactagtcattcttgctcccctattccatcatctttggccaccctagctcgttgtcgctggctcctcctcctcgcctccatcatatctacgcaccactattccaccaccacttccccgtctacggtcgttgtcgctttcccctcttattaggcagcaaattggatggacaagcttcgtggctgcacaaatcaggagtagcttgggtcgacaagctctgccgagttgggggcaactacagctaatggatttggcgttgttatagattggaagcggttcggactaacaagctccacggttggagggagttacgaccaatgggatttagcaatggcttgggccaacgagctccacaaaggcttcaaccaatgatgtctttggcggcaagggccagtggcggagccagaatttttccaaacctagggctcaattagttgaatgtatataattttgcctttatcttctagcttttgaagttttaaaatggaatttcaatgaatacttaggatcaggagtagggctgcagccctagctgccctactcttgtctccgcccctagcaagggccaaatatagttcttagatcttggcattgcctatccacaaatcgccaccgtctttagcaagcttgggcacttgcgacgtcgtcctattggtggcgacaacctcttctcaacagcgacggtggtcggcggaccttcctaatcatacgcgcattagaggtggcttattcctagtcttcattctcttctcctccatccctgtttgggacataacttttttcatggaaaacttgtggcttgtagaaggtactcttgttgtcttacactttgtaaacaaacttcaaagtcagtccctttcctccatgatggcatccgagcctacgtgactagtggggttactcctcttaggccatacacagtaaacgctctaatgtttacaggatgtctggatctaagattttctaatttttagagatttttttattttactttcaatgaaaacatcacctatctcatcgtgcacttattcgttcatcggctacatccaaaatttaggttttaaaaattaattttaagctaatttgaagctttctattacaatctatttttcatacttgacttttgaaccgtgaatactatcgatatggaagtcttacatataaattatttttattgcttagttggttttacaaaccgtagtctaatcaaggactcctttaatcaatcatcatagccgaattcgttggttgaagttttcccaatcatccttttatggaacgtttctttttctaaaaattctcacggctccaaatagaggtccttgtagaaaattgaatgtgttgttgcttgttgttggactgggatactatagagctcaaagcctcaaattacgtgcaagacgacgttcctactcctgcgtaccgctcgatgttggttggcctacgatgttttcgtgtcaaacttggtggcgcacgcacacgcacaccaagtcgatctctcgctgtcctacatggtcgatcggatactgtcagttttctttgtcctctacgcacaccaaagtcgcctactgctgcgcgatatacactgccaacgtactgcaaggatcccgaatcgatattggagtatgggctagcagtggcactgtggcagctcccggccggccctagctagcgtatgtcatgtcgttttacaccatataatttccaacttgtcactaagtgccggtgcatgacgtacctgcatgcagaggtttatactgtactgtactattcctatgtacggatccctccgttaaaaaaaaacgaatataggacataactgtattatttagaccttcaactccaaatttcaactttcgtttttcgttagcacactttttaaactgctgagcgatatatattttttaaaaaaatttcatatagaaattgtttaaaaaatcaaataaatttattttttaaggttacaataattaatacttagttaatcatgtgtaagtggtctttcttgttttgcgtgccctgaaaaattttcttcctacccatgaaacgaacgaagcgtaataattaatacattcgccttaaaatatcaactctagttcactacgaccatgaaaccccttttacactattaacctttttctttttttttgcaccattggattatagagatatgtggacatttttcaaataactgcccgcctatcaatgtattttttgttttggtccaagggctcgtcttcttctctctgtatcatccctctctcgtactgagtaaaaaaaacactcatgcttaacattaggagtatttacttatcacttaaaaccaagagtaaagtttttactctctgtggattttgagagtaaaaatattacaaacggttgaatcttatcagtaaaaaattacaagtggttaaatttaagagtaaacaaaatacacacaaaaaaaagtaggtggcagcaaggtcacaacttggcgaggtagctgcggcacatccacctgcgatctcgatgacagtttggtaagggataaccgagaagacaatgctaagaggtactgtggcgttgcgactagcgggagctagcttccgagccaacttcggtggcacatgggcgagtggatctggggtggcgcagcatgcgacgaggagcaggacaggtggggtgaggaccaggagctctcaattcagtgtccgggatgatgaggtggccgctgcttgcacatcttgccggtcaccggcgctgcattggtcattgctgctgccaccgctcgcatgcctcgctagtggccctaattccttgtgttgcctctcgcatgccttgctgttgtctcggtggcgaaaggaggtgggagagcgagagatgcagcgtgagagggagaatgggtgccagggactaaatgcaaaaaatggtgagaaaggaggatgtcatctggtgcacatatgttagatctaacggtgaagatgggggttgcgtgtttccacccaaatgagaggttgcatctgaaactttccgcaattacaatggatgccaagtataattttgttttggttagtttagttggtaacatataacatatgaagaaatcacaaatcccagtcattgggagtggaggatgcgcggccagtgcccatataccaccatcaccgtcatcacggttgcatttgctgtggacgttggtggcagccggtacggagctgtgctggtgggtcgatggtgggctacaaaggtagagtacgtgcgagcggcggtgcggctaagcattgagccctacagtttgcggacgtccgcgcagcggtgcagtacctgcctctgcggctctacctagggtgcgggaattgtgtattactttgcatcattcgaccatttcggtaaactgatatagactatcaactgtcctattacctctgttttatagtgttttatatcataagccgctttgatttttttcatagtcaaacttttaagtttgacttagtttattaaaaaaaatatagcaatactttcaatgcaaaacaagcatattatcaaaatatatttaatattgtgtttaataagatatacatgttactaaattttttatatgaacttgtttaaatttaaataaattcaattagaaaaaaattcaactgcgacaatatgaaacagagggagttcagttactgcgagtcgataaccaaacttttttggtctcggtcatttccacgttttggtgtgagtttgtttggttcggttatttttagccagccctatatgtatagagcaatagttaatgaacgcatgcacgtattaaccacaccctaacgttggaaatattaataggcctgatgcatgacaaattgcatgcgcgcacctgtgccggggtcgttgcacgtattctcgcgatcattgccgaacagtcaatgtcaattatatcgacggccggtttgcgttagcgtttgcttaactagtgtactagtactaaatagaagtattgtactactagtatatgtagcgtattcatcgtgaggtaatgatatgatgtcgatcgatcgatcgatctaccgacctgttgatcatcagtgactgaatttaaagctgctttttatttgaaaaccattgctatcttccgtccaagttacgtatgtaccactgccgagcagttattttgcttttttctaagaaaaataaaaaataatatgattttttattgttttagtttctagtaatatgtaaaatttactagctcttctacgtcgtattaaagttgctagtcacattcatagtatgaaaaatttctaaccatgccgatatcattttcaataataaaaagtactttttagaaatttacaaaaatcaccctataagctagaagtttgatgtttcaccccataaattattttgttgaaaatgcctgcccacctacttagttttgtatcaaaaccacctcggtatgcacgtgtttaaccgaatcaacgtgttttcataaattatgagccatcaatgtagtctttaccaaatttaaatacttcaataatatggtcttaatactttttagagattccataaataatgagagcttaaatattgttgaaccaagtttcacaatatgcataaaatagtttaataaaacatgaagaataaatataatgtaagtacttggataagattgactcgattagcatggcgtgtggtatatctatatcaacgataataggctgatttggttaagtacgtgcgtcctaacatgacttttacaccaaaacttagtaaaggtgtgtatttgtaacaaaaataacctatgggatggtttctgtaattttctcttttttctcgaccgttttcatccctgaatacacaggatacagacgatgaaaaatattacgccatcgatcgatctcctgtgtcctgtccaattaaaactcgcgggaagccggcccaatacaggtgttggcagactggcagcacgcggcccacgtacccttcatgcatgaacggaacggctcccacttttgagtcttttgatccaccacaattttaagcacaatatgtcaataaggttgggttcttccttccattttcccaacccacctctctccattttcacgcgcacacttttcaaactggtaaaaagtatgatttatacaaaaactttgtatatgaaagttgttttaaaaaacatattaatctattttttttaaaaaaatagttaatacttaattaatcatgaaataatacgagcttcgttttacgtgccgggggagaaggagttcccaacccatcctcccgaacacaaccttagtccacttgctatacctcaacctcgattctacgtcgagtttgtttgaagccccttatctccaatagtagaaatcttcacccataaactatacaaaaccatgtaatttgggtccgataatagtatagatgtttgattttgctgacataatatcgtagtcagtaaagtaaacataaaaataatatgtgcgtcccacatgtaactgaagtgagaagaaaaaatattgggcccgcgtgtcagtcccatcacctttcttctcttttcttcctaagcctgggagatggggggcagccgataggacgggagggggggaggaggaggtcggtgagcctgggagggagggagagagaccaaatgcgccggcgggagagcggggagaggaggtcggcgagtctagaagggagagaagaggataggaggttggtgagccttggagggagagagggagagaggcggtcggccgcaccggcgggaaagtggggagagacggtcggcgagcctaggagggagggggaggcaccggtggaagagggaggggagaggtgaccggtgaggttgggagtcatgttcgctgccgctaccgcaatgacgacaaagacgatgacgcacacgcgccactgcgcgcgcccaccgttccaccaccagccccgtgcacgaaggcagcgccgctcagctccagcccgtgcgccatcattgccaaggagacgaaaaccacggagcgcagctcctttccgttaagccactgcatgacgcggtcggcctccatgcccacgctaacattgccacctccccctcccccaggctcgccagctgcctctccccccctctcccactcgctgcatccccctctatcctaggcttgggaagaaaagaggaaagatgatgcggttgatacgcgtgccccacatattttcttctcatttcactaacatgtggacctcacatattatttttattttgctgactaggatgccatgttagcgaaacctagcaaggctagcatccatactactataggaatgagatctaaattgcacggttttatatagtttaaggttgaagatttttggtataggagataagagatgtcaaataaactaaacgtaaagttgagggacggcaaatggacttttttccattttaagcagcggcggtagggttggtaggtaggaagatccggcgccatgtacaaacgtcgccgtcggtcggtatcgttttccatcttcgacgtacacgttgatgttactaatacgtagtactggtaccacatggcagttagacacttaaacttggcgcctggatctggacatgccgacgtagatcggtcatcacacgttcaaaccccaccctgagttttttaaaatgaaaggtagtccctcggtttcacaatgtgactttctagcattgcccatatacatataatgaatctaaacatatatatatatatatgtctagatttattaacatctaaataaatataagcaatactagaaagttttacattgtgaaatagagaaagtaacagacagtgcctacttacttcctccatcatagaaaaaaataatttctgcatatgtttagatacatatatagtcagaagatgattttcttttcttacgaagggtgcatctcacagtgcaacctgtttttatatatatttgttgattggtgagagacaatttcaactccgtacttggtaccttaataggtgtagcggcctattgaaattaagtacacgtatggttttctttatttatgattgttagttggtgtgcaacgtcactatatctgtatcttaagtttgtatgcgcatgatatatatgttcatctaatgaccatcccttttatcaatatccatcgtttatcacgctatatttcatgtctagctttaaaaatgatcttattttcatgggctggcaagtttcaaatttgatccaaaatattctttgatttgctaaccatttttttcaaaaaaaaaatcaaatttctgaactttcaatccatacgtaggtttgtggtttggctttttttttttgattcaaggttccataaccattgccaagagtgccacattatattttgatcttttggccggggtcggaagaggggctttaggtgtgggatatatagaatagatctccatgttcggagggaggtggctaaccaatagcacatgagcatgcttggaagcaagcggtgcagggggatgaggtcggtaacacgtacaacaagaactcaagtggctgggaggtgttggcgtcttggcgagatgtggtgctaagtgttaacaatagtggaggcttagtggatgggaatatcttagctaaagctgcacaaaacatctggtttgaagtggggggataattagtagggaagagggaattgagtgagtgagagagagagagaggaggtggctagtgaagcatgtggatgttatcaaggcaggggttgtgtctagaggaggaagggtgacgtcatcgtgttgcaactttggataaacggaggaaagccattgacagagacagctcccaggcaggtcggacaacctcccaagctccaccgctgccatcttctttgcggattgtctttcgacattaaaaaatcacagagaaacattgttagccgtttggatttaacaacggtattggttccgcccctaaagaggacgagtacggtgagggatttttttttccttaaaaaatgaagtacaggtagacactctcatttatttttcttgaccgaaaagtttctccaatatgaatttggatttccctccgacagtagcttctagatcctaacctcgtttggatgggccaaaatcctgacgaggccacgtctatcagtgatgatttccatcggtttttctgaaatgtacagctgcaccgaaatctcggccaaacggaaaacgggagttttcaactttgtgctgaattttgtcaattgcattgtcggttatcgaattgaaactactccgaataaattctgacaattggttagaatggtttgtcaattgcgtttgttcaatatctgcgctaatcgccaaatctcccccaaaatcttacaaagcaggggtcgacgaggcggaaacgagaacgacccggacactcacaacgggcaggagtgggtctcataataagttcatatttcatgtatccgtttaacctaaaaataagttaatttttaacaattattgtattattccatgcttccaaacgtataagacttattccattcttttgtttttttaaaaaatctaagtccaatttatagttactatgtgttaaattaagttgttgattagaacccaaaagccattgagggcggctagggaatgtatcccgtctgaacgggatacttgagattgacatcaatgctgacgtcattatacgtacgcggtaccacgtatgatacctacactactacgaaaacgatttttccgtgtggtccaaaagggttttcgcgtgcggatctcccgcccatctgcattgaagtgtcagcaaaaatccgattttttcgtgcgcacgcgaaaatctaattttcacgtgcgggtggcttatgtcgcaaaaaaaaaaaaaccaaaccctaacccaagccgccgccctcctcgtggtcgccgtcgtcggcggtggcgttgccgccttctgccgctaccggccgccgcggccggctcccagcagcgtcgctgccgcccaccgccgaatctgggcgggagaggggcgccgccgcccactgctggtcccggccacagccagggttttaaatttcaaaatacgattttatgccagtggggggcgaaattaccgaaatttcggaaatttctagccgaaattatttgaaaatttgactgaatttgaataaaatttgaccaaattcacaaaaacttgcaaaaaaccaaaaatttcgggcgagatttgagtatgccggtgggggtgaaaattaccaaaatttttgaaatttctaaccgaaatttcaaaccctggccgcagcccacaagcgaggccgtgctaccgtcgcccgtgagagacgagagagagatagaagaaatgaggataacgatgagtaggtggagaggataagatagaaatttttgaagtggttgagaggggaaaaatacctgaggagggtatttcgcgtgcggtgctcttaagatgcccgcatgcgaaaatttattttcgtgtggtccgcttgcaaaaataggtttattttttgcgtgtggactcttaaaaggcccgcatgtgaaaaccgatttttgtgtgtggtcctcttaagggtccgcacgcaaaaatgggaggacaatttttctagatgcggtcagttatggaccatatggaatctaacgaggggctcgtacaggaaaatcgttttttagcagtgcaattagttccaagacatgatatttgtgtaacaggtcagataccctataggtatcatgtcaaggtacaaaaacatgatacttaagtaacaggttagataccctataggtattacgtcaatgctgatgtcactgtatacgtatacggtaccatatatgatacctattggtatcgaacatgatacatgagtatcaagtatgatactttatgagtaccaagtatgatacctgcatgtaccagccatggtacctgggtaccaagttggtacctgtaggtaccaagtccgatacttatatataccagacttggtacctgggtaccaggtccaatacatataggtaccaaagtattatgatactactaaagtatcatagcacactaagaaccaaaaatcatatcttaccaagacagagctcaattaaaccaacaaagaaaattgattccgggaaaaaaagtcatcatagtggtagaaacacccatagaacatgtagaacaccccaagatcaaacctcaaacccaagccaacgcaaaagctcgggggtcacgagccaagatctaaatatatggatccgcaccacaagaggccttgtcctcgatgatggtgacctcatcgacgatggccacctcctgaaacgtggtgagtagctctgtcttcgtcttgtgcttgggtacctaccccacgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 68985 - DNA, 702 bp, Oryza sativa
cctgcagcccctgtggtattctcccccggccttctgagtttctcctgctcgttttgaatttctacggtctttctttgctccatttgaaccccaattccatcgccttcctcagtatcttttcgcatctttgtgaggcctacattggggtagagccgtttctcgacctctttcgcttctactacgagttgcgtcggatagaatccaccagggtatctggatgcgttggtttccgactttgggatggcctgaagttgcgctatatccccttccagtgcccttcttctcgtagcaagtggcaggcgaggtggttctatcttcagatagaggattcagatccaatctttgttgttcctgaggaacaaccagacaagattccgtcttggaccgccaaacccgtcttgaccccttctcttcagtccttcattgatgccatcgatgacctccgagtacggggtttgtcggggtatgaagtcgctgccgacttcattggtaggcggatccagccactccaggctcgagcccacccagcctttgactattctgggccggaggacgcgacccgggtttctcctcggggtatttttcttgtatttaatttgacttccttatgtgcatgtttctcctgacttaccgaattctggttctcggtctacaggtatgaacagcgaaaccgtggagcgtcgcgtcggccaattgatgatc

SEQ ID NO: 68986 - DNA, 1258 bp, Oryza sativa
acaccaattggtcttccattgagtagtgagtcgggggctacagatgttatatcatatttttcataatatttatcttgattgcttgcgacataatctgagtacaaaagtacctatcgagttatggagttctatcttcctatgctttccgttcggtttgccaatggatggttgcctttgggccgattcctagcacccgggggctcgttggatggaccgaataacgcaaggtgctaagtattattcggaataaatcaaaagcatagagataagataatttattttctgctcttaataattgcaaaagtacctgagtagtaaattctaatccgtgaaactttgttccattaatgacgaactcatatcactcatatgcatgtttgggaagtgcctaggccgactcccgatgcttggtggttatgactagtcgggcagagtgtttaaacgtacagagtcatctgctcggggaaatcaaaattgacaagaggagaaatacatatttataaatattttaaaatacttgattttttctcgagtattatatttatatcagatactactcatcctatatgtttgttctgcaggatccagatccagatatgcataaaagggattcatggctttaagcttatctcttacgctccaggaatggatcagtcagaacatcaccaccggccgcctcgaccgccgccgacaggtgtttccgcctgcacggctggcctattatgccgccgttgttgggcgtctactcttcaccgaccggccgcctcgtccgccgccgactggtgcttccgcctgcacggctgacttattatgccgccgttgttgggcgtctacgtcttcaccgaccggcttgccttcgccgccgccgactggtgtttccgcctgcacggctggcctattatgccgctgttgttgggcgtctacgtcttcaccgaccggctgcctcgtccgccgccgactggtgtcaccgcctgcacggctgacttattatgccgccgttgttgggcgtctacgtcttcaccgaccggccgcctcgaccgccgccgactggtgtttccgcctgcacggctggcctattatgccgctgttgttgggcgtctacgtcttcacgaccggccgcctcgaccgccgccgactggtgtttccgcctgcacggctggcctattatgccgccgttgttgggcgtctacgtcttcaccgaccggccgcctcgaccgccgccgactggtgtttccgcctgcacggctggcctattatg

SEQ ID NO: 68987 - DNA, 2048 bp, Oryza sativa
ccccgtccctaggggcttcaaatcacaaaccacaaattctcacaaatctcatccaagaaacaaaatccaatcacaaacattgtaaagttgcaacacaaaatcattggattcaaatctacagcaagttaacaacaatgaacatgtaaacttaaaaaaaaacacgtcgtcatcgccggcgaactcctttgttgtatggggtggccgccgccgcctccctcccccctccagctggatctgggaagggagggttggggcagcgagctagcgacgcagccggcgctagtcatcgtcattgcgcagtagggccgtcgtcgtcctgcggtagtactcgtgtgtatagtagtgggatagaaaaaaacaggttatgaggaaatgctttgtgcacgtgtttttctctttaaaatccacaatataatagtatgtactcgatgtactaaatagttaatacatatagaagtttctgatacatgagaactaggagcgagaactagttcttatatgagaaatcatccaagaaagtaattttaagagggcttaaaaaagaaaataatgaaacaacccatgatcaattataaattaagttctacaactcaaattcgaaaagactggtaaggcaacgagcaaacaatgaaaaagttcgacggttcatatttttttttactatagatttgtatcattagatttatcatcgaactgctttaataacatacggtcataaatattcgacactttagtcaaacttttgaaatttcaaaataagtttttacaaaatctaataaatttatgaataatattttaggtaaatttaagtgcacttttttactttctaaaattaagtgtttcaaatggttgagatttaaaaatttgcccaataatcaaatataatgactagagatcggagagagagagtataaagatctgaaataagaaaatagacaatagtagctatagatatatatatgtctagattcatttagatcaatatgaatgtaggaaatgctagaatgacttacattgtgaaacggatgaagtaattcaattactctagatttatttagttattctcatgaaacctcaaatttcagatggaaaagaattatgatattatggtaatatttttgaggtaatttaagtgcacctcttttaattttgaaaattaagcgtttcagatggttgagatttaaaaaattatccaaatcttacatgaacatcaagtataatgaccagagagcgggggagagagtataaaaactcgaaacaagaaaaatagactgattgtttgtttgtagctaatgcactaaagccataccaagagaaccgatcccaatggtaccacattatcgccgatgtgcaaagtacaaaggagttgctagcagaggtgaaatatcgtcatgtcgaaagaggttgcaatagggtactcatgagttagcgcagctgactagtagaacgaagcattgtgcactatggtgggagcatattcccacctgcattcaaggccttgttctcaacgattgaaataactttgttctcatcagtaaagctttctctttctgaaaaaaaagaaataagaaaataggcaatactagctattaaaacataattcaattactctggattttagttattctcatgaaacttcaaattttcagatggaaaatttcacagggtcatctgtcagttctgtcgcatctctgtccacagttgatatatgaaaagaaaaatccatcctgaatagaaaaagaaaaacagaaaaaaaaaccttttgtttttccttttttctcacttgtccctacttgaccagtccttgtccctatctcccctttctcaggtcaaccgattctatccaagatccagtccccctttctccttccttccttcctcgagcctcatttcccccccaatcttcttcccaaaagcagctccatccaaacccaatcaagccccactccccaccaacccccttccctcaattataagcctacaactactgctgattgcttcagactgatccaagaaagggaagtttggttgtggtgcagagaggtgca

SEQ ID NO: 68988 - DNA, 22290 bp, Oryza sativa
attcctgcagcctcaagaaagggaccatctttctgctgctgctgtccgggttggtgcttgttgaatttgaggctaaagaagtcggaattggaggttttgtaagagggaaacaatggctggcaaggaaatctaccacaagatgaaggacaaggtactgagtaatggaggactggaggatggggattcttgtttgttcttcctttggcctccatttccctttcatgtttattgtttttttttatttttttgctattcctgtgctatttttggggtaatatttaggtgcaccgttgtgtcgaatcttttccttttcatattagcttgaggggatcttgaaatggcgaaggctagaagtctgaacatgtcttaaaaatcttggaatgatgctaggctatggtgtctatttatttattttgggccaaatctgttgcttaattacgacaatccaatggtttgtggttctataaacataatgagtcccgatgccatgaaactccgtgttgacgttagattcttggagttatcatgtttctcgttcctactagcagaagcaggaaacatgtatcagtggagaaaataactactgaggaaacaaaacataactcgtctagaccagtagagagacaagcatttcaatatgttggttatgggaatctggtccatttcaccataaaacttcaagaacacgatctccggcttttgccggttaagcatgaattttattttatgcttagatttttttggatattcttttttatgaaagcttttggaactcaagaactcgtttgattgacgttgttccttgggagttttagagtttgcagcctggaaactagaagttatcttgaaatgttatactctactcaatgtagaatacacacatcactaaatccagactaaattcattttggtagactaccttatgcaccttctttgtgtttattcttgctgtgatgcaaccaatgtcaaaaaagcgaaaactgtttttttgctccattgtgctggatgttttccgcaagcttatatatttgctttgcttagtgttgtactattagcaacttaacatgcttgacgaacgattatgttttgtttaacaggtgaaagatgcttttagttcgtcaggaccagaaacagggaaaggaaaaacaaaattgtcaggcaagcgtgtcaagcatggttaccatcttgtgaagggaaaatcaaatcatccgatggaggactatctagtggcagagtacaggcaagaaggagagcatgatctggggctgtttgcaatatttgatgggcatttgggccacactgttccagacttcctgcgctcacatctctttgataatatcttaaagcaggtaatatttcaaattcaatgtcctgttaataggcttagcctcaatacttgctgcattgcctacatgctcagatagtaagattgttttgtcatcatgcgtcaattgttccaatattgtatttttactagctacatgtcctttgatttactatggataaaaatgaaccatccaagttctaatgctgttcacaataaatagttgtgtcattcattttttttgtcgttttaaggagcatctgacagtgtctgtacttacagtaaaaataacccattcgctatgtacttttatgtgttaaattctgagtttagaaggtttaaaaaaatggaattagaatatatggaatgaagattgcataatattaaagaaatgtaggaagcattttgagaaaagaaaaacaaggcggagttagtggggtggcgatttaccaccagcatcactactctttttcttttaggtattatacttatcctcaaaaacacagaaagagcaagtcaatctataatgcatatggtaaactataaacagggtaagaagagttgtacttctgttacgcttacaagtgttatctgtgcttgttctacaatctacttgcaagaaccatgctaggaataactatggagtgacctaaatatatagataatgtctatgcaattgaagatagtcaactgaattcacaactgtgctgattatttattgactccttcaacctcagccagaattcttgagcaacccacaagctgcaattcgaaatgcatatcaacttacggatgcaaaaatattggaaagcgcagctgagttgggcagaggaggctccactgctgttactgccatattaataagcagtgaaaattctgtgaacctagtagttgcaaatgttggagattcacgagcagttattagcaagagtggtgtagcaaaacagctttcggttgatcatgaaccaaacaaggagcggcattcaatcgagaaaaaaggtggctttgtttcaaacttaccaggtaaatgaccatttcttgtcaactctttttcctttttttttttttttgggggggggtttagtcattgtaattaacagtttaaagttatagatgttttttactgaggtttttttgtttgctaatctagtgtatctaatgtttagttccacactgctttcttatttggatttatgtccttgtatgactatatactagccatgtggccctcaatactgcccatctatttgagcccgtttcattggttgacattgcatcagatcctaggtccaggatacaccctaacactaagcatacctatgccaatattgcattagtaattaccagcagtggcgtacacagaccctactcttaactgcttctatgctgttactgtcacaacatatgagatgcaatctatcgagcttcaattccaaaaattttttacttgcaggagatgtaccgcgtgttgatggtcagcttgcggttgcaagggcatttggagaccggagcctaaagaagcacctcagctcagagccagatgtggtggaggaacctatagacgagaatactgattttctaattcttgcaagtgatggattatggaaggtgatgcctataaagctcataccaaccatccatgatagattacacctaaatttattgttttgcattctatatgcatacctaacctaagctcaacaaactggagaccatgtcctaccttatttaattctatatacacaccaaatctcagaatatgcatacatgcatgcactacattatttaattttgaacatgaggtactggaggttgagttttgtctaacaggtgaaagtgcttattcctacatttcagctacttcctccgtcccaaaatataagcatttttagatatctacacggtcttcgagatgctactttgaccaacaatgtctataaaagtaatatgttttaaataaaaagagttgcatattatgatagtttgtttaatgataaatctagcaatatcaaatttacatgattgatctttttcattattttgctattaatagtcaacatttaaaaagtttgatttggcactattctaaaaatgcttatattttgggatgaatgaagtatgtaatttggcatgcataagcacatcctgactcatgagttgcgaaccttgatttttctattttcttaagctgcatctatgactattgcatgattgtttttttttttgttttagttgagttctttactctttttatgctagttttcccaactcacctcgctcgttttccacgtgcatgcttttcaaactgctaaacggtgtgtttttttgtaaaaaatttctatacgaaagttgttttaaaaaattatattaatccatttttcaaaaaaaaagttaatacataattaattgtgcaatagtacgtgctccgttttgcgtgccggggaggaggggttcccagccttaatgagctgctaagttgcattagcgacgttcttttatcatatgcaacgattataatttcaagatcatacatatccaggtgatgtccaaccaagaggcggtggatgaaatcaaggacttcaaggatgctcaggcagctgcgaagcatctgacggagcaggccgtgaaccggaaaagcaaagacgacatctcctgcatcgttgtaaaattcctctgctagcagaaacagagtctcatacaagtgtacaattgctaccatctgatggtttcagtgttgttacttttgttgaatattctggttagtcttgtcgaacattgccgattgttgaatgccccaatgggacatgttcatatattatccctacaattccagtggatggttcattaattccttttgccctatcactttttctttatcaaaattctctcaacgcgaaaaaaaaataaattgctgaatttttttatctcaattctgaaacaaatgcataacacaaacatgcaacaaaaattgaatggcctgaagaaaaaaaaaatgctcgcatggggaactagctaaggattaccagctgagtctaaatgtaagcacaacgtttggcttaaaacagcaaacaaaaaatattttatgaataggacttatatatgcttttagcaatttaaaagtaaacggtgaaaaataaactataatgaaaaaactaaaaaattcaaatttagagtggctttaaaggctgagttcagcaagggagttagaatccttccccttcaacatataaaacggaactgtgaattagcgcataattaattaattatatgcttaaaatttttcaaaataaattaatatgatttttcaagcaacatttctatagaaaactttttcataaagcacatgtttaataattgaaaaagttaaatcaagagcgctctcggtttcctcctatcgcgcgacgcatcttatagccgtctatccgtgtcttcgtgctgttggagagacacgattgcttcatcaaagtgaggaatctgtatagcgtccagtattgctacaaaggacaccaccaatcatcaaaactaaagattggctacactagcattgttattttagtttagtttgtaccattatgctgtactcaaaatatacgataaaacgagtctaacattgaatatatccaaacattttaaataattacttcctccgtttcatattataagtcttataatatgaaacggaggaagtacttgaatcgtagaagtaacttagctctgcaatagtaactacgagataccctttttggaaagaggcgcgccttcgtacatatgctaattaggagaagagtgagttgcgtgtttaggcaacgaagcgacttcgtgctacgtagtcgcgtccccatttaataatttaggaagcatatgcgtgaaaaaaaagagagtgttgaacccacggtcccacactagtcactagcgtggaaaaaaagggagtatagaagtaggaaaaagtgtaccggaggtccctgaacttgtcaccgagatacgaaaatgtcctccaaccgcaataccagatatggggggtcccctaagtatgcaataccggtcacccgaggtcccagggcaggatttctccccgatttgtctgacgtggcagcggttttgtccaccgtggcgctttgacctcggtcgtcgtcgctgacttagcagcccggtagttaggacaacccgtggcgcactgaaggggcattcacttcacttctccctcctctggaaaccctagatcggcgagggcgacgcagctagcgatgaaggcgattcggagcaggctgcggcggacgggcggagtgtcgtgcaggcgaggcggtgaccggcgtgcctctaccgtcgactacctcgagctcgaggtggatctgggggcggcttaggcgcggcgaccagcagccaccttgggcgacctcgaggttgcatcggcgagtacccctccaattgggaatccgaatctggcaggtattacctttcgtagttaactgtgtgtgcttgcatggtaccagtgggatttgggaagtgaaattttttatattgtgagatgccttttttatctgggatttgatgtaagttgggagttttttatttaggtatgtagttgattagaggttatttaggcttacctctgtgcaaaagtttcgatttggacatggtatgcatgtgtaggtcaattataatataccctaaatcagttttatatgttgtttagcatgaaggggatggacgtgttggacactctcgtggttaggtttcatatgaatggggtttttctgttagatgggagtgagaagaagtattgcggtggatctgaggctttgtcatatgtagatagggataagatttccttgtcggagttatttggacacctgaaggagcattgcaatatgttgtcagggacaatgctccactggttgtttcctggtagggatttgcaaacaggtctaagggctctttgtgatgataaggcttgcaaattgatgtgtgattgtactggagaattggaggtggcagatatgtatgttgaagagcccaaaattgtggatttgtgtgataagtctgatgatgagagtgatttatgaggtagagatggaattggaagttgagagtgaagaagatggggaaaaaggggatgtacatgtagatgcatctaaagggaaagaagttgacaagggtaaagcaatagcagaggaggaaactgataggaggatagttttgtaccaatctgaatcagcacctctagttagccatcaaccttttagcagtgctcccaaagctagccatgaaccttcagacagttcacccattccaaatcagccaacatatgacactgaacccatagctaacgatccaccttctgatagtgatgaagatagtgactatattccaggggatgaagctcagtcagatgatgatgaagaggctgctgagatagagaaacattacaagaaggtcaagaggaaggtgaaggcaggacagctagagaacctggatgacttctttctagagaggggacaaccaagtgtgcatggtggtgttgaagatgcagggaatgaaaccccttatgcaaacagcgatgaggaggactcagtagatgagattggtagtgatggggaggtgaggactaagagaagtaaggaaccaaggtacaagaagagtgaaggtgtgcctaagtttgaactagggatgaagttcaactgtaagaagcaattcaagaaggctattacaaaatatgctcttgcagagaagaaagtgattaactttattaaggatgatgggcaaagggtaagggccaagtgtgattggcataactgtccctgggtatgtttgctatccaaaaattctaggtccaacagttggcaaatagtaacatttgaaaatttgcatgcttgtccacctaggagggatagtaggctagttacctctgttagaatagcagagaagtatggaaacttcatagctgctaatccttcttggctacttgctcacatgaaagctattgtacaagaggaaatgtttgcagatgcttctgtggctaagttgaagagagcaaaatggcttgtgcaaaagaaaaagtttgaggctactaaggggcaataccagcagttgtataggtatcaactagagcttcttagaagcaaccctggtagcactgtggttatcaacagagagattggcatggttccaccagtctttaagagaatctacatatgcttggatgcattgaagaaaggtttcatagctggctgtaggaaagttgtgggactggatggatgttttttcaagagggcaaccaatggagagctgctgtgtgcaatgggcagagatgctaacaaccaaatgtaccctattgcttgggcagtggttgccaaagaaaacaatgaggaatgagattggtttcttgatttgctttgtggggacttgaaagtggggacaggggcaagctgggtattcatttcagatcagcagaagataatatcattacaaactgcttttttcacttgtaaatttccatcacatgtcactgaacctttattttttgtatttccatacagggtatcctaaatgctgttgagaagtgggcactggaggctaggggtggaaacgagccgagccaagccttagctcggctcggcttgcaatggctcgcaacaagctaggcttggcttggctcctctcggttagggaaacgagctaaaacatgagctcggcttggctcgtttcttggctcgagccagctcgagctagcttgcaagccttccgttgaagctatataatttgtaatcattaagaaaagcaataacaaatcatcaacatgtaaaattaaaataactttatatattcaattcatcaagatctagacgataaattacatattaacaaataataactccactacaaaataaaatcatccatataaatatatgatggcctaggctcacgagccagctcgggcttggcttgttttagaaacgagctgaaaaggaggcttgggcttggctcgtttggcattcaagccgagccgagctaagcgagctcgagccaagcctgagctgagctcacgagcccgagctttttttccacccctacctgaggctgagcacaggaactgtgctaggcacatttatgccaattggaagaggcattttcctgacaagcaattccagaaaaagttctggaggtgtgcaaaggctccctgcaggatgttattcaatcttgctagggcaaaacttgctcaggtgactcaagctggagctcaagccatactgaacacacaccctgagcattggagtagagcctggttcaggttaggttctaactgtgactcagtaaacaataacatgtgtgaatctttcaacaaatggattttagaatctagattctatccaatcatcacaatgcttgagactattaggagaaaggtcatggttaggattagtgatcagaaatcaaatggtgcaaagtggacaaatgttgtatgccagggattgagaaaaaactaaatgtttacatagctgagtcagccttttgccatgcaatttgcaatggaggtgataattttgaggttaatcaccatgaccataggtttacaatacatttggacaaaaaggaatgctcttgtaggtattggcagctgtcaggactaccatgccctcatgcaatatcttgcatttactatagaaccaacaagctagatgagtacatagcaccttgttactatgtggatgatttcagaagcacacatgtgcactgccttcagccagtagagggaatgagtgcttggccggaggatgatagagaagcactcaatgctcctggatacataaagatgccaggaaggccaagaactaaaaggaggagggagatgcatgaaccacccaagcctaccaaaatgtccaagtatggtactgtcattagatgcactagctgcaagcaaattgggcacaacaaatctacctgtgcaaagcatcatggtgcaagttctagcaacctaggcagttctgagtagcttccatcaccaagtcaacagatggtgttatcaaacacaccaggcagttctgctcaaagcaggaagaggaaagctgtcagccttactacaacaagcaccacagaacattccaagagcaaccaatcaaagagcaaggtaaatggcaacaatttttcactattttcactttcgctaactttacctaattgccatactttcccactacaggcagcaatggatagccaggaagtggtcagggttgctgcaaaggccaaggtttcaacagctcagggtggatctgctagagtagatcttcaagcaatagttccccattcaaacagctctactactgcgtctgtgaggctcacatctggcaaggcaactgtcactgtctcagctcaagagcctacaaaaaacaagccaaagaagagagctggaggattacttattcttctgccctgggaagcaaagaagctttgaatgtgccattgtcagtaatgttagtgcaatatttgaacttcttttgtgatgtaatggcagactatttagccaagtaatctgtgatgccaaaatgtttggctatgtgatctctatgatgccatgctatttggctctcttatcagtgatgtaagacaaattatttatgttgtcatgccagactgttaggctagctatgtcacttattatgtgtatttgaatgtcagacaatgaatgtttgcttatctgttactgctggaagccaaatatggagtcacattttgcattgtcatgaggtttgctgcagaaattggcaggtttcatacactgtttgtatttgtttcatttcctgctgacatggacatttgctgcagaaattgacatgtttcattcactacacaaatggatttttcatacaccgcttgattttgtttccctgaacaaacaccaaaatttgcacaacctgatacacattgcatgctgattttctttcagattccatattgctcttaacacccactcattcacaaatttaattccaactggatagcacaagtgcacaactgatacatacatattttgacacatcaaaggaaagacttgatcacaccattcagtccacatagcatatagacaacacacatctaacaccacacatcagtccacacatcaacatgtctcattccttcccaactaacaccacaaacagcataaaaatacgtgacagcatacagattacaaggatttttttctccttctctaacttttgattcctagccttcaagcttctaattttttcctttttcacagcaaccatagccctcacatcatctatttctctcctctctcgctcccccttagcccgactgtcttcaacttccttatgcaacaattccttctccctcctcaacgaattcaccatgtcccgcaagtcattcaatagctcactgatgaaactggaagtcgggtcgtcacaccatgcccagaaatcacaccccccaacctgaaaccacaaccctacattcaaatcccaaaccgtccaaatccaaattcaacaacagaacaaccaaaagccctcacttaccctagcatgttaacacttgtagtatcggcgcccagggttgtccgtgctccatgagatccacctcgccgctttcgccgggcatcggcatcggcacatcaccgcgggttggtaatccagaggaccaacccggtaaggcacgggagaaggcttccactgatgggaagacgacgagccgtcgctcatcgagctcgacatctccgtaccgccactcgccaagtcgccgccgctctacaaatcgctgccgccgccgccgcccgctcgctagggtttcggtgtttgggggagaagcaaaccgcgccaaacatttccctcgttatatcctaactaccgggctgctgagtcaacaacgacgaccgaggtcaaagcgccacgatggacaaaaccgctgccacgtcggacaaatcggggagaaatcctgccctgggacctcgggtgaccggtattgcatacttaggagaccccccatatctggtattgcggttggaggacgttttagtatcttggtgacaagttcaggacctccggtacactttttccatagagaagaagtatataatacaattttatttttttgaaaaagccatcgattctgtcgatgccgcagtagagcccattgggccaaacctggcccaggactagaatacgcgcgggccaagaaacagggcgccgtgtcgcacgtcgaaaaccctaaaaaaaccaccgccctttctccactcctcccgacgttgccgcctccgcctcctccccctccatcgccggcggccgcttctagccggagagaagaaggcatgccgcggacgagcgtggtcgagagccccggctgcccgccgctccgggccctcaccaccgacatcctcggcctcatcaaaggtagcccgtccccacccttcccgccgccgccgccgccgcggcggcggcgtgctggtttgcctcctccggtgagagggctgatcatgttttgtggtattcatcctcaaccgcgcagtcgtggaggcccgcacgaagccggcgggcgtcgccaaggtcgtcgagacgtggggcgcgcccgacgcgccccgcgccgtcctcgccgcctcgctcgccgaccgcgccgtcgaccccgtgagtgttcgcgacctcccgttattcctccccgcggtaattggtcagagtatgatcctcactgcgttcctcgcttcttctcttcttctacaggttttggccgtggcgcggaagaacggcgtggtgagcaacgcgtttgcatttggagagctgaagcactcgttgagcatttttgtgctggttgtttattgctgtgggttttgtgtgtaggttgagctgctgaatccactgaatggggagactctcgcaggcgtcaacgctgctgctgggcgggcggcaccggctgatagttctgcagaagaggaccccttagccacgctgcatctcttcagaagacatgcgctggactcatccatgtaattttcatttgatgctctttggcaatttattgtgcacactcaatttgccatgtagatatgggttatgaatccacctgcatttgtggtctccatgctttagtgttctttcattttgtagataatggcatacttatgatgtattcattgcatatgtcaggttaggcacatttcttgcttgtacagagaaggggaaagcatatgtcaagtctgtcgcaaaggaaaatgcatcctcggacatggctgttgggccatcaagctcatgggatgtgagcaattcgggtacagtgcaattttcttcagtggatgctggtgaaagctacgcgatgttcggagggtgggtttacaataatctttatattcattatgtagcatctaagtgtactataaaaaaatattgcttctgattactaactactcaattggaaacatgagtagcttttatgaaggttgaggcgctaataataatatttcattttaggaaaggaatagaagtcaatttgtgggatatcacatcttgtagtaagatatggtctgccaagtctgtaagcactcactgactcacaccttttatcctttttctgggtctacttgcacttttatctgatgttatagcagactgccacgcattaactacttcattcttttttttacctgaagcctcgaggcaacagtcttcagatattcactgcaccttggttcactgctggaacttttttgtgcaaggatgaccatcgtaaaattgtagcctgcacaaataatcatcaggtattgctgatatgctaacaaaaaagatccattttcaactagtttggtcaaactgctctgtttctgtattgttgtctcattgaaactgatccaactttataatggcaaagcagaatgattgcaattgattagttttttcatgccagttagttgtcatgctgtatagtttcctcgtataataaatcatgaaaccgatactggattatgctaaataggatgttctcatacatcagttttcatctttcaaaataacactgcattgatgaggttttctcaatatttgtacctgtggtgcttcttctgattgttaggttcgcttatatgacactgcttcccaaagaaggcctgtaatttcagttgattttagggagtcaccaatcaaggcagttgctgaggacccaaatggacatgctgtctacattggtacaggaagaggggaccttgcttcctttgacatgagaacaggtattatatgatagtagctggtgtgtgataattcttgctgatggcacttggaagtcaaaatacattctgaattatattttcagagttgtagcttagtttgaattttgtatctagtatactatagttcaaataaaaatctcttttcattttcgtactctaaagttcactctggcatgtgtatttcattgtactattttttggctaccatgctctgatgcttacataggtggtacaacattggttgtttatttattttcctgatcgattcatagttagttcatcatgtgctatatggatacatttaactgcctggagaagttttatttaaatttaacttaatattctgcaatgagcttatgcatcatgcacttttttggaggaacagagaaaacaaatatgcatctctgtgggtttccaggaacatcaactgtgaatcaaaaccttcggttgaatattcttgctaaaaatgcacctcctcaattgattcctgtgtacatccctcaactatagcatgaataaagttgtgctgttatggttcttgtactaacctgagcaaatatgccaacaaattttcaggggatttgagactactaaactatctgtgagtgatattgaaataccagataaattggtttcaattcaggcgttagaaagatatcttgttcatgtcccttatcagatatcaaaagatgtttgattattgtatgcttacaacattctagattatattctatgtaaattccttacactttgcaatcggtattcactttttagttctttttaatgtatctatttacagaattaactttagcttgcacccttttcccaggaaaactacttggttgctttgctggtaaatgcagtggaagtattagatctatagttagacatccagagctacctttgatagcatcttgtggtaaggctgcatattttgaaaaaatatttttccaattatttcatattcatttattttgagcgcaaatttattggttacatgtatttgtcttgcacacctttactagtctaggttattctgtttgcattaactcaggaaaccaatttactattgtaggactggacagttacttacgcatctgggacacaaatacaaggcagctgctctctgcggtacgtttaacagttaatttcatagtattcaaatactatattttccatgcaattaacagatactgtttcagttctgcttttatttgccattgcttcattttggacataccatataagtgaattattgtggtcatgaagacatcatgggctagtcaaacattttagacttaaccttggggtactcttttactggttggcatgcgcaagtgtattggtattggtattggtattgatttttcttctggccacccttttgctgtctagttaattgccttttggtggttgttttgctagtttgctgcattctatttaaaattaagatatatctcccttcggaaattacgtgcttcacagtgaagttataatgtaccatgattcttgtgcaacttgaaactgtgtccaggtttaaacattttatccttgtagttgcacgatctaatgctcttcactgtcctgtttcgtaacaggtcttcctcaagcagcacctgacagctgtggttattgattcacatttctccactgaaggtaccattccatttattactgttctttgtttaccaatgtaattccagcacacatcaccttaaataatagtgagacttaatagagcagtgcttctattatcttgaatagaagggctagttaagatagtaatctacatctttcagccctaggaccccaaagcccaagatgtagtgctactcttcaaactttttgaaacgaagttcattgccatatcgaattgattcatgaagaattccacgtgttcatctacttacgctcttgttggatgttcagaactcgaggagactaaatccaagcagccagatccagttggggcagaagttagaaaggaaagaaaggaaaagaagaatagaacgagtgaaatggatgaagacgaaactagaatgctcgaccatgatgacagtgattctgaaatgcacacctcaaagagaaaaaaatctggtgaaaaaagcaaaggaatgaaaaagaaaagcaagaagcagcaagtcgcatagataggacacacaacactggagtcagtgttgaccagttttgactttttgactaaggtgctttgcccttcactcgattttgtacaatgaatatcatttgtattagagtttattcgaactcgaacaatagcacttatctggattctcaattcttcaaatacttgccgggccaattaagtattttactatgccttctgagcaatataaaagaaatggcgtattatcaccccttttttgtgtgctagtccgtcctttcttatcaagctgaagagtttagttttgatcatagtgtttccttactctatataaattgataagagaagtgcacattttgtccaattttggtccatcaactataaaaccgttcattatagttccttgactcttggaacagtccacatttcatcctacatctaaactgggggtacggtaacatggcgcttgagttgggtccacatgagcaaatagtaacggtatgaatatagcaaccataatgaacgacagtgaaacaaaaacttgaacaaatactaaaaccttgcctccttttcctttcccatatctcaaattttttctttttgaacaaatactaaaaccttgcctccttttcctttcccatatctcaaattatttctttttgaaagaagctatatattatttaagaaatttctaattaagattgtcatgtcacacggagccacatcaccaaaagctacgaaagatgaggtggtttgaaagagatcaataatgacgaccctctaaaactcagtattaagaaaacatagagtagaaaaaaaagtaagaatagaatgtcatactcattgaattcctataagattctgaagcataggaaagtttcaaattgtctttgattagcacatagaaaaaacccaaaaattctacatgaaaaggaaagcatgtggtgagacctcatgtttatttttatctaaaattgctctaggatgatccattccataaaaatttcaaaggaatggataggaaacaattttgttttaaagggtttgataggataaaatcagtattactatggtttttcctttgtttcaaattcatgtggttttttctttgtttcaaagatggtctgaagccttgaacgaattcatagtgaaggactaaatttggaccgagcggtcaagggattaaatatggagcttttccaatcgataatggcatggaagtagttagtggagtgaaatgagcttagctgaactggttaagttccttgcggtggaactacccacctaagtatcctatatttgatacgtgtgctcgtatttacggctaattattttttcagtggtagataatgtaattgttgatagcgagacacctctctttcgttgtaaagttgttagtggaaatctgatgcacgccagtttcctactattaatgccaggaaaagaaaattgcccatttccatgagtggtacaaggggaacaaaattaatctttacatagttcccttcaaggcttgaataactttattaacatcgtttccgtatgaacattttgcttatctataaactattacttatctccatatatatatagcatcttcagaaggatcctggcaatctcctcatcacaacaaccatgtgatcatatgacagccagaacaaaaaacaatggcagtcttctcgcaacaacagcaatcatttgaccgccaaacatcccaattgtgctggataatttgcagagttcaacagtttcagaccattttcctcccagccttcagctattacgctgtcgttctcgaatccggggacaaactcatcaaaatctgctaacgatttaagttgcctgttcagtgaagctattgtcttctggcagtctgccagtttccctgctgcacgagctagctctttctcctgcagaaagtggtgacatctcattagtagcatacaaactaaaagttttagtgtttgtcacaaggcttgattttgcaatatatatgataaatcactgaataaatgtacaattagtactatgaaattcacctttttaatgtgaagttctttacttgccataggtttcattggttggctaagagctctgctggtaaattgctctttcaaattctgacattgcactccaagttcagaagattgtgctttctctttgtgaatttcctcctcgagcaaacggatcttcctgcgcaattcctccacttccgcctctttgagctcaaaccgactggcgaatttgttcttctgggcttcagaagcatccaatgcagtaatgtaggcagatgacaagttcttctggctttccagcttcttctccaacgaactgacatgatccttcaggcgcatggcttcagcctgtgccaacctgagctgggactccaatcctgcagtcaatggcttgtgcttctcttcagcctcttcaagcatcttaaccttctcattcaggccagcgatttctgagtttgcagattggagctgagatctgagctcatttgtctgcacacccagtgcctctagatcacaagaccgtgtcgcgagtttctcagacagtgccctctcctcctggattttcagttccaagatgctaactttcttctgcagagatgcaatttcctctcgtgccgactccaactcatgctctgtacccttcttcttctcttccagagcttcgattccatggcacctcactgcgagccgggttgaaaacgccttctcctcctccagcttcttctctagaagagtgatcttatcaccgagatttttggcttcagattgtgatgcttccaggtgaccacgcagctctctcctctctgcctctagtgcatccatctgctgatacttagcagccagctccagcgtcagcgccttttcggactcgagacgttcctccagaatgcggcccttgtcgagcaagctcgtgatctcgccatgggcgagctcaattctcccctccagttcattcctcctgttctccatggcttccatttcggtttccatggaatgtttcactcccttgacaaggttcagttgcctctgcaattcgaccgatttctcctctgccaccatcgcccgatgccgggtgttcctgagctctcgctgagcttcgtgcagcgccttctccctgtccgccttctccattgccagcctcttgatcttctcctcgagcttcaccagctggacgctagcggcgtcctcggcctcgctcttggatgggctattcgccgacgcgatcttctccatctccaggaagtcatccatcatgccgatgtctgcagccgcgaggctcgcactcctcgtgatgctcttgtcgttcttgaattgatcgagctcggtgatcagaatcgaggcccatgagtccgagcagtctgactggcaatcggtgactgactcggcgtagaccgagcttggtgcacgcttgagttctctccgtgcattggcctgccaaaaattctcacagatgttagtgttagagagagttattagcggactcatgggccttgagttggtacgtgaaactaatgaaaatgaagattaagtaagggcacggaaaacaagaaatctcttagcgcatggttagatttatttgacattttagggtaacttctatatacaaagttttcgtgcaaaatatatcctacttcctccgtttcataatgtaagtcattctagcattgcccacgttcatatagatgttaatgaatctagacatatatgtgtagctagattcattagcatctatatgaatgcaatgctagaatgacttacattatgaaacagaggaagtattatttagcagtttgaaaagcatgctaacggaaaccaaggtagaatctacgtactaatcagaagagatttgcttcggtcctggtgcatggttcctcgcggtactaaatcattttcgatcgttaaatctagctaggtagggtggacattgttagatccaacgatcgaaaacgatttagtaccatgaggtactttttattgaactggagcgaatttctgatcagaaaagaacgggaactgtccaaaatgcagagctgttgggggaaaaaagaggaaatggcattacctgcagccttctgcattcggcttcgagcttggctatcttcttgatgctctcaagctgctgcttgctggccgtctctgctgccctcctgttcagctccttctcgatggtcctgagctccacctcctccgacatggccagcagctgaaccttgagagcagagttctccttctccaaggaggccagccttgagctcgcatcagtttcagcgttcaccgagaactcggacttcgcctccagcttcgccttcagctcgactactcgcagctcgaggtcggccttctccgactcccattctcgcgactgctgcgctagcgcgtcctggatgccatgatccagctcttccttggcacgccggagttgcctgacgcattccttgagggcgccgtcgaggtgaacgattctgtcttccagtgttgagttcttggcagttgcagcgttcagctgggtcttcagtgatgctatctctttctcggccttctcccatcctagtaggagaattgcaggtttttgttatgaagatctggcttgtcagttgtcagttctatttatgcatgtgtagaaataacactgtttctaggatcagattaaaaaaagaactctttctaggggattaagcttttgcttcaaatcattagtacattattcgtgaaaaaaatattagtacataaaacttaaggattaggttgagaggaccttagaataagaatgttctttttctaagtcagggaattgataaaactacaaatgagcttttggaccacatgatcagtacaaaaaattaaaagcaagagacaaggaacatatctgcatatgcatatgcagtatatccaggtccaaacagagtcatttcttaaattttttggcccagcgaaaaacaataatttgtttgaatttttgcttcatgtactgaaactgtacgattcagtcatgtttaacatcatacctagaacagcttcctccgcaacttttgaatgctgcttcacaagatcatcttttgcacgtatgtccaaaactgcagatgacagtctctcgctcaacaccttcaccttcacattgtcatcctgcgcttccttcgacgagatctccggtgattgaactgagcttggagaactctttggagtatcctaaccaagaacaaacaggatcaaacattgtcctgactagaaagtgcaaaattaggaggctattcatgcaaaatttcttgtgaacttcagctattagtcatgcaacagtattgcagaacaaagggagtggctgaagtaacaataagaaacctctattggatgcatctgaaaatttggaagaatcaattatcaaagtattaaatactgttttttttctggacaaaagcaaatgagcacgtgaagtacgacatggtactttctgagatcatgttcttgcatgattcccaacattatgctcagagaagcacaatgattaaggggattcttaggactttgagcaccattactccataatcatcatcatattaacttctatacaataggacacccctaattaaatgcacaactccatcagaattccagacatttctttggaggtacaggtagagctgatggtcaaagatcaggaattcacaagtaaatgttgcacatgaacagaggtgagagagagagagagagagagagagagagaggcatcttgattgctctgtgccagcagacacattatgaggcatttgggttgggccaaagggtgatgctgcagcacatggagatggatggagtggccaccaaagaaaatgcatcttgccctcatgcaagccataattcctgcagagaaaagctagtcccaactaacatcacatccttgttgtccatggataggtaaggcttgtcctataatcccttcccggtatagaaacaaacaggacccctctctctcattctctccttcagtttacaggcctacccaaaaactgtgacatatgatcatggactaattgccagtgtcacctaccaaacaaaggaagggaaactgaatctatcttacagtcccctcattttgtcatgtggctagtatgattgggagctgctatgtggatgtctacgaggatgtcgcaaacgcgcgattttcgcgatatcaccagacaagagaataaacctgctaggatggatgaatcatcaaacagaaagaataattcttgtaccctacatggtacaactaggattggtcaggaagaactgagctgtttttatgcagaggaactctgatcctccatcaaaatctttatctaatgccatcagagcttcaaatcttaaagagttcacatctgcaacatggtggtagattaccaaagcttccagcctctacagatctgaaaccggatgaaacctcacatgtttgccatatcagatggacccttattttctctgtactgcacatgttacatgatctgttcaatggaaggagcgtagggctcacaaagtcaattgacaatcatcaattcgtttgagcatgcttgcacaacactcctagacactagacaggtattatcattcttcaacatttgagcctcttttactg

SEQ ID NO: 68989 - DNA, 3021 bp, Oryza sativa
tttgagaaatgtgagataaacatgcggaaatgaccgcgatttcggaaaaaaaatatgaactttattttccgagaacacgcagaagagctgcgtgtctttggattggtaggaaaagattactgcccaattatcgtgatattctaatattgcaagtagtacctactgtttgactttaaattgtgcaaatatgtataaacttctgaaatgtgaatgcagtatacagggagaagaagaaagagagtgacttgttttttttttctcacctgttcatcagacagcctctcggatggagaagaaaccgagctctcggtctcggccgggctcttctccgtcgatctccgccgccatagccagctccggcgatccatccctggagctctctacaccattcggctcaatgccgatgcttctgcgcctcaatctctctgcttatctcactgtcttcctattcagcaatccaaattcgatgagttcatttttttttctgaagaaaaaggaaagaaattttgcctcttatattaataaagcaggaattcgatgagttcatggtcgcacaagaaaccaaacacacagaaaggaaaaaaaggagttgcagcttttgtatttttgtccgtccaagaacacaatcaaaaagccttcaaaaagtcaacttgatacagtccagtgaccgtgagacaaaacctccttgatcgagacatgaaattcagctcaagttcagaagtttatcagtgtgcgacgaactcacccagaaaaaagtttacaaatcctaccaaattaccatcccggcaccaagacctatcactctatcagagattcagagccaaaatttcacccaatgcatccacatctaatcagagaagaaacaaaaacagaaagaaaaaaaaaagaaagaaaccatcctacctgccatccatggagaatgaacagaaaacaaccatcagatggattagctcgtactgggccaatccaagaacaagcattgcatatcgttttcacctcaaaaaccacccaaatcaacccgaaagatttcatcaagaaaaccaaaaatcccagaacacgctcccctccactacaaattaatcaccaagaaatgggagaagcgaaggcagagtccacacgaacaggacatgaatccaagcagagaagaagagcagtggagcagcagcacacgcacctcccggaggaggccgagaagcgtgacgagccgcggccggaaggaagcgaggcggcgcgatacacgagacccgacccgctggattcctcctcctactcttcctcctttacctcgcctatttaaaaccgcgaggtcggagagtacaaaaggagtgtgaaaaataaatacttgaaaaaaaagagagaggaagaaaggtgtggcgtctcaatagggagaagaaagaaatggaggcttcgatgtggcattttcacgcgagataagggtttgatgaaaaaaaactgagaaataggaaaaaaatacagtattttaacaatgataagggcccctttgaatcaaaggaattataaaggaattttatagggttgaaatactataggaaatttttccacgtagccctttgattcaaaggattgaaattttccaaatcctacaaaattcctatggaatggcttgttgcatataggttttagaggaaacttagcaagaggtccaatctcttggtaaaaatcctttgagtctatctctctcatccgattcctgtgtttttcctgtggtccaatcaaacgatcattcctgtgttttgtaatcctctgttttacacttacattcctgtcagaatcctatgtttttcctattcctccgtttttttattcctacgattcaaaggggcccttaatagtgcaaatgttgaaaatataatcataactaactgggtgacccgcgcaattgcgcgggtagcacccaaacaaaatcatatatttttttaatatgattttacttaaaatttattaaatagctatctaattgtcttaaaactttgaaggactaaaccttatcatccctgacggagcgtggagctcctcaccgggagaccgcgcaggcccccctttgccggttcggccgggggcgctaagtgaggttcttcgccctcgatcgatctggagaatgttcgcgagagagcaagtgcacgagacacgggcgatgtagacaggttcgggctgctgagaagcgtaataccctactcctgtgttctggtggatctgtgtgtgaaggagttacagagagccggagagccagagagttcaggctccagaacccctctagcctccttttttcttctttttttctttcctcctcctttttggtgggcaaggtcctccttttatatctcaaggggataccacatgcaccacttctacctacttttcttttgggtggggacctaccctatcttgaccaaaacttagcttgcaccttcgcctggaagttaaatcacaacttgtccttgagtgaggctcagcgccgtcactcgcctgacaccggggatctccctgttactcccttattaatgggcggagatttgccatggctgctttccaaatgaccatccgacgagatgggtcatacctacctccactccaccggaagcagatgcatcgtgggagcacggttgtctgccgatgacgcgaccggcgtcagaccagtcacagaccggtcattcttgtccaccacgtgtcagtttagcatgctacacgtctgcccttcttcatacaatgacttccttgcaatggttgcgatgaagcctggaatgtatctggccggggctgacgtgccaactccaggagttcccacgccggcttcggctagggacgagtgcctggaggctctcatcattccgacaggacggggcgaggcgtgtgtcaggccgcctgttgccacctaacccgcgatctgaccggtctgtgaccggtcacacactgtgacctgtcacggaccgaacgagtgtgctacgctgcattaaatgcggcgtggggcgctcgtccaacccgcaataaacgcggttaggt

SEQ ID NO: 68990 - DNA, 11005 bp, Oryza sativa
accccccccccgagggggtcaggccacgtgggtgactgcagctgccccaaacctctagtcaagatacccccggtcccatgtcaccgacagtagcccccggcgttacgccagggcgatcgcccccctcgagggaagcgctcgggcgtgacgccactccttagacctggtgacagatggggccggtctctacaggcagcagaaacccagcggtcgcaaatcgcgcacatcggcaaggaaaaaccgaccgacaataatgagcggctttctttaagaccgctacattacttaagtagcgcgcgaaccgggacgagccagttcgtttcgcctggagatgtgatgacggtgcatcggtcggcgagcgtagttaacgcgcgcacgatatgtcccatctcgactgccacggccgcacatccgcctcgtgcgccgcaaacgggcgagcgggattagtggaggcgtgggcgcgaaagacgagggggcgaggtagtgggcgcggggatcgaggagccgggcatagcgttggcaagggtactaagacatcaaggaagggatttgtttccttcctctcgtcactcttccctttgcctttgccacttgtgctctgactctccgtttccggcgccctacccttgccatactcgctcgctctcaagctcctcctccgccggcgtcatggcacggggctccgcaccgctcgagggtagcgtgctgccgccttcccgcatcgtgagcgagaggcaggccgggctgccgcgccgattcatgccggaatctgccaccggccgggaggtggtcgcgctgggcgagggacgcccggcgccgcattacccggggcggtccgtcttcttcctctctttcgtaatggcagggctggtcccgccattctcttctttcttcatggatgttctggagctttatgatctccagatggcgcacctcacccccaacgcggtaatgacgttggccatcttcgcgcacctatgcgagatgttcatcagggtgcgcccatctcttcggctgttccggtggttcttcaccgtacagccggtgttgccaccgtcggtagtcggtggctgctactttcagctgcgggggccagtgctgaaccgctacattccctgcgtccttcgcaagaagtgggacgactggaagagcgactggttctacacccctctcgccgacgaagcgcacctccgacttccgagccagcccccggcgcaggcctccagctggcgggcgccggtagatctgggagacggctacgacgccgttcttgaccgcctggcgggtctgcgatcccaggggctcacgggggccatggtgttcggcgactaccttcgtcgccggatcgcgccactccagcggcgcgcccgggacgcctgggagtacactgggtccgaggactacatgaggacccaccaggggggcagatgggactgggcccctgaggacttcaagatggtggtccaacaggtgctgaatctcagctccgtggaggcatccctcatcccccaaggtgtcctccccctctgcagcgatccagagcgcgccaacatcctgactatcatgcaggaggtcagggcgtcaggggagcgggctcctcgaggccacgatggcgcgggcgggagccgcaggggggaacaatctaccccgggagggggtcgtgcttctgggccccgtgatgggggcccggggggcagccgccctgccgacgcccgggggaagaggaaacaggaggataccccctccccatctcctccccgagggggcggggcggtgcgtgccagcagcaggcgcccggagggtgctgtgccgacgtcgcagcccgagggggagcgaaaaaagaagcggctccgcaagatggggggaccgaaccatgccggggaaacctcatctcccccccaaggtggtcgtttagccgacctcctcgcaggttcgtccccgcgcccactgcggccgtattcattctcccaaggtgagttttcacttacccgttttctttttgtcttctggtttttcttccgctttcagcgagattccgtcgcgcccccctcgccattccaagtccggccagtctgaggccgaggagacagcgaccgcggaggcccggaggcgggaagctgtccggcgagaagccgcggaccgcctccgggaagctgaggaggctgcccaggaagccgtccgggttcgccaggctgaggaggccgctcaggaggaggccagactccgccgggccgggaagtcagcccgggaggcagaggcgacacgcgcacgccaggcggcctgccaagcccccgacccgactccgcccgaggcaacgacgacttccgaggccacccacgacgaggccgcgggcgcgccgctcggacccgacccttcgggcgacgttcgggacgagccagcctcgggggacgcccctgagtccggcacgtcgattggcgggccgagccgcacagcgcccacaccaaggcagctctcccctctgccttccaccgccccactgaacacagagcccctcctgcaggccctggccgccgcgaacacgacggtgctggacgggttaggtgcccagatggaggtcctgcaagcagagcgggcggaactcgacgcggcgtgggcgcgcgtcgaagaggggcggcgctcggtggaggccatggtggaggcgggccgcaaggcataccgccggcacgcctcagagctcgaggcccgtcggtgggagctggcggagatcgccagggaggtggaggaggagcgggagactgccctcatcgccaccgccgtgctcaacgaggcgcgggacgatctccgccttcaatacgggagccgggtggcggagctagagaagaaactcgacgccgcccggggagtccttgacgccgccactgcacgggaacggcgggcgacggagaacgaggcggcgtcccggcggcgcgaagtggcccttgaggctcgcgccacggcgctggaagagcgcgcccgcgcgagggagagggacctggcggaccgcgagaccgccatcgctatccgggaggcaacgctggcggcgcacgaggccgcctgcgccgaagaggagtccgcactccgcctccgcgaggacgcgctcaccgagcgggagcgagctctcgaggaggccgaggccgcggcgcagcggctggcggacagcctgtccctccacgaggcagcgcgggaggagcaggcgcgccgtaatctggaaggcgcccgcgccgagagggccgcactggatcagcgggccgctgagctcgaggcgcgggcgaaggagctggacgcgagggcgcgcagcggcggggcggccgcgggcgacggcgatctagccgcccgcctcgcagctgtcgaacacaccatcgccgatctgcagggcgcgctggactcgtccgccggggaggtcgaggccctccgcttggcgggcgaggtagggctcggcatgcttcgggacgccgtctcccgtctagaccgcgccgggcggcaagcgggcctctggggcgagcggaccgcgaagtacgccgccaaccaggggggcctcgcccagcgccttcagagatggccgggactctccagcggctccccgaggaactcgaggagacgatcaagtcatcctcgagagacctcgcccggggggcagtggagtttgtactggcaagctaccaggccagggacccggacttctccccgtgggcagcactggacgagttccctcccggaaccgaggacgacgcgcgcgcgcaggtccgggacgccgccgaccacatcgtccacagcttcgagggtacggcccctcggctcgcgttcgccctcgactccgacgaggagggcggcgacggtggtgtggacgacagcgaccacgaggccggcgacccgggagcctcgaagtgagcccccaggcccccgccaatcttaaaagtttttcctttcttcttccgaggccttcgggcccccttcttgtataaactaatttaatctgcaatcaaacaaagaagaaatttctgtgtcaattttatttgttgtgtgtatgagacgaggatggtctgtgccgcggtccttctgtgtcttggcttgaacaagggctcgtgcccaggtcccagcttcaaacggcgggggtcggggctagtgcctggggagatccacgtgtcgagactggccaggccgggagcgcggtgaccgagggttatggggacccgattgtgggcctttgccgattcccccccggagttcaccacgccccggggcacggctcggttctgggccccgtttggcgatttccgccggcccgggccaccgagggcagggtcgagcacgagcgtgctaattcaagccaagactcttcaaaaggaaacaatggcacagacacagtccttaggaaatcgaaaaagcttttattgaaatacggaagagaaaaaagataagtatatgcatatgtggtagcccccggccaaccctgcacgcccgaggggggtgcggggttggcccgagcccgagacctgacacccgacccccactaggggtagaagcgacgaaggtgttcgatgttccacgggttaggcagctctgtgccgtcgcccgtggccagccgaacggagcccggccgggggacgccgatcactcgatacggaccctcccacattggtgagagcttactcagtccagcacgcgtttggacgcggcgtaggacgaggtcgtctacgcagagtgatcgggcccggacgtgacgctgatggtagcgccgcaggctctgctggtagcgcgcggctcgaagggccgcgcgccgccttcgttcttccaagtagtcgaggtcatctctgcaaagctgatcttgatcagcctcgcagtacatggtggcccgaggggacctcagggtgagctcggatgggagaaccgcctccgcgccgtagacgaggaagaaaggcgtttccccggttgctcggcttggcgtggttcggtttgcccagagcaccgctagcagctcctcgatccacgagtcgccgtgcttcttgaggaatttgaaggtcttggttttgaggcccttgaggatttctgcgttggcgcgctccacttggccattgcttctggggtgggtgggagaggcgaagcagagcttaatgcccatgtcttcgcagtagccaccgaagagctcactagtgaactgggtgccgttatccgtaatgatacggttaggcaccccaaaccgagcagtgatacccctgatgaatttaagtgcggagtgcttattgatcttgatgaccggataagcctcgggccacttagtgaacttgtcgatagcgacatacagatactcgaacccgcccggggcccgtctaaacggacccaggatatcgagcccccagacagcaaacggccatgaaagaggtatggtctgcagggcctaggccggctgatgggtttgcttggcgtggatctggcacgccctgcaccgccggaccaggtcgaccgcatcgttgcgagccgtcggccaatagaaaccctgacgaaaggccttgccaaccaaggtgcgtgaggcagagtgggctccgcactcgccttcatggatatcggcaagaagctcgatgccttgttcccgaggaatgcacttcaggatgactccgttagccgcgtgccgatagagggtcccttccaccagcacgtagtgcttggagatgcgctggacgcgttcactcccttcgcggtcctcgggtagagtcttatctgcgaggtacgcctggatctcagcgatccaagcaatcaatctaagggagctgggagcgctcccctcgggtcccgaggcctggactccgacgggcctcgggggccgttcaggcgcgtccgtctcccctagggggtcgggtcgcgccgacggctgggcaagcctttcttcaaaggcgcctggtggggtctgggctcgcgaggaagcgagccttgagagttcgtcggcgaccgcgttatcccgtctgggcacgtgccgaagctctatcccgttaaaatggcgctccatacgccgcacctggcgcacgtaagcatccatctgcgggtcagagcactggtactccttggagacctggttaacgaccaactgagagtcgcctaacaccaggaggcggcggatccccagtccaaccgccactctgagtcccgcaaggagtccctcgtactctgccatattgttggttgcccgaaagtcgaggtggaccaggtatttaaggacatctccgctcggcgaggtcaacgtaacccccgcaccggcgccctgaagagatagggagccgtcgaattgcatcacccaataggcggtgtgaggcagctgcgaagggcccgagctgacctcggggatggagacgggctcgggagccggtgtccactctgccacaaagtcggcgagggcctggctcttgatcgcgtggcgtggttcaaagtgcaaatcgaactcagagagttcgattgcccatttcaccacccgtccagtaccctctcggttatgcaagatttggccgagggggtaggacgtaaccaccgtgacccgatgcgcctggaaataatggcgcaacttcctcgaagccatcagaatagcgtaaagcatcttctgggcctgagggtatcgggtcttggcgtcccggagggcctcactaacaaagtagacgggccgttgcaccttttggcggggccgatcctcttcgccaggggccgcatctccagggcgcttttcgtccgagaggccgcgcggggcgcactcggcttctgtgtcgacgacctcggggtcggaaggcgacaggcgcggccttcccgcagtggccccggggccatcctgggggtcgggggcgcctggcaccttcggacaagcgggcagagggccagctccgatcgtcgggggcctcgggccaccgttcggctcgggggcctctcctccctgctctctcccgggtcgagtcgacacaaggtggggatgcgcggagcgagggtcgtcctcgtcgcgctccacgaccaacgccgcgctgaccatctgcggagttgccgccaggtagagtagcaacggctcctctggctccggggcgaccaggactgggggagaactgaggtacgccttcaactgagtgagggcccgttcagcctcctccgtccagataaacggcccgaagcgtttgaggagcttaaataggggtagcgccttctctcccagcctcgatatgaaccgacttagggcggccatacagccagtgacgcattgcacatccctaagcttgctgggggggcgcatccgctctatagctcatatcttctcggggttggcctcaatgcctcgggcagagatcaagaacccgagaagcttgcccgcaggcacgccgaacacgcacttgtcggggttcagctttatgcgggcggtgcggagactttcgaaagtttccgctagatctgagagtaaggtctcctggttgcgtgttttcacaaccaagtcatcaacataggcctcaacattacgtcctatttggctacccaaagaaattcgagtagtacgttgaaaagtaggacctgcattgtttaacccgaaaggcattgtcgtataacaataagttcctatgggggtaatgaatgcagttttttcctcatcctccctagccatgcgaatctgatgataaccagagtatgcatctagaaaacacaaaaggtcgcaccccgcggtggagtcgacaatctgatctatgcgtggcagggggtaagggtccttaggacatgccttgttaaggtcggtgtagtcgatgcacatccgaagcttgccgttcgccttgggaacgacgaccgggttcgccagccactccggatggatgacctctcggatgaatccggcctccagaagtcgcgccacctcctcgcggatgaaggcttgacgttccggggcctgccgccgcactttctgccggaccggccttgcgcccggccgtacggcgagacggtgctcaatcacctccctggggaccccgggcatgtccgccggtctccaggcgaagacgtcggcgtttgcccgcaggaaggagacgagcgcgtcttcctatttgtcgtccagaagaccaccgattcgtgtggtcttggacgggccgtcgcccagggcaacctgcttgatcgggacctcgtcgcacgtgatcatccgctgcctcggggcggctgggacggaggtgctgagcctctcgtcaccacccgcgggcttggatgccacggcgaggtggtccgcgcgctgctccatgcaagcaagcgcgactttgaggtcgccatggacggtgatggggccaccggggcccggcatcttcatctggagataggcgtagtgtaccgccaccatgaacttcaccaacgcgggcctccccaggaccgcgttgtagggcagactgaggtccgccacatcgaagttcacccgctccgtgcggaagttggcggaaccaccgaaggtgaccgggaggtcgatatggcctagcggccaagtgtgccccggcgtcacaccgatgatcggctgggacggccggagcaccatccccggggccttgatggcgtcaaaggcagcgggggaaaggatgttgagggctgcacccccgtcaatgaggacacgccccaacttcacattgcaaacggtgggagaaaccaccatcgcgatctgtcctccccgggcaacgcacggtgggtggtcggtctggtcgaaggtgagggcaacctccgaccaccgtgcccgccgcgtcgcctcatgggtaggggccacggccagaagctctcgcttcatggccttgaggctccggtgagaagcgtgagcacacgctcccccatcaacggtggcgacggtggcctcaggctcctggaaccctaggtcatcgtcggcatcgttgatgtcctcggcgggggccttctgcttggcctcaccacgccggttgccggcgggagccgccggggtattgccctcacggcgctcctgcctcctctcctcctcccacttcctcgtccgctcagccaaacttttgaccgcgcggcagtccacgaggtcgggagggaggtattgtgcacggtgcaccacctgccggcgggcgctccctactgggagcgccggcctccttctttttgtcgctcgcaggcctcccctttcgggtggcccacgaagcgccctcgacggcgaggacgtgaccctcgtcgtcggaatgggccgacctcttcttcctcctcctgtcccgccaccctgaccgagcagcgggcccgggggcggccggagctgccacaccggaaccggaggagttccaggtccaggcctcctccttgcgagccacacggtccgcgagctgaaaaagctccgcggtggtctggggctccttggaggcgatcttctcgagcatgcggttgtgccgcacaccccccctgaacgcgtagatcaccgcgtgtgcagggatgcacggtatggtgttgcggacttgacaaaaccgctgaatgtacgagcgaagagactcatcgtcccctcgctgtaccgcgtgcaagtccgcttcttcacctgggcgcggatatgtgccctggaagttcatggtgaactgctggcacaaatcctcccaagagtggaccgacgcgggtggcaagttcattagccaaccccgcgcctgtcctttcagggccatggggaagaaattcgccatgaccctgtcgtcacccccggcggcctcgatcccaatcgtgtagatctggagaaactcggcggggttgacgcttccgtcgtatttttcggtgatggtgggccggaaccttgggggccaacggacgttccgaaggctcgccacaaaggctcgacagccggcaccgccaaccggggacacggggggctggcccccgtgcccggaccgaagtggcgctccggacgaggaagcgccctccgatgcgtgggcagcacggcgatcattgcgccggcgcttgatattgaagcgggcatctggccccctacgcacatcttcttgggttagaggcgttgacgagggaatggcggacgaacggcgggtaacggccgccgctcgcggcgccctccgcctcgacgacacggagccagcagtagcaacgccagtggccttagtggcggaggaccgccagccggcgcgtaggcgctgctgcgccgtcatgaccaaattggccacgtcatctagccaacgtcgggttggagtctctggatcagggatgacgggcgggtgacgcaggagcgcgcccgcagcctggagcgcgccctggggcgtgctgccatcaccgtagacgaggagacgacgctccccgtctcgccgtccttctccatcgcccgcgtgcggcgaagtcgcggatctttcgacctcctcgagcgcctcctcccgcccaagacttcggcgagagggggacagtggagtacgagctcgacggcgcgggttctgctccccgtcgtcaccgctagcgctcggagagagattgtgcgccactgcccgttcggccatggggctgagcaggagaagcttggcgcacacgaaagaggacgagggcttagaaagacacacgcgccccctacctggcgcgccagatgacggagcgtggagctcctcaccgggagaccgcgcaggcccccctttgccggttcggccgggggcgctaagtgaggttcttcgccctcgatcgatctggagaatgttcgtgagagagcaagtgcacgagacacgggcgatgtagacaggttcgggccgctgagaagcgtaataccctactcctgtgttctggtggatctgtgtgtgaaggagttacagagagccggagagccagagagttcaggctccagaacccctctagcctccttttttcttctttttttctttcctcctcctttttggtgggcaaggtcctccttttatatctcaaggggataccacatgcaccacttctacctacttttcttttgggtggggacctaccctatcttgaccaaaacttggcttgcaccttcgcctggaagttaaatcacaacttgtccttgagt

SEQ ID NO: 68991 - DNA, 7008 bp, Oryza sativa
aattgttgttgtgtcatcttgcaacaaagtgacaaaaaatataccaaaatatagatggattaactatacataggaattaggtttctttggttgtgtacatccactttagatatagaagggcttctattctacaggttaagttaagagttagtgttctcatgtatcctttttttttaaaaaaaaagtttcaagggaagggaattttaggttcttaacaggttgcagacccaccattgattaattatatcatcacacatgcatccaacataagtcttatttttcagataatggattaaaaacctgacctcaaaaggatgtacataagagcctagaactatgtaaaagaaatccagctgctagtgcaagattaagcatatagccgggaccagtgggttgcaggccggtttaagccggcagtggccggttgctcgagacaagaaatccatggtcatcaacaatggccaagtgttcagttgcttctgttcactgctcaatgctagtgctcagtagggaaatgtctgaccaaaacttgaaaaagttgataccaattaaacactctgtccattatttgtagctgtcagctgtggcaacgcaactaccttttttttttttttaagaaaatggattaaaatccggcctctacatccacaatggatatacatagcccggcagcgcaactacctagttaacattgataagaatgatctaatgagttatgagtttaataaaacctctttagtagaaagatgtatattccttgttcatcacttattcccaaacctcgtatggggctactcgttttcatctacaatctcagataaaatccttttcattccgcttagccttatcgggtattttagtgataagctctatagaaattggacgatcctatttggtcaaatatctaaagaaaaaaattccaatttttcctcaattaaggtacgaaggcttcttatccacaagaaaagaataactttattctttcatacactctctctagttattttagatttgtactaagtcaaacttatctaagttcaactaactctgtaggaaaaagtattccctctaattttaatgtttggtgtcactgactttgggacttattgatttcttttatcattaaagacactttaagcatgacatatatatttgcttgcatagaatttctaataaattggatgaccaaaagtcaacagcatcaaatattttaaaccaaagggctacaatatatccaacacaatatatatatatatatatatatatatatatatatatatatatatatatatatactataaaaatatattcaaaagcttatttaatgttgtaaatgtcactacatttttctacaaacttaatcaaacctattttttttttaacttagaacaaatccaaaataacttatatatagaacttagggattactcaccgagttattaaggaccgggtataataaaaaagattcacaaatttggtgaaaagaaaacaaaaggctcacaaacttatattcaatggaactcaaccctccaaattttatcaaaggtctttgaaaaaaaattctccaatttgaaagcatgaaaaaacaaactaaattccagaatcttgactacgaatctaaatatagattatgcctaaatacattgtcagaagtaaagcttttacatcagctgtaaaccaaaactatcggaaaagcggtccggcccataaattcatccacctattcggctattcctccacaaatcccatccagcccaaggcccaaaacctttccgtcccccacccaagtgggacccatacggcccaaggcttacacccttcccatccccacccaagtagggcccatcaggcccaagtcccaaacgctcccccaccccattccctaagtagggcccgtccggcccaaggcccaaaacgctccccgtccccacccaagtggggcccatgagcccagtcacctaacccacatccgccgcttcccctccaatccacccacctcgccgcccgtcgccgtcgcctcgtcgccgccactcacctctcaccaacaatcgcgacgacgaaaagaaaaaaaaaaaaagaatctcgtctcacccccaatggcgcagatcatcgacgggaaggcggtcgccgccgacatccgccgcgaggtcgccgccgacgtcgccgccctctcctccgcccacaacctcgtaagtcacccactcactcactcactcgccggctgcggcggcggataggttggagatgatgagagcttgagtgtttcttggcaggtgcccgggctggcggtggtgatcgtggggagcaggaaggactcgcagacgtacgtgcagatgaagcgcaaggcgtgcgccgaggtcggcatccgctccgtcgacgtcgacctcgccgaggacatctccgaggcggcgctcgtcgccgaggtccaccgcctcaacgccgacccagccgtccatggtatatctaatccatccgttcttactacaagaacaataatccccattcattctagtgtaattagtactacctggttagtgggatagatgtggagatgattttagattaggcttaggtggaatctaaggtaatcatagtgatgctgtaatgatttggggtaccttggcatgagctctacggtggagttgacttgatcttgtcttcgaatcggaacatcggtagtcagggtgatatgtgtttgggggttattgaaggatttaaggtatgtgtttatattcactatttggatctgaaactgaaaaggctatttaaggatatctccaatctctacaatgtggggttggtacttaatcgtgagattcacactgcaattccagtcctctgttgcttgacatctggactgaaaaatttgtgtgatcttttgaagtctgctcttgaatggatatcgggatacaggcatttgaagttgaaagattacataagatatgttgcctagttgattacaggagcttgtccttttgatctatatctgctaaacttgtaattatctcctcatgctattcgaacaaagtagttcctatttttcttgctcatgcttaaggactgactttatctgtttcatatgcaagatggatgttgtagtaaaaaaattggggcttagaagtggcttagatataatctattagcttgtctacaaaaagtgtgatttatattttcctaaccacgtggatgtcaggtaaacacaattaactctagatttaatgtccatttaataatgtacaagctagagttagtctgaaacagcactgtaacttcagattttgcctctgcctaatgttgaggtattgattggaggtatatgactacatctatatggatctgaattctgatgcaatcacaagtatttgacaatgaacttgtgctgtcataacaggcatacttgtccagcttccattgccaaagcatattaatgaggaaaagatattgaacgagatcagcttagagaaagatgttgatgggttccatcctctgaatattggcaagcttgcaatgaaaggcagagacccactgttcctaccatgcacgccgaaggtatggaaacactacaacagaatgctagaatatgactgctgctgcagttttcgtttgcagttttgatgttttgattttcattgaagggatgcatggagctcctaacacggagcggagttaccatcaatgggaagcgagcggtcgtggttggccgcagcaacattgtcgggctacctgtatccctgcttcttctgaaggcggatgcgaccgtatccattgttcactcccggaccccaaaccctgaaagtattgtccgtgaagcagacattgtcattgcagcggctggccaggctatgatggtacattgttctaccaccaaattatgacatggttcatcacaatccactgcccagttctaactgcagatttcttggttgccagatcaaaggagactggatcaaaccaggcgctgctgtcatcgacgttgggacgaactccatcagtgacccaaccaggaaatcggggtacagactcgtcggcgatgtggatttcgcagaggtgagcaaggttgctggtcacctgactccagtcccaggtggcgttggccccatgacggtggcgatgttgctgaagaacacggtggatggagcgaaacgtggtatagttcagtaaagtttccatcttgtatgctgtaactgcaaggatgatgttgtaattgagtgcatttctggacaaattcgttctcatttttgttgtgtgacggttatttcgagaataataagaataagtttgtctgtcatcaatcagtaggtagtagctgatgtttgtctgataaatgcgaaaataatgtgcatggtcactatgagttggtcaccaatcagtagagtaatgttttgaatttggtaatttgattcaattacaccaagcgctttaacatgtaaaccaattcaaacagccagtataaatcaaaacgccgaacggaattttccaggaactcacacaggcaagtatgatgcatcacaagttgaaacatgaactacaaaattatattctaaaaatcttctctatgggtttctcaatttctgtttcaacacctgagcaaactctgtcctgtcaacctcctcttcctggctggctgccaagttcttcagcttcacctttccactgcttatttcagactcaccaaccagcaccatccacggaatgccagattgcgtcgcgtacttcaagtggttctgtatcctagtagtgagtttgaactctgcctttatcccagcattccacagttcactaacaagctcagcggccaatatgaggtccttgccgataatcgacaccaatacctccgtctcggtggcccggatctgcaactcaggaacgattttgttatgttattgcaactcattcaaagaatgaataggtgataggagcattaggtacctgattcttttccatctcctgttgctccatgattgcgaaaactctttctattccaaggctaacaccaacggcagggacttgcttcccactaaacataccaacaaggttgtcatacctgcctccagcagcaatggagccaacctgttgggaaatagggttagttcaggaagcaggaagcaactataattcaatcggtcagagaaaggtgttaaataagttcagatgacaaataaagtggaagattttcagatataaaccagtgcctggtaaattgtaatcaactactaaagactacgcaattagaaaaaaaaaaggtaatcgaggacatcctttccaattataagaatgataagaacagaagggatatagaacgatttccagtttatcaagtgtgcaattgaataaacaaaatgatgggctaactgaaaacactaaccagtttaaaaatgaggtgcagagatgaataaaaattatctaacctgagtggtgcccttgaacacagcttcatatatcacaccagtgtagtaatcaaggcctctagcaaggcttaaatcaaaaacaatcttgcctattgcatttgctttatctagagctttgaatagtatctccagctcatttagtgcagtaacagacccagcgttccccataaacttgctaccttcctttctcaattccagcaaaacttccagcggtggtcccctagttttcactaaatcaccaatcttatccgcagtttcattagatatgcccttctcgtccacctaagtcaacacgacaaacagttagggccatgatcaagtcagtaacatcaaataaacgaaccataacatgttagtttggatacttaccagttcctttttcacttgttcaaatgtttgcttgtctagcttgtcaatgcttgagcaaaccgttctgaacttttcaggaggcacaccacagatctctaacattccatcaagcaactttctgtggtttagttttatctcatacgtgcctatatccaactgatccaacaactcagttaaaactttgataacttcaaaatctggttccattgtttcatatactccagctatgtcaaagtcgcattggtagaattctcgatatcttcccttggacgggttatctctcctgtatactttagctatctggtatctcttcaatgaacttatgttattcatagcaacatatcgggcaaatggaacagtcagatcataccgcaaagagcaaagctctccaccctgcagattatttggtgtaaagatcaaatcatgactgtgagcacacaagctatggaaaataatgcaaagaaatgaataatcgagcagctgaatgtagcatgcccacaaatactgatcaaatcaagaatgttatgaaaataagtcaaaaaccagcataaattgaggctcagtgcaaaatttaacccacctaccgacctaaagtgtacagcgggactgaaaataatacctgatcagcaaggtcataaatcaactttgagtcttcaccatatttgcccataagtgtttctctcagctcaaatacaggtgtatcaagtgaaacggcaccgtgcatcttgaatacacctgttattattgagaaggcatgctcccttatggccatttgctctttcccaaagtcacgtgttccctaacaagattaaagaaaagcatcaggcatcgtaaaagggtgaaatcataccagtctggcactctggctaaaaagatgcttctgaaaccttatttcaagcaattggagcatagagattaagccaaacaaggaaatgtaaatggaacaccttatgcaaattacataattcttaccttgggaattttaggcaatctcctcacttcattggtctcaacaatctccttcaccttgtccacaagggacaccaatctgggacactttggatcaaacaacagtgagagctcggttccccactctgcaagtagtgcagaattcaccgaaagaacctcctttccgttggtcacaaggtccctaagcaacatcagtacagcagaagtacccttccccaaagttttcttcttcttgctcttcttgtcaccctttggtttctct

SEQ ID NO: 68992 - DNA, 718 bp, Oryza sativa
ggtcccgcgttttggagctgcggaaccgttgggactgcgacggtcccgcgttttggagctgcgggaccgttgcagtgccacgcggccgaccgcgggactgacggtcccgcgttttgaagctgcgggaccgtcgcggtcccgcatttccatcccgcgggacgagtatatttttgcaaaaaaatttcatgcatgtatataaatgtaaattattgaaaaaagaagtatattcgcaaatttaattccgttaatgaatctatacacatatatgcctagattcgttaacatctatatgaatgtgggtaatggtaaaacgtcttataatatgaaacggacgaagtattacactattttccactgaatccctccctggtttgcttccccttagggatttaacctccaagaaccgaacaagccctgacggggctgagccgaagaggctattctatgaaatctatagaaggaggaggaggaggagggagaaaggtgatgtcagcggaggaggaggatgagcagcagcgtcggcgtcagcggcgagactacttcatcaatcttgcccgccaccgccaccgccgccgcagcagcacagcgtccgccagaaatcctagccctagacatggaagaggaggggagaggggaaggggagaaactcaccggagagaaggtggccaccgtcttggtcgccgtcgcctccgacttgcgcggcaccgcgccggccgcc

SEQ ID NO: 68993 - DNA, 5443 bp, Oryza sativa
ctggttccttctctgagtttgtttggttttgcattgtataatatccagggcttttcgacatggacaaggagggacttcaatacattcatccgtgcttgtgagaagtacggtcgtaatgacataaagaacatatcctctgaaatggaggggaaaacagaagaggaggtgcagcggtacgctaaagttttccaggaaagatacaaggaattaaatggtatattttgtaaccttttctcttactgtttgtattccctactgatgacctatttaatgtgtagctgactttgttattaacttgtaaccaagtaatggattgcttacatgctgagctgagtaatggtcagatacaaaatctgttttgactaaatatgatgtcctcatcctatcagattatgaccgagttattaagaacattgagaaaggagaagcaaggatataccggaaggatgagattatgaaagctattgggaaaaagctagaccgctataagaacccttggttagagttgaaaattcagtatggccagaataaagggaagttatacaacgaagaatgtgatcgttttatggtatgctacaccacaattgttcctgaacaatttaagcccctttcttttttgcattttaacagcttgtgtctattacagttatgcatggtgcacaaactcggatacggaaactgggatgaactgaaagcagcctttcgcatgtcgcccttgttccgatttgattggtttgtgaagtctagaacaacccaagagctagctaggaggtgcgagaccctcattcgtctagtggagaaggagaaccaagaatatgatgagcgtgagagattggccaggaaagataagaaggttggtcatagtagacctttttcaattcccgtttggcttctagttcacttcatagtgaagtacaaacatattgccctagtagtcatcacaatgcaatctttctaatcttcagttttttactttcttgcacttgcagaatatgtcgccagcaaagcgttcttcatcaaggtcgctcgatacccctccacaaagctcttcgaagaggaggcgccagtcctacactgaagccaatgcacgctcagtaagtgttatttacatcgcattctgttcatctttactagaaccacacactgttttggttattacagtaaagtaggacctcacccacttgtttttctcacagggaaggagaaggcgagggtgatctgattattgttcgttcctccccccatatgcatttagggagctcatttggaggttgacatgaaacccaaggggaaaccccagatacatcccaattgtctagcagtagctttagctcaaaaaaaaaaaaaaaaactagcagacataactctagtgagatggttagcttgtataccggttaaagtggttgtgttttaaagttttaaattggacgggcaacattacaaattttaggtgatcataactttaacaagtagttgatctctcttttggagacatcaatcaaataaaacaaagttgcttttacctgtatgcatgtcgtctccacaccaatgtaccaccgctcgtcaggcgtctgcatcattgcacaggtaatgaactctccttttcctggaaaggggatatggcatcgcatgtatcattttatgccttctgctgcctaattagtaattacccagtcgactgcaggcaaactatatcttgcaatagcggtgtgagaatatcatacacaggcaatcctgcaactactacttccaacttccaagtattgagagaatcaaatagcttccaacttccaagtactgagaatcaaaagagataaaagcattcatgtgacgaacattacaacaggctccataaagatgcagagagctggagtgaagatgtactccactgcactacattttatggatgctcagtgcggtctgaaatctcacaaacaaaaattgcattcggtatatatactgttcccattcactcttcttgataagatgtggtacataaaaaatccaacaggttcagatatcgcgagagatgcccgctctccaactcttcatatagttatgtctatctagctaaatacccaaggagataaaaaaaatgaaaggaaaagaaacaatcaaaactgagatgcagctgagagttaagttctcagccctgactaaagctcagatgaaccaaaactgtgactttcaaatatggagcttattgagctcagaactcgccgttgcagcattgcttgtgtcactggtgttcgtgcgagcttcaggttcttcttttctaggcgaggccgagaggatctgaacagcaggttgagctgctccagcactagagttcaccacatttggcctcgctgagcatacagggatagttgttctgattgtaactgaggcagctaaccaaggaggccgttgctggtataacgaactcggcaaatttaccggcattcttgttccaaatcttggtggagcttgtgcacggggagaccggcactcaggtggtgtggccacacttatttgaggaatgtttatgtgggcaggatcaccacgacgaataggactaggtgatgtagccacacttatttgaggactatttctgtggacaggatcaccatggcgaacagaactgtaatggtgccgttggccagtttcacacagaagaacaggattgaccctggatggtgatgactccggtggctgttctgcgggcttctttgattccaaccgcaaaccgcccatgatttctatatcttgatttgattctagctgttgtgatggtgaacgcgtggcggagcttgaggcagtatgagatttgctttcttgctcggaggcaggactgctctcggtatattcttctttcttgttatcttgaacagcattttctgatgtaccagagaaatctggagcagtgtatcgggagaagaccgcagcatcaggaagctcaaccatatcagcacccactaaccttttctcatgaattttgtgaacattaactggcaatggacgtcttggtacaaaggaggcaggataaggcgagaagtaccgtggaaggacgggggaagcttcaggataacatggaataagacctaaaccatcttggctggatggcatggtgaattgccctctaggtggagggtacatgtggagcacagttggaggcggtggaaagcctgtactgcccatagtgggtaccattggaaaatgcggcttctgctgtgttgcttgcacctgatgccacatatggtacattgcttgctctggtggaacacttgggtatgcatgcttttgtaaatgcaaccggccataaaatgatgcatttgatttcggataagagggtctccgagatgacgggcggttactgctttgctgtttttccttttgctgtggtgtctttcctccatttgtctgattcaagcttgcaagagtacgagccactataatctgttcctgatcatcatcgtcatgatctggtggacaagatgaggatgatggctcacctactcggggcactgttaggcacaacaaaaccaaatagtcagtgaaaaagttctgaagttgatacaatggaatgactaggaaatgccgcagtgcattatgcataggttaataagggaagatccattaacatatatgattgtctttcctctttatttttccaataaagtacttagcacataggcggtccattgttgtacatccagtgaaccatgcattaagagaccaaaggtggtaagaaggtgagaagatactcacattgcttcaattcagaccaggctgccatagcagcatttttctgtgcttgtttcttggtcttgccgggattgccagtaaaggtcatccctgccaactccactgtgcatgtgaacacaggtgtatgactctgcccagatcgaattgtagtgtacactggcagttttaaacctgctcgatgagctgtttcttgaagcaagttcttgtagatcccagtttcatcctgtggagtgaaacagctttaggccctcagcttgaaaaaccattcctcaagaggttacagaatgcacaatataaggatatgcacaataaacacaagtaagctcaatgtttatttatttaatatccatttcatatgctgacatcagtgagcattgtagagatgcacactggaagaagaaaatcacatggctgccaacgttgtatactgatttgtttttactgcaaaatcaggaatgatgcaactagatgggacaactggcaaatcaacatcagatatcataaatgagttaaaccatcccaaccgatccatcataaataataccacatccctttgacttattgcttgggggaattgtcaagaacactgaacttttaatacacctgccactggaagtatcttagatacatccacagcgtagatgagatttattgtcctttgaccaaaggaaaggttggtttaccaccaattacatccagtgatccaggacatttcacaatgtccatccactgagaaactactataatatgtactacaatatagtagaagcagcatgtacaagccgccataatagcatcagcaagtacaacttgtcaaataaagcacaaggactgaactaagtatttttacagataaagcaatgagatgatgcgtaatatgtcagtaagtctagcatgttaagcaaaaagtctaactgtgacttgtgagttatggacttgagctatggacaattcctcactcttaccatatcaaactaagctacaacaagttaaatagagaactgatgatgactgttactttcaacttcctatgccaatctgattttttcggtactaacaagcatgatgatgtgacagtgatatccttttgtggttctcaatagatgattggcaactatgcaatctgaggtgatctgctagctagtacacatgtgacatgaatcttatttggcaaagctgaaaggatacaatttaactgtcccctggttcaagcactttatctgtttatcaacaaaaaaacatccatgacaagttactaaatctctgattctacatagaactacaatgagatctaaggttagcgctcttccaggatgtcagtcaaaacataccagagatttctcaagatgacaaatgcaaaagtttttcacacaagacatgcaactgatttccatatcataatgcttgagaatcaatttctggagggatcaacagaacctaccagaacttttgcagcaagtgacgatgatggccctctcttcgacagctcattgagcgcaacctctgccgccgcatgctctgccagccgcagagtagaacagaaggcggggctttcgaacgtttctccattgaaattaaccgtggccttaaaccgtggcgcgtgatctggaccctcgcggatgcacgcataggatggcagattgaagcagctcctctgagcaagctcctgaagctggttcttgtacatgcctgcaagctg

SEQ ID NO: 68994 - DNA, 8490 bp, Oryza sativa
  unsure (1)..(8490): unsure at all n locations
cacagcccggacgaagagcaaaatccagaaaccaaattcgcgtatgattaattgaagttaaacccacacactaatcaaattcaggcgctggggtaacacccaaaatcccgcgacggcggaggcagcagccggaccctccacgaagccagcccagccatcgccatgccgccgccgccgccggagaagagaccaagaaaccctcaccaccaccaccaacaagatcgacgaaaccccccgtcacccagatcgaagaagccaatcaagaaaacaaaccccaagcacagcgagaggttagcaaaaccaaccttgcttgcttcttgattcgtcttcttcctcctcgatccctatccttcaagctccaggaaagcgaaggggagagagggggaaaaaatcctcctcctcctcgtccgggtgggtgggatcgcggcgcaggctgctgctgctgctgctgtcgtctacgcttgcttggtagtagtagctactgctgctagtgcggcaaagcggctgacgctgcgggagagagagcgagtgggaggagaggagaggaggatgggttaagcttgagcttaagcttaagctcggagagcagcattaggcgagagctaagtgctaaccactgctactagaggagtaggagtgaatagtgatagaattaaggttattctcaacccaagacactagacatagtttctataaactccacatcatcgagaaactagtactaaacattactcttccaatgcaaacaccactattccatacttaaatttaatgctacttatctcacatgatatcttagatattgtgtagaaactaagtctcatccaagacatggttttcttcttttttctcgtttattcacttgccatattattttttatcctagatgtcagtttatttaatattatcctagttattaggttaggaatggtcatagagcagtaggggagtgtgagtgtgagagagagggagtaattaagaggtcagggcgggggaatggaactatggaagggagggaaggggtgtgtcggctttgctaacctttttgtccgctttcatttctcatcatattactagtactattatctaataatgaaacaaataagaacattagaatgatttagagctggagattcagataagcatatgttagtatctaattaatgagaagctaagaaaccgtcgagtttatggttatgtttaaagagcttaaaattctgagtaatgattggttggtaataagtttctaagaatctagaaaacaactggatttttttagtttctggattctaatttatttactaaattctataactatataagaattcagattgttttgggaattagggattttgaaagaacctgcagctgctataaactctcctaaatcagaccttaggcttaaactcaaaccagtttttaccttaagttatcggcaacgcgtgaaacaagacaagctattaacgcatgattagttgggtattaattattacaaacttaaaaagatatattttatttttttaaaagaaacttctacaaattgtgaagttagccgaaccgaatatccatttaggatgaagccttaatcaatattactataggtctctcctgtcaaaaaacaagttgctttttgaattccatgtcaaactttaataacttcaaacatcaaatacttttaactatatccaacttttatatctaaagtacttcacggtgttatagttcattggggttttgagataatttgcaatcggaattaaaggtcaaagttgcatcttgaccgaattgtggccaaaggaagctttagggagtgtttgaggagaaggggattgaggagattgggaagatacgcaaaacgaggtgagccattagctcatgattaattaagtattaactattttaaattccaaaaatagattaatatgattttttaaagcaactttcctattgaaattttttgtaaaaaacgcaccgtttagtagtttgaaaagcgtacgcgcggcaaacgagagccaatctcccctatcacccctaaacgaacgatgccttagtcagaagcaaagtgcccactataattaattgtggccaaaatgattgtgttcatctcatgctagtagtagtacttaagtttgacccttcgttttaggttgtgctattccatacggcccattttcccgagattcatgtgtcgagatttgcttgcctatgaatataacttttactttcttttcaatttatgaagtagatacatttgggattatccatgtgtcgagatttgcgaaatgaaggaagatcaagcaagctgtccatgcaaggcagcagatgcaagtaggtagctttgagcatgatgactcagtcacagctagagacagatcaagcaagatgctaccacaaagtacattactgcgattgttttactacaccccctcctttccactcctttccaaaataagtttatttatgggtttgtcttcaatacttgaccatccgttttatttaaaattttgttatgatcagtatttttgttgttattagatgataaaaacatgtataatattttgtgtgtgagttatttcttttaattttttatattttttttaaataaaacggacgatcacccgttaaatacagaatacataaataaacttatattttgagatggaaggtgtagtagagaagcaaaagccctgtttaggtttaggagagattctgataattacatctttgtttcccccaaacatgaccaaaatatattgtgctaggttcctagtatcaagctaagctaggcagcactgaccacccttttggaattgtttatcagttatcattgaagatcgcaggttttcttctactaaggccctgtttagttcctcaaatttttttcccaaaaacatcacatcaaatctttggacacatgcatgaagcattagatgtagataaataaaaaaactaattacacagttagggaggaaatcgcgagacgaatcttttgagtctaattagtccatgattagctataagtgctacagtaacccacatatactaatgacgggttaattaggctcaaaagattcgtctcgcggtttccagccgagttatgaaattagttttttcatttgtgtccgaaaactctttccgacattcggtcaaacgtccgatgtgacatccaaaaattttcatttcctcaactaaacacaccctaacaaagtggatgaacttacatgtacttacaagtagtcaaatgacacttgctccagctgtatgaagatcccctcatcatttcccctttctgcttatcttaagctgggtagagccaggtaatcaattcttaagctgggtagagccaggtaatcaattattttttaccaggttcatngnnncgtgtgcatatcatataatccctccaacccaaatataataatctaggatatataataatctagatcagattagatacaacctgtgatataaatctggacggtcccctaatctgtcctagatcgctatattttaaaataggagtattatctagagtccatgcatttccatgtcctgtattttaaaacaaagagtaaacaagtacagtaattaaggagcaaattcatactgtcctgatgaggtttaaggcttcaagctgtgaacttgagcctgaatatagttgggcacagcttccaagtgttatcaccaagccagtatgttaaacagtttgcagcaaataaagtaatatcaaatggatgatgaacagcacaggccaataattattaaacattcacaacatgctgaagcaacaacaattcataatttaggtcaaaaaagtagaagtgacaaagctcagctccagatacaaattttccactagtacagtacaaatggatgccatatttttatacatacaaagtgctaaacacgctaagaaaacaaaccgaagttttctcatgatgctatctagtagttttctgtaattcatccagtctcctcctacagttattaacacctgaaaaaggctgtgaattttcattctacacctgcaacagttttgtagccgagtagagatcatgacaagtctatccaaccatcagcctttctacttggaaggaaacaattctatgttatgcgaggaaggtgtttgaaggtactaatcgagattgaaaataaatacctccataacacccgcataccgataccgcacatactgccccctacacaatctggacgcaggctggtgtgtcggaccttggacctgcgatcgtccggtagacgtacagtttctcaacaggtgtttcatccggaagcgaatccaaggggcatgaccttccaggatcgttcatgatctccacactaaggcggggcatcttgcgtgcaagctgtcggcatgcgcccagggtcaacaagcacgacgacatccaaagggatcgcattgtctccagctttgctgcgttcgccagcaatggcttatcaccaaatgggcagtccctgatctccagtttcttcaggctcttgcagcctgagaggatgtaatgcaggcccaagtcgctgttcccagcgaaggcgattgaaagcatctcaagacgatcagcatgtgccccaatggatttaaacacaagatctgtgagaaggcctgagatagagagacgcctaaggcccctgcatgactccacaatggcgctgaaacctgcatcaagaggctcccgtgtgatgtagtctggagtgtgtggctcaaggatgcataggcggaagcaagtgaagttgggacggttctttgcaatggtaataagtgcctcatttgtcatccgtctgcagaagtagagcactgactccaacattggacaacttgcagagacatcaacaagacctctttcagtcaagaatcctgcaccaaaagggtcagaagggaagacccgcaactcttgaagtttattgcaagatgatgccacaacagctaaaccatgatcctcaatgaggtccatcacctgaaaaattgcagcttaacttttagaagaaaaatatagagaaaaaagattgcataaagagctaacatgaccaggttaatagccattggggttcagatcataattcagtttaaaatatctgccgtagagcaagcaactcatctagcagttaacagttaaaggatggaaactatgagggttcagacaataactcagtttgccaagaaaggcaaagaatgctgccctagagcaaatggattcatctggcagtcttttcacaatgattctaataaggataggataccattgtcatctatgttttttccatataaatatcctacttccccaaaagataagagtggtaatttcaatctattcattggaggcacccaacagcatgccattgaatgtaacatgcatcctacaaaactgtattgacaaacatgaaaaacatatgcatgatttaacactcaatagattattccaagccacaaattcttgttgtcatgggaaaagtgcagtcagtttcatcataaaatgctattgcagccctataccaatataattgataaaactacattgtgaaaaaagaatacatgtagtcggacttttactagtgaccatgataagtaagaaaacatcaggaacttttttactggaggtccagaagaaaagaaaaaatttgcaaaatccacttgtagggaatcaagtgcttgtattgcaaagagatatgcaacagtttttcaaaagttaacagattcgaatgggatgaatacatagtagtaaaaaagaattgacaagagttgcatacccataattgttgcaaatttctgcatctactaatgaatttgatgagctcaggacctcgcacagtagcataactcagattaagtgatgtgaggccttcacatacacaatagaatgctggcagataatctggaacagcatcccaagccccagaaagccttctcaagcttttacaacctccaaacgccgcctccagctttgcaaacagatcggaatggtaatcagcagagaatttgccagttccgagttcaactagctgaggagccttatgaaggaggctagcaagcttgtcaagggggatagcattgttgagcttaagagtcttcaggttgtgacatctggtcactaaccgttcaagtacagtgatattgacctccccctctaagcatgaaaagtttagagttactagagaagtgaacgattccgggaagaggctgagccaatgaatagaacaatcctcaatctcgttctcttgcaggtcaagttctcttaggtgtctgcaatattagacaaaatcagaagttgaagaaatgtgcatggtgactcatatcttaaaagaagaatgaaactgtaaggatagcatatagccattaaccaatgttatcacttgtgaaacaaagcccatatgagtatatggtggaaaaggcaaggtaaatgagaatccactcaaacaaacagaagcaaactttgactactgcattcaacaaccatggcaaacataactggaacatatcataagactaaaacaatgaacacgtagggtttactatcatttcacagggacttgatttcatgtgtgagctatactagcattccccactttcaattacactatgcgaactcagcttataatgaatggtattgtatttgtttagtagataatgattatactccctttggtctcaaatacttctcactgtatgctattcacctttttacctttgatcgcttgtcctttttacaaaaaaagttatgtatgcttaaaagtatgccatgttagaaatgtgtgtcatgccataaatacaaccgcacaactttcattaatactaaattaatcatataaaagttaataatggtcaaaattaaaacattgatgatcaacagtgaagtaaatgatagcgagtatcatatgttagcagtgaatataaaccaatggataaaatcggtgtagggatcaaaatcaactaaataaatggagtccagcagcctctgaaagttgaaaagacctatttttttaccacgtatcatgaatcagcatgagcaatattacctagataaatagattaatcatggtggtttaaaaaataaggtgaaggaaagcaacatcaacaattggaaagcaaaccattcatgaaaattttcttataccctattattcaaaaggtattaagaaaggcaacacgtgaaacacacttttagttgacacaaaatacctgcctactctaaagcaaaaaaaggagatagcaacaacaataattgtcagttgcagataacacagcacatcagttgtctaatgtatcacgtatggctagggcaagtttgaactttttaagttgacacttccagtattttagactactccttgtaaagaatcaaatcatcaaaatctagcatcttgttaagaaggaaccatctaaaacaacaaggtgtaccctatccataatcaagtcaaatttctgagtggacagtgtaaaccgacatcctcataatcattgttttaacaaaaaaaaaaggttttatttgcagctagggcaccaatgtgctgcccactactacatactctgtccattcaaaattcaaaacatttgacgttgggagaaataaacacagttctctcaaagtcaaataaatttgactggagagagaaattcttaaggtaattcaaagcatgctcaatcaatggatataagtagcaacagtaacaacaaggataagaatcacacaagaaaagtttgtacttagaagatagtatttcgatatagctaagattcatcaatgttaactaccatctgcacccagagctacaagtgtagatccttgtaattgaaataaatgtaacgctgagtttacatgcataacagtgttaacaaaaaagtagcaagaactaaaaaatgattctggctcaataacagagtaaatgtatgaaaatagttttgctaaaatcctgcttccattgtaaattttgaatgctctaaaatgtagtctccaatctagagtcaaaatattttgaatcaaaacttaaatacatctggatttatcaaacaagtgaatgtaccagtagccctctagtctagcataaaaactagtatctatgctaagttctcaaccatcagcaagtacacatgtggtgctcaggctcatttcgtcctaatatccaagaatatggccttatacgatcaccgaaccaaatttagttatctcacaacctattctaatctgcctgtttgaagtgtacagtagttaaacttcacagttcaactgtttcgagttcctcaaaatgatgcaaatgatactgctttggcatattaaactactactaatggatgaatcaggatcgaaactcccactattagatccttctatctggtttaggatataaattccccaatgataggaatcccacacattcctaattcttttctggggggagtccagaagatactcgcaagaacaaatctgtttgttttaactgtccattacatgaggacatcacaaatattggagcaaaaatcac

SEQ ID NO: 68995 - DNA, 5541 bp, Oryza sativa
aaggcgtgctcccagacctcgtccgggagcgagtgccacggcggcgccgcggcggcgcacgccgcgcgcgagccgccgcgccccatgctgcaacggatcgggcgggcgggcggctgtggcttttttgcgctgagctacccggcggcgcggcgcggcgcgcgcggcggcggcggcggcggcatctgctccgcttgtgctcgaggttgggtttggttgggaaggtgaagcctcctcttctcctctcttctctcttgctctcacttctctactactagtagtacttctcttcttcttcttctctttctctttctctcacttgttttgtgaataaaaattttgttttatttttatatttggtttttcttgctcatctcatggaggtgatcactctctgcctgcctcaatacttattctatttttatttttatttttagtgttatttacttgtgctgaaaggcttttttcagtgggtaagtttttggggagtgagcatgatgaggtgaaaatgttgggatgaatagtgataggagtgggggtaggaaggggtgtgcctctttgttcttagcttggaccaattgtgatgggattgtttgtggagtgagctgtgtgtttaggttaggtttatggtgatgagcaagtatgccgatatttgatcattgctactcaattcttagtgttatatgggattatggattgtaataatgtcatttatttgtttagagaaattggttatgccattgttgtttttctcaatctaatgttatcatatgtgttatactattattgtatttggggcataatacgagaaaagtagcgaggtgtagcatagctaaatatagataactttattttgacttaccaaaagaatgttggttttcacttcttatccacaaaaaacaataaaggtaatcatgatatggtgtattggccataaacaatatcggtgccccttttcttaacctatattttcataccaagtcatgcaagtttcttttttattcaagtgcatctatgtgttaattctctatgaacatttatcttcatccaattattgtcaatattttcacatgtccggttgtttgacaccaaaaatatttataatcatgctttcttgttacaaaccaaacaatttcacttgaacatcgtacatactaaatgaaaccccacgcatttatgcggaaaattatataataatatgtaaacattatgtacaatatagaattgatttgtacattgacaatttgatttcacatgctttacacaataacatctaaatagaacatccaactgttgaaatataaatgatatcgcgatgtcgcttcataagagaaaagaatgctaaaaatgagttgaggtgattgtgctaaaaaaaagctagacaaaatgaagatgatatgcatatgcatggctcatgagatatatggacaatttgcaccatagataaattgatctaaatgaaagcaattgaggtgatattatttcataagaaaaaagagaattagaattaattatatttagtggtataggaaacacatcatcctctcgagatgaaactaatttgggtttgagaaagattattcgactaattgacatactcttggttctcgatttgttttgatccattgtagtcaattcgtatttttcttattttatttcttaaaatattcttgcttatattttcctgatttcccatctttggatagaatttccaattatcgtacatgtctatatcatttttgtattataggtggatcctcatcaccatttatatgatctttaactagctcatcacatcacacatgaagataacaactagcatgacttctttccatcataagtggtaattacattatataaatgtcattataaattccaacatttatgcatagtagcccatggtacatgagagaccattggagcccattgtttagagaagatcctggtttattttggggggtggtcccaccacagagtgggggcaaccacggcagcatgtgatgggcgcatgggcctctctacctttttactgccccagtcacagaacggcctgcctcctcccccaaaaataaaattttaaaatacaaattaaccaaaagaattttactttctccttttttgacctgattgcttgctcgctcgttcattctctctcaaatcccaatctcgagaagtttttattctcgccgcctttttactgttgcaaaccaatctctctcgctgctacgaacaacttttcacggtaaaaagagagagggatgcaaatgttaatctcggttaacatcatttttttaaaaaatatatatataccttagttagcatctaaagatattttgactaatgtaagaggaaacttgcattgagattgtattacggagattatatcggtatatgggttagtatcgtgttttaggattttttttagactatttactctgagcccaacgtacttgtcaattttaaaatgtactcagtgataatttttttcaatgcacacttgttaggataaaaagttctatgttacacttttaacaatatttttttctaaaatgcaaaggaaaacaatggttttaagggcaactataaagggaacaatgcaataaaaactaaaaagatttgacatcttaaatataacttctagacaaagatccaacactttttgttagctgcaaatttcccatttataattaaggaaactgattttaaatatttaaaaacaagtctcattaaaacttttcacatttatctactttgcactttgcatttccctcttacttaagaaaatgaattttacatcttaaatataaactgctgtaaattaagaaggtttttctccgcataaaataaaatataccacttcttaagtcctaacccctctaatatagtattccatcagatgataagcataaccattcttatcttttaattaatcctggcccatgtcagtgggcagaactagaatatttactggtcctgctaattactcataatttatttttttacggtgatctcgaagtacgtggtgttttgcaaaatcttcgagagccgtgaaaaaatactgcagcacgcactggtcccagcattaagctaattaatgcttaattaagccatcgaaccgcgtaatctaacattaaacccgatccaaatcaaatcggatcaaacattagcagcagaagcagccagagtaactgggagtactgctgtaaattttctaggtcagtccgggttgaatttttttttaccgcgagctcagaatttgcagggttttttttccctgatctgttcgactgctcatcaccgttaagagtttagctttactgacgggatttggagatggtcctgaatcgttttttcacttctcctttttgcagttttcagaagaccggtccaacgtgcaacctctttctcttttttttttcactaaaaaactttagagtatatttagtttgaaattatcggcttgtcataattttgctcgccgagatgaaactggtcacacggggtacctctcccgttagacgatgaagatgaaaatgtttataaaaattaagtgtttcacgtaaaacgagatggtaataacatgtgattaattgagttttaattattacaaacttaaaaaatagattagtatgatattttagagcaacttttatatagaaagttttcgcacgaaacgcacctttaaccgtttaaaaagtgtgccacgagtatccaaaatttaatcttctgcttgcagaagaaacgaacatggcccagtgtcaccgtttatatcttgccagcggtaagagtaaagtgcatgtgtaatcttcaaacttgtgcatgtgtgttatctaaggtcttgtttaggggaggttgagattatgagaaacaaccagtaagaagttagctggtgaaaatgtggagaagcttctaacttatagtttattttttttgaattctataactacagcttttcagaatctagaaaaaaaactggactatttaggtgagctgattctatagtttccagaagccccccctaaggctgatgaactctcaaaatgtatttttaggtttttaaactttcattgagtgtcatttagatccaaacggacttcaacttgctttgtgtgcttgacgtctatgtgttaatggaacaaacatgtcaatcacatatagaaaatttaagaacgcacattttctcctctctttttaatttattttttcaaaatttaaatatattttctcatctctcctctctttttaatttttactttttctatgcgattgacatgtggatcccactaacacataggcgtcaccatggcatgtcatgtctggcctatatgacacccataacaagtttggtatcaaaaaatacatcttaagagtctagggagttagataatatatccgtacaagtttaaggaccgctcgtgcacttcactccaataataatttaccgcgttatattttgaatgataatattaccgtggttaaaaatttattcctacccaattttttttacaatatttatgtagcacctaagctaataacaggacagggtttgcaagaccgtacaattatcgcatggttatcatgtgtggtaaccttatcagtttttaaaaccatgatatacctcgcgataaccacaaaccgtgagggggtggtaactctacccaaatcagtttggtgaaagttttttttaaaaaaacatatcataagctttaaaagtgtgtccacgataatccgtcatctggtagcctgactatatagctcggatcggatatcttacactggatgtaagagagcaattagtcaaatgctaaccaagaaatcatatccagagaaaccatgatgccaaaagtttgaatctcatccaaaccctataaaacccaaatgctattatgaaatcatacggagtagtagtagaatctgatgacctttgtaggcagagatcgatgatcctagatggcatcctgccatctgctcttttcatgggagccctcacttttcccatttttttggccggcaaaaggctacagagaggcaggcctagtacactctgcaatgcatcatcccatctcatgatgcccatcattttctccttttttttaaccccctccttttccaacttttttttctccattttaaatccccttttctccacaccccaagtgcaatctatccattttaaaaaagatttaaaaaatgaggggaaaataaaaagggagaggagtgcatgatgggaggtaggaggtgggcccggatgtccagatccgattgaccaaatcatttgcacggtaaaattaccaaaacacccctgggtgacgtcactgccccaggcttgtgtttcttgcttttttttatttttctcctctctttggtctgacactgtgggcccggctcctttttcaggcctgccttcacgaaaacatcatcgacttgtccagcttttttttttcactttctttcttctaaatttctaatttttttttgggaacgattaaataaaaggtaccgatatacgtaaggtggtgatgcgtgatggcctttggagtttgg

SEQ ID NO: 68996 - DNA, 1161 bp, Oryza sativa
gaaaatataaataaacattaatcaagtttagttgccaaacattttagcaaatatacatattacgacattaccagaatttgaacatatggttacgatacatactgaaagcaatcacgtagcattctgtatgctacttttgtctgttccttgcttcttttattaggaaggagtgtcggtgctctcaaaaggttacaatatagagctgcatgtaaaatgtatagaaatctcaaaataaaaacaagtgacacgttgaatggaaaattaaagcaaggcctaataattattcataaaagtagtgcattaatactaacattaatacaacctttggtttgtaagatgactttgaataagaagacaacaacaggagatttttagcgtgaaaaggaatagatgggtgataagatgtcagcaaaactctaaactaacagcacggtcagcttcctaataaaaataaggcatgcgaagccttttggatgtaagttgttattttcttataactgaagcttttggatgtagtaggaaaataattgaagtttttacttgtaacattatgcttgtctgcaagttgttattttcttataatacgaaacaacgtggcttacttttggatgtagtaagaaaataattgaagcttcctaattatagcaagtatgagctatggagtataacaactcactgcaatccgccaacttcccatctctaccagcacggccagcttcttgataatatgcttccaaactctgcatcaatcaagttctgaccagtaaaactcacggaaaagaagcataaacataaattaatccaatttgggatgtatctggattcttagagaacaaaagccatattgtttctgcatgttgcagatcagtaatgcaacccaacactaagccttttgaatattgtctccaccattcaacaagaagaaggaaaatgtataatcaactcctacaattttcatactgcacacagtatctccttcaattgccatcactgttacattctagcttggcatcctacaggttcaagtgtggaaatctgtctgccatcatcagagtcagagcaagtctttggcagcattagagaggcttctatgtattttcgtgaatgaagcactaaaggttaaaccaacctgtgggaaaccatagtgaagggctgcagaat

SEQ ID NO: 68997 - DNA, 11144 bp, Oryza sativa
ttcgttcataaaaagaatgggtgtttgttgattgcacctgtcaaggtgcttagaagtatttgaccacttaatgcctatattattgtgaaactaaggatgaatcaggcaggatacagcttaagaaccaaagaaataaattggaattcctgtcatcctatgctgtctgaatattttaaataaaagattaggcactcaggcaaactgatatccttattatttccaaatggtgcaaaaagctgaagtttcaatggataatttattatcaactttccaactgttaaagcaaaatcatacatattctatgcatgctatgtcgcagcaaaacctgatcgcataaccatcctaattcttctttgggtattctcttgcaccaaatatagtcgatccaactctaacatttgtgcttcccatttcaatctgtagaaacgcagaaacagtagaaaatgttagacattgagttactaaatctattaacatgatggttgcaacctgttcttaccgcttgctcaaaatcagcagacatgcccatagacagttcacactgctcctctggaattccaagctccttgcacacctctttccggcaattagccagtgcctatttgttcaacaaattgcacatatattaggccttacccctatggaaaatatagtccagctaagtgtgtctcagaaaataaccttgaaattctctggagttgaggagtaatcaagcatccctattgtcatcaaaccagaaaacacgagattcgggcagcctaatttgacatgctttgcaagctctacacatcctgatggatctactccaaatttcgctgcagaatggcaattcaatttcagagctatggataaaatattcaatgcttgtgcacaagaatatagtgcttccatatgcaagattgatcattccacgtacttatccatgactacagacaatccgatgcgtagcaatgctggacagtataacaataaggaacagagatgcaaacaatcatatgaattctattgtaagtttataaccaacccaacgcatgtagatctgttgctaccagaaattaagttaaaaagtagtactgtaaaggaaattagagtacccacattcttctccactggtgttgacctggactaagactttaaggggttttcttcccaagtcagctaccacacgatcaaggcgattggcaatctgaaaaagcaaacattgcatttatcttgttacagttgcaagattgcgaaactgatctgacaaccaattattcttccctaacttatgagtgatgcaactgaagtcatgctatacaaaatatgaaataatatcaagttctactacaacattgatatgcaatcattaaggcatactatttttttgttatgttactttcattgaacctgtaagtgatacctaattatccgaaaataagtatgttgagttgatgattgatcagataaatatggtgtatcttatagcgttagtatttcaaagcaaaaagtaatcacacgaagaaatattaatttgatgtttaccttctgatcatcaacactctcgaccatgtcaagatttggtacaccagctgtaggtcaaaacacaagaagataaaacttagttgaattttaaacctggaaaaaaaacttcaaatacctaatattcaaacaaaattgatagcttcattgataaagaatgagtctaacgttccatgaaaccagaacaagaatgtaattcagtgctttacatttaggaacatacagaaggcccacataatagtcaattgcacagttaactattcaacaaactgagtaattgagagtagataactctggctgctagaataaaagaacaagaaagcatatattgaacggccgacaaaattggcagtaagaaactaaagccatgttttagagatagccatggctaaccagtgaaagagagggaaaaaaaaagttcaagcacatcgtcttaattacaagtaccaacctaggagggctctggccttgttgctttgaaggttcccgatgaaatgccactcaatatcctctggaagctgcaaaacagacaatacttgctcagttgccaaagtttgaatatgtttgaggtcatttaattcaagaaaaacatccaagaagaactccaagtgaatataaaagaggaagaaaaggaataatgcttcactaagtggagtgcttgttacatatgaacacagaacacggtgagaggaataatcagtgaattccttgacatttatctttattttcatgaatcatgattcactacaggttcaaaatcaaacaatacttatgtatacattaccatgagaagagaaaccatgaatgagaatatctcaaaataatctacagataaggtttagtgatgtacatgattcacatgatgtgaggccaatccaaacaaaattatcaccacacaaaaccaacacatcctctcttcaaagtacaactgattgtaagccaaactctttggaactaatcatagtgcaacggcagagcgcctacagcttccaatcagttgacaacacggggatccctctgctctttacccagaatcgaactgtttgctatggaattgctgtgaaaaacctatgaaactcagtgttccaaatggagctataatgttcgaggatcaagattctactacaaagccgctttccagttcatttactaacaagctaacatgatcgatgattctattctaatcgacgaagcagtaaagcttacacacaaaattaacgcgctgcgaaggattgattacgaaattaactacttgctgatttttattacgggaaaatgcatgacgatgctaaattgctcactaccgtatatctatgagacctcaggagtgagttggatcaacaattttctctcaatcgcaatcgataaattcacaatcacacagccagcgagaaaagataaaagggcgagagctccgcgaggaaagctaagtagggcgagggaaacctgggaggccttgtcgatgagctcctggacgtagttctccccgaagcagcggtggccggcgtcgtacacgccgcggatgacgcccaccggcttcgtcttgctcaccgccaccacgcgcacggactccggcgcccgccccgaccgcgccgccgcctgctgcgcgcgggacagcaccgaccggagcgccgccgccgcgccctccgccgcggcaaccgacgccatcgcccccgacccctctccctcctcctccgccgtggccgccgtctccgccgccgccgctggtgttcggtggatagtccgccgcctccgcttcggatggagagatcctttcaccttaattcacatgagttttgagtcactgacatgtgggcctggtatggacctacatgtcagtgactctaggtggtgtttggatccagggactctaactttagtccctctatttagacactaatttagagtattaaatatagactacttacaaaactaattacataaatgaaagctaattcgcgtgacaaattttttaagtctaattaatccataattagagaatgtttactgtagcatcacataggctaatcatgtattaattaggctcaatagatacgtatcgcgaattagtccaagattatgtatgggttttattaatagtctacgtttaatatttataattaatttccaaacatccgatgtgatagagacttagaagttttagtcccgtcctagtttttcttttcgcttcttctcgaacttctcgagtttatcttttcttttttttagaaaacaagagagaatcgtgtggagggagaaaaatatacagaggtgcgggaacactctggaccgtgcgatatgaagtgaacggataagattgatcccccaccatgcgaaaaacaaatgtaaaaagaaaaaaaaaatccccttcggcgccaagctgagctgacacctccaagtccaaccaactcgtctccgacccaacggcaacgttttttttttttaaaaaatagactttttatgctttaattttattaatagacattttcaaaaaatattttcgaaaactgaacttttgcgtggcagcattgtcctgccacgccaacaatggtgacatgataaaagttatttggccacgctagacgaacagacgtggctaaaagtttcagattttaaaatacttttggaaatggtatattaataaaattaaaatataaaaactctaaacaaaatttcacggcaatgggaatcattttgaaacaaatcaaactgaaaatccactcctcaatcttaaatttttccttagtataataggctaattaggtccaactacataggaacttcttcgagctaaagccaaacggtttggcttggtcccgtgggaacaatgtcgacttgcaccactcctcttccctagggccgctctggcgagcaaaggaagcggcaacgatggaggggatccggtgatgggacgacaacaaaagcggaggaggaacacgtcctatgccttagtgcatccatcgattatggcaaacttagggtgcgttcgttccatggacaatgagtgagatagcacatcgttttccgcgcgcacgcttcccaaactattaaatggtgtgttttttgcaaaaaatttctataggaaagttgctttaaaaaatcatattaatccattcttacaatttgaaatagttaatactcaattaatcacatgctaatggcttacctcgttttgcgtatcttcccaatcttctcaatcccctattcctcaaactcacccttagagaacatggggataatggaacgtgctatgaattgaagctcgggttattggataaaggaggaaggtcgatggcgagttacgagtggagatatcggctgacttgaggtgtgacaacatgttcccagcatggggaatccattttcgacgttgtggaaagtggatgagaactatgtgatggctagtgcagctaaagtgcagttgggagtagaggcatgccttaatggtggactccacaatggtggagatgaagggaaaagggagggaaaccctagcttcggcgacacgaggaatcgacaagagattgtatgtagcgatagaaggatgagatgtcttgaccctccggattggctaatgccgatcaagaaccaaactagaaaagctatccactgcgtgacggagaaaaatatagatttatacctaattaaaaaatacatgtaaacatagagatttagtgatgctaacaagagcttgtgtgttgcaatggaaaacaaatgattttgtagcttattaagttaatcctatcttactataaaattacagcccactagtataaagctcgacatacaaatataccacctcaatggtggagatagggcccggccagcgcgggcaagtgcccaggctccaccactatgcagcagtttatcagcacttagttacaatgtttagtcaccagctaatcagcatacaatttataggtaatgccctcttgcacgtgaatcttcttgttgattaccatgcttaactaaatgcctgttactttcagataattaattcaatttcacaccatcacaattatgatctaaagataaaattatataactttctggtatcagtcttatttttttttcaataagatagtacaaactccatactctagcctatatagccatcatctcattgatatattctcataggatttcctctcctaaattagaactcgatgaccgtcaattttacatacgtatatgataaaaggtatacatatttgaattgatttatgtatatttgtttttcgctgttagacttgcccaagctcaaaagtattcctggatccgccactgtgccactcatcatccactagcaataattacactgaaaaacttatgtaagcatgcaacatcatctataattcattgaattctataaattaacatacaatcatctttctttatattgttttttataatgtttctaacatcctccggacaacataaacttcttttattttttaagtagatagtagatagaagtagaactgtagaagtagatagatagatagtataaaagagaagagaagagaagagaagagatagagataggctgtgtttaattctcttcaaactttcaacttttccgttacatccaacgtttgaacatatacatgaaacattaaatgtgaataaaaaaatcaattgcacagtttgtatataaattgcgagacgaatcttttgagcctaattatgccatgatttgataatgttgtgctacagtaaacatttactaatgacatattaattagacttaatagatttatctcgcagtttataggtgaaatatgtaatttgttttattattagtctatatttaatactttaaatgtatgtccgtatacgttaatttttttttcgccaaaacaactcaacacggtcatagagatatagaaaaggtcgtgttggatttaggcatgatttggttcggacttgttgattgggaggaggcttgttagattccacccttctttttttcttgggggtaagaagaggaccttcactgttggttccctccatggtgtctcccacgaaaaagaagagatgtttaggcaaagggatggacggtggcgccggcgatggcggctggtccaccctgagctacgacgccgacgtgctccacatccaccaggtttgcgcccattggcgcgcctccacggcccccttggctgccgcccggccatggatcgtggccggccacgagacgtcgcgcattgtcagcgccatcggcgaggactactccttctggctcccccatggcggcggccagaggatcatcccctgcttcggcgacgcgccgccggcggggctcccgtactgctgcggcacgccgcgcgggtggctcgccctggcggacgcgccgcgctccccgacgcggctcgtcctctgggagcccgtctccagggcggagatcgcgatgcccccgctgccccgcgcggggttcgccccgcagatcttcctctccggcgaccccctcgccgccgcggcctcgccggggtggatggcgatcgccagccagcccttcagcgtcgcgggcaagtggcagacgctcttcttctggcgccccggcgacgccgcctggacgccgcagcgcgagccgccgatggacaggatcgacagcgcggcgttccacggcggcttcttctacctcaccgtcaggtactggtacctctacgcgtacgacctccgccacgacgccggcgcgccatggccaccgccgcgcgtccgctccaccttcgtctacctcgacgccgaccgcgcgtgcgagctgtccaggcaaggccgcagcctgcgcgccgcgcacgtggtcgccgccgccgacggcgtcgacctgctgctcgccgtgctctactgggaatgccaccgccggagtgtacagatggtcgccaaggtgttcaggatggagtgggcggcggcggcggcggacctcgagctctcgccggtgacggacctcggcgagcacgcgctcttgctgggccgcggcgacgcgctcgcgctctccgctgcggagttccccgcgatcaggaggaactgtgtctacttcgtcgagcacgacaatgccccgcatcggcattgggctatcgccatggatttaggggcaaatgcttcggagctgattccgcatccacaatttcaggaagatgagccaagcgaagaagatggcaaatgcgccgccgatcgctccttgttgccgtattcctggttttgcctcaaacaacccttcttcaagcataagtgacatggccttcgccatcaataattgacatcattgactttactgtatacttcctctgtttcacaatataagactttttagcattactcacattcatataagactttttagcattactcacattcatatagatgttaataaatctagacatatgtgtgtgactagattcattaacatctatatgaatgtgggcaatgttagaaagtcttacattatgaaacggagggagtaaatttgatctattatggcaagtacaaaggtagagaccgatatggtctctacgttaattagaggctatcacgttacaatagttaagacaatacggtctctaatcattaatgtaccaaaatactttcttactagtcatctttcctttattagactcaatgcaataaaaaatttcctaataaatgctaagagtcgactctatgctgttgtcatgtgtagcaaccatctttctcttttcttttctctctctcttccacatcaccaaatatgcttgcatgacaataaagagagaccgctaataaagaccattgtacatgcccttagtttcatcaaggattctagtgattaggaaactatggaagggagatttttcccttctatgggaatttgttcccaagtagagttgtagagggaccaagcttaagagtgttttgccagtttgccggtttggtggtttgggagaatgcgaaagaatcagcatcttactcctgacaattcaatttgcatctgtaagtacaaaccaaagcttgtgacataatttaatttgaaaccggattaattcaagtgacatgacctttaccatcaataattgacatcatcgactttactgtgtaaaatttgatctgatagtttcatcacggattctggtgattaggaatctaaggaagggagatttttcccttccatatgggaatttgttcccaagtagagttgtagagggactgagagtgtgtccctagctagcttaagagttaagagtgctttgccggtttgccagtttgggagaatgcggaagcatcagcatctactcctgccaatttcaatttccatgggtaagtagaaaccaaagcttgtgatataatttattgtgaaatcggattaattcaagcgagtgccctttcctttgatgtggttattttctcttttagtttctctactgtgtggtgagcctacaacatctcatgtttcattggtccggtgatggtgtcgtatactaactgaaacaaatttatatttgctagtattgtcatcctctgtgttaaagaaaagaaataaaggcatttttattcaatttttgtgttactatcctgattcctgacacaagattgcatcgttgcgtagagctatcccagcaatatatcctttgtaaacacagtgagcaaagtgaattctttagtcttcaaatgaagtttgatttcccttggtcttctttttttgttgaaagaaaagagtatatatttgaaattttgtactttcagtgccttgtagaagaaatttgcagaacttgtccttgcttatgtttcagtcgttctaggagtccaagttttcccaagatcagttacattacaggggtttgagagcacagaagccctttgcttagtctggacatcagtttcaagtctttgggcactgtgataggatatggtgaagagatgatacattatgttggctgggagaaattccatagcaacaaatgagatagggatattgttcaatgagctgtatgattatatttcatctcaattgattttccattctaatgagtgaactaagagccgaagacttttctcgatttttcatcaatgcatccaaagaggaatcaaggtcctcataaggttaagtttttttgtcaacaagcagggtggctcaggaagcaatggattctctccctcagaatctcagatgttaaagcggtgtgagtaaggcgggtaagttcgctgacttgtttcgttatgtctgattgcttaatgctgttctaagttgaccgctctgcctattttatgtgaccatgtagatgtgagaataatcttcagtagtggtgaggcccttgtgcaggaaaagggcaatctcaatatatttgctgaataagttcatgaacacatgtcccatatgttcatggtggtcatggtcattgactcagtgcacaagaagttacatgaaaccttcctctaaagttcattgatgacagcggttctccttagcttttgttttgcagggttttgaaaccatgttcaggtcagcaattcccaagaggatctgcttcggtggtatgaagaaaaaaaatgccaagggccatcctattatatctcatgcaactgagaggtgtgctgctggtgtcttgcaacctgctgggcacttcaaattaggtcctaatgaattcaaagttctatacgaaaatttgacattttaaccctttcacaaaacttattctataaatgaaccatgacaaaaattataaccaaaagtaggcttctacctcaacgccatggactttggcgttgaggctcaacatcttagcgccatatttcacggtgtcaatgtcaatgggcttgacattgacatggtgggccgaagtgccaaggcctacggcgctgaggtaaaggtctatttctgattttagtttttaccaaggtctagttatagaataactttagtgaaaggatcaaaatgtcaaaattgtggtgaagtctagggttagtgtactatgtaatataggagaaaaccgaaaaaacccactaaaagttgatggagcagtgaaatcatggtatcatgcactgaacccgccaataggtcggttcaatccaggcttaaatttttcttggatcgaagaggcttgctgggtccaagtccaactacataggaacttcttcgagctcaagccaagtggtttggcttggccacatggaaatagtgtcgacctgcaccactcctctttcctagggctgctttggccgagcagaggaagtggcaatgatggaggggatccgaagatgtgacgacaacaaaaaacggaggaggaatgcgtcctatggctcagtgcatctatcgattatggtggccagcttagggaatatggggataatggaacgtgccatgaattgaagctcaggttattggagaaaggaggaaggtcgatgtcaagctacggtggagatatcggcggatttgaggtgtcacaacgtcttcccagcacggggaatccatttgcaacattgtgaaaagcggatgagaactgtgtgatggctaatgccaataaagtgcagtggaggtgtagagacatgccttatggtggactccacagtggtgcagatgaagggaaaaatggagggaaaccctagcttcagcgacgcgaggaatcggcaagagattgcatgtggcggcataa

SEQ ID NO: 68998 - DNA, 3360 bp, Oryza sativa
atacctaactaaaaaaatacgcaaggtaaacataaagatttagtgatgctaagagcctttgcgttgcaacggaaaacaaatttgagtttcggcttattaagttaattaagcacatatttaatccaaatagtactttcattatttttcttattgaacaagtaggtgattccaaatttatagagagttagctatgaaacgggagagaaatcgttgaagggtgatgtaataatatagattgtagaaccctaatatcggtggtatagatggtgtggcagaagagactccatcacttttaagaagtattgaatggtatcagtagatgatagaactatatcaaatttgcacagtgaagtcgccggtgtcaattcatcacaacattcggccgatcaacgttagatacggaaggtcattttcgctgaaaagccgacgaaggaagcaaaacataaaaaaggcccactatcaattaagcccattggctaaaactacattttgtattccagcccaagaaggccccccaacatccacagcccggccctccctccccacacgctgggcgggaagaaatactcaattctggagggaccaaatcgtaaaaaagccccctacctccactccgctccaatttctttcctcttccgtttcttcactagttcatttcacgccgcccccgcgcgagcggcgacaaggcgaaaccgcttcaatataagatcaccccaatcccccaattcggcaactccaatccaattcaattccccacccccgatccgcctctcgcaaatctcccgaaaccctagccgccaccgccgccgccgccgcctcgagcgaggcgtgatggggaagccggggaagtatggcgacggcgacgacgacgactcggaggaggagcagctctccccttcgtcttccgccggcgaggaggaggaggaggaggtagaagaggaagagggggaggagcagcaggaggagcagggggaggaggaggaggggtttagcggggacgaggaggagcaggaggtggagggtgaggcggatggggagcaagtggaggaggaggaagaggaggagtctagtgtcggggaggaggaagcagaggcggagggtgaggaggaggaagaggaggtggaggaggagcagggggctggggaagaggaagaggaggaggttgatgaggaggagatcgaggcggtcaccaccggcgccggaggggacgacgacgacgaagaagtgggcgatgacgggggcgcggaggaggagtcgcagtccacggaggacgacgaggtcgccgccgggaaggatggcggcggtgaagatggcgacaaggtgggtgtggcacggtttggtgatctaggtgctggtaggggttgggtggtttatgtttgaatctgttgataggtggtagcgattatgctatgatttctctttttctgaaacgaaatcagcagatttccgttgattatacagatttttttcctgtttccctctgtttagctgtaaagtaatctgttatgcgtctatactcctgtagacatttgagggatgatattagtgttcatttaaaattgtagattgtttttttttagaaagagaggcagtcctctcccgtgcaataggttgtaaattttagtaaagttgttcttgtttggtccatctggtgaggattcctgtatccgtttgggttttctttatgcgtaagtgtgctgtagcaaaatgtttaaagcttcgtggtatatttgtgctactgaagtagttttttatcgcaattagccaatcagcatggtttacagttatcaaaggagtgattgttagttctaaaaaagagtttcaaaatattttgaaggggagtgactactctgagtgtcactcaacatcactgagttgcttgtcttcaattgcagttggaagatgctactggaaacgcagagatcgggaagcgggagcgagcaaagctcagggagatgcaaaagctgaagaagcacaaaatccaggaaatactggatgcccaaaataaggcattgatgctgacatggtttgataagttcccatatctcctagcgattaacctccaaataggaataccttattgacatgtgatctaaatcttctgtgcttttttgcgttcacttcatggctttgagttctgtggtagcttagaatattaaattcatggacagaacaacaaggggaagggacgtctgaagtatctcctgcagcaaactgaaatacttgctcattttgcgaaaggaaacccattggcaaaagaagaatccacgtgaaggtatattcttcttggaataataatgctaaccccatactttccattaagggaagttactgctaaccatttgtcatttgttacaacagtacagtgccaatatttttctgtaatatgcgaaatactttctgtttttgagacctggtagtgatgacttgccgtcccattcccatcttcatagccttgatgaactccaagatatcatgtagtgcattcctttagctgaacattgtcaggattattaagaaaagcttttctctattggaacttcaacatattcagatttcagatttaaagtagttaaaaatggtcaagctgttaaaacatgcacctaaccagtcatctttggctcatttatcattttcagtaaattttgatgagtgcatagagctttcaacatctttttgtgccctagctatctagtattctagtatcaagtggtatttgttaaacatatttcaataatttttggggaatggtactacttaccacaacattcagatctatttatccagggcatctatctcttcttgttgtggtacatatttctttgttcttcataggtcttctttgtttagctaatgtggtaaggatcttaggggacgtcatgcatcaaagatgacagaggaggaagaagatgaggagtatctcaaggaggaggaagatgcccttgatggtgcaggagggacccgtctggtttcacaaccatcatgtgagcatttgcttgatgattctgtcaaaccttttgttttacaagccagtcttaaatgcagtttgtgtaacgaaaatgtttattttgcatggaaggttcgatttgtttgatggcgaaacagtatagaacggttcgcaatttcattgcgaatttgcgattacttgtgctgaattaatcaacattttgtgatttttttttctgttcggatggtgtttaaaacgaaagctgttgtgagggaatgcagtaaattatgttgcttcatctcacggcctgttatggaaaggaaaccctggttctgatttctcaactactcttgctcctactggcaggaaaggagataatatctatagccattatttgagcaagactgggtgaa

SEQ ID NO: 68999 - DNA, 1673 bp, Oryza sativa
cgacatgcttttgttcttgtgtgaaccaaggtccaagtcagcgaccgtatgctgtgcaacatcagctttttgtcaaaatagtctgttttttaaagaaaaaaacatcaaagcagtctgtagaacaaaagttgttagttttttatctattaaagaggaggaattagagggattaattgtggctttcatggattgcacttaattgtagaagaaaaatacatacaacaggtacccggtagtttctacccggtagatctggacatacccgatctgctgctgctcagctggctctctcttagttcgtaggtgtgtgtgatagcaaggtgcaattacgctagttgttgtcctagactcctagttcattcatttgattatattttttggggataagtctgcatccttcacagcatttaacccgtgtttatgtccagatgttgttatcttcacatccttgttataactgaatggtagtgtttatgtacaaatgccctggtagctttctttgtgattaaaatgagtccgtcacagactcgtgcaatctcatcagtttatgttaactactaaatgatcattatattcttgttggtttacttgacaggcataaaaggaaagatgagagattaccaactagctggacttaattggctcatacgcttgtatgagaatggcatcaatggaatattggctgatgagatggtactctattgctcttcattgttgttacacatatcaattaacattaagattatacttattgactcttatatggttatgcttaattcaacttcatgagctcatatttggcatgaaatccttctcgttcagggtcttggaaaaacccttcaaactatatcactgcttggatatttgcatgagtttagaggaataaccggtccccacatggttgttgcaccaaagtccactcttgggaactggatgaaggaaatacaacggttttgtcctgttctgcgtgctatcaagttcttaggaaaccccgaagaaagggtaatccccatgttatctctgtcattcatgtgaacttcttgtggtatattgctaacatatttgtcatacttggtcagaaccatatccgggaaaatttgttagtcccagggaagtttgacgtctgtgttactagttttgaaatggcaattaaagaaaaaactgcattgaagcgtttcagctggcgttatattattattgatgaagcccaccggataaaaaatgaaaattcccttctctctaagactatgaggatttacaatactaattatcgtctcctcattacgggcactccactacaggtatgttagcaccaccttgtcacattaattctacattgctacctatgcaaattttgtactctttctaatctaattatggtaatttgcttcagtatacatttcttcaagttcaagttatgtccaattttatcaccactgacttgattatgctgcagaataatcttcatgaactttggtctcttctcaacttcttgttgcctgaaatatttagctctgctgagacttttgatgattggttccaaatctcaggggaaaatgatcaacatgaagttgttcagcagcttcataaggtaacagatttgatatccatattctcaattgatagatcatgttggttttccttgtatgatttgtgtaacatgttacacttga

SEQ ID NO: 69000 - DNA, 938 bp, Oryza sativa
  unsure (1)..(938): unsure at all n locations
atatataatgcttttctgcctatgttttatgttttcataacatttgtgtatacacaactgtgtatcctgcagatgactaggctcttggacatcttggaagattatctgatgtacaaggggtatcaatattgccgaattgatgggaatactggtggtgaagatcgtgatgcttcgattgaagctttcaacaagccagggagtgaaaaatttgttttcttgctttcgactagggcaggtggtcttgggataaatcttgctactgctgatgttgttattctttatgacagtgactggtatgtccttttcaaatcgtaattttttctcattctacaatttgtgaagttaaaggttatggttatttggtttcacaggaatcctcaagtggatctgcaagcgcaagatcgtgcacatagaattggtcaaaagaaagaagttcaagtttttcgtttctgcactgaggttttatttaatttattttaagatttaaaaacactggtttagcactaagcaatatcttctatttatttatataacagaatatgcttcatattctatgcagtatacaattgaggaaaaggtgattgagagagcttataagaagcttgccctggatgctttggtcatacaacagggtcgattggcagagcagaaaggttagttttttgcttcataaaatgttgcttgacaaatgaaaattcaaacatcaattaatgttcttctgtcgtggtgtttcagctgtcaataaggatgagctattgcagatggtcagatttggtgctgaaatggtattcagctccaaggatagcacaataacagnnnnnnnnnnnnnnnnnnnnnnnnctaagggagaagaagcaacagcacaacttgatgcaaaaatgaagaagttcacagaagatgctattaagttcaaaatggatgacagtatgaccctctct

SEQ ID NO: 69001 - DNA, 9810 bp, Oryza sativa
ttcccaaaggatgagcgtttgaggatcagagctaaatgttcttggaatggctgcccttggatgatttatggagctcaaagaaccaagtgtgattggtttcaagtgtgtacctacattgatgtgcataaatgtccacaaaataaaaaaaataggcttgtgacatctagaaggattgctgacaagtatgagcacttgatcaaggccaatccagcatagaaaattgatagcataaaagaaacagtatttttggatatgtttgccgatgttagccattcaaaaattaaaagagctaaatctatagttatgaagagagtgtatgaagctgcaaaggaagaatatcctaggcttttttataaccaactagagatacttaggagtaatcccggtagcactgttgcagtatgcttgaatccagagtacaacacacctgtttttgaaagaatttatatgctttgatgcttgcaagaagggatttatagctgggtgtagaaaggtgatagatgaataatgtgaataagaagtgtgtactaattgtataacgcactattgtagctggtcatgccatgcacgtcgttaattgtaaattgtcgataaataacaattcttttgctttaggaatagtatgattaggtcgtgtccttttagttgtattttctccaacttcatgaaaaaacatcaatatttaccaacatacctcagcattaggagaatactcatcttcaccagaccaacaatctaagcttgactttgagcaaataatatcagaggttgtcattacaattcccttcttccttgtttcatcccaatcaaccagaaaccccgagcagtgtgctaatggttttcctcctacaaatatacatacatacatatatatataatatcagcaaacaaataaaattttctattatatcaaataagagatgtgaaaactatgtaccaatggatgaagaaagtcctaaaatgaattttgcagcaccaaggactgctttctttgcaggttcatagatgtccaacaactttgggtccgaaagacacaaagatttacttgagttaagtgtgggcaggctcagctgacgagctacaagaccatcaatgcataagtacatgtcaatttagagttagaggaataatttttttaatcttgcaaaacattttttattaaagagaaaacgcattaagaaagtaacactaaaaaaatcctccttttttctattagatggagggtggtactgttctcaacttttgacttacaccatcattaacaatgagttatgccaaatctgcattatatgtcaacagcataaagaagaaaatgaaagaaaggaacattggcatatacaatatacatagtgtacaggtcagtcaactaatttatagagattgctaggagctaaataaggtcactagctgtcgatacaggatatgcacgatctgtataatcaatcaaccataaaggtatatcccaacagaaaagaaggaaaactggactgaaaattacctctcttttcttcgaattcctcacgtctcttctggtaagcatcaacaatgtccatgtcaggtggctcaaggatctcttgaccatcagagtcatacccactgaatttgaaaggtaataagggcatgtggagtggagagctcggtgcagaagatacctcctcctcctcctccccttcattcatcttctctggcaccttttcctctccatcctcacaactatgatcggcctcgatcatttttctcctcctcttcatcctttgatctcgctcagatgatggtgaagcaggtgcagatcgggagcaatgcgatcgccccttgctgtcttgctcattaccacggccacgcacagtcctcaggagctcctgcaaccctggctgccgccttgttgcccttgaccgagtgttcctcaaccttggcacatcgtcctcttccgcagcaacaggtgccatactctggggttgctcaattttcctgcagctgcatatgtagaatttgcaaatttagaggaaaggcatatatgtcgtgcttttctgaaagcatgattgtactccctccaagttgaaaataattgttgttttgaacaagggtatggtctctaaaaaataactttgaccactatttagtttcatattataagactttctagccatgtccacattcatatatacgttaatgaaggaaaaaaattgaaaatatacatttttttaaatattttgcgtttatatatctgcatgaaaaatatttgcacaaatataccttcaccgcacggcggggacgcgggaccgagtggtgccgctcttccattctgcgggaccggcggtcgcgtagaacggccgtgcggcaccgtctcgctcccgcggcgcggaagtgcggcaccgcctccctctcgcgcccacgcgtcctgagacggtcccgcgtctccgttgtgcgggaccgtgccggtcgcgcgtcgccaatgcgcgggaccgcgccgatcgcgcttcacggttgcgcgggacggctcgttcccgtcctctgccacgcgcttattatatgacagcgaatttatactgcgtggcactatttaggactgtttttttgtactgtttgtcactgttttggcactgttcatgggcgatcccgcggttccaatgtgcggaagcgccccatgcacagtacgaaacagtgttgcacagtgcgaaaacagtgtccaaacacttcaacagtgttcaacagtacgcagagtataaaaatcgctagcacacacggtgccgcgtattggaaccgcgggaccgctacagtcccgcgttttggatgtgtgcatccgtataggacgtgcagagttcatagtgagggctgcggaactgtgggtgggccaatgagtctatgcgcgtatgtacctgcattcgtgatcatgcttatgaacgtgggtaatggtaaaacttcttataatatgacacgtacgaagtattacactattttccactgtatccatacctggtttgcttccccttagggatttaacctccaagaaccgaacaagccctgacggggctgagccgaagaggctattctatgaaatctatagaaggaggaggaggaggagggagaaaggtgatgtcagcggaggaggaggatgagcagcagcgtcggcgtcagcggcgagactactcatcaatcttgcccgccaccgccaccgccgccgcagcagcacagcgtccgccagaaatcctagccctagacatggaagaggaggggagaggggaaggggagaaactcaccggagagaaggtggccaccgtcttggtcgccgtcgcctccgacttgcgcggcaccgcgccggccgccgcagcgtcgccctcgcccacgagagggcttaaccgaacgcaaatctcgcataggccgggattctttccacaccgggttgttgggccgttacccgggccattcccagcccaaccgaacatggcccgaaaccaaagccaggccgcctcgacggaggctattctaggatagcgacccaatctggcctaagagatagatgggcctgaaatgcgccgatggtcaggcctgccacatcaccacttcacttggccctaatactccttttttagggcccatctcaggataccgagttgctaccccccgacccggcggccagatcgcgagctgggaagaggcggcggcggcgatgagcgcgggggtgggcgggctgcggcagctgctggcggcggcggtgacgacgggggtggcggaggcgcgggcggcgatcttcgggcacgcgctgaacccgacggggaagcgcgcggcgaccaagctgctgcggaagaagatggtcggcgagcagctcgcgcagtggtacccctacgacatcaagcgcgacgacccgctcgtcatggcgcgcgaggagaaggcgtaagtgctccccatccctccacttgagctgtactagcttgcacgctgcctggttgtgcccaccatgtgttcgttcatttgcttcacggggagggaggaggtctgggttacgcccaggacgtgtttgctgatatgcctaggtgacgaactataagagaagtatccaggatttctgctctgttggggggcagtttctgtgtcatgtgctcgccaactgtttgttgatatgcgtgagaggtggtgacttctgttggatcatgcctgataggtgcttgacgatatgcgtcaccaacgcgacttttgttgctcgattcgtcctgtgttactcatccgtgcagccatggtagatttaccggttgtctgttgtgttgagtaccatggaattttaccgatttccacttgctaggtgcataatcctttggtagggaattgctgattgtggtatgattaggtgaggttgtggatccgttgggtttgaaatgagtagtattatcactgcactcaccactgttcttggcgcactgcgaatattattggttggttttgataatttgatggctttgtagctttgttcgtcttgagggaacaagttcaagccttggtttctgtttacagtggattcattagtcaccaattgtagtgaattgaacttccacatccatgatatatataaccaccgaaggttgagttcatcttgcccaactttgaccccaaattctcttgaatattgtgttgttataatctgatagaaatgattgatataatctttaccactcgagttatgctgtacagtatgtatgtggattacatttagttgattatcattgtatttactgtttttaaatgtacggctaaagtacagaaggtgttcctgctattcttgtcaatttgattttatcgccatttccccctttatgccttctgctttttaactcgtatacaatgataacatggaattttgtaattaacatcacatctctcttttgtaggcgtttgtcaaagctggaaatgcttaagcgtcgcgggaagggtcctccaaagaagggccagggaaggcgtgcggtcaagagaagcaaatagttgccttaattctgcatacatcagttcctggcgttcatcctgtttgggcgctgaaatatttcgttgttgtcagcaatgtactctttctagtaggtcaaacaagatccattggcaatgaaatttgctttccttcatcataaaaccgatgtatttgtgctgccggcatgaatgcaagacaattttctattgattgttctgttgccataaatttagctttggctcaaaagattgcatttgagtgtacacttgttaaccttagctctgtcctctctttcttctcatatacagaattcgtattttggtattgaaatgctacaatatgtgcaatccttttcttgcatgcaaagctcaattttggcagtacaatgaaggctcaattttgccagtacaaaagaaagtatgaacatggctggttctctattcagctaaaaagaaaggaaaaaattatcataaatctgcaatctgatctgatctcatctgatcaacaaattgcatttcttacatttggactcactcacatcctaaaaactgatcctatcatcactacagtcattcacacgaggacacgcaacgccaaagctcctcaatcgccggcgaccttgtccggttcaggcgacacgtccgccgtcaccggcggcggcgccggcctgaccctcctccgcgtggcgagcacggtcatgccgccggcgaggcggaccgtgtaggtgcggtcgttgcggatggtgaccgtgccgccgcccacccacgcgccgttccggagcacctccaccgccgtccccggcggcagcagcggcggcagcggcgtctccttcttcttcttcttcgccttcttgctccccgccgccgccgccgcttctccgccgccgcgcggttgctgcgatcccttcgtcttccacggcggcgggctcttcttcctcgccaccatagctcgcgatcgatcgatcgcgagctctgatcagtgaaaaatcaatggaggagacgagggggctcgtggatttcgtggagtatttgtaggcggcttttgctcgctctcgcggggtgaatcggagtccgactcggattgtgttggacgacacgttacgtagcgctacgctacgtaggaacgaacgaacgacgcggacgcgcgctcggtagatcgatgctaccgactcttgacacgatgtacgtgacgggcaaagccaatgccattaagccagccgtgcactgcaactggttggtacatgtatgccacggacgccatggcgacgaactccgacatttctgcaagtccgagttgtcgctgctgtcgtgtacaaggcacgtaggtttttgcttcatattttactctttatatagctgtgttagttctatagctgttaggaagaagcacatcgagataaaaaatctgtcatttttcatgagcacgtttacctaactgcaaaaatagtatacaaattaatatatattttctaagtatgaaattattattactcaattaattgtatgctaatgatttatctcgttttacacatcattttaatcctctccaatccttttctctcaaacacacttaatcgcaatcaaaatatatattttagaagttgattttcatgtttttattatagtttactttttagcatagtcactaggaacaataagcgttacgaacttataattaggtttaggcaaaacggcttagaatcagaacgaagcatgaaaaaaaaaagaaggaaaaagtgagaagaggtctcaaacaaaagtaggcgcttctcctctccggctaaatctcgccgtgcacggcgtcgacgcaccggccgccgtcgaacaccgcggcgccgctcccgttgcgcgccagcgcggcggccgggaagctgagcacgcacgcgaagtcgctctcggcgccgttctgcacggtggcgacgtccaccttgatgacgtaccacccggccgccctgtcccgcgcgagcgccgccgccacggcgcgcgcgcggcggccgggcggcacgcgctgcgtccccgcccacgccgccgcacgggcgtcgccggcgccggcgccgcgcgccgtgatcccggggagcgccgcggcgtcgccgagccgctgcccggcgtacgacggcgccgcccggagcgccgtgcaccgccacgtgtagagcccgcccgggttgtcgaaccggagcgtcgccgagaggttgtacgccacggcgggcgccgcggcgtcgaaggcgaggaggcggagctcggcggaggcgacgacggggacgacgtggtgcggccggaggagcagccgcggcagcagcgacggcgcgaggacgagtaccgccaggagcacggccagcggcgcgaggcacgccgcggtggcggccgcggccgccgccacgcactgccgtcgccgtgcgctcgccggcggcgcgggtggctgatcggtggacatggcgtacacccaaggggagtggattgcaaatttgcaatttgcaatttgcaaagctgcaaatgtgctaatgagcaagcaatgcagaatagtggggctttgctttgctgtgctctcctcttctccttgaaagagtcgaactttttttttttcttctccttgaaagaatagaagcaccattgcaaaagcaaaaggagaggaaccaaccagtgcactgcacacatcttgttgcagcagaccatgtaatttgacaacgcagcatactgatgattccatgattaatccagcacttttgctttaacagaataataaattaacataccagaaaattaaaaaggagagattccaggagagagaatttagttttggttccgatcaaaacttttacatgaatgaatatatatgacaagtgcgcaaaaacaatgagactctaggaccagcgaacaaaaacaaaattggcactaggcctcgttccattattatgtttctgctaaatttctgatccggttgggctcccgtgattgctaaagtcatcgtcgagagatctcctcgtcgattcccacagctgagactcgattcccagcttcctcagctcagtaagtcctctctcaacttgtttacataattttgcaaacaagaaaagcatcagataaagtaagcaatttagccggtaaattttgtacaagacagtcaaaacgagaagtatatgatttcaaactttgaacgaatagtgcaaaggatggcagactttgagacaagagtttcatcattgttcagagaggagattaccttctatgatatcgatcgtagaaactggatgattgccttgttctatccaaaactgtagccgctcatcagctatatcttcttctatgtcatgacttttggcccgtctccagaagtaggttaaccatgactgccatatgtattcatgagttcttgtacataccagttctgaccgaaaacgaatttttgtgcaacatcacatcgattccaggagaaaacaaaatgccagagtggtttttcacctgcttgaagcgtacgtcgtcttgctcttcctcgcttaattctaggaccaatgacagcatatgtaattagaaagtgaaattgttattcccgagctatggatgtaaaaaggaatattagtaaagtagaactaacctaatgactctggagggttctggccttcagaagatggacctgcagtaattggaaacttaagtcatagtagtaaaactacacgtcacgcattgctgcaggccattgatgtgcgtaataaagttgcaatattcagactggaagttgtattcatctaatagaatcaggtcaacatagcgacatagtaatttttttgaagtctcagtgaattgtgcagggatgattctagaaagcagttctaatcacaataaactgcaattcttcagcacattaaatattatctaatattttgttgtgaagttatttcatatgcaacatctgaataaatgagctatcttgtaaatacggttttgttcatggtatcacaatcagtcagtgtatcacttctcatcaggaacgagggaattggtataaccagctctcaaaatcccaagctatgctatgtgttaaacatcaaattgtcggtaccctcacagtgaggctcgcatacattccccatgtactgaatattaagaaaaaaaaatattttatgagtttatcttgatagagagaaatatttcgagataagagacctgggaatctcataaaacaaaaatattataagaaaagaataagaaatgagtacattttggagaagccacctgagagaggtctgacgcgtcgatgttctgataaagcaagcatgactgcgtcctctaccttcaaaggggatattaaattattgagaccgaaacccaaataaaaataatagttctctaccattccgtgggaatatgtaaatgaaaattcgttgacacatatattgcatctaatatatacaacacaatgataaagctagtcaatctaatacttcctctgtttcataatgtaagactttctaacattgcccacattcatatagatattaatgaatctagacatatatgtgtgtctagattcactaacatttatatgaacatgggcaatactagaaagtcttacattatgaaacggagggagtagtagtaatagtctagtagcactcttaagtttcatacatcactttgcatttcactaattacacaaaaaagtgatgcatgaatagtgaattagcagtctttgtatcaactgatgagactgaaaccaaatcaaaatattttgaactaacttcatcaacactaaaactgactttaaaaaaaatgagagaattgacagagataactttcacattctaggaaaaattcattgcaaatttatgaacagaaagaaaatgaaagatgaacaaaatattcaag

SEQ ID NO: 69002 - DNA, 1182 bp, Oryza sativa
tgatactccctccatcgcaaaatataagcatttttggatttcgacacagtctttgatatgctactttgaccaaaaatatctatataaaagtaaaatgttttaaataaagagagttgtatattatgatagcttgtttaatgataaatctagtaacatcaattttacgggattgatcttttttttttgctattaatagtcaaagttaaaaatatttgacttagcactaaaaatgcttatattttgggacggaggaagtaattgataaatgtccgaaataatttgacttaagagagttgcttattttgaagttcttatagtttgtaggcactcaccatcgacagcatatatgaaaggtacgccatgagtatcatgatagcaacttctctgtcagttgagtgtctgcataacatcacaagcttgccacaatgattttcatatctacataaaaaacaaactactctgtggcatgactaaatcacataggagcagacctggcaaaacatagtttcttaataatataggcactaagcaacccagcctgccaaagtgagtaccagtaattagtccaaaaaggcatggtcaaatgaatcatcagaaaggaaggtagtaaatggaaaagaaaaggaaagatcagtggaggttgtcaaaaacaaagagacttacaactactccaagaagggtactggtgaagaataggtagagaaaatttcctatgaacgctagtagaacaaggctatcaaaattagcaatatcaatgtcttcaattgcattaaagagcacaacagatgtagcatcattgacaaccccttcaccaaaaaccagactatagagtaggggtgtttcgtcttggttaagcacctgcaagtaacaaaattgcatatttaatggtgtgctgtttcattttacaagacattaacaacaggtcattaaatggaaaaacctgtaaggtgcaaacagaatctgttgctgagaagatagccccaattgctgcatatatggattaaacaaaaagataaacagcgagcagaatgatgatgtattcaatggtaccaaagtccaaccagtcgcttcaataattttgaagtgtagaaaggccaagaataaagtatctaaccaagatagtccccaagctggagtggaccaacatcaagttttttgaacaatgtcatggcacctgatatg

SEQ ID NO: 69003 - DNA, 5111 bp, Oryza sativa
atatagttggttatcttgtgatcattaatatggaaccaaaataagatgatgtaagctgagcaaagaattcagcaacttacctagagagattatcacaaaggatatcaatgtccccacagcaccaaataaaataattgtcataaaattgcggaagaattgttttttctttacttgaaacctgatgattataaacaaagatgcatttcagttaaaagcttcacttatataaaatgtaagtaacttcaggctatcactttgatgttagggtcaaatgttttagcgagaactgaaaatacatgtatttctgcacaaaaatataatgctggagcttaaaatgttattagctaatccaaagaaatacacaggaaattcatattaatcaattcagttactgcaggaatgcatgcaatttcctaggttcgaaacagggcagagtaaggatgctgattctctataaagactatatatatacttgcacagtcaggaaaaataatctaaatgactcacaagcttactcacgttcagtaagaatgtaagaatgattagacatacttggatccaatcatcaccaagtcctctaattgtaaaagggcttcatgtactactgtgatacaatcctttttaagtctgtatttcagggggggaaataattgtttgggacagacgtgatagtttaattcatttttcagtataatttcatgggaatgggtgggcagttgactattttatacatccagctcaataagtgtaccttagcattcacaaatcacataggttttgaggaagtcttagaaacatgggtttgatacatccagaggaatctaagtaatattttatacagaatggcaataataatatcatcatatgcatacttcagaaatacatgaatttctcaagtgagtcctattgcggtgcattttgctctcaagattaaattagccaaaaccaaattaaactaagacaaggcaccttcttttcttgtacagaagaacaacaaaataaattccgctttggttgggagctcactagaagagctataggtacacagaaagctcacccagcattaaagatgatcggtggaagcaaataaatgaagaagaggtcctcactgaacacaagaatgtgcgagttcttcccaccactgacgagcagaatcacacctccagtgatcagcccctgcaagcgccaacccacagaacaaaactcaaaaccactcccctgtaaggcaaaaccacaaacacctggggtgcaaggccagagagccctctcatctcaccatgacaagcgcggtgatggattcattgacccaccggttcccttccagcaggtgcccgatcacaatgcagctgcacagcagcgccacgaagatgttgatcgcgacgatcgagtcgtagtccgacaccaacagcccgccggatttgagaacgagagctcccaaatccagccccatctcgaccgccgccacctcagtggatcctcctcagctcaccctggcagaatggaaacgaacaattctcaatgttaaaaattggatcatttgctcggtgcaagcaagcagatcgatctccatgattgcctgaacactgtagccgtcaacaaattcagagaaaccgcaaagcaacagcaaatcactcccggcttaatcattccacaacccaaatcaacaaaccagtgaccagtaggatgaaagatgatccgagctacatattctcactgaattcctcaattccgactccaaatccaaatccgacccaagaagccaccatgccgccacctctcctctcaagaaaaggatgtgcacaaaataaaagtaaaaacaaaaatcgaaattccgcacgcacctgcagattcaagcgagatggccaccctgatctgaagcaggagagaggatggaaccaacaaaaaaaaatctggattcagagagagagacgtgagaagaagaagtagaggaggaggtggtggactggtggtcgtgtccatctggccatgaggccgtgagaaacggaggggaattaattaacgaaaatcgcgccacctgtcaaacggtcaaacgggccccaccaggcagaggaagggaggagacccatgtggatgacgggtggggccctgaaccgggttggccccgcctgtcagtggctgtggctgggttgccgtcctgtggttttggttttggttttggtttaacctgaggggtgtgaggccgacgtggcacggggtgtgtgtggggcccacccggggatggagaccaataatattttttcttagataatggaatgaatggagaccaatatggggtattgggaagcaatgatggcgaatggatgggtgattagaggaaggataataatagagtccactttctactattattttattttaaagccaacatatataatagattggctataaggttggctgcaattttcttctcctctctctatctcttacttatgcatttaatggatttgtcttggagcttgtgataagctagctcttgcataagagccaacatacttaattttccactacctcttttcttcacctaagtatagtaagcttatagttcactattatacttgctcttagatcgttcggatgatgattcatgagtgtcgccctgtcgaagaggcaagatgaaatgaaaggagagaagggtatcgtgtatcatgtgtggtcgtcgtccactgctattaaagacaagaacagaatataacggtaaagttatacttccttcatcccctaatataaaaaatattccctatttttaaacgtttgaccacttattttattttaaaaaatttatacaatataaaaaataaaagttatacttcaagtactttgaataataaagtaaatcacaaataaaataaataataattctattttttttaataagacgaatagtcaaacagtgcaagtaaaatgtcaaaattacttatattaggggacggagggagtagagtagtacagacataggtggtgttcttttctccggaagatgaagatgaggttttttacgcaaaacgaggtggtattaacgtatgattgattgagttttaattattacaaacttaaaaaatagattaatatgatattttagagtaatttttatatagaaagttttcgcacaaaacacaccgtttagcagtttgaaaaagtgacacgaaagtcttaatattctttcaacttttattggagaaaagaacgggactataggactcccttcattctaaaattcgaacagggctgactgagttcgtttattcatgttccctatttccctctcttgtttgtcgcgtgtaatctctatagaaaaattatttttaaaaatcatattaatcctttaaaaagttttttaagctatacttaattaattatgtgctatgttgctccatttttcgtgattagggggtcaattcccaactccatgagacagacacagtcttagcatgattgaaacaaaggaaaaaccatatgaattatagaggattttatcctatgaaaaataatcctatagagttatttgaaataaaaaatgtttcctatcaatttcttaggaattcatgtggaatgaaccttacaagattaattttagaggaaaataagcatgatatcttacttcatgataatcaaacaacttttcgaaatcccataagaactccctaagtataacattctattcctacatttgttcctattgctgtgttttctcatccccacatttcaaaggagccataaactcttaaataatgttttgagttaatggtttgcttgtttgatctatcttaaatccatttttagggcccctttgaatcgtaggattgaaaaaacggaggaatgggaaaaacataggattctgataggaatgcaagtgtaaaacaaaggattgcaaaacacaagaaaaacacaggaatggccgtttgattggaccgcaggaaaaacgcaggattcaaacgagagagatagactcaagggaagttttccaagaggtcggagtggatgttaaatttcctacatttttcctctagaatcgtaggaaaggaaagtttcctacgtttttccttttatcattcctacaaatcaaaggcatgaatagtgtaggatttcaattcatttgtttttcctccatttatcctccaattcaaagggggccttaatagcattaactttcttttccaaaataagtatataaatccaaaaccatgaaaagaagtatatatttttttcaaattttattccaaaactacgttccaacaagcatgctccatacggctaggctatagagttgatagagagatgtggagggcccacgtgtcagggacacccaacgggattgtgtttttttttttttgagatagtgttgacagcgaaagagtgtggaatgaaattcttggctgtagatgagcctgtaggccccgccacggatgcgaggccaccagcggatgagcgccacgtgtccgctacaggcatgggcagcgcgaccagagaagtggacaggacaaggccgcatccgccatcctccattgattcatctcccttcctttgcttgagattcctcaacctctacatctctctcctccaatcccctcctctctctctatctctcttcccggcctgtgcagagacggaggcaggataggccggcgagcaaaggttcgagttctttcccctcggattccacaaagtaggtgtcttttttgtttaagaaaaatagaatcaccaagttgttgttctcgttgagttttggttgtattttgtcactcgagagcctctgcatgttccaaaagatggtgttttattggtggtgttttgatcatgctagatgtggaggatggacggatcagatattctgttgtttactcgctttgaaatttatgcttgttttagtattatgcatctttgggcaattatcgcatggatggatcatacatgccatttctttcggttcgaatgtcttcctgtttactactttggaattatcgtttttagagtttcgaattagctgattactgcaagtacagttccccgctgtgtttttgtttgtgattctgaactgcaaactgatctaggatcgagaaatgttggtgtatttagagatttaaggggggcga

SEQ ID NO: 69004 - DNA, 14540 bp, Oryza sativa
aggtactaaagatcatatctcttcaaactggttaggaagcttacttaatgaagacacaattggattgattttagtggccaaaccaagccaacatacagactgtgcgcatatggctactcgcattcctggtactgtagcagctagcggggtgtactacaatgatcaatacagaatgccatgtaagctgaaaggaattcattgcatggcattgaattgtataccgcaaaaagcgaaggtaaggaagtgcatgaatggatatcaatcaacattcaggttttgtgtaaatgagaaaaatggacaaaccaccgggcagtcaaatggttccttgatccaacaaggccagaatttccggtgtcattcttatggttctcataacagcagtgaaactaaagagtgcagccttgaagatggcactgattcatacaggtaatatttgtactacattacaggataatgagcctactttttccccagatgaccaatgtttattgaatttgtgtatctggacatgcaaattcattatcatcctaattcctatctttctactgtctttaaatgacacgtcctatgtacaaagctgaacacagtcatttttaagatggacataacccatccaacattttttattttgtttttatggttgacataacctgtttgtctttttaaatttctaaatctattgttgcagggattttgaagaacattcaagaggagcctcccaattttcagataatcaagttgcagcaaagaaaaaatcagtcaaatctagtcaagggttggctgaagcttgcaaatttgtttacaacgatgcaaaatttgtgaatgaaagagctcaaaatgatattctcttgctttcacggtattcctttcataataatctttaaaaaatatatcccttggtaaaaacaagagatttgtacataacaaaattatgtgtctcatttctaatcctagtggcataacaaggctgaacaaacgtgcgtgccaggatgttgctgttttagggtcaggatttctcaagcttgatggtacatgatttcccttttagctgacaagctcttagtttctttggtatgatttaactatccatctaaagctattatttactgaaagctcgtgcaaggaaggacactaaaaaaattgaccacagtgtgaaggaaagggcagcgcggcttacccattttgcgagagtatgatttttcaatatgtttagataattgaaccatccatgtgctttactttttgttcctttctacctctatgtactttagcctgttacctctgtatgcatattcagatattaaaggaacaggctcagtcagacttgaagaaagcagcagatcagcattggagcgatggtgctttggaggtctgtgctagttctctgtccttcacttcattttgctggaactagttgaaaatactgagcgatatatagctgccaaatgtttctggagtaccgatgttgttttattaccggtgttaaccttctttgtgtgtgttactatcaaattcatgggattatgcttatataatacactatttatttgcaatgcaggcagatctgcgacgagctgactcggttgttagacgacgtgccatggaagatgctttcatggctttaaaggtagcccaacttgttcttttccatctctactgtctttaaatgcagcaagttggtttagttttcattacaatttacaagctaagatatgcaagattttaggatgaaaacataatcagttattttgatttatgaaagcaagatttataactcaaactcgtaacaattcttgattatttatttgcttaacatcatgccccatacatcatatttccaacaaattttgtttgttttatgagcctgctgtcatgaccggtttgctgttatgcattacattaatagctaaggtttagtttgattggcttagcagaaaataaataatcatatatctagacatgaataactagcctcagacttaatcatactctatctacaccttgccatatcgacatttttttggtatttgttgctgcacaaaaggaaaagtttatggatcacatactagatgttttgatcaatttgacccttcccaattcttggtatttctcatacagcatcttgattattaaatattacacttgtatgtaattctgtaatatttagtgcagtttgttcgggatatccatgacatgatggcaaacagattacaagagcagtaagttcatttcaaatgctcatttcttagagaaattcaatgtttaattaaggagggtatgattttacttcgctggttcatattcattgttagaacaatctgatttgtactaaaataaatatactttagattcgcaaaggatggttcctcttctcctgctaattcaagaagtttcatcacccttgagaaaaatggaaataccttcgagctgtttcctcatgaagtttcaacggaccagattaccgccatagaggttatatctagattaacttatttagcagaaaactcccatcatatggctaattttggttaaatttgttatccatagcaagcatactggagtatggcatctgcgttgtctgaggctgatggtatcgactacacagatcctgaggaggtgaaacattttttacccacattataaagatgaaccttcctatgtccatctttctaaccttctcttttctgtttctgaagcttgagttgttagtagcaactctcattgacctggacgccatggatgggaaaaagagtgtttccttacttgctgaatgttcaagctctccagatgttaataccaggtatatcacagcattattgagtacagttacctgcaatgtatgttgcttctgcgttgttagcaagatcgaatccatcttcaagtacagaaaatgagaatatacagaaaatgagagaatgttaatataaagaatgcagatttgatatgtcctgtctctatacatcatggctatgtgccaaaatagctaattagcgacaaaaaataatttatggataaaactattatgtatatgtccttagtgacttaaaagccaattcaaaaaaggaactatgttgaaaataccgtagaattaactcaaaaattaagtcttaaataaattttggcggtggctgattcgttgtagggcaaacgatgaggctctatgttatatttctgaattacatcgcattcgtattgaccattattatgtatgtataccccttgtaggaaagctttagctaatgcactggctgcagctccatccatgtggattcttggaaatgctgggatgggtgcattacaggtgaacataaatctctcctatagctcctcctattgacaatttctgattaccttcatatcagaattttttgtatgagaaatttctaagcctctcagagccaggaatcatgcttgccccacagttcaaatttgatcttcatattcatttgtaaccatgatttccaagctgtacaaactgaagctcatttctcccttgtgatcaattatctaaaaaaggttaaaatccatagtacaacgcagcctgtttctgcataataatcagttattgttgaatgaacttgctagttgctacttgctacatgaactagtttctttgaagttacttgggtaactattgatgtttcatcaatctttgcttgctctttcaattgcagagattggctcaagattccaattatgctgtagccagggctgcaacaagagccatcaatgaactcacaaagcaatgggagcttgaagaaggtgacagcctgaggtttgtactgaatcaaaatatggtttctaaagagacagccgatgacagtgcagcagcagatgacaccaggtgatcatgtgcaaataagaaggaaaaaattacactaggattaacagaaacttatacaaacatcacgtttcagagcatatatatggataaggtgaatgtctatctctgtcacagtttcagagcataatgtgctgcttggtatcaaaccagatcaccagaatcatcagaatgacagaatgcatgtaactgacacatcttttcagtgccaaactgccaaagaaattaggaactggtgtaaagataaatgtattccttcagtaagacatagtcaatagtgttagaataattgggctaggcccaacttatcctattaaatctcaaaggcccataataagtgttaaggataataataccacatcaggatttaagcgaggaatatcttaacctaaatagggagttattggaggccccctgttgactggttgaggtggggttcggaatgccacgcgcgcgcgcgcgccgggccgaggccgtgggcgtgggcgaggctggctggcggcgtgcgtgcgtcacgtcgctattcttttgcagccactaaccacgttccaacaactgcctctctctcctgatagataaggaggccgcgagtccgatctgtaacggacgcttgcttctttcccggtgttagttcctcctccgcaccagtgctgttctcgcttcctcgcttctgatctcttgcgcgcacgagagattggaaggagcagtgcctccaaaaccacatcttcgcctgagatctgcaccgggtaggcgggtgatcaggtttttgggtagtgcctctcgcacgattgctcgccatgtctggagatgccgccgccgctactggaggagatggcagaggtggtgcgccaggagctggagccggtgccgcgaacgacaacatcaacggaggcaattctgcctcataatccaacggagggccattctcgaggtatatccttctcctgttccctttgttagcgctatcgctttactgttatgtgcgctgtgttcctgttcctgacattcatgatgcctctagcatgttattgcgttactgtaatgtttctgttcctgacattcatgatgcgcatagtatgctactggttatgttaagatcactctacactgtttatgccatggttattgctttaacattttggattaaaatatgccgattcatgactatatttccaacaaatagatgaagcaaaagagcatggttgaagaaattatgttcctcagatgttttttgctattcgattgggaaatggataatagtgccacctcctgagtatttctttgagaaaaaaagtctattttacaaccctaaaaactttcactcgcaccgagttgttaaatcctgaactttagccaagtggcatactccccttttttttacatggcatactaaaatttgatacaaatatgcaaaattattagtcgtgcttaaagcacctaatgataaaacaagtcatgtcgaaataaatgatactccctccgtttcaagttataagacgttttgattttggtcaaagtcaaactattttaagtttgactaattttatggaaaaaaattgtaatatttttaatccaagactaatatattatgaaagtttattcaattatatatttaatgaaactatgctgatgttgtaaatattactatatttttctatagagttagtcaaatttagagtaacctaaaacggagcgagtatttacatagttcttttaataaaataaatgaccaaatgtgaggtttaaaagtcaacaactttatatttttcaaaaccgagctagtaagtagcccaacaatgtcacacaatccgtgtacagtacaatggcacttgtttagaaggtaatccaacaatcggaaacgatttagtaccatgaggtactggtaccttgaggtacttcttgttggaccggagcaaatctcgttgcataaaccaccctaattgtcactctagttttgatattctaccctataacctatttcgttgcaaaagcccacccaccgtacacacgtgagtagcttatttgctccatttcttctgacatggattcgcagtgaactgtataagccatgttgtgttcatctaatatggctatgaggtgagtttgacttgagctcgttcttaggtcctgtttgggagagcttaagattctgagaatctactggttgatagacagcttatgagaatatggagaagctactaaacatagcttctgaattttagtttattttttaagtagaataatagattctcaaaatctatgtgacaatctcgattgtttggggagagtttttgattctgggagaaactgcacctactagaaactccccaaaacagatccttatactagttcgaagtggcaagaagggtggaatgacaatcaatggcgttgatcggcagcgaatccatattgaaagaaatgggccaaatcaactaataatgtgtatggagggagtaattttggcctttggttgcctgagcttttgcaacaaaatgggttacggagtagaatgtttaaaacgagagtgacaacggaggaggtggtttatacgatttggtcagtttaaaaaggacccaagacatgttttgcacgaggacaaaaacatccatataactaacttatcatcgaagagattagtacaaggtaatactataccatttctagtttgaaatcggcagagatggttaagctagctttcgtgagcaggagtgtacatcaccattcaccacaccaagccgtttcactgaagcttccgccttctcgccgataaattaaacggaagcagagctgctgctgcaagaaggctttcagctcacacgggagagaagagagatgggagtgagggtgaccgggccggcgggatcgccgctcgtggcggcggtgctggcgagcctggaggaggccgccgccggcggcgggtacgagctcgtcggcacggcggcggcgcgcgaacagagtacccggccgcaccttgcccggaacgtaagccgcccaccctttctgagaatttcttttaaaaacctttttaattttaaaaataaatctacaaaacttatttttaacatatgaacaattttgccacgctaacttgcatggcaaaaatatattgtcacgctaatctaactgacgtagctgttatttactcataccatcctcgctgatatgataggataaaaccgtcacacctattgcaggtgatgtgtcaatgtttttttttcctaatgctagatgtggtcaaagagttaagattttggaaataagttttgaaatgattcattcttaaaattaaaaattttaaaagtattttgaaaaaaatccctttctaacgcagatttgcatctcttaatgtgtttgaaacttttttaatcactcgagtggacatctagtcgtgtagtatcatagatttgcatacgttgttctgttcttgcagccgtttggtaagatcgccgcctttgctgaggacggcgagctcgcgctcgtcgacgccgtcggtggccatgttgatggtagccgctctcatgcccgcgtgacgtcttgagccatcggcttggagaaggccccactgtacaggctacgtactgacagttgggccccaccgtgctgttatactacttaggagttgattattatggtgggggccatgtgtcagtctcgatttgatagcaatgtgtcatgcggtgaagatagaaatgtttgtgtgcgagcgccagtaattaagaacaacacagaggaggtaggggggcaaaggagttcttttgtgtcgattcctattgcatcaagataagactatttctttactattgattttacaaagaaaattactatccatacgactagtgtgtacgacttgcgtatgactagtacttagctactgcttgccgtgacttacatggaaaaaaactgacttgtatgaagtgaattgattggctgatgaggcagggtcgaataggggtcggatgtatagcggtactcctttacaaataaagttcatcgtaaaacatctcgagaaggtacgtatatgtgatcactaatgttgttgatgggatgtttttcgtaccgtgcttaaaatctgatgtacaagttgtttttggcttgttgcatcacttgtgcattactcctctaaaagaacttgtctaatgtggcgtcaagaactaacaattaagttacagttgagtcaatcaggaatatgaggccgcgccatctgtaaggtctccttctatgtccacgtcagtgtaatttgtttctatcgttcgatatatcatatacggttcggatgcattttgccagattatgcatgcactagaatgcacaggtactagtgcttgacaatgacctatcatattacaagtgtacataatgcaaaatgtatgaggctataatcctgcactgatttttatctgagggtgcatgcatggataagaatggatgctattggccatccatgtaacaagtttgcagggtgcacgaatgcacgatggcctcactccctcgtgtgttattgtgttaggtctgctattttcttttttaaaaaaatatagtccaaaagagagacgaggtggggaagacttgattatattgttctcttttttttttcagaacacgcaatacgattacgcatcttttcaccgaaagacggggaaaagaaaagaaaaactcaaatcacccatacaaactgattgattgaaataggatcacatcaaggtggaagggaaaaaaattaaaacaacatatatctattatatgaactctagatgacaacaacattaacagtcagatttaggataagtgtgtacattaacatctactccctccgtcctaaaaaaaaagaagacaaaccctggtttccgtgtctaacgtttgaccatccgtcttatttgaaaaaaatatgaaaaaaattaaaaagacaagtcacgcataaaatattaatcatgttttatcatttaacaacaatgaaaatacgaattataaaaaaattttatataagacggacagtcaaagttggacacggaaacctggggtttgtctttttttttttggacggagggagtatctgtattgtaatgtgtttttttttaaaaaaagaaaaagcttgcatgcatgatttctatgctagtttaaaaagagcagtgatggtgatgaggggttaatctgtcatcaccaactacttactcttttgtaataaagaaataatatgtggggtcaaaaggttcacatgttaaccaccccatcgtctctaattttactgggaaagacaaatgatattataacgtcatatggatcatatattaattacaaatatatatagaatttaagagatgatatatacagaaaataatgataatagcaagttaatcattatttttcgtcaattaaaattctgttgccacaaaatgtttcatccgattctaatttcttatattttttactcagcagcagtagtaataccattatcatcaagcctatggtcacatcattcacgccaagtgtccaagcacctactccgaagcttcttgctgattaaattagacggaaatggagctgctaactgatgcctaaattataaatgtcagcatgtgtagaacgaggaagaactcacatcaagctttctcaagagagatagagacagagacagagtttagagagagacatcggagatggtcgcgaaggtgtacggagtggcggcgtcgccgtacgtggcgacggtgctggtgtgcctggaggaggccggcgccagctacgagctcgtcgccgtcgacatggccgccggcgagaacaggtcccgccaccacctcgcccggagcgtacgcccctctttgccctctccaactctaagattcgcttcactttcatacatgatgcatctcgatctcttcttgcacaaaatcaattaattgctcgctagaaaccttttcatctctgaattaattaaccaatcaatcaaatcaaattcggctatatcgttcaaaaaaaaatcaaattcggctatatttcgttcaaatttgcacgtgtttctcgcagccctttggcaagatccctgcctttgaggacggagaagtcactctctttggtatgaggaacaccacacctcacccgaattactgtgatatgctccatctcaattacttatatattggaaatgaataatgagtattcactttttttgaaaggaatattcacatattattattattattattattattattattattattattattattattattattattattattattattattattattaccagagtcgcgtgcaattcaacgctacgtgcttcgcaattacaacaaaccggatctcttaagagaaggcaaccttgaggagtcggcaatggtggacatgtggatggaggtggaggcgcaccactacgaccctgccatcttccacattatccgggagtgcgtcatcaagccgatgatcggcggcggcgcccgtgaccaggccatcgtcgacgagaacgtcgagaagctgaggaaggtgctggaggtgtacgagcggaggttgtcggagtcggagtacctcgccggagatttcgtcagcgtcgccgacctgaaccacttcccctacacctactacctcatgaccaccgagtacgccacgctggtggagtcgtgcacgaacgtcaaagctgttgagattatgggcatataaggatttaatttattccataaataaatcatgacattacagatgaaaactagcatgaacgcatcattagatctacacatgtaaactacgcagaataacatgaacagatcaaatatgcgcaacatattgaacacgtaccgaggtgacgaaaagaccggctgcttggtcgaaatttttcgcaggtgtctacgaaggcacgaaacacgcgagcgaagaggaaggcgagccgtcgcgaacgaacagggagcagtcgcgcgaagcgcttcccaaaaaccttattgccgccttctcccggtgcaggacgtcaaaggcagaggttccggagacctgctctcccgatcgcaggtgcacgccggcgagcgggatggagtagtctacgagcgacggcgcagtacagagtaggaggcaaaccctagattgattttcgcatgtattgcgtgaagacggcgggtcggtttatatagagaagggtcgcttgatcagggcgcccgcacgatctctactgcgcgtaaccgaaccggataagtcgcgcgtaacttatccggactccacgccgtttgcacgcaccggatttttcggaacgtttccaaaacaaaacgaatccgaatttgcagcaaaacaaaactgcaaaaggaggctgcatctgcgcaagggtgaggagccaatttttcggaccattcgacgcgtacgtcgtgcacgcgctgccctgccctgccctgccaggccaggccaggccaggccaggcgaggcgaggcgagcgagcgcgcgcgtgtgtttcccctcttctctccaccacacatgcttcaagtggctaggagggcatcctcccttttaaggaggtccccctctcctagaataagcaaggtggtactaaactccacatgcatgccatcccatgaggtgggcttttgtgattttccaaagaattaatcttcgagtgggctaaggcccattcattaattccaacaatcccccaccaaatctcaaaatcccactgagatttgccttttccaatgtactgtttatataccagtggttcgatggagaccaattaaggttgaacatccacctagaactccaagctacacttactcacaacttgaacaatggactacgccttgaattgcaagtcttgtgcaagcaagtttcactcaaagtcttatctggtactagaccgtctgtagactacccctcgggtggagcgtataagtcatactcctaggtctttggtaagcttcctagaagattcacccaaaatcttcatagactgcgaccaacagtcaagctcacaaaggtgagttccttcaagaatgctctgcaggacaacatctttgctaattaaagccaacagaactcattaaggcatagccaacctgccttgcagctcacgagagtatatgcatcttcacttggatagggtatatatattggtactctcctctagtttattaatggtttgttcttcccaggatctaattcacgggatctccgatcacatagactgggttaccaccatagtataactcacatgggtctcaaacccatctccttcgatgcattgtctatcacatttcgtgatagtccctttgtgaagggatctgccaggtttctcgctgtttggatgtaatccaacgttataactccggagtttcttaatttcctgacagacttcaatcgtcttttcacatgtctagacgatttcatattatccttagaactattcactttgacaattaccgtttgattgtcacagttcataaggatagccggcaccggtttttcaacaacaggcagatccattaatagatcacgcagccattctgcctcaacagtagcagtatccagtgccgttagttctgcttccatggttgacctcgtcaaaattgtctgtttgcaagacctccatgaaacagcaccaccacccagtgtgaaaacatatccactagtggctttgatctcatccacatcagagatccagttagaatcactataaccctccagtaccgcaggatacccagtatagtgaagtcccaattccacagtacctttcagatagcgcattactcgctcaagcgcacgccagtgatcatctcccggattagaagtaaatcggctcaacttgctcacagcaaaggagatatcaggcctagttgcactagccaggtacatcaacgagccaatgatttgggagtattccagttgattcctagcaattctcttgttcttgcgaagcaacaagctaggatcataaggtgttggagaaggcttactatcaatgtagccaaagcgattcaagatcttctccacataatgggactgcaagagagtaatcccattctcacctctaattagcttaatgtttaagataacatcagctactcccaaatctttcatatcaaaattttgagacaagaatgatttaacctcatttatcacctcaaggtttgtcccaaatatcagtatgtcgtcaacatacaagcacaaaataactccctcacccccaccatggcgatagtacacacatttatctgcctcattgactgcaaagcctgcagatgtcaatgttttgtcaaatttctcatgccattgcttaggagcttgtttcagaccatacaaagacttcaacaatttgcacactttgccttcttgaccttcaactacaaacccatcaggttgatccatatagatctcctcatccagctctccattaagaaaagctgtcttaacgtccatttgatgaacgagaagaccatgtgaggctgctagggaaagtagcacacgaattgtggtcaatctagcaacaggtgagtaagtgtcaaagaaatcttcgccttctttctgagtatagcccttagcaacaagccgagccttgtacttttcaatagtaccgtcaggcctaagcttcttcttgaacacccacttgcaccccacaggtttacacccatagggtcgctctgtcacctcccaagtcccgttagcgataatggaatccatttcactacggacagcctccttccagtagtctgcatcaggagatgcatatgcttctgaaattgacttaggagtgtcatccacgaggtacacagtgaaatcatcaccaaaagacttagccgtcctttgtctcttactccttcgaggagcttcactgacatcctcctcagagacaagttcatgtgtatgttcagtttgttctggtggtgtgattgaactgggaattatttcagagggttggttcgaaccactatgtgtatccttcattggaaaaaagctctcaaagaaggtagcatcacgagactccataattgtaccaacatgcatgtccggtacctcggatttaactattaaaaatctataggcaatgctatgatgagcatatcccagaaaaacacagtccacagtcttaggtccaagtttgcgcttcttcgttattggtacattgactttcgccaagcacccccatgtgcgcaaataagaaagtgatggttttctaccaatccatatctcatatggtgttttgtccttatttctgttaggaattctgtttaacacatgatttgaggtcaacaatgcctccccccaccatgccttaggcagtcccgcggtgtccaacatggcattcaccaagtcagtcagtgtgcggttcttcctttcagcaatcccattagactcgggagaatagggaggcgtcctctcatgtatgatgccatgttcttcacagaataagtcaaactcgttcgagaaaaactctccaccacgatcagacctaagcctttttatctttctgtcaagttgattttcaacttctgccttataaattttaaaatagtctagagcctcgtctttcgttttcaacaagtacacatagcaaaatctagtagcatcatcaatcaatgtcatgaaatatcgttttccacccttcgtcaacaccccattcatttcacaaagatctgaatgtaggagttctagtggtgccaagtttctctcctcggcagccttgtgaggcttgcgaggttgcttcgattgcacacaactatgg

SEQ ID NO: 69005 - DNA, 1490 bp, Oryza sativa
ctgcagcccgtgcgacctgataagaagaaaacaatgagatgtcagcacaaacatgtacattggccccagtatcaacccaccaattagtagattgattaactgaaaaaacagtaggtaaattaccatacccgcttccatctccagtgttgccaatggtcacattagcagacttagaagtctgccctgcaggtgccttcatccccttgcgttgtggacacttcctagccagatgaccaacttggccacacacaaagcaagtcctctcatcctgattaggattgttgttgttcttcttctgcttcttgaagttggtggtctgctgagctttgtatttccccttgctcttgttctgggccttgtgcacaacattggcactggactgcccaccatcgcccttagacgcggcatctttttcccgagctttctcctcaacatcaagagacgcaatcaacccctcaacggagtattcctgtctcttgtgtttgagtgcagtaccgaaactcctccaagatggaggaagttttgcaataatgcacccggccacaaatttgtcgggtaagacacacttaaggagttcgagttccttagccatggtttgtatctcatgagcctgttcgactacagaacggttgtcagccattttgtagtcatgaaactgctccatgatatacagatcattgctagcatcagtagcaccgaatttagtattcagtgcatcccacaactccttagcgtcggtcatatgcatatacacctcgaccagacgatcgccaagaacgcatcccacaaagagagtagtggcttcctcgaattgcttctgctgttcagcagtaagaactccttcaggtttgccagtactcacccagaagcatttcatagctgtcagccacagagtgaccctgatctgccatctcttaaaatgcacaccggtgaatttatccggcctcagtgcatcggcaaaaccagccatagtaaaatcacagtgcctataataaggtttttggattgttgagattatgggcatataaggatttaatttattccataaataaatcatgacattacagatgaaaactagcatgaacgcatcattagatctacacatgtaaactacgcagaataacatgaacagatcaaatatgcgcaacatattgaacacgtaccaaggtgacgaaaagaccggctgcttggtcgaaatttttcgcaggtgtctacgaaggcacgaaacacgcgagcgaagaggaaggcgagccgtcgcgaacgaacagggagcagtcgcgcgaagcgcttcccaaaaaccttattgccgccttctcccggtgcaggacgtcaaaggcagaggttccggagacctgctctcccgatcgcaggtgcacgccggcgagcgggatggagtagtctacgagcgacggcgcagtacagagtaggaggcaaaccctagactgcatctgcgcaagggtgaggagccaatttttcggaccattcgacgc

SEQ ID NO: 69006 - DNA, 2593 bp, Oryza sativa
tcatttccaaagaagtagtagcaaatcaagcgaaacaaaagcaataaagatgaaggcttcctcgttggccgccgtcgccgccgcggtgctcgtcgccgcggcgtgctccgggcgcgcgccggtggcggaggcgacgatcgagagcacgtgcggggcggcggcgaagggcgaccggcgcgtggacgtcggcttctgcgcgcggcagttcgcgtcgtaccacggcgcggcggaggcggacgcgtgggggctcgccaagatcgcggcgctcatcggcgtcaacctcgccgacgacgccgtgttcgacatcggcgccggcaagatccgcccctcccccggcggcggcgccaagggggacaaggccatggacgcgtgcgccaaggcgtacgacgccgtcggggtcgccttcgcggaggctgccgacgagctgggctcgcgccggtacgccgcggcgaggcaggagctggcgcgcgtggcggcgctcgtgcagcggtgcgacggcggcctctcccgggccggcgccaggtcgccgctgcccaggtacagcgccgactgccagcaggtggccatcatgggcatcgccattactaacctcctcaagtgacacgtcgccgcgtcgaacacctttggtggtgtggcttggttcttggctgcttacctacaaagtgaataaattttgtatctgtagtttataaaatccaataaattaagacaattcattgggtgtttgtttggtttaggaggttgattttcattgtgttagattatatttggtcgagtgatataaatattttgggactatctatatttatggcgccatatttttcaacaaaaaatagtcggcatgtatttatgttgtagcttcctaaattacatatgtaattttagtgtatttacaatgtaaatcccaaaaatacatatataagtcctaaaattacatatgtaaatcccaaatttacatattaattacatatataagtgatgtgtaagtgaggtgtaactactgtgtaaattcgtataaatatataaataattattaattttataacggaggtgaagtgctaatgagcttagagcttgattaggtgcagctggttctttcacaaaaggtgtaagatgggtgcatgtgcttgaaacgaatcttatcggaggatctcacggttaaaacatccgactgtaaattatcctaaaatatgtcgacacaaatttagcaatatcgaatatttttgtgtaatgtgaccaaagttctagatcaatgggttgagaaacaacatcgagaaacgtgggatgctatttctgaatggttttaaattttaacaaggaaaagatgagattgtacctatgttattaggatgggaacaatggttcagaacgagggatgcggcatgattccacgttcttggtgacttagattttgtaatgttggatttgaaaattcatgttatttgcccacttccttttaccaaattttggccaagaccatagataccatgttactgccaaataacaaaccttttgtgtattcaaaatttaaaaacctgtttcaaaaaaaaatcgcataactgtcagtgggaagttccatgcgttgtaatccaaatgaacaactcatatttcgttttcaccatgtaactgaattctagtccaatatgagtttggtccaacaaattgtaggatcaagctgatggcaaatgaacaagggggaattcagatcaaccctcgataaattaaatcaataaatacgaataaaagttactcaggtttatgtcaaaccgtatggttcaacatatggataaagttaagcgataaattcaaggcgagatcatagcatttcatatccttatcggactaaaacaaacaaacaaattgataatagtagtcattttgacatagatctttgttccaaattcatatgtgcaaattagaaagggataaaaacttccatgatatattcatgtcactgccaaacagtgcaatgcccattgtgacacctgattattattaattacatcaagagtcgtgcagcacgtacggatggatcagcagctcatgccggcgtccaagggcgtgtccatctcgccgtcggcgagcatgtcggcgagcaccatccctgcgaccgcgccgccgacgacccccatgccgagccccgcccccatccccatccctcctccaccgccgtgactcgccgcgccatggccgtacggcgctgggccatagccgtacccgtaatggtggtggtggtgatggtggtgctgcgcgtgcgcgccgccgccgccgccgccgtagggcgagccgtggtggtacgccagcgttggcgactgcgccgcgccgcggcggccgccgctgtggcgcccggccgacgggtacgcggtgatcgcgctgagctggaggcccttcccgctgacatgccgcgtcgacgacgcgccgcgggcgccggcggcggacgccggctcggcggcttcgtcggtgatctggtacgatatgtggagcacgccgcacttccggccgctgacggggcggcgcacgtggtagctgaggtgcctgtgctcgccgcccttcggcgccgcggcgacgaggtccttgaccgggacgaacacct

SEQ ID NO: 69007 - DNA, 3415 bp, Oryza sativa
tacacgcgcatcttggagaacatcgtcaccttcttgaggttcttggccgagaccagcgtcacctccagcacccggcgcgccatcgccgccgcggcgaacagccggccggtcactgacggcgaccgatcaaatgaagccgcaaatgattttttctctcgcaagtgttcacgttcttggattaaggaaggacgatgcacgcagggtggttaattgcaaacaaggttaattaagatttgagggcttaatttgtgtttacgaggtgtaattaatttgtgcggcgagccgttcatgtcggtggcatatagtgtcatgggtatttttagtagtagaggtttggagagcacaaaggtcatttctctgttggtttcacctccattgctgtggcaatgtgactggatttgaattctacttgaggatatgtgttcaatctttttaaaacataggcagaatttttgcctcattttgtttgatagagaagagatacacaacaccaacaaagaaagggctccctctcaaacactaatctatttaaaactcaaaagcacctcaagcacaccacataaactacaatgatatatgatatatgttcatgtttcacttttaggtcatgtttggaacagaggaatggaaaacacataaataggaaaaaagaacataggaaaacaatggaattcaaaacacaggaagatacattttggactgtttggatcacatgaaaaaattgacagagaaacacagatgcaagcatgaagcaaaggaaattttcctttagatcaaagtagatgttttttatttcctatgaaaatggaggaattactacctttccaaaggaaaccaacaaccccattcatttgttccaactaacttcataggaaaaatttccaaagtattataaacgtaaaaaaaaatccttcaaaaatcgttcctaacatggacttagaggttgcgattatttagaatttttttcctattttgagcctaacgcacgctcccagtttaccccatgggccccctttatcggcaagtgaccgacaggtgggtccgtagacaattgggatgaaaatttcggttgtaatgctccacatgtcggctgacaggtgagcccgttacatccggttgatgagttgatctgtttggagggacaacgacaagatcaagcatatcaacccatatgggttgggccccactttcgtatacatacatgtgtactgttgacggagcgcggcgctcctcaccgggagaccgcacaggcccccctttgccggttcggccgggggctcagggtgagatctcaagctctctctgtagatgacggaaagatcgcgacctctcaagagaacatgaaacacaagcgatgtatacaggttcgggccgctgagaagcataataccctactcctgtgttttggtggatctgtgtatgaaggagctataaagtgtgagccgacctctccctcgttctaggctctgaatctggaaagaatcaacccctttctctatgggcaaggtcctccttttatacttcaaggggataccacatgcacccctccctttccaaactggacttttcttcttttcataaatggacggagatttgcatggtcgtcctccgaacatcctcctgacgggacggcacatacctacctccacttctgcctgaggcgggcacgtcgtgggaaggtggctgtgtgctgacgacatgagcagtgtcagaccggtcacaaatcggtcattcttgtccaccacacgtcggctcagcaacgtgcatgtttgcccttcttcaaacaacatcttgcttgtaatggttaggatgaagcctggcatatatcgatcggggctaacgtgtcatctctgggatgtaacacgctagctccagccggggacgagtgcctagaagctctcgtctagacaggatggggcgaagcatgcgtctgaccgcctgtcgccacctaacccgcgatttgaccggtctgtgactggtcacagaccggataatcgagtgcactgcactgcacttcgtgcggcgtgacacgcttagccgaggcgcaataaatgcggtaggtgagccctgctgtgctcacctaacccatacacgtggagtagaaaacgcgaggggtcggggcgcctcggccctcgggggcgaggctggagtggtccgacccccccctcggggagaccaagaggtgggcgcacacattaccctcgggcccgacgtcccccgagggtgccaggccacgtgggcgattgtgtctgcctcaagcctctagtcatgatactcccggtcccatgtcaccgacaactgtgaaagtgtgaactccccttaacgtacaaaatgaggaactatgtcacaaagaaggaggttcgactagctaaaataggctaagttagattcacatctcagactcaacaaaggagggttcatcatgtccctgcaagaaaaaggattcatcctctctcacttagatcatcccaacatcatctgccataaacttgatcatcatcacttagagtgagtttgaggagaagtggattaagaagattggaaagatacgtaaaacgaggtgagctattagcgcataattagttacgtattaactattttaaatttcaaaaatggactaatatgattttttaaagcaactttcctatagaattttttttacaaaaaacacatcgtttagtagtttgggaagcatgcgcgggaatacgatgtcctttctcaccctatgtcacctaaacaaacgctcccttagtgcaagaacgtaggagtagggcattatgatttcgagcaatctaaacctgtataaaccatctgtcttcattctctaatatcccctcgttctcatgcacgacctaagcacgagctcgaacctgcaccatgaccgaactatcaaacgagggtactttgccttcctgcttggggagttccttgctctaatagtattgaacacttggcacattaaacatgaaaaaaaatatactatcatggacaccatatcaacaagaaacacacgtcgttgatatatattttgttctttttatacttaaattgcactgatgagttttaggataaactcaaacaatcaatttctaccaaaataataggtgactaattgataaataagtaacaaatgacatatatgtatataaaacggatatatcaggcccacattaacatcacgcggataaccatctatgctacgcgcccactgtttcgacgaaaccgctcctgcgtctattcgtaaaataccccgatacaccattacaattatgcgcaaatgccacactactttgtctcactttataaaaactttgctacccctatatgtcatttcgcattatcgttcgactatataacataggtcccgcatctggcttgcctgacatagaaaccatttctctcatttcttttttct

SEQ ID NO: 69008 - DNA, 5290 bp, Oryza sativa
ttcgccggggctaccgcgacggcctcgtcctcgtcgccttcttcggcgactcgagctacggctggttcgagccgcacgagctcctccccttcgaggagcacttccgggagaagttcgcccagccgggtggccgcaacttccccaccgccatcgacgaggccgccgacgaggtcgcccgccgcgccgccctcgcgttcctctgcccctgccaccgccccaacgccgctcgcccccacgagctcgacccgaggtacctcctcgtcgacgtgcctggattcgacaccgacgccgagtaccaccccgagcaggttgccgcggagcgggagaagatcgatccgcgggcgctgctggactacctgaagggtgccgccgtggagcagctggacgccgccgagctgatcggcaagcccaagcggcacatcccggcggtccagatgagctccatgcttgaggcctaccgcctatccagatacgcgctgaaggatcccacctacgcccaagctttcgggatggactacgacgaggcgcaagcggcgaaaacagcgttggagaagaaagctcgagaaggtatactcactcgcatgcccaatcctattaatccttttagctgcgctgtatgctactatgctattgtttctgctgctatgtactcaaacatgctcgttaagctaaccgtaataccattgctgagatatagattgaagtttgattcctttgttctgaatagaagtgtagatctggttcaattagttttctgtttcatatttttgttgatctgtctgttgcatgattgttgtttcattggggttgatgtggtttgtcacacgattattatagaattgattcaaaatgaagtaaaatttgacagatgcattgcagcaaccaatcttgagttgtcgtagattcatgggtattgccatgatctccaatttgatatcttattttttccaaacaattactaagggtacaatgagaacttatttccccactaccttgtaggaatatttttttataaaaaagattagggcctgttattattcgattgtgattttgttttgtcatgcttttattcatatatctcaattagagatttacgtgctacttagtacttgctgcagtttataggccaggcctcagttcctaacttgctatatgtttggaaatcgtgaggtcctctcttttcctaacatttatgcatcatttttctgttcattgcccatgcacttcagattgtatgcttgctgtttgttttttttttcatccctatagtttggcatttagacatgtgcaagcagtgcacaacacaacatttgttggttaagcgtaactaaagtcatgcatcataaaggactactataaatattggttaatgtacctgataaaacagagttatgagaagtgaatgtgattgggtttctcatctgcataacatgttttgttctggatgcactattccttgttcattgatgaagcaggctctgaggtaaggtggttgagttcacctttacattgtgaaggaaggcaccaagttaagatacgtatgactacaacatttgttagccgtgcttgttggttattatatttattaaacatgtataaaatgtatgaacattaactacgtataagtttctttgctgttattttagatgcatctagctgaaccattcggaagcggtaaatatgattaggatttctgttctttatgaaaaagggtaattctcaagatttgcgcataacataacaatcacaagaaaggaaatcatataattatgtatcgtcaacctaaaaaatatataaacgaagcattctttgcagactccaagtttataagtctgagagatccatgcctggagtaaagcaaggtgcatctagcttgcactaggatcagaggttccaacaccatcaaatagtgagggtactgaaagggggatcaatcttttgcctctcctgtccatgttcttgaccaccactagtgtgtttaagttgctccttcggttagaagcccccctccattcttcccgtgatcacaaatccttcatattggaattgtctcttcatattaccttctgctgctgctgtcctgttccagtgatttacttcccttctcgtccttttcttaactcgactagttcctttcttaagatgatgccttcagctattgctgctgctgctgctgctgctgctgctgtccaattcctgaattaacttctcttctcgttcttttgttaacaaaacttgttcctagaatcaatgctagttcctttctgaaaatgatgcctccagcaactttgctttgccttcagagttcgtagcggttatcataggttccttttgcacagaacagaatgattagggaaacactagagccttcagttcagtttagtttagtttattactctttccatccgaaaatataagatgttaggactggatgggagacatcctattactatgaatttgaacatgatgtttagattcacagtgctatgatgtgctccatctgatcctagtaccttatattttgggacgggggagtactacactagagccttttagtttagtttatttttgaaaagctaatcacagtgcacaaaaaaactgaacctctccggttgccaccaagaaatagctccccgcggttttgcttgttctaggcgatgcttcttcctgcccggacaaattctcctctttcctaggaaaaagcaaagattccatgaattgaatatatagacaccccttaggttgaaattcatccgaaattcgaaacgaatccacataagattatttcagtaaatggacatgaataacattaaattacaaattccacctgaattctccatcactctcttttggcgagatggtgataccgagtcacatggaagcttggaaagacgtggagagccaatgggggttggagaggcatcacagaatatgctcctcctccgttagatatttggtggccgatgagcgagacagacgccagcatttgtgccgtccaggagcaaagcactggtgaattttgtcctgccgtgtcagtcggactgtcaccctgtcttggcttaaataaaaaagctcttgaagcattaaacccccaaaatggatcaaccaatccttgcctctctactctttagcctttccaattttctgcgttagataatgatcaattgacaaagaagaaagttaaaggagctcattggctctctctggagctatttttcaactagacataataattcatggaagggaatgaagggatttcccttcaagaagaagatctcactttgcatggcaaatgagaccaaaggcgaatctcttcctgccacaaacaaatcccaagaccaagaatataggtgacggtcacgtagtagtagcagcattggtagtggtcgtacgtcattacttgcaatttgcatgtgcgtccacgtatgtaggcacattttcttttttttaaaaaaaaaattctgatacattgtgttcgctcgagagagaaagagaagccactacatactcaattcgtttcaaaataagttaacctagcacattatgtgactatcctatttaaattttaaaataaattaacctaatacagtatgtgacatattctatttaaatttatagtattaggatatgtcacattctgtattattgttttgggatagagggagtataatatttttcttttcgccatagaaaaaaaatcactgtttctttggttggatattaacctggcccaaagagagaatcccaggagaagcagagtcgccagcactcaccttttgcatccaccgacacggatggacggctaggatggatctaccgacggtctggattgcgcgctggaagagtcacccatctatcctcgccagtcgctgattctttttttaatttttggcattgctacactttctttctttctttctttctttttgcaaggtcttttttgtgtgtcatacacattgatttgtcaaggagatgagtaacaaataaatataaataaaaagaaaaaaaatcaggatgcatttccctttactactctccagctcgtgctttctcatcattcttcttttttcccccaagagtgaattgcacttgcacgtgttctgttacacagtatcagtgaaaggcttaatttttttttctttttgttgagacatgtggcagtcaaagccttcataaacgaacgaaatgtcatgatgtttttttaaatctctctaggcaagagacgtgtttggtgggaccggaaaacacaggaggaaccccaggatgatcagggcgagtcttcaaatacaactcctgcaggtattgtactgtacagtatatatacgactgtacatattcttctcatttttattatacttgtattattttgtattttacatttttcttccttccaaaaatccaatttctttcaaaacaaaaaaaaaccccgactattttaactcaatcacaatatcattagttaaattagtttattgttgttttatatatttcaaatacaacttctgcaggattgtaatgtacagtatatacgagtacatatattcttttcatttttattatactagtatagtactttgcattttcttccaaaaatcctatttctttcaaatccaaaaacactcgtctattttaatgttgatataatttccactagctcaatcacaatatttaaattagtttattgttgttttatatttcatatatataaaaatggaaaaccatttgcgttgacttggtcttgatgtgtggctacgatgcgtttgcaggtcgtccggcgaagggccgcaagaaggcggcggagaatcccggcggccgccgccggaagggcagcgcggccagcacggcggcgaggctcatggagaagatcatgcccagcgcggcggcgatgaagcccagggccaagaagaaggaccagtacctgctcaagcgccgcgacgacgcgcgcgccccgccgccgccgtccatgccggacgccttcccggcggcgcccatggcccccgctctcgacgacgtcccgccggggttcccttccgatcccccgacgccgccgctccccagcagcaccctcgccgccgacgaggagttcttgctgcagaggcgcactccaccgccgctgctgtccgcgccacccaccccgctcgcgcttcctcccgccgccgccgggcaggtcggcgacggcggcgcgcccacggacgccgccaccgccgccgcggcgccgaagaaggcgaccaagccgaagaaggcacccgcccgcaagcgcgagcgcgaggaacccgctgacgccgccgcc

SEQ ID NO: 69009 - DNA, 2990 bp, Oryza sativa
agacggccccgttcaggcccgggacctccggcggcaactgcgcgccgctgccgctgtccagggccgtgccggcgcgcgcggtggttgggcagcagcccaagtcgatcctcaagaagacggtcaccgacgacggcgcgccgtcggcggcggcgctccgtgatgccccgcgggtgaagttcatgctcgacgccggggacagcaagctcgagccgccgccacctgcagcgccggcgagcggcggcggagacgccgccgcgccgctcgccaagagcgccaccaagtcggtcgggttcgcgccaccgcctctccagccgccggcgcgcccggcacagcacccccacctgcagccgccggcgcgtccagcgcagcagcctcctcgcccgccggtgacccagccactccctccgccgccgcctctccatcagcaccagccataccaacctcgccacaccgacgcgctgccgctgccgctgccgctgccgccgccaccgccgccgccattctccgtgcagcagcagcagctccctccaccgccaccataccacctccgccacagcatcgacggaatgcaccaccagctccccggaccaccgctgccgccgtcgtaccagcatcgcgccgccggcggcgtcgtcttccccggacagcatcagcagcagccataccgccccaacaacgacacccagctcggcctccccggcgccggcgccgccgccggtgacgtcacgccggcgtggaagagaggagggagagagttcgacgaggagttgatgagggtgatgcggggaatcgccaagatggtggagccattgacggacaagaacggcaacttcccctaccacctcttcacctcagcttgagagagagtgagcagcgtctctcacagacatatgggccccactgtcagtggcagtagctgggctaccataacctcttcacctcggctcgagtgagagagagctgtctctctgacagacagatgggccccactgtcagtggcagtagctgggctggtagtactagtagttggactagtagcttggtgacttaattttgccaagaagaaaaaggattttaaaaacaaggtgtgtgtgcctgtcatgtgatgtactcttgttgtagcggtactgggattaagtttggtttggtatgggtgcatcgaccatactattattagtacctttatttctgggattgactcatggtcaagtgaagaaacagttgcagacttgcaatatgttatttctgactatgatgttgcagggataacataggaaaatcaaaatccacaaaccgtcaagtagctcttcacgaggcacgacttatctccattttaagctccccggctgcgttaaatagtcttgattctcgctctggattattaggttcagtaggtttagaattcaaaactgtaatagtagttctagatttttttaaaattatcggtgagaaactgagagtacgaaaaaaattctttagctcttccaaacaacaccttagctttgtattcttagttgttgctctttgtcaactagctattgggtcatgagattcccgtatataacgtgccatattggtgaggaactttatcatccttcatatatgactttcgccttttactctgttatagttcctagctacgcctctctctctctctctctctctctcacacacacacacacacattgagatggcctccttttttatttttcttttaagaagaatttgagatggcttcctagcgatgttctcttgtcaagaagcacatgcatgtctccctcgtcttatgagaaatggattaatgaaccagttattattctattatacctctaaagaacctctgtaaaatcctatattccacgatgccgggggtagagccaggattatatcaagaatatggcttaatcactagagtatgtacttcttgaacaagttttaataagaaaattagcaaattccttggtattttttccgtcaggtgtggggccctgcatgatgcccaaacattctggacatagagaggccagtttacacgatttagttttcttataacattacttcatttcaaagtataagttcacacgaataagatagtgttcctttctagtgaagataaaaataaagttagcaaacgtaaaataaaaacgccgaaggaagacctgaaggatggaacactgtcctccttagcaggggcggattcacaatgggggcgaaggggtcttgagaccccactaccgcccccgggacagtggagacccccctaagcccccactaattcttttttccatagatccataggatgtggggactggaggttcgatttatactgatgtagtttattcagtccccactattattttttttctagatccgctcctgctccttggctaaacaatgttaatttacatgccttgcgactgtcacatttgaaatgaagcacaaaccaaaccaggtaatttctattaacaaatcgatcaattctcattccaataatattggcacggctaacaatcccacatgacaaactcttacaacctctagtcctagttgaaaatacctacagcccgattaaaatttacaattactttatttcataatcatagaaaatatattaaaattaacatagttccacttaatccataaataattgaaaatttttaattcaattttactctattatattgcccattaattaattatagtaattaatttaagcagattttggcgccttgactgcctcgaagcgtggctccttcgcatcgaacttttgcttggcgtacacatccatgtactccccgaacacgtactccgggtactcgccgccggcgccggcgccgccctccaccgtcggcgagatggtcgcctcgaaggccgggttgtagaaggacgcgacggagcgccggttgccgtcgcgcatggggaggacgcggtgccacgcgctgcgttagcggccgttgctgagcacctccacctggttgccggtgttgacg

SEQ ID NO: 69010 - DNA, 13403 bp, Oryza sativa
  unsure (1)..(13403): unsure at all n locations
cgagcacaccttcttcacccgatcaagaagctccttcgggacgccatggttcaccagctgcagtgatcccaagagattattaaccatcttaatcaaacatgatcgatattgctgtcatgatcagctaatcaccaatcatcacatgatgatctggttaactcgataatgaaaatgaattacatttccggcttctgttataagtcaccagctaaccgttaacttgcattataatataatttttggtcgctgtaacaatttcagctccaactaaaatactccctccgtctcacaatataagggattttaagtttttactcatagtgtttgaccactcgtcttattaaaaaaattatgcaaatataaaaaaataaaaaattgtgcttaaagtactttggataataaagtaagtcaaaaaaaatagataataatttcaaaaaattttgaataagacgagtggtcaaacagtgcaagctaaactcaaaatccctcatattataggacggagggagtaggagtgaagctgggtgcgttggagatgaacaagagagttggagatgcgttttgactagtccacaacttcactccagactcaacacctggagctaaatttaggagttggatctctaccaaacagaccctaaaaatgcacgcagatctgattaattagctacctggaagaatccccactcctcgcagccattgtcgatctgcgccatcgtctcggccctctccgcggcggtgccgtcgagcttggagaagttgatcaccggaaccaccatggctgaaaccttgaagaagatggtggtttagaagttccttgtaaagaatatcaactttggtgttttcagtaattgagctgctaatgctgctgcttaattaagttgtgatggcttgagttaagctggagatggagatggagcatggatgaacgcatatttatagggtagaattgcactgatcaaggatggacataatagtttattttgcaataatgaacaaatagtttgcttctaagaaataaacaggataatttggtcaaagcacaggaaaatgttggagctgacctggcatctgccaggttatctgggatgaagcttctgggcagcgacagccgttggatgcttctggcaaattggtactatttgcatctccatgtaattatgcaccaattggagcaagctgatgatgatcatgtccttgtcatacgtgacctttgaactaaccctcattacactggcagaggattgccatgttgacaggacaaatccttgtaccatgatttcatattattgttcacatgaatgatgattcataattcatggagttgatttgatctcgtttatcatgatggtagaagtttagtttatcgaaaataataaaaagaactcgatccttgaaactagtagaatgatctttattaaattaagaaaaaaaaactatacaacacgacactaataggattctcataaaccacttaataccttctgccggcccggcgaaaaataaaccactgaacatagcctatcttgtttggtatcttgtttggtgggaggtacggatgtaaactcttagaaatagagtctgtcgtcaactcctattattttttactaaaaaatattcgcgtatggcggtatctgtaccaacaagcactcctcaattcttggaattctctcgtggaaaatatgtgagactatgacaaatttctatcaacacggtaaattttcctgaaaattggcatctgagatagtcggtgctactctctgaagattcacacaccaaagagtccaatgatcgatggcaccgtattccctgaggaaaaagagaagaaaatgaaaaagcttgctgcatcttgccaaagaacaaattgttctgagagtgttattgatgtttcctggatttttttttctctccaggaaagtgtgaggaaaatggctggaattcgtaggggccagaattgtgttcctctctctatctgtgtctgaaactctatctctgtttctgcttgtgaattcagagttgccatctcctttaatttttaatttggtcactagctcatccaattgctcagacttcacagtggacttcttgttcctttgctcttgtgttttttctgcaagtgcagcaaaattccataaatcccagtcactgcacctatcagcatgcaactgggggaccaaatgaattaaattgtccatgtgattgtcaagctgtcagatggaacctcggttccctcttccattttgtttccattgtggatatgtaaatgaatatttcagtaaatgtttgcagcaagaaattttgggactccctctcctcttctgaggtttctttcaaacaaaaaagaaattttgggaaaaaaaatttcttcaggtgtaagacgtataagtgcataacagagcaattcattccggaaccctactagttttggccttgttttagatatattgttgagcaggttattttcacgaattatcgatttaataatatgataaattattttttaaaaaagttaacaaatgacttaaaacatgtgatttaaacaatacagtagaaaaaagtatttttatggagaaacatgtttttaagcttagatcaaataatttgttttaataatccagtgaataagcttaaaagaacgtagagttagtggttgatttagggctaatttttttattggaaatatgactatcaaaaatagatggagagagagtggatttatgaaatcagtttacagctacgtatggaagaaagtttaggtcaattttttcgttaaagaaagtttagacccaattatattgcatattgtcagtgctatcaattctgtaattaattttcacgttgaaatcggaatctggccgtcgcatcacgtcagtgtaaaaaagataatagacggccaaatgagaccaagaaaaacatttggcaggcaaatgtcgccatcacctttacctgcataggagggtcatgtagaattaggcatggttaggtgaagtaattaattaattacataatgccttgttgagttaattattcagttagttgccattcgttccagatcaagaattcaaagattgaggatgatatatttaatttgcatgttgcaacatgtatatgtaagaaaagataagagtatatatcaccattgcatcagggggtttgcaatttgcatccaagataacaaaatatatttttcttgaggaacatttgaattcttctccttctcccatgccactggtgatgtatgcattcatgcatgtgcattttgaataagtcatttgtgataactaatatacctaatagcccatgaagtaatcatgcatgaatcaattagttggaaccgtatctatatgtccatgaaaataaacgcattatatgtacgatggaccacatggcacgtcgacgaagaacacatgatgaaaaagaaagacattccaatttgccagtcctagctatgttgcattagggatgatgtgaaagacaaaaacttttaatcaacacaatattgaattgaattgaaatctttctcgtgaactcgagaaatctccaaattaaacatcatatattatcagttccctcacattgttcttgagcaaaacatgcatgcatatgaaacggtcagcagccacacaattgtcaaacatggatgatcaaccgtgtgcatctatatattggaacttttttaaaagtttttcataaatatgttactagaactactatagcgcgcgtagctgcaaagttgattttctcactgctcgatcttcaaatatcactcattttttttacggtgatcgttgaaggttactacttactagtcaatgtacacgtgttgcgtgtgttttgtggtcgaagttgtatcctttcattctctttaaacattatttttcttcttatttttaaagaaaaagtagcaaccaagcgttaaaaaagacgacaacaaataagagtacataaatttgctaattcctgaaaattcatatttttggctctagtagatggggataacagtcctaaagggcgtttgcctacatctggttatttggtgatgaaaccaggatttcttaattttatttggtgcaagggctattaggccaaattttatttaaattccgataagtacaataactactattgaaatctcaaactatgggagatgcctacctacggcccctaccatgccctataggttatttttcatgaacattgggaaattataatatattcttttttaaaaaaaagtgcccccaatttcatttgagaacacaaaaagctgagtgaaaataatcagaaaacagttccaattttgtccgatgcagaacaacatatcatgagtcgatatcctctctctgcatcaacttgttcggagatatatcaatcatcctttatgacttgatttgctttcttcatgttgcatcgaccggtagactagactctttgagtccgtttatcaatctactctttagaagagaagtcatacaaatggacaacacaatgactacgttgtttgggttgatgagaaaaaaattaaagtcattgataatgacaagtaatcaatcaaacaatggtatatatgccaaatctaattaagcatggcacatatccaaccaaatacttggcaatctatccaagcatcctggggtgcgctacatcccagaaacttctaatttttgccacatgcagaaaattatttattatttacagcagccaaccagctgattaattggcctataaaaccctcattccctagctccatttgaagccatcaactgcaagcttacatcacactagctaattagctacttactcttcttcttgctagcttgctagcttctgcatttagacattgcaaaatctgaaaaaacttgagaaattaactaaacaaaatggttgttccggtgatcgacttctccaagctcgacggcaccgccgcagagagggctgagacgatggcgcagatcgacaatggctgcgaggagtggggattcttccaggtagctatacataatcagatcatgtgtcttcttagttgttgcagagatcgaaagttataaatcctcaattatatataagaatagttggtgcagtgatcgaaagttattctcgatgaatttaaacatatcaacatattgtgaccaaaattatccttacatttttaagaatagttaatcaaatgaacatgtgatgattggtgattagatgatcatgacagcatccatcatgttgattaatgattaagatggttaataatcacttgggatcattgcagctggtgaaccatggcgtcccgaaggagcttcttgatcgggtgaagaaggtgtgcttggagagctaccgactccgggaggcggcgttcatggagtcggagccggtgaggacgctggaggggctcatggcggcggagcggcgcggcgaggcggcggcgccggtggacgacatggactgggaggacatcttctacctccacgacgacaaccagtggccgtcgaacccgccggagttcaaggagacgatgcgcgagtaccgcgcggcgctgcgggggctcgccgagagggtgatggaggccatggacgagaacctcggcctcgacaaggggcgcatgaggcgcgccttcaccggcgacggccgccacgcgccgttcttcggcaccaaggtcagccactacccgccgtgcccgcgccccgacctcatcaccggcctccgcgcccacaccgacgccggcggcgtcatcctgctgttccaggacgaccgcgtcggcggcctccaggtgctcaggggcggcgagtgggtcgacgtgcagccgctcgccgacgccatcgtcgtcaacaccggcgaccaggtggaggtgctcagcaacggccgctaccgcagcgcgtggcaccgcgtcctccccatgcgcgacggaaaccggcgctccgtcgcgtcgttctacaacccggcgttcgaggccaccatctcgccggcggtgggcgccggcggcgagtacccggagtacgtgttcggcgagtacatggatgtgtacgccaagcagaagttcgatgcgaaggagccacgcttcgaggccgtcaaggcgccaaaatctgcttaaagttaaaaatagacttttatttgtgaattaattaattgattagttgcataaactatacataaccgcttttgctattcaagataaaaaaataggtgaccttacaaaatttaagtggttattattgtcatgagaatacaactattgttatgttacagtatatagtttggtattttagtgtgtcacggtttgtcagtaggaatatataataatgtaatagatcgtgttgttatatatacatgaataaactatatagatttttttaattaagttttgtcctatttattcgtacgacatgtagtttccgtatcattaatgatgcgatgccttgctggttggacaaaacaaaattgttatcccaattcctcagtaatattattaacgactctcatgcagggtacattttgacttttcttaatgattcttctaatttgtgacgtttaagatatcataccatatagtactactaacgattgttttacatacaggccatacattaaaaattaaaaagtactcctatgttgacctaatgagtaggatgttattaatggatgagccttcagtggcttgtgtaatttacagctgtgtcactgacacgtgaatcataatagagtgggactcatatttcagtgatgctagtacccatgatacgcactattctaataaaagctcctttcccattttttaattaatgctatgagagaaaatataaaccaaattagtcatacaatcgtaccctaggcgggtgtgccgacctatgcatcatatcccatattttcctccaaattcagatcctgatactgatagtgtcggataacatatcactcatactatatcatgttccatattattttatttgaattagattcaagaacgaataaactatttgtatctctagtatataaatattaaatataagaaggcaattaaagtaccaaaagagatatatcaaggaaaatcttttaaaatattacatgtgagctcgtaaaatagtgattaaccaatcgtttatcatcatatttgtaggtggatttataatagatgttcatatatgttttataacatacgggcggatacaagtcttcacatatcctaacccataattttttatggatttggattcgaaaagtatctgggattccattttctctctcatattcttcccgcgagtctcgggtcaggtgggtggtcgggtaatacccatcccattttcacccctagtaggaagtgaccaagcatagatcaggtgataaaatttaccaaaaaaattggcaaattttgtatgagaaccatatgggtctctcgaagtaattagtaattgcttttagaatgttgtgtgcttaattgctcaaagagtgtagctgatccttaaacttgtataattgtatcatctagatctttaaacttttagaatgccgcaattataggtccaaggacttgttaaattgtgttatttcgatctcaaactgcaatgacctcatagggatcctatatagtttgccacatagacgctgacatgctataatcaactatcctacctcgagtgacaagtgggtccactaagagttcttttttctttcttttccgtttttcttttgtttccttctttttttttctctttcttttcttttcttttctcttcttctgctcatggtcatcgtggaagccatctaggggacaccaccagacgagggtggatggatagcggaggccggaggggacaccactatggtggcgaagcaagaagggtgggagaacagcggagcctggaggctaggatggacaaacgaattgtagaggcgctttcgtcaccgctgcctaggaagcaagagcaaacggtggggagcgacatggggacaagggttggtgggatggctatagcaaattctggagcaagctcttgctgtctagtgctagcgaaaagacggaaggagggacagcgccacccgttactatcaggtgccggaagaacaagtcacggctgctcgtgagattgtcttagtgggagggggatatgtgactatcagttggtgtagaattagtgataataccacattagcatccatgtggcatgccacgtgagcaccacatagatcttggaggggtcgtggcggtttgcgacacaaaagggcacaatttaataggttttgggacttagatctgtgttttgagagtttaaggacatatatgacacggccacgtaaagttttaaggactagctgtgcactttactattgttcaaaagaatatagtaatagtagtaggagtttagtacactcatcacaagtgcgttaggtcatatatggcatgacacaactccacgttccacgttggatttagagtttaaaagttaaattagagttatttccatgttggatttagagttatttcaatttgtatatttcatctaaaataaaaacaaaataatttatctaaatattacttatcaatataatcacagctacggttcaccgatttctgaagctgaacacccagctgtcagtcataagaaatcttgatctggagtaccacgggacggtttagtgtgcaaccgtagatccctagatgccaactttctggaccaccatcagtgcgcgtccaaatcagtgctccagcctccatgtggtagcgactctgccattggcgacaacaagggaacaggatgctattgcacagtgcacacaaatggattgaaagaaaaatggccacaaaggctctagctacctctatgatggaatggtctttttttttttttctctcctttccttttgcgtttttttggatgattggtccatagtggagcaagatgccttagctggaggctatccatatccctggtatagcataaatgtcttctgtggcgtaggttatgccaacttacatagtagaaatttaggccctgtttaattctatgggtgaaaagttttggcgtgtcacatcggatattcagatatacatttaaagttttaaacgtagtctaataacaaaataaattacggattccatctgtaaactgtgagatgaattttttaagcctaattaattcatcattagcaaatatttactgtagcaccacattatcaaatcatgatgcaattaggcttaaaaggttcgtcttgcaatttacacgcaatctgtgtaattagatcttttgtctatatttaatacttcatgtatgtgtctaaacattcgatgtgacagggtgaaaagtttttgtgtgagaactaaacaaaaccttaatagaaaaaagggcatgtaactagactcaaggttgtctacgaaattgttttgagatattttgcgttttgaatgaattttggttacttgttggagggaattggtacacgaatcccctaagaaatgcatataaataattgtttgaaacaaatatggttttaaagcgtattttatcgtcctcggcataatttccctcaaggattggtaccaagtcatccaaaatagtgatggtttttggttaggtttggtatcaccgaaattttataactacacctaaaaatatttaagcaccgacttgtaagacaaaactatttttgaattttagaactaaaatttagggttaatttagaggtattcactcgctgttttcatcacttaatgttacattttaaaaccataaagaataaaacgtactacctccttgcacaaatatatgacgttggttagttcaattttgagctaaccaatgtcaaataaaaaaaatttggagggagtaagattcttacaacctaattattttcactgcatccatcacatgtctgcggtttataagctgcaaccaaaacaatcctttcaaacaagtgcttggttaaaaaaacaaaatggataaaaacaaaatcatatatatgccgtacccgttggtacacgtaccagtccaagacatgtgcaagagtacaaacaccaaataaaacacccattgttcgattcgaatttcgaaaagcccgcacgaatctctaggcacaattgacggacagatccaacaaaaaaataataatgacgacgttaattagtaattactcaaccattaccatgtgctaagctaggaggaccgggtaaaaacttaaaaaccgctgttataactaacagcgagagaacactggcaaagcatgcacaaattcggggagccaagaatggcattactggatcacatcacccaccacactagtagtcgtcgtgacgccttcccttccactctcgccgccgccgacgccgacgacgacgccgccgacgaggaggagccaagaattgcatggcgggatacgcggcggaggcgggcgcagctgctggcgcggggcgtgggcgcgcagcacggcatccgccgctgacgtcgctggtggtgtccaccatcgccgccttctccgccgtcgtcgtcttcgccatcctccgctcggtgcgtgcggcgtctcgtctcttcgatctcactcttgtagtcttgttcttggcgtgttcgatcggatcgatcacctgtggatggcggcgtccatggcgtgcgtgtgtgcaggcgtacgacgcggcggtgtcgaggacgacgacgctgctggggcacaacctggagccgacgccgtggcacctgttcaagcacgacaaggggcggccgccggcgcgcgccgcgttccggtgcgcgccgtccctgacctgccggccgccggtggcgcagccggcgccggggacgacgaacgcgagcgcgaacgcgtcggccgcgccgcggctgtgcccggcgtacttcggcgcgatccggcgcgacctggcgccgtggcggcgcggagggggcggcgtgacgcgcgcgctgctcgacgcggcgcagcggcgggcgtcgatgcgcgtggccatcaccggcggcgggcggcggctgcacgtggagctctactacgcgtgcgtccagagccgggcgctgttcacggcgtggagcctgctgcagctgatgcggcgctaccccggccgcgtccccgacgtcgagctcatgttcgactgcatggaccgcccggccatcaaccgcaccgactacggcggcggcggccacggcgaccacggctcnccgccgccgccgctgttccgctactgcaccacccggaaccacttcgacatccctttccctgattggtccttctggggctggtaagaattaaaaaatactccctccgttttagattataagacgatttaactttagttaaagttaaactatttcgagtttaacttaaatttataagcaaatataataatatttataatactaaattagttttatcaaattaataattgaatacattttcataataaatttgtcttcggttgaaaatgttacgttttttctacaaacttgatcaaacctgaagcagttagattttgatcaaagttaaaaacgccttataacctgaaacggagggacggagggagtacttactttgtcttattgcttgtcttcttcccagtagtacgacagtagtactattaaaatatttgagtttagaacatgatttagttagaattttagaacttttaacatctacaatttcccaaaaaaaacttagttcatgaatagaaaatatggtatgtttaaattgacctcaaaatgcactttccattatatcataaatttgttacattttatagacatattctaccaatgttatgattagtggccaaaattttaatggtttactaaacatcgagtatttcccaccagagagagtagtattatccgttgggttctacaaaatatcaaatatggtgtggaaaatcacaaattagagagaaaggattatgcattgatgtttttttaagtagtgattcgctcgggttccgattctatgaccgatttgggtaaagtctctgtttttcagcaaatgtgagttgaggttttatgtatttttacataatatataggcctgaaacgaacatcgagccgtggagcaaggagttcagggacatcaaggaaggggccaaggcaatcaaatggcaagacagagtggcaacggcgtactggaagggcaaccctgacgtggcgtcgccattgagggtcgcattgcttaactgcaacgacaccaacatgtggcacgccgagatcatgcgccaagtatatattccactcacataaataaacacgtgatcaatcattacattatactctctccatcctaaaatatcgtaacttttagctattaatcataaccgaaagtattacattgtactacctatgccataaagtatcgtaacttttacctattaattagaacataaagtattttagaactaagatagtaataaaggttaataaaactgactaacattatgatgaatgcagaattgggatgaggaggtcaagtccgggtaccataactccaagctctccagccaatgcacccataggtaacgcaacggtgtcgtggcgttaaaaaaaccctatgatttagttttatgcaccgatcaattcaacccaaacctttgtttcaggtataaaatatacgcggaggggttcgcgtggtcggtgagcctaaagtacatactgtcatgtgggtccatggcgctagtgattgacccgcagtacgaggacttcttcagccgtgggctgcggccggaggtgaacttctggccggtgcacatcgacgtcgccgccggcggcatgtgcgagtcgatcagggacgccgtggagtggggggaggcgcacccggcggaggcggaggcggtggggcggcgcggccagcggctgatggaggagctcgacatggacgccgtctacgactacatgctccacctgctcaccgagtacgcgcggctcatgcggttccggccggcggaggcgccgccgccgcggccgccggcgcaggaggtgtgcgaggcgtcggtgctgtgcctcgccggcgagaagcagaggcggttcctggaggcatcggcggcgagccccgccgtgtcggagccttgcgtgatgccgcccgatgccggcgagtgataaaatgtgttacattatgttttttttagagcaacacggtaggatacgtaggcagaaaatttgagcagttcaacttgggattttaggatttgctttcagccttaaacttattttattttcagccgagcgcaaaacaattcgaaaattttgagcaaggcgtgcatttgaacctccacatgttgagttctcaactagcaaaagtgcttcaattacaagatcgaactttcaattacaagatcgctttcgtttaaaatccaaaccatacccaacatcttcatccgaattgaccgaaactagtcagcacttctcaacctctagaaacacaccaggagaaaaaaaacaagtgtgcttttaagaaaa

SEQ ID NO: 69011 - DNA, 3833 bp, Oryza sativa
cgcgaccggttaaattaagacatactcatacattcgcataggaaattcgtaactaaaaccgcatttttttcttttttctggcacagggcaaatgaaacgagaacaaataatgtaagattcacttaatactactatttcatagagcaaataaatacccatttagcatccaggttaactcaggagtgccaaggacatacataaaagcatactgatgatatgcataataacggcatggttagcacctgcgcttaacagtgaccaagtgcctcacttatccagccgatatgccctgctaccgttttatctttgagattatcatcattctcctatccgatgacgcatgtacaaaatgagaccagaccagccagtgctgcagccagggaagaccgcggtacatcgtaacatagaaatgcccaaaaaaacaccgcatgaccacgaaatcgttgatgaagcatcatgacaccgctgcagcgaagctcgcgagtcagcaaagcttagctgtttcttgacttagcatcaaccaccaatcaagccaggtatctgtacacattagcgttgtccttctcgcgttccaggtaatcccttgtgatgaggtcctcgattcgcttcttgatggctttgaagtcaggctgcagtggacaaaaaaccaaagtaagggaatgcagtgtactgtagtcatataactaatttaaaagaaataacttcttccttatgataagaacaacttctcgagatgaaagaaaaacagctaattcaaaatgattgacatgtgagctcagaacacattagcacatcagctaattcaagatgcattgaagacaaaaatatgccgcatgagttgtactcatatgcaactatacaagatgtgataaggattaaaatatgtgggatttcctagaagtaatatgtagtcggtaccttgaacatgcggctgagctgctccacacattccgcaactagctgctgatggcccataactttgcgactcttcataatgcgcacaatcgatgcatcaattgcataccgcctgtccttgtcaacatcttcgacaacctttttcttttcatcaacaggaggtaggggtatctgcacataatatgaagaatacaaccattaacatcatagcattcatactccagaaagaaggcccaccaacacgcaaaacacaaaaacacgaaataccttaattcttctcatcctgtcagtgaattttgaattgaactcaaaaacatcgttgggagaaatagatctattagctggttccttgttaagaatcttgtattttgcacaggagagagaatggagcaaacgcactacatcatcatctgataagtttagctgtgttacaatctcagaataagtaagcctgtcagatccgttgaatagcagcagcaacgcagcctgcaaaaggagaggcatgtcaaaaaagtatcataaaggtttttagtgcaacagatctgttgacagtcatataatttaaatttacctgatatgttgtgacaatgagctcaatagtttttgcctcaaactttgcattgatattgcaggttcccaaggaatatatccaggtaagctttctgtgttttgttcttgtttggtaaaactccttgaaaacctccacgcatttcacctaaaaatgataaatgcaaatgttcatgtaaaaaggatcacatggcaataaatgtttcatggaaaagaagataaatatggatcatgtttcagcttaacattatcaaggacaattgacaagcatgtaatgatgaaccctaaagatctgcaagaaaaagtcacttaccatctcagcaggaaggttaatatcgaaagtcttgtaacttggccagaatcctgttgtcaaaacagtgacagccaagtctatcccaggattcaactcctgatgtgcagccacaaactcttcaaacttagtttgatggtcccttgcaacagtaagatcagtaaccattccctccattttagaagtaaattgtccaccacactgctgcttgagtttggtaagtatgcttctttcatgttcatcattggcactcttatcaaaaagcaatctccttgcaagttttttcctgcaaatagctccacacatgaagcaatatgaatacaaagtccaaaaagtaatgtttcttaaattcaggaggtatataggcttaaaacaagataacacaacattacctgtaaaactcagcaaagaggtctttatcgctgatgtatgcaagcaatcgcaccacctgaatcatatttcattttcagcttagatttccttctacaaaaatttaataatggtagcaaaagagaagggagaacatgcaccttctcaagagcatcttcgatggcttcatcactgagcttttcactgcaacctttcttcagaatattgtcacagaaggtggcaagcagttcagcacttgaactgccagagacacccttgttacagaagacctcgaatgcttctttaagggcctgtagaatgagaagtttaagaatgaggcatcacatttgacttaatgaaccaatggtaacaacaaggaataggaatgtgtcgattggcagaccttatgaaagagggtgtgaccctggaaacattctgtgacataagctacatacttgtcatggagctcaatgattttccagacaaaaacctaaaaagaaaatcacatgttaggtggaaaacatttcatcaccaacgaagtgcaagaagttcaagttgtgtacctgttcctgcataccaaccatgtcctttttctcgggctgtacaaatagttgatattagaatattagctaaataccagtttgttgcaacgaatttgaaataatcaaaagttctgaacttcaaaagatctatatatttctcagggaaacatataattgtaatcaaatataaacccacaaataatctaactacaactctacaagctacatgcaaaaacaatcttaaagatataatgtttctcagggaaacatataattgtaatcaaatataaacccataaataatctaactgcaactctacaagcaacatgcaaaaacaatcttaaagaatcacatagcatcccaccaaccgtcaccagtaggttctttatacagtagagcacaaaaaactaaatcaaataacatgaatttgaatcactaataataaatgcaagggaatcaagcatttgagtgtaaccagaaacagcatataccgtgtcaggaattgtgcacactaggaaaactatagaataaaggacaattttacaggattaaatagaaagagacagtcagcgacctctgtttgatcaactgaaaccagtttaaagggagctaatttaaagcactaatctggcatgcacaaatcacaatcctaataaccatactttgatggaacacaagtaagaaaaatgctaaaataaataccgcaccttcttattactagcagaatcttctgcttgcttgaccaaggctgtgccctcatttgtaacatgctgcagagaagtaataatttaatcagaatgcacaaaaaggttatagggaataagcagaccaattttgaggcaatgaggcaataccgttttaaacatgttagcaataggttctagaccgcggttaattttggagaagagcctgtacatcctagaaaggtcttcctcctggagaagataatgggtattcaatattatttgttttcatgatatacggttaagaaatgaatcatgttgtccaacaaaccttgtcatcacgaagcaatgcaaaacacccagaatgctccttctccaacaggggagttgcatattgtgcaagcaattcattttgcactttctgtgacaatccaggaaggataataa

SEQ ID NO: 69012 - DNA, 4926 bp, Oryza sativa
aatgtacctttatcatgtaatcaggacaagagtcctcgagaatccagctttgagccttgagagagtagtaatctgtagtatccttaagcaagaaatcttcaaagtcattctcataacattccatactgcctagtccaatttcaacaaatatgcccaggacattcttcagcagggccctgtctatctgttcgccttcacgctctttgtcaatctgtcaaagaaaggtattgcaactatttaagtatacgcgcaaaatcattttcccaattcaatgtaggaatgctgactcaccagagctatcactgcacctttaacttgtcctttgatttcttggtatatctgttatgagttggtcagattaggacacagaaagtttgcaacacagagattgaacaagagcaaaagctattttaccaaatctcggaagcaagtaagcccaacttgttcaagtggtataagcgacctccgtgagatgaagtatcgatcaagataaaagaagaaacgtgacagccaccgaaccatgattttatggtttgaccacctctttactagttccctcagcataaactcgtcatgtttatctcttaatgaaggtaagacctgaaatatattaaaattaagtgatataaagctcagagtgtacatacaaatataacaaaggagcatagcatacaaaaagagcatgtaatacatgttagaatatcagatcaatatgcacaagtaggaaaaatagtttttgtttcaagcaaaatgtgtcagtttgcttagcgcaatcctaaaaaattatgtacatgatttctaccatgtttagacaaaaccaggagagcaatgctaggatgcaaagcatgatgttcgtcaaagaaccagtatcagccagacatttaaggatatctcctgacctcaaagtcatggaaacaatcagcacactggcatgaacctaaaaggatgccttttatagttttatgtttctaggctatagtcacttttacagcagccttggccaaaacagtgggggcggaaatgcaacgttcacctagtcactagtcgttagttgatcaatgacccactgactagtcggaggctccaagcctccaaaataaccaccatttaaggatatcggcacaattttttacatgtttcgtggtatatgttgagaccacagggtccacactgcatacactagtgtgggtgtgcctgggactggcagaagggaagaccggtatgcgtgcggcaaatgcatgggcccactgtgagcaggggcatggcagtgtgtaggataaaaaagaagcaacaaaggagccagggggaatttggggaatttaggctaaccgtagacccctttaccccccttttaacccacacttttgggcctaaatatttcagctcataccatattctgtctcctagttggtctgcctgattgattagtcaccaactaaaaccaactgactaggaccgactagtcggtcgaactgactagcccactgtttactccctaatcgagacggtgactaggaccgactagtcggtcgaactgactagcccatgtttaccccctaatcgagacggtgactagtcaggctggtcggccaactaggtgaagtattacaacccgccgcacattggtagagcgatcagctgttgactgactagtcatagattcgtatcctacttgcagagttttgattcacaaggaaaatcatcatcgtttcagttaagttaactaataaaaggaaacaaattatgacctattcaactgagatagacttactacacaatcgaatcaaatagatcacctctatcaacaataatcaggtaaccgaatcagacaaaactaagatccccaagtacactaaccccattctcctcctaaccaaggaggaattataacccatcggtgcccggccaccacaaccaaaatcgcctggatcaaccccaaatcacctactatcgaatccaaccggaaatgacagacatgcacaatcatatcaaacatttacaagaactgcagaaaaaaaaagatcgtctcaccatggaggtgatgtactcctcgaatgactcccggtacttgtcgtagagctgctgcgagtagtcgtgcggcggcttctgcgtgcacatgttgtatatcgtcctgcagacaacaacagacacggagtggggggaaaccctagatcagcaccagatcgaagcgaatcggaggggaaaccctagcgggcgggaggaggaggaggaggaaacccaggaggaggcggcggcggcggcgggggacgtacgtgtagagcatcatgtagtcctcggagctgaactgtggctcgggcttgccctcgaggatgttcttcagcttggtgatgcccttctgcatgaacgcccatccctcctccagatcgatcgtcctccgctcctgccccgccatcgccgcagccgccgccgccgccgccggtgaacggaggccgcgcggaccaaaccctaggggagagacgccgccgcgtgggtttgggttgggttccgcgcgagaaaaatggggaggaagcgggcgagagagatagagagagagagagagagagaggaagagggagcggcagactgatgacaagttgaggcggtgacgcggttgggggtaagtataccgcttatatcggtgtagtaagcgtgtcacactgtcacacaaatccgcaagtgaaattgggctgcgaattgcatgggtgatcgggtcgaggctatcctctggatatactctatttcaaaatataataacttagatttatttattcaaatttgtactattaaaaaataactcatccgattctaaattgacaatgagagtattttacagcgaattattttgtatgaatttctttatctctatccattctataatcagagtcgtcatccttccgttccaccaaattctatgttttctctaagttaccctcatggcacatctctaattatatgggtttggcatgttataacatattaacatgttacctctactctcttaaaatcaccggatccactgctttattctcttaaaaacaccttcctgacacatctctaattatatgggattggcccattacaacgtatcagtatgttattggtgggagtatgagagattttttttttgcgtgcttcggtaataaaaccatatataaatcgtaactttgctatttgttgagcgattaaataaatcccaaatcacagataattgataattttgttggtttgatattcaatatttttcgaattttttcaatcttgagagttgagacaccgtacgtctctaaaagcaactgcttcttcttcggcaaccacacctctcctcggataactattcgagtgcactgacttaaattttgaggagtggctaagcatactgctttaatcgtgtcacatgagagcattgtaccaactgcatttcgcaatgaagtgtttttaaggatagtgggagacaaattcctcgcatgaatcggtaatagaggggtgctttgttgatttggtagttaaaaacatattacatagattacaattttagtatacttgttagctaattaaaaaatctcgaatctcacaaatgatctcaccattagtttgattcccaatagctctgttatatctttaaagggagacattgtctccctatcatcggcaattgcttcccaggcaaccacgtgctcctccgattctttggcaacaacccttttagggtgactatgacgttcctttagcgaacacgacttattgtattagatcaccacgctgactctatttcatgatggtttttcctatgcagcggtgggagagaagtttctcacgtgctttgttagtagagaaattttttacttcggtaatagaatcgtatataaaattctaacttttctacttgttatcaactaaaattttccaaatctcaatcaatttaatctcactgctagtttgatattcgatgaatctttgagtgtcttcagcctatagacatcatctatccgccaacaactgatccttctctagcaaccaaaccactcctccggcaactaccctcttatagtgagcacacccacaactcatcgtggatcaccatgtaaactcccttttgcaatggacttttgtcgacgtttgatatcacaactacggtattttgcatactatagggatcgttggtaccagggtatagcgagattgaagtagaaaagatggagacaatgatttttatacatgttcggccccttatctgtcaggtaatagccctactcctgttggccgaagccggtgttgcttctttattcatctgaatcacacaggtacaataattggaataactcatctgactgtcgtcgacttggcggtatggataaccaactcgtagttgacgacagggtagtcttcctcctcgaatccgcactcggcgagatcagagatagcagctatatctctcttgttgacctccgcagacaccatattaggtttgtctaggcttatctctgatgtcgatatctggcggcgtgtgttggcttgtattgatctatattgatcttgctgtggctttgtgtcattgtggcattgtggcgtgtcccctcttctcttagggggccttgtatttatacccatagatgtccccttgttcaagtagaactagggagaccaatatggatacaatatgttgtttccatatataactctactcgtcattccttatccgcaactctttctatatacgaggtttgtttccgtataagacatagtatgtggtgggctctaccgtgcttaggtatatggtatccataaccctgacaactttcttgtgcggtggtggaagataaatttatcatgtgtttcagtgtagaggatttggtaataaaccatatataaattgcaactttgctacttgttatgcgattaaaaaatatccccaatctaggtaaatga

SEQ ID NO: 69013 - DNA, 7130 bp, Oryza sativa
aagagtcctattcatgtttgttaatcaccttggtgttcgggattgacatcaccctggatgcccgtgactaacaacataggcggtaaagcatgccctggaggaaccgaatggagctagaccaagatcaagggtgaccaatagaggtcaacactatcaaaatgacactggcattgataaattaacaatggaggatgatggattttggtttatattgcccaaatggctttcaggctcactgtccttgtttactactgcaaaaagggtgtggtagtagctaaagagaatgagagagaatgagagaagggagaaattgagggtacggtggtggctgggtagggagggaagaggagacttgggatattgacagctaaaacgagcgccatgttgtcatattataaaaatatattatttgataagcctcttatagcaattttttattttacatgtgaatgtacatgaactagctaataccaactagcattgcttttccattgttatgttgctcttacaatggcaaatttcgcctattaaattctcatacaaacgaacagttcattttattttatttgacagtgatacgatccatttataacctactgattttttggtatgtgtttaaacaatgtatcgcccttattatattaaccgtacctagtttttgatatcttgtaggtaaattagcacgaaaaaattgctgttctcttctaaatttgagacctacttcaacatatttcaatgtctctgaagactggttatgatgtgaaataaatattattcactatgatattttctatcgtagttagatagtacataaacctacacagtgatatcatatacggagtaattaaattgtgcttgattaccagcacactatgccacaatttaccatgtacaaatatttggctagagccattaggggtgggcatcggtccgatcgaaaattttggtctcggtcttcggcctttcggttagtttggtcattgaaaagtgaagaccgaattttaacgtaaaaatgtcaagaccgaaaaattcattattggtctcggtccagaccaaaattcaacaatagtttcatatatgcgatcatagaaattttcaacacaaaaatcacaaaaataatactttcttcgtttcacaatgtaagtcattctagcatttcctacattcatattgttgttaatgaatctagacattaacaacaatatgaatatgggaaatgctaaaataacttacattgtgaaacggagggagtagtacgtatgagtaaagactttttttttcatgtctagaaggaatagagatgtgaaaaattagaatttaaccctattgaactcagtggatcgtaagttgcatttggacatttttttttgttaatttggtcttttcggttgaccaatgagactagccgaattgaccaaactaaattcggcatttcactacttaggaccgaattgctcggtcttgatcttgtcttttcggtccggtctttttctgcccacccataagagctacagttgtagcaaggttcttttggaataaattagatccacaccaattttacattgctccattaacttgacaacaccatcaattttacattgctccgcatgacttaaccatctataagtctaacaccatcattgttataaccgtatacacatgacgatcacttaccctacactggctatgcttcgggagagggttgggaagcctaactccctagcgcgcaaaacaaagcatcgtttagtgcataattaattaagtattagctaaaatattaaaaatagattaatattattttctaaagtaatgtccatatagaaaatttttgtaaaatatgcacgtttaacaatttgaaaagtgtgcgtgcgaaaaatgagaaatgtgagttaggaatgtagagataagagctcaaccacctttaagggaaaaaatgaattttatatttttgcaaatagaaaagaaacatcgaatgaaatctgcagtatttcgaattcgaaagatttcatttcatacgcattttgtcttttttcttcacccccaacaacacgcatccggctggctcgatctcgacacaccaaccaaaaatcgaatcgcgttcgagccatcgagccgacaaggcgacaacagccacaacgcctcactccccccaccccacgcgctccgacgagctccgatccgccgcccacctcgccgcccgccggcgatgagcaccgcctccggcgacggcggggacggcggcggcggcggggatggcgcctcgtcggccgcggggggcggcgggaggcggatcccgcccgcctcgtccatgccgtgggtccgcaacctccgccgcttcgtcggcacgggcgccggcctcggatccgaggccttgatgggtcagtgccgttcgccgccgccccatcccttctcctttcctgtggtgtttggccgggccgggattccgttcctcatcgtggagatggcggtgcggttagggtttacgcgtctcttccatgaaaatgatgatgtgattggggaggagaaattatgggcccccctctagtgggaaggattactattatgtgttcctcaggtttgagattgcataacgcagcgtgtggatgcgtggaatgggctcgctcttgcttgatttgcagtgggtgatttgggtggagcggcatagtttcttgacatttgacgaaggtcacaactcacaagatgttcaggcttctgggagtcctctgcacagaggaaggcttgccggctgtggacgcagtcagtagtggcaatgtagggtgatgggctgggattttgagtcttcgtcgtggagatggcgataaggttagggtttacgcgtctcttccacgaaatggtgatgctattggggagtagaagttagggtgctctagtgggaagggttactggatgagttatagtgcctcaggtttgaaattgcataatgcagccggtggatgttgaaatgaactcactcttgcttgatttccactgggtgatttgggtggagaggcatatgcttttcacctttgaggctttcacaaaagtcacaagatgaaatcttctgggagtccttttcacatactccctccatcccccaccccccccaaaaaaaaacccaatcctggggtgcatcgctaggattgggttttttttggtacatagggagtagtaactagtaaggcactgtaggcttgtcggccacagacgagtaagtagtggtaggagtagtaaggcactgtaggcttatcggccacagacgagtgagtagtggcattgtaggaagacaaacatcagattttagtcatgtgcgttttacttgttgatacgtaagctgaggctattggtaatgtggcttgaggatatctcccagctagttcaggaaaactttgatccatatagtgcatatagttgaggcttagttgtccttttctgttttaatcgcatttgtgaattagggactataagataagatgtctcattggcatgcaatttttgggtgcatttgctacaataacatggttgctttgttgatcaatattcgcatgtttttcatgtgcctgcttgtaaactatttgttttaaacctttgatcgcagaactggaaacaaaaaggatactgcttgagattttcaaggagcgccaacggaagagtatggaagctggtgccattccaagtttttataagaaggtgcacagcttggttcagtttattggataccgagatttcataatcttttacgttattatcaaattcgcagcgtaagcaaaataaagatcttgacaacagtagctgctttgacaaacgatgataaaaaagatattggtttcctaagtatcatagtttagttctgattcaagaatgcattgccttctcgtcaactcatgaaattaatatctcctttatggacagaaacctgaagatggatccattagcaatagagttcagaaattggcaaagtacaggtttctaaaggtaatgtttgatttcttcttattgctattgagatattcgtgtttggttggcagcttacttgcattgccatttaaccttctcatggtttgggccttacaatagttattttaaacaaatggcagaaacaatctgaacttctgcttaatgctgatgatcttgatgccatgtgggtttgtctcagagaaaattgcgttattgatgatgctacaggtgctgaaaaggtaggttgttttatgtacctttatttcagaccagcaatctgccagtttttaatctaaaaagttcagatccttggatgacaatatgcatcatatgtctacaatatgcacgcaaaaaactcatccaaaatgaaaaaaatcttttggtgtgatatgcttaatctcttttaggggatttttttagttcattgctacttgcttgaatttggtgtacatactgccctgtaaatctaacgatgatccttgtatctgtatttgtgtttggtgtagttgttcatgtagcagttttggttcgattaccttgctcatctatttttctggagtcttgcagatgaattatgaagacttttgccatattgcaacagtatgcacagagcagatcggccagaagtgcaagcgtttcttcagcccttcaaattttatgaagtttgagaaggatgattctgggagaattgcaatcctaccattttatctttatgttatgcggacagtaagttattttcaaacaaatattattaggattaccaaatttgttttgtgtaatatttgatgtcttccatttgcatctctgataaactggtaattctagcccacaccatgcttcttttccaatttcccattggatgtactcctagttctttttactaaatgacaaagtaggctagttatatgttatcatcagttgctccattattattgttagttagcttttattagaaaagccattcaaagcaataacaccaaatcgctattacaatacaagaacatgagtcatgtcattcaccaaaataaacttgatgggtgtaacaatgcccaaggaagctaaaatcgtttcctcctattacatcagaatgggtcacatttaagtctgaaacatcacataaactctgaattcccatccagcaaattttttgctgaatccatatttatagctgtaacttatttcaaatcattatcatgcatgctactgtttctttttccttgcgtatacaattgtatgacattcttttaactaatttcttcaggtatctctcacacaagcgagaattgatatgagtgagcttgatgaggattctgatggtttccttcaacctcatgtaaggacatcctaacacacgttaacgccattgcacaccttagtaatgtttgacatgacttaattctattaacaggaaatggaagcatacataagagggcttatccccaatttggcacaactgcgtgatatgccatcagcatttgttcaaatgtactgccgcatagctgcacgcaagttctttttcttctgcgatccacacagacgaggtttagaaccaacctttaagtgcagttgtattaatatgcaaattactttaatcgatacatttattctttgtaagagtagctaactgtttgtaatcgatacatttttttttcagggaaagcatgcataaagaaagtattgctgagcaattgtcttcaggaacttatggaactacatcaggtaatagaagaaacatatttcatggtttgctggtagaaactctgtaaattttatacccttataggcttacaacataatattgctgtatcctatattctgtttctttgtggttacgattcttatcaactatattttcaggagagtgaggaagaggttactgatactgagcaggctgaaaattggttttccctgacgtcagctcagcgcatttgtggtatgccagccaccctcatgtctggttttctgatttttcttttgggtagcagtagcacacaatcagtgctctccaaaaagttaccttttgccattctattgcagtatagttgatgatctacctaatgcgcatggtcccatgcagatatgtttcttgcacttgacaaagatacaaatggaacattgagcaaacaggagctcaaggaatatgcagatggcacattgactgatatcttcattgaaagaggttaaaatccattatctgctctcatgatactttatgtttgtctttctagacgtcctaaccaaaaagaaacatgcaattgcagtatgtgaagtttttttatgcattatacacatagatcatggtgtatttcataaatctttagtcgtgaatagataaacaatattataacttcttttctttttccagtttttgatgagcatgtacgccggagcaaagttggaggtggcaacagtcgtgaaatggactttgaaagctttcttgactttgttttggctctagaaaacaaagatactcctgaaggattgacatacctatttagatgccttgatcttaatggaaggggattcctgacaactgctgatatccatacattatttaggtatgtacggggaatctgtattgtatattttttgggcagtgacggaaacatctgcttcggaaaagtggcttaagcaggagaaagttgattgttgttcattagaatagcttttccatggcatataaaagttgagctagcattgtttttgtcaaaattgggaacagcctctgcaatcacatgctgaataatttactgctattctattcctctgttaacttttatctcggaagaaaagaaaggaggatgtgagagttagcattcctgcctgatacaatcttcctagatttaatctgccattttgtttgcttgctgaactattagacagttttgctggccttagtgggcaggacatcaccatgacattggttcaatcgcacataggtgtcgctgtttcttacatactcacaagtgcaacatcttcatttgcacgtgtacatatttttatatacttcagtattttctcagtttcttatgagaactaattagtaaataattaggaaatcttgatgtgttcaatagactataggaatggttcaaactagatgtcatacatatttgtaatatcctttggacctttgtaaggccttgttcggttaatcccaagagggagggattgga

SEQ ID NO: 69014 - DNA, 11020 bp, Oryza sativa
gtttccagggatgtacaccagaaatggattgaaggcggaaactatgaactttgcatcgaagacgtgagggatgaaatctgggacatggtaaagccggcagatcctctcaggatcgcactaacagatcttctatcttgcaagcaaggcgggactattgccagcatgcttatagatgtgcgcggcttctgggcccacgacaacagagagaacctcctccaggaagaggaagagcaagtggaagaggcctgagttctccagctgccgtgcaaccaacctggtaaactctcaaccgcaaggcactggcaattgctggtatctcgcaaccgcaaggcacgggcaattgcttgtaccactgtatgtgtgccattgtagcttacatagtgtattagaatcaagttcaacctgttcgctgggagacttgttgtaacctgtaagtgttccatttgtgtaaccggagtgaaatctgacatattttgagttgaacatggttttgtcgtgtcgaccagatgtattaccgcagggcttggttggatgcagaaaggaaagcctcagcctgtggaatttgtacgtctatgcgacaccacgcatgtaattcggtttgcaactgcaagtctatatacgcaaaaatacattgtatgccctttgatgcagtggttatttgtgcccttctccgtgccaatcactagtttgctttcatttggacgtgctctactttctgcatttggaagattgcacagatttcattgactgctccctctacgttttctagcagtgtttaaggttgagatgaaattcgtttgatgccttacacaactttaggacccctttgaatcgtaggaatgaaaaaacaaaggaatagaaaaaacataggattctggcaggaatacaattgtaaaacagaggattgcaaaacacagggaaaacacaggaatggccgtttgattgggccacaggaaaaacacatgaatcaaatgagagagatttgagagatagacttagagaaaatgttccaagaggttagaactcttgctaactttcctctaaaatatatataggattactcattccatgggaattttaaaagcttggatatgattcaatcctttgtttcaaaggacttcataggattttttctataggattgaaatcctctaaaattcctacatttttcctacaaatcaaaggggccttacttgtttggaaaagacgatgcaaaattgcaaatgccctatatttatagatggtgggagtaaatattttgaaaaactttcaacaacatatgcttatttttgttgggtccccttatttactggttggttaaatacagtggtgatgccggttcggcccttttggacactactagaggttgtgttcggcagcccctcttccaacccatctctctcgttttccacacacacgttttttaaactgctaaacggtgcgttttttttaaaaaaattctatacgaaagttgcttaaaaaaatcaaattaatctatttttgaaaaattttttagcaaataattaattaatcacccgctaatcgctactccgttttccgtgcgggcacttagtgttgggaacccctggttggaacacaccctctgtctggaaaaaaaactaatttcatataaaaacgtgacacatctaataaaataaatattgacataaccaatttatctgaacatagagttgttgtcgtatcttagtataaagttggtctattaggatggagtacacactaataactcttaatttgacttgattttttttcttaatttgaccttttaatttcaaaaaacaactttgaaacgggccaaaatgtgccgccaaacagcgcaaaccccatccattttgaaacgaaagctgacaagtgaagccagcggagtggagtggacaaatctccgaaccacaaattccaattcaaaaactttttccccgagtagcctcgccgtcgccgtcgccggagatggaggcggcgcgggagtcaatggcggcgctcgtcgacgccggcctctacgactgcgcccagacgctcgtccgtaaccccccatcctcccttccctcccctccccctccccctccctcccgccccagttcccctctccgaatcactagggtttcgcttttgcccccacgaatcagtcgctgcacctgcgcgcgcgtggatcgggctcgcttgggtctcgtctctcgtcttgggacctgtggttggttcatcgcctgtgccgcgcgaggttgggcgggtggttgggtgattgtgcgatcgggctggctgggcgcgagatatttttttttttgtctttgttatctgtttcataatgtatcgagattgatttcgggtggagataatgctagtttgttacttgcaggggtgctttcttgtgtcttcatcacctgcgagcagcgaggctggtatgtccatgaaggtggaaagcttggtaagctccattgagtagctcgggaaatggtgctaatttggtcttaaccattgatagtccttgttctgtccagagttggatcgttgaagcatttacgctacttaatctatgggaagtctgtttatgttgttgctttgttgctaggagcttaactgaggattcttcatctagaagaactttacattgtcgatttctgttgtctagaaggtccaatattgatcttcttggagcttaaggtgtcagtgtattgcaggtactgcatggtgatgctttgcatggagagaaagaatttcgcagggcactggtaatattgccgataaatctatgttgatagaaaaacgataatgcattttgggatttcattgtattcggaaatgtaacacatgattcagaccccagttctgaaatcttagtctcttatttcctgtttcaccatggtagagtgcctacaaacaagctatgcaatacagcaaaaacattcctaggcaagcaacaagtaatactagaagctcagtaactgccactggccggtctccttctccaaattcttcaagtcttgcaccactcaatgaaaatgaggtgaaaacagctcggcaggccattagatattccgttcgttgttatttatttgtcatatctagcaagcaactcattctttttctactgttgcaggtgaaatttaaaattgcactttgctattctgctctacgtgagcatcgtgaagcacttcaagaggtttccatttttcattcacctttgtttagttctctattatattcctgaatgttactccatcctgggaagtggaaaggcaggatcatctgaatatatgtaggatgactcggactcacttgtggtagcttcttctgtatgatggaagacatatgatgcaaaacatggcctctatgttgcctgcagatggaagggattccttctaaagcgaggactctaaaaatgaatctgatgttagggaagctatatcggatatccagaaataatcgtgcagctgctgtatgttataaagagtgcctgaggtatgcaatgccaaattattttgcttcctagctcctcaattctgcaacagtgcaaacgatcacataactaccattttcttttgcatatcacgtttccccctaaacattgatacagaaaccaacattttttttcaccattaaaaatattgcccctcacttggccatttcatgaagatttagtttgacaaatttctttctacatctatatgctcttatgacaggcaatgcccttatgtttttgaggctattacagctttggctgaaatggggctttcttcaaaggagttctctttgatattctcacaagtaagtgttttgctccataggcagcttgtattttcaaactgaatatagtgcagttttagtgaggtcagataaatactagttatgctagatcctaagactcttgagtgcttgattgcctgccattttttctggttgcctattatgcttgccatgtatataggctgtctaatcccattgatgccatgccttggccagtattgctacacaactacataggtcattgtttgttttgctttacatcaaaggaccatttctcagcatcatataaacaatgatattttattgatggaagatgcatactgcaacagagaaaaagaagtaaattacatgctgttaatagttctatataatatatccctttattttattgatgatctctttatttcatatacaatatttaccttcgcacaattcaatgttattacagaaccatcatcccaccaattttttatcctttctatatttcctttggcgccgtgagcactgcaaaaaggaaataatgagcgcacatcagtttatcatgcaattgaagatgtggtattctctgtaggcaccaaatcgaggaggcaaggctccaggtgactctttagatgcacagcgttggtggaacgtaagtgaactacttgcacccttgtgtagatagaacatgcgaaccccaaaaatatttgacatttcttatgtttgatacaagtaaacttctatgctggattttcttagtatattttatttacattgattattgaacctcaaaaccacttttactttcgaaacttattaaattggaagagtgggaatgaagtcctttccttttcagctctatgttaccattgtatgaactgagcccacttgtggaacagttctatcatgcacagcttttaactcatggagttcttttccctgaccacaaataatttgtcaccactgcgtcaacaaatgcacacctgcacttctattgttttcttgtagtggggatactgtgatcaatactagaacattaggaagcaccatgatattgtacctactgatcacatgcagttgtatttttttttatgttgtggatttatcagaagaacccattttgttccgctcacagctacagtgctgctttagatttgggctcaattatgtataagagtttccttgcaaactctacttaactcatgcagcatacagttgatcatacttattgttcttgttattggttgactcaaacaattattgacttaaatcattgttttcttaacagcgctatgttgaggcccaatgttgcattgcttcacatgattataaaggtgataaaatagcattaatccaaattcatttgacagttctaaacgtaagatgcacttattttatttttgtcattgtcaaaaaatcgtgttgcatgattacagaggatttccactactaaacaaatgatatgtagtgttaatgtgttatatcaccctgtattgtcatctatgtcttaattttctgttggcccttgttcctttggtgttggtccttgtgccactgggtaagcttgatagtcaacatttcttaacttcgatttgtttgcttgtatcctctcatctgttaagcataaacttgaagaagtaatactgatatgccaaattcatttatagtggtcgcaaaatataatcatgttatttttttgtttaggtggccttgacatatatctagacttaatgcagcgattcccgaacaatgtgcacatcttgctggaaattgctaaggtttgtttttcttcaagcattctgtttatgttttatgtgctctctgtaacatgtggattcttgatgcattgagcaccatggctatgtcatacttcttattgtttatgtacttcatgtttggttctgctgtgctcctctgtcctgtctataaaatttccttttgttatgtgttgaaattttggagttcctcttaaaattttcatttggtggatttaattcccctccattatgaattgatcctgaatttggagcttattatttgaaggttgaagccatcataggtaggaatgatgaagctatcatgaactttgaaaaggtaaaattaacaagtatagacttggaaccccttaaaacgtaagtatgtggtaaaattatttgcttccttgcaggctcggttaattgatccaaacatcatgacatatatggatgagtatgcaattctccttaagtcaaaatctgactacacaaagcttaacaagttggtacatgatatgctgcatattgaccctgcaagaccagaaacatgtcttgctcttgcagcattgtgggaaagaaaagatgaaagaaaagctttgacatatgctgaaaaggtttgtatcgttacataatcttttattgaaagctaatcttgatcctaatgttccttgattttccttcaacagagtctccgagttgatgatagacatataactggatatatcatgaaggtaataatgcaaaagattgtccgaacgactggattttgcactgttgtagacatgcagtggcattttcttgctttgcaaagtattatagagaaatctctgcaatgaattgcgtgggattaaaaccaaaatgttattttatcaaagttaaaaccaaaatgttgtgatggtttttcttggtatttactctgggaagttgtatacttgtaactttgctacctttgtttttgtttatccacacgtcaggcttattgtttgcttattgcttttcaagggaaatcttcatcttttgttgaatcgacctgatttggcagtcacagacttcaggggagctcaagaacttagggccgatcttcgctcttatcaaggtattttggtgatgctcctgattttgaagatcaaatcataccatcagtctaatacatatactatatcaggattggtacgtgcttatctagcgctctctaaatgcaaagatgcattattcactgcacgtgaagcaatgaaggttatgcatcagtctgcaaaagctctcaaattagttggtgatgtgcatgctatcagttccagtgggagagagaaggtaatatttattttccttggtcatttatacctcaattatattttggtaatggtcagttagtcacttggtcacaattatagtttgcatacttcccctcaataatagtaccctttgacaaattcattgcacaatttccaggctaggaagttctatgaatccgccattcgtcttgaacctggatttctgggagctgcattggctttggctgatctgcatgtcgctgaaggacgaaataaggatgcagtattgctgcttgaaagatatctaagacagtggacagatgattctctacacatcaagttggctcaagtttttgcagcaacgaatatgctttctgatgcactttcccactaccaatctgctctaaggtgcgacttttctcttggagttgaactgtcaaatagcatcattgttgcaatagcgtgtttcctcttttgttattgacctgaaacccaaagagtacttgagacactcaacacacaagtagtcaatatataatgcattgatatactggatataactaaagtatgtgggtaagattgtaatgctggttcctggactatgtagcagttaagttttgtgctgaatccgataactgggttggacggggtgaactgaattatctgtatgatacaaatttttttggagacactactgtttcagctggtggaattcgtttttttataacctttggctactacttatccatgtgccaacataactatttcatgttctagttgaaaaagtttccacccgtgatgcaggataaacccacataatgaggccgcaaagaaaggattggaacgcttagagaagcaaatgaaggttcgtgttccatatgtaaccatctatcatggagcctacccagctctcacatccagaacaagaaaaaaaatgactctgattttccatatgcagggagtagacccggacgcgcctgaagaggacgaagagaacgaagctgacgatgtcgacggtgatcaagacgacgctgaactactgtagaaaaaacctgatcaactcacatcaacccaaggcaccacctcttaccaagcgtcaactgcgaaagaggaccaaatctgcagccgctgccacagcaggagagcccctcaattgccatatatcaactagcaacttggaaggcacggcaactggaagacgagtgacgacgacgggtgcctctcccttaccgcgagtaagttttcttgctaacgcgaaacctcgtcgtagagttgcaatgctcaccgtaggtttatttttctaatgctggggaaatgtgaactgaacttgttggtttcaagtcaaactttattactacctctgtcctaacatatagcaacttagtacccaacagtccaaattcctggtatctaggatgtctcatttgatattagggtgctatattttgagacggggtagtagttaatttgctctccatgtattatggttttttacattattgtgttatatatcatggcgacaaaaaaggggctgcaagtcgtacaacctgtgcagtgatcagatacgtacggtatgtataagacggcgattctaccacgcacagtggtacatacgtatacgtacactagccagcagctggagctggctggcttctctactacactggcatgcagcttggtgtggcaggctacacccagagcgcgccggcgtcgcggaggagcgggacaaggccgccggcgacgtggagcgacatgacccggtcggtggagccgacgagcctgccgccgatgaacactgtcggcaccacgacgccgcggccgcggccaccgccgttggcggcggtgccggcgagcaacatcccggcgagcgcgttctccatgtcggcgccggcgggctcctcgtcgagctccaccacgcgggcgtcgacgccgagctcccggagcaggcgcgtcacggcgtgggacatgccgcacgagctcttgctgaacaccaccaccgccttctgcgacgccagccttgtcaccctgtccatctctatatatgcaaatgtctatgtgcctagtgtcttcttccccgtctccggcgactacgacctggccgcggaatgcgccgggatctttggctggatggatgtcaccggcggtgatcgcccgatcgatcgaggttgtgtcacttgttagtgatgctgatctgctggttgtgcttgcatttgagaggttagggaaggcatgcttatatagtgttcttatgcatgttggcgaaatggtatatcgcgcgtgcaaatgctgggtgaagatggagttaaagaatcttcagaggaataattaaaggcgatcgatcgatttatgcatttctgcgggttttttttttcttctctctctctcttttggttttgggataatgcttggcaccatttctgggttgtgaaaaagatgagctgatagataggttggtaaggaatatggaacattttggcggcgacggaaacgatttgcggcgtttttttttgcacaaaaggtggctgcattttgaaaaggcctgatacacctgataatttttgttatgaacgatgatcgtgctgtgcaaggttactttttcgattatgatttctttcttttatccggtaaggatgatcagcaatccactagactgtcgatacgtaacaatgtaactcggtactatgtatgatgtttgggagtgaattaacacacgatcagagataaccaatgtgaatactggctgtcagattaacttaatccatggtctacacatgccgacatgcgtatacgtaaagagacctgcaagttatgatgatcttaggagtcaaagaagatcagcaattaaattagtttatcctatgttctgataaacttgtttcatttgagacaatacagagcagccaaactgacaaaatcttgctttgctacgtacaacaaaagctacttctgcaggtatatcactgaagctacaacaaaggctaaagagcatccttggacatttgtgaggctattaaactctggatccgggatagggactgatccaatcagacatctgatgcaaagggacaaagaaatactaggaaactaatacattttgtacttcatgtcagctatacttgacaattcagtaatttcagtcagtactgtggtacctggattatcaaattgtcacagaacttactcttatcttttactttcacattcagaccacatcattccttagagttatcgtcagctcaagaacaatgttctcaagtctgaaccacagctagtgataattacagacaatttcagtttctgccgtattaacccagaatcaacctctcgaagggtcagatcagcaatcaggggagccagattccacacagaatccctcaagaacaacaatggccattaaccacttgatcagtgctgctctatccaataacttaaagcgaatctccaaaagcagcagaggcttctcttctccccactagttttctcaccagatatggacagcaagcgatgccgcgatccgagatcgcttttgccatcggtaaatctttcaaaacagaccaggatgatggaatttcatatggataaggagcatctggtctgatatagggtagggattccaggtagagtgtggtctcaggagatcccatgccacactgtatgtggcagattgtgggaaacatggaaccttgggcagttgcagcaatgatatttataatgaaaggaatggaatggattctgcaagtggaagatcaaccatgcatattgtatttgacagattagggaatttcttctgtgaggataatctttatcttccaaactgtgacaaaaagcattcagtgttgtacaacagtacggtataaagaaccttgatgtggacaacataattcttagagaagtttactggaattgaagcatggaacctgcgaattatagagcaatggcgatggcaaaacgagtattgttcagggaaaaaaaatcagagatcattgggtaaatgatgagttaatcaattgttttaaatttttgtaggagacaagttatgatttcatacaacatcacacaatgaaacatagcttctgtggtctatgaaaagttaaaagactaaatcatttgttatagtaagaacataccctatgtggcttgaggagatgagggcatcaagaagatgtgaaacttatgacaattgtaaaaaaaaaaagaacaaatcaaatagatcaactttaaaccatgccgagcatggaattgttctccctattcttt

SEQ ID NO: 69015 - DNA, 9118 bp, Oryza sativa
  unsure (1)..(9118): unsure at all n locations
tgctctctccgtttatttttccaaagaatattaggaaatgcaatcatatttacatggaatcactggccaactaatcattttatttcctcctttttggggcaatgagctttgctaattgttataatgccatgttcctctacttgtcttgtgtttggtcaaatggctagtcaagttcaagcatacaatatttagtaggtggttagagaacaattaaagttaagaatcctttcaaaggaaagcaagaaacaaaggacaaagagagtgtaccctctcatggagaagtgttccattctttggtataaaaatttgagatctccagtgtaccaccatggcattatattgtgatcttcctctgttgtttgttactggtgttgctcttgtggaagaacattggtaactgatgtggacaaatcttctccttgttgctttctcttctaaaggaatcttaccaactttctcaacgttgggttgtgcagttaaagctagctggactcaaagtagagcccattgaaatttaatttttctctgaaaaaaagagaggcatttattatgctggtatgtttgctaaacatgaaaactactcccaccgtttcaaaatgtagaaacttctagcatttaaatcttgttccagaatataagaatttctagtaatattcgtagtattacttatcaaatcaattacctcccactcaaagttgctcttattttacccacaattattctcaccttcacacatccttatttattgagtactaaagtattttcttttcaaccttaatctgtactaaacaatttaatctctactccctccgtctcaaaatgtaaaactttctagcgttgagatatttatatagatgttaatgaatctagactcacatgatttataccattgtctacattcatatagatattaatggatcgcattgtctacattcatatagatattaatgaatctagacacacatgatttctagcattgcccatatcatatatatagatgttaatgaatctagacacacatgtctagatttattaacatctatatgaatgtgggtaatgctaaaaagtcttacatcgtanaacggagggagtactaaacaacctataagtactaatattttggaacggagtaccccctttacagaaattaaatagaaaaccacatataattggctttaaccatatttagaccctagctataatacgatgtatttttttatataaaagaatattatacaaaaaattctcgcattccaaacagggacggagggccgctatctcgaactgtggtatatcaataattcagctttcttccccagcttagttccatgaagatcttatgggctttgattttgatgaaacaagtgaagtcggagttaggtcctacctgttgattctgcattagcgttcctctcacattggttaatttgcatctccaatcaatccattcttttaaggtttatttatagtgtccgttctaatcacgtagattgagcccgtacaaatgttgtttatttttctcttctcaaagtaatccatgcatatctttaaaaggtttgtattggtttctctgtccaaattaaaaatggtgattttgattagctgctcgaagtccattagtggttgcaaaagttcctttccaagccaccacttttatgctaatataattaaaatctaagttgatgattttttttattgcacggtagacgtgcaagcatacccctcattttactaaattcattttgaaaacttatttatgtatggataatattcatgagtatctagatttgaaacccggtgagtggagtcatacatcatgactccaccaccaccatatcaatagtgcttcacaaattatgatgatttattattctttcatgttctccaactttactgaaatattgcaacatgaaaagaattttgcagtttgactgaaatattgagccccaaaatatagttcaaattgagatcatttaggcttgtgctcaaggttaggtcaaatacccctctttgagttgccctcaagttgagacatggcacacatatttacatcaaaattcttgtgtcctctgattgcaatgacattctattttagaggaatataatgtaatattatttcttggggctgctctcagtagagcagacggcagcagttgacattcttgttgtatctatcaaaatatattctagaaaatagaatataccattttttcccttcaatttaaggcagttattcttacaagttgccaataattgaaacagcataaattgcatatccattcaatggtaaaatctcttaggccctgtttgattcagcttaggattattataatctggattattagaagtaaactgaaacaaacaaatagattattatgatagattattataatctataagccagattactataatctaataatcttctctagaggagcttttttcagattattgggtggctaaagacccactacccttagatatctccaataatccagagaaacaaatagctcgcagcttattctatttcaacttattataatacagcttagagtaatctgatttaataatctagtttataataattttaagctgaaacaaacaaaaccttagttttttttttctcatttggagtttatacatttcctttccttggcaaaacaaggtttctgaaacataaagcaaagtgatcaattaagcatggtttcttaattatatcgaaatttgatggtgcaatgaaggttgacactcttagttccacttactatgaccactcaattattttcagctacattatcactacaatatatacatcaggacatccaaataaatttttttttgtccaatacaaaaaggctcccagcttataaatataagtccctggatggatggctacaatgtgagaatatttgtagcaaatgctgcttaattaacacaattaagcactccattaattaactcagtaattaattaactaattaatcaactaatcgatccccctctcacatgacgctgcatgcgttggcgttctcctcgctgaacatgtagtacgacgacgccggcggcggcgccgccgccgccgtcgagtagaggtagccgccaccgccgccgccgccgaaaccgccggccatcgggtagtagtaggcgctgctccggagcggtgcgccgtgctgtagctcatgacgtacggcggcatgtgcccgccgccgccgccgccgtagtaggacgccgggtagctcatcggcgtcgccggcgggtagaagacgccgccgtcgacgacggcgagaggacccgcgttgccgggggacggtttcgtcggcgcgtcctgcgggcttgcctccactactgcaccggcgccgtctccggtggcattggcggcggcggcggcggcattgccgttgccgttgccattgccgccaccgccaccgccaccgcctttctttcctttcttttcgccaccgccgccgcctcctcctccaccgccattgccattgccgggaggtgcaacgggctgcttaccgtgcggcgtcatggcgaacggcggcgccaccgcaccggcgccgccgccttgcccgtctccggccaccatcgtcttcggggatccaccaccaccgccctgcttgttgccctcgtcatcggacgcctcatcacacgagcccccatggtcgtcattctccggagggacagagccacctccaccgccgccgccggcggccacctccgccgtcgcagcaggcggcgccggctcgccgggctggccgttcgcaggattcttgttcttgttcttattctttttcttcttcttgccgccgccgccaccgccgggagagttggccgccgctgctgccgccggcggcggcggagcgggctccggccatggctcggcgtgcttacccgtcttgacgagcttcttgacgagcgtgtcgacggagacattgccgatgaccaccaccttctgatgctgcacgtctatgtccgtcttgtacacccctgaaaatgttgacgatcaaatgtacaagtgcaaccaaatcagtacatatttgtttcaaatcagtataaatttcactggtttttttaatataaatttgctcaaaaagcattgtgctaacatttcgattcagataatgtaagcattgtatgaccattatgttgcagctaaatttgagacagggagcagagttttgtggtgagtttcagagtatggttgtaataggaaacaggggatgaacataaaagaaattaattttctgaagataaacagtgcaggtctgcaggattgcaaataaaatgatatccttgatgagattcttcttccgtacatgtatcattagcttgatagtaaccgaactgtttgaaatttaataggagtactgtccatgggtaaaagtaaacatgcaaaaataattgtaagaactgaaacacttctctataataggaacatcaggagctatatatgcttatcaaggagcataaatgaaagttttgaaggtgtaattttctcacttcagttctgtgatttcctcacttcaaaaaaaaaagagagagagaggaatctttcatgattttttttttgttgctacaactctaaaatagagaacatttttttgacgatcaacaaaaaaaatgcagttgtatgaagtcattctcttatgtccttcaaaatgttctgataagatgtggtaataactaaaagatttcttcaaagttgtgttttgtttttactccatctataccttctatgctatgtagcaccttcttgaccttcttcttgcagccctcacagtggatgctaaccttcaaagccaaagtctggaggagaaaaaaaggaggaaaaagagcacaaaccaaagacaaaaagaacaccatcagcatcttcctacaagcagaagaatgaccagtagctctgcatatctgccaacaagattgcaagaaccctaaactgcttacctgatacttgagtggctctggaccttcttcagcagctgccatggctggagacagagagagaaagagaagtctgagagagatgatgacagaagtgaggagaagagagaatataatgttgtgctagtgtctagtattggtgcaagtatttgagggagtgaaaggggtcaccaagaagagagagagagagagagagagagagagagagagagagagagagagagagaggggggggcagaacaaagtggcaatgtttggccctgaggagggacatgactaaatagcatcagagagcaaaagggaacaattctattggttttcttttgtattcttttctttttctctttttgttttttgggaggagggaatggtattgatgaggtatttattccccacatctccagatgcccaagaaaatgcattcacaacaataactagccttttatcttctcactctcctggttttgtttgaatgttcaaggtactcgcattttcttttttgcgaccctgtttggaacgcatgaattttcgcaggaaacagttctcaattcatgtgtttcaaatagatctgaaggacacatcttactccaaccggtcgtaaatatttgatgcttagcaaaagattcaatcaaccttttaaaattctgaccatcaatagtttctcaaatatgcttagtttgaaaacaaaagaaatgatttatgtagatttacctcgaaaagtactatttaaatatcataaatttattctaatataaaattaatggtcggaattctaaaatatatatgatcagagggaaactatgagtacacagctacatgcagcgaccattttatctattgtctaaaaatgtattccctccggattgataatacttgtcgttatagataaggacacaatctccaaaaagtaactttaacaactattgtctattataatttatatagaaatattaacaaatatatgattttgttgaagtactttttaagactaatctatacatatggttttcatatttctaagataaatattttaaatatttatagttaaaaattctaaagtttgcttcacccttgtccaaaacgactaatattatcagtccgaagggagtaatcaaacggaatttctacatgcttttcatcgagaaaaagcacagaagatgtatatgcatgggggttgcacttgcaacccagcagcatcacatgcaaagtccataatttgccacacctacatgagaaaaaaggggatgtactatgaactgctatcgcctcgggaattgagggcaatgataagacagacagcagaggaaggccctcccctgtcttctatgctagtactccactccagtatgcaaacctggaagagaatcatattcatcaccttcacatcctcctgctatctatacggatatgcaattatgcacaaaccatgtcagtgaatgattctctcaagatagctgatgtaaacaagcgcgcaaacacacacatttctttgcattgtgaagattcttttttcttacctgctgaagcatggctcgttccagtggattggatgcatcctagagctcttcagattgtgcctgaatgttgatgacaaactgaatttttctctctgtcaagaagatccatacaatgagttttatgaccataatactcaatcttcagaatgcagctgagaggtgatgaactgttcaaagctcacttttgcagttctgaagaatcagaagttcagaacccaatcgtcaagagtgtgcctgaatgttcaaggcacactgagcttttctctgtttttttttcaggaagatccatacaaaccatacacattgtgaccatgacactcaatcttcaggttgcagctgagatctgatgctgctctgcaaattccaactagatgtgatgcaaaaccatctaccttgcaattctgaagaatcagaaagttcagagtccccaatgctcaatgacaccatcatccccgccgggatttcagcaatgccatgaagcaccggagtttcctatccaagaacggcggtgtctaccttgtctgctcctccggccggaccggagctgccgccgccgccgccgccggctgatcgccaccagcgggagcggcggcggctttgcctctccctgcacctccgaaacgccggagttgggatcgatacgaagcacatagcggaggcgccgcagagaacggcaggccacctcgccgcagctgagcggcggccgcccttctccggcggcggcggcgccgtctacggcggagacgacgtggcacgtcgtccaccgtccgatcaggcgcctacggcccagatgaatccgcgagatccctcgagggcaccctgagccactgacagcgtgggcccacatgtcagcgacagaatcgcggggtttcttcctccttttccctcgcgcgattcgaaaccaaaaacgaaaccctcgccgccggggccatcccaatcctcgcggcgagcggcggcggcggcggcggcggcggagggcaaccgattgtggccggtctatcctcgtcggctcgccattccttctcgccgcgccaggttcgatctgaccaattccccaagaatcgttcgacctgaatcgatcgacgccgcgtgttcctgccatttcggcgtgcttgattccctcaaaatggttttggtctagggatcgtgcttagctattggtggcggtgctcctctagcggcgggttctcgacggcagaatagtgcgttgtgagggagcctcggtttagttggttctggggatggaggacggcgccgcggggggcgatgtgtccgccgaccgtgtcatcgctgagttgctcgacatggggttcgagttcgacgagatcagccgagcgatcggtgcagtcggcacgcgctgcgccgatgtgctggagtttatgctgggtggttcaggcaatgggaaaatgaaaaaggcgagtagggaaacacgaagccgtagttgtgtctcatctaatgcagaagcacgcccgagtgatgatgggaacaaattggttaatcctaggaaaagattaaagcaatcgagcattaccgatcatcttgcatcgaataccggctgcagaaggggatcttgtggtgagaaagctagcacgtcatatccctgtttagcggcttccgatgatcctagagcgccagtggcagtcagtgctgatgtgtgttctgcattgaagcctgaatctcaatttttgcttgctaattcaagaagtgagtctgacctcggacacaaaattagtgctgttctgcggaaacactttggattttcctgtgtgaaaggattccaaaaggaagctttggatgcttggtttgctcacaaggattctcttgttctagcagcaacaggctcaggtattctttaaataaatgctttgctctttatctttttgagtaatttgggggcttcctccattgttatgcaactagcagttttgatgtgatggttgagtggctgtgttgccaggaaaatccctttgttttcagatcccggctcttctgactgcaaaggttgtggtagtgatttcaccattgattagtctaatgcacgatcaatgtctaaaacttgcaaagcatgggatatctgcatgctttcttggttcagggcaacctgatagccgtgttgagggcaaagcaatgtctggcatgtataagattatttatgtttgccctgagacagtattaaggtaatcactctgcttttggactgatgatttcctaattacgtattgctgcacttattttgggaacttatttacatgtaggcttatggaaccattgaagaaacttgcagaaaagccagggattgcactttttgctatcgatgaggttcactgtgtttctaaatggggtcatgattttcgaccggactataggtctgctcttgtgttcgatatcctctactgaaggtgcatgtcattgtttacattgttttttctaccacaattagtaaatttatatgtgcaagccttcactgagatgtttttctcttggtactaaaaaactaacatgtgtctgccatactttttaggagaatgccttatattttcttgcagcatcttaaatctctactttattttccacatacaggagattatctgtgcttcgagaaaatttcagtgcaagcaaattgaagttcttggagcatgatattcctttgatggcat

SEQ ID NO: 69016 - DNA, 1713 bp, Oryza sativa
tttttccggcctaatctcagattcagagtaagtcaaacttgaaacttctgaatttgttctgctggtttccatttttatgttctttctagaggatgtgtaaaagcaagtagagaacattacattataatatgctacattaaattgtaaaaagtttaaattatttggcctttctaacagtttagctacatgtaattatgttgaatgaccaatattttattacattttgtaaatagatgcctccttgcaagtagatgggcacctggggtgtgcatttcacttaaaagatgtactacatcaaagatatgaatggttagctttgctagaattgaatctgtattttggactagtatatcatgtgaatttgaaataatcttgtccggggctacacaaacaagtttccaaactgctctattttgttattgcctgatgaattgccttactaaaaattcatagttagatataatttgagaagttttatagaactacctactgtttatcttatgccactgtattaaactgggcttcttagttcttaccctctcccctccccctccctcatgtttctggttgcaggtaaagcacagtaggacctcagtctcagcttacaaaaaggacttcagagaacttgtagtaacatataatgattcaaggaattttagggggaagggacagaaagctcttagtgagatcaaccctgattctgaaagcagttcatatgagtctccggatgatgctatgtcagatgatgaagatgcaaatgttgattccatgagccatgaagataatagttttggaaaaactaaagtcggcatgcccttgataaatgaaaatgctgaaaatgagttggatgtatatccaggagtagatgattttgatggtaatggactattttatatgacttttttcttttgagtggaaattatctgcttgatcctgaaaagaaatactggttacattattttcgaacataaatgtttcacggccaatgcttatgtaaaaaattatcattcttttggggatttaagatcctttgatggaaatcatatgtaagcttaatatggctattggaaattttggaggatatgtggtagcagtgcttttaatttcgtcattttgtaatttcatgtatgtatctgattgacatgcttctcttgtagttacatgcggagagttccttgagtgctcgtggcctgagaactctgcatcttcttctcaatgcaacaaaactggttccagttcctcagaaattgctgatcaaggtcctaccattatttacgtacccaccaggaaacaaactgtggagttagcaaactatttgtgcaaaactggtctcaaagctgcagcatataatgcgaaggtaaatcttctttgattgatttgtgtggcaaatgatacttgatcagtagggcccatttcctgatatatgctaattctctagaagcaatcagcttttttgtaacttacagtacatttgattatatttatttcttaattgctattcacagtcctgtaacttgttttgagctatttgactcttttttcagatgcctaaatcacatttgagacaggtgcatcaacagtttcattgcaatgccttggaggtaataattacttgtttcacttcctagcttatatcttgccactgctaggtgcaatttccatgtgctcatatgatggtatacaaatttagtttgagaaaacagtatgcatgaa

SEQ ID NO: 69017 - DNA, 964 bp, Oryza sativa
acagaaatttgttcacccaaaagcacataaagtcataaactcaacattattgtgcagaaatattcataaaaatgaagctctaataaaaaaaatctttcaatttaaattgttccatcaaatttgaacatatggattttggtgcagaaacctacctttctttgttgtagcgctgcatcctttctgggagtcaagatgggaacatagtttaagataagaagcaatgcatgtataacaagaagatgcgtgttttgttaaattatacacctgctaatcagattggcctctggctctatagcatcagcaataacagcagcctgaaatgtggacatcagagatgttgacacaatacatcaaacaatgcattgaagatgcatagctgaggggtatctgtgtatggacataccatgtgcatggacttagcatctccttcctcactcctttcttctgcaaggttaaactggaagatgcatgtttgagtgtttctaacaaattaaagcagaaattaaatccaaaatcgtgatttcatctcactttttcgtacatgccctcggtttccacttggagtgagttaatctgcaaaggaggcatcaaagaatcacactagtgttgcatataagaaaggttaatcttaaagtggagaaagatagctgttttggacttttggcagatggatccaaaagtccatacaaacagtcataccacatttcgctggaacaagaatcaaggactaaacatagatgagagcaaactcatattttaggacaaactcaagtagtatataggatattctgcatttcctatcattaattttcttatcctcctgtgttttcgaagaaaaaaattcttagaaaatgctgtttatgacaggaatcacctcatcatgaagagaagaagatgtgcgccgcgctcttagagagcttccaagatcaactgatctcctaaggatgatttagcctatattact

SEQ ID NO: 69018 - DNA, 4465 bp, Oryza sativa
aagttgatcccaggaaatgtggaaaaataagcatttctagctccaaaagtcgctatattttgggacggaggtagtagtagcttatttgccggattgctgtcatggattattgctccacggctctaaaaatacggcttctcaacaaaaaaaaaacatctaccgcgttgcttagaccaattgttctaagctatctgttaagtttatttctcaaagtatttaacttatccctatcatcaagtagataatctaaggcaataatctgtttcaaatgccacatcaacctaggttagtgcatgcatgaattttgtaacaagctttttgtgtttttagattagctatttgacttatttctattcgcgacttgttctgtttaattttctccaaagcaacacattggtgcacttggatccaccatttgtgaagaaatgcataaatttacatagatgataggtagcgcttagggtaaatcccaaatgcaatacatataaagcaacactcgtggatgtgttatccattccgaagctcatgataatatggtgcctacatcagaaaattagcaacagaacaaattcataaaatttccatccaacaacaaaatgatggcacaaagcccattgctttgatctgcagctcaatttctctgccgagtaaactaacacatctcactgatatgtggtatataagctacagcctcaaactaaactagccagtattagcatgcatgccattattattaatcagtggcggagctgttgggggtgccggagggtgccaacacacccctatctgaacccctcctccctgttgttgtatgattgtacttacaaggtcaggcagttagcaagtctaaaaaaacattagcccattagcaagaaacaatatctacaaaattagttagtgatttcccttttttttcaaagtaaaatagaagatgcctatttacattgaaaggatttagcattaagaactagttccaaacttccaattatattattaaagagctaaaattcaagttttttttgtaaagaactagtttacacatttattgttattgacagtgactatttggcctcctttgctatcgatattggttattcggccttatggcttatccctaccccacaccccccaaccccaaatcctggcttcgccacttataaatcacatgggacatgataaataacatcctctcgaatgcatagccatgctgaattgagcaaggagaagctatatgtatatgggaacaatttcaacaatgcagtatgaaatctgccacgtgcaagacctgaaacatgtgagcatacctttgctcccgtcgatttattgcgggcgactctgaccctggaccgctcgtcgctggccggttctgttgcttgatcgaaggtatcatcggaactgacttcccgggcgtgtatcggttcgtcaacgacggtggtcggctcaccggagcctgatccgaaaggtaacgacctatctaaaatgcacagaatacacgccaccacttagcgcgccgagcaccatgcccactattggttggtgaacacaagtaacaaataatcacatcaaacacatcacccgcataaacaatgcgaaatgcgtgatgtaaaatcataaatcagccggcatattccattaattaggagatcgtgaatgagtattagattattaggaagacgggattgacgattgaatgccgctgccgagtgatggaagtgaaaatggggatggattgaggttaccgatggggaaggggagcgggtgccggtgcgccgcggggtggaggagagctcgatgggtggccccgagagctcgtactcgtcgtcgtcgctgccgctgcccccatccccaccaccacccacgccgccgcctcctcctcctacccccgcgccgtcggtggacgccatgacccgcgcgagccgttgcgccgcggccctcgccgcggtattatgcgcgcggccacgtcgccccacggtggacgccgcccccgcgccacccagcgaccccgtccgcgcgtggcggtgcacgggcgacgccgtcggagatccacccggcggcgacgtctgcgccgatccaccgccaccgcccccgtagtagtggtgcccgtacccgccgccgctgccccggcgagcgtacccgcccgcggggctcgccggccgcgacaagcgatccatgggaacacggcgtcgcgggtgatcgatcgatcgatccccctcctcgattcgtcgcgagagggagagagagagagaggtggaggtggaagcggaggaatgggaggtggtggtggtttgtgtttgcgtccgaaggcggaggcggaggcgggggggacgtaacggtctcgagtttcgagggggggagtgatctcgagtggcgtgggggtggatcttgtgtggcgcgggtcgcctgtggctacaccggttagacgtgtacttctatacacttgggttctttttcttacatatagtggtaagcagtggcggatctagagggtggtccggttgaattatggaccataaaataaaaataatctaacacaggactagtacatgttaataaaaggaaaaaaaaatttaaagtgagaaaaataagagatataaaatctttattaatataaacttttatagtgagaaaattaagagatataaactctttattaatatattatggtacactttaaattatgtggcctattgtatattatcttattatatttatctgtgtttaaaaaagttacgtaagataggtcatccatatctaaaatcctgggtatatcacttgtgatagagtgctgcatattcatccaagggggaaaaaatagtgtggctatctcatatcaactggaggaaaaatttctaactgaaatgtaccatgtaatcattagtgaactcaaaacctaatgatactatatagccatcgaccaagcttgtcgatatactgtagtgaattgggcattatatgttttgttaatatttaaagtagtgaatgaagcctcgactatatattattcactgtattggaacattataacgtattcatgtaactatagtgcatctatgtgatactttaaaggatctagaaatctcttcagaatgtaccatgttacattcttgatgtatgtgttgcttgttatactggtacaatcagtgtcagtcaacctcgacaatttttgacaaaacttagtactgaactacttaaacgataaaataacactataaatttaagcataatcaccttattatgacaccgacattgaatccaccactacaggaagagaacaggaaatagaagagagtgccgagttctgtactaaaaataaatgataatgtattcttatcctacaagttgtatgggtcccaaagcacttgaatagaactagagaggaaagtatgtatgggtaatgcttgaaacttggtgcaaattgttttggtagaatccatgaaccatatattaacgaaagggcatatagtctagtggttacagtgacctgagtagtaccccaaggtcctgagttcaaatctcctatggagcgaatttcagattgggttgtttgcggggctaagttccctatttcaatggccgtatatatccggttggatatagaggccgggtaaaaaaaatacccttctctaaaaaaaatgaacatatattatggtactaacacattatattggaccaaagacaaacttggcactagtatagacatacttgtaatctagcttaaatatacctaacttcccttcctctcctaaagagaactggcctggccatgccataacattattggcttcattaatcaaatcatacaaaaacaatttacaaccatttagaacaaacgtgtttggcatttggcatgtctaagtccagctatttcttccaaacgcaggaataacaaaccatacaaaattataaagcacgagtacacatgaaacttgcataaaatggaattgcatcaacggttgaaactacaagaacaaactttaccattccttatgaaaactgtggcaccttcatttaaatttaacaaagagggagtactttctacaaatccaatacaatgcatttgtttatcctctacaaacaacatgtaaatttacagatgaattatacacttggaataatggcttccaatatgaacctataccagcttaaatacgtcgttctacacaaactatctgcacaagatatgacaacagtacacaaatgtatcctggaacaaaattgagtggtctctgaaaatttacagaaatgcttgcaccttctgaacctcaaactcagctatgttcagcctcagtcacagtgcccagttgagatccatggatgctccgctccactggcgaaccaggcacgaaaggaacgaagcctcggcccccgaacatcgggcgcatgaatctatcatcaaacttgcgccacacgcgatgaacggagcgagtctgaatggtgagaagaagctgaaggttgttctgagggg

SEQ ID NO: 69019 - DNA, 3346 bp, Oryza sativa
tggtgcaaattagctagctcactctatcactgcgctgcattagcttagcatgacacgtgtctccgatccaaacctccatgggcccacccaatcaagtcctgatggcgaataaatccttctctatctggtcacccatcacacgtgtacagagcccggctagctgcatgccctttcagcaacttggctttgttaattagccgattaattagcgtcgattaaccacagctccaggttctacgtaatcgtgagattaacctaactacaattttaattacggatttgaaaaaaatgtgcacttgcttacccatgcgtacacagttatatattctcaaaatattgttattatattccctccgctcctaaaatataatggattttggttggatgggacatatcatagtacaataaatctatacaggaagcctgtccaaattcgttgtattatgattcttttttgttagataatgaaatatactttcagtatttgctcaacgagctacaaccaattattacaccaaatcgctcaaaagcgttcacaatctaatgagaccaaaacagaaagcaacacaaactaataagcatcaacacaagattaaatatctacaattattgaaatcttattcgtgaaccttcattcgaagttggcaaaaatgtacatattattcattgtactataatatatcatatcaatcaaaatcttttatattttgatataaagagagtattagttaaagatagatcgatcctggttggacaaatccaaccgcagttcaattccggcataatccagggaaatggtattcatgttctaaaacataggtagcgtgttgctagagctatctatctatctatcttctacctgtcgctaatgatcttttcaactgtgacatttgtgttactcaattaatccaacaactccccagcccaagagtaattaaactaaaccacgtaattagtcatgtaattaaactgcctgcagtccattccggtgtgacacttgcgcaaaacaacgagagaagcttcaatatgtttcttcacacgtgtgcgtacgtagcgccaagtggatcctcaatgattaatggtgatcaatttgcatctaataattgagcatcacggattggtatggttctcatttaattacctttggataaatgtgcatgacaaccgaggcatgtttgatggtggagttgtatgtgtaacttaattaggccttttttttcttctaattgtttaaaatttagagtattattttaatgggtatttagggtttcaataattatgggttctttatcttgtatttggtgcttattcgtttgtgcttgcgttttgttaaatctcggtgtgttcgtgtgaaactatctgtgtgcgattgctttagagcgaatttgtataataatttattgtagttcattaagtaaagactggattttattttattatcttaaaaaaggtatttagggccgggatctagtcttaactgttctactctcggttccaccctgcctttaattacgtttactaactaacggatatggtgtttgatttttacaggctctccgtctcttgaccatgtgtaaggatcagcacacgctttaaatggatatgtgtttggtgacgtgcaatcgaaaaatgatatagttaatagccatatgtcaacaatgttctatacagtaattagcatacaaatggaaacggaactttattagccatgtgccacattggctacctgcaggatggagaggatgcatatgcatgatatgatgttgtacgaaccttatcataacgcgtaaagacaaaccgaccaaaggtcaattacgcaaccggagaattaattccaacacctacaactctccgttttaaatgtacatcacttttaaacatacgttttatcattaaacttatttaaaactttaactttataaaatacttactcagtctcaaaatataaaagatattttggacggatgagagatttacttagtagtataaatctggacagactccatatccaaattcattatactaaaagttttcttatccgtccaaaatttcttatattttaaatccatatccaaattcattatattaaaagtgtcttatccattcaaaattccttatattttaaaacggaggaagtataagttatgcatgcttaaaatactatgaaacaaaagagataataattgtataaattttttcaataaacaaatgattaaatatatatgtcaggaggaaagtactaatacagtacatatatgtatacaagatcacaatacacaccgtatcattggttaggtatatatatgagagagatacatgcactagtataatacacattcacagtttcacaccaagtagcttccaagatcacaacacttcatagcatttgttaggcacgcatgagagagatacattcactactctactcttagattttacatttttacaaagtatatgtatgactttaatcttttctatgaacagaactatatgtacatatttccctatataagcatgattttgatgaacaacaaacataaaagggaaaacatttacatgatcaatgcacgcgtatatatatatcccatatttaattagcatgtgcatgcagatgcagtgcaagaaaaaaaactgcaagctaagacctcacgacgtcgccgatggctggcggcggagcaccggcgggatgacggcggcggcgaaggggccaaaatgaggccgtctggcgccgaacaaagcggcggacgacgacggcggtgagccagcgcccggagacggcacggcggcggcagcggtgatggcggcaggggcgccgccgccggcgaagacgcgcggagagaagctctcagaagctgccgcagcaacgaccttgctatgctcacatgaagggcacacccggaacaccgtgccggcagcagctggtaggtggtggaggccgtacagcggcgggtacgacgacgtggtggttcggagagtgccacgcagctcggccacctccctctgcagccgccggttctcccgcgtcagcctctcgcagcagcgcttcagatgctcgcagtccacctccgtctgcttcagcttcgtcctgagaatgatatatacatatatgttgagatgattgattcatgaatcatgatatagtttggagaatagctagctatagctagcatcattcttaatttggttgagatattggagaacacagcaaattaaagggagattagtagtatatggtatggtttgtttgttacctagctcttctgttttggaaccagacctccacttggcgcggtcgaaggttgagccgattagctaaatcactcttttgtttctgtatacgaaatga

SEQ ID NO: 69020 - DNA, 1359 bp, Oryza sativa
ccacctacagaccaacctggaagttgcaactaatcataacaacagagcaaatatgtaaagttctccttcgcttaccggtctctgcagaggatacaaacagagggaagctcaagctctcgacaggagcctcgccatgagggcgagtttcatcttcttctccctccatagcttcttctgatgattgtgtgcatgttgtctggtcatcctgttcatctcttctagttgctcttactccaagcacaagctccaggtcttcttcatcgcccatgcatgttggtataagcaccggtgtaggcgcaatggtggccttcactggagctggagagtcccctagactaagctcaagttccatatcaaggagagagaggggtcatggagtgaggaggcaaagaggaagcaataagcaactatcatatatatagtggtgatgggccaatcatcagagattgaccagaataataaaataacagtatccaagatgactaagtaatcagaatatagttttagattactgtttatttaatgctagggaaggtgatcaatctaatcacaaataattggaatcaaaagttcatgtgccattagctcggtgattcttgaattattatatcagtgaaggtttgcttatttccaagaggattttccgcatggacattctatatttgagttgttccttcagtatatattctttctgattaacgaatgtaaataatattggagaaatatgaactctttatgtctcacagtagtttagtatttttcatatgcataaaaggtctttttattaccaaatcattgtacttcgttttaggcaattaaaacataccatttctttttgtagtcatagcttatatatagatgtctcaatatgcagaagttatataggaaatattaaagatttccaatggttgcgatagagccgtgtcaactgaccataatgtttcttgaaacagaaggaaattaggtggggaaaaaggagagattatttcctccagtacaacattttttaactttgaaagaaaaagcatggctgaaagcttccatctattcacagtttttgaattatcacttaattgtacagacagtgatactgagcataacaaaggtagaaattactttgtcataaaaattgcttcagaagttatccctcctcaaagattatttaataaaccagtggtataaaatgaatataaaataaaacaataatgcaataaagtctcattgaattaatcgtatatcaccaggtggtaagtaggaaagctgtggtaaactggtaatgtctagaatctgtatatgtcaaatctgaactggaatcatctatgaactgagttgagtggggcctatatctactgatataga

SEQ ID NO: 69021 - DNA, 7166 bp, Oryza sativa
gtcaagcattgacaaagatttgtcatttgtggatgttgatgcatgagcttgtgatcacaaatcacaattagacgccggtggacaacccattttcttgcagtggttgcctggcagctcgtttctgaaccagccaatcatttcacaaagccaataagctttgagccgggcctatataattatgattagattctgcaccaaagattctacatgcatggaccacaatcgcatacatatatgatttgatgtcatatatataccagtactttattatgtagggagatgatttgcaagcttaacattgaccatgttaggtagtagaaacattctatctaaaatggatactagaaggtcaggttaggtagaaatgtttggtaagtttcaacttgcaaaactgaatgttctttttggaagtaattgggctatggcatgtgactttgtgacactagaggtttcagactgttcaagtggcatactggagctgcttctctcacttttgacattgtttggtagtgacatactaatcatacccatgatctaggaactatttttcccccaacccaacagagtacaccctctgtaggctatgtccaatagacaattcatgtataaaagtgaacttaatttgagacagagaatatagtaacttggaaatggcgacatgaattttttttttgttcaaacagcccccctaagtagtactacagtaatgtcaacaaccaaatcccaattgaaaatgattgataactgataagcacaggagtggcatggctaatactttgccagaaaaccatgccttgttacaccctatcgtcttctgcatcagaggtttggttggaccaatacatcaagtgaagtcttcagaaaagggacttctttagcttagaaaagccccctgcaaatcaacaccaactcatgaactgttaattagaatccacgaatatactcaggacgtgtattgtaaggcaaagaaaattcccactgttctacaaagatgtgtatctgtcagtggcctactggtcaagctcaagcaggataacttcagacaagtctatgcatacatctccgtggaacatgtggaatgcaattgtgtaaagcaggttgtaaagttattatcagttgctagtagacttaatttaggtaggaaacgtatctaggactcaaggaagtattttctgcatgcaactacctggacttggtttttctaaaaataaagaggattatggatagcttacagatgcagtatactgaccagtctagcatttaggttggacataagcagatgatgtgatacaagagcttacttgtcatacctcacccaatcttcgaagtgaatacatgtccccagaaatatgaattattgattccacataactatttctttctgattgaatcatatttcgcattcttatcgtttaagtatcagatatttcgtattcacttagggatgacatctgaaacggttatccgcgataaaaaaagacatctgaaatggttaacatttaataataaactagctaaatgcccttgctttgctacggataaaaggaaaagaatatcataatactgcattaaataaataaaacattttttcatgattacgttacccacctttttgctacaaggaatactcacctcaatttaattttatgtggctatctatgtagatctagttgttatgtaatattaagaagttcaagggataatgtataaaaccacaatgggaataggtgatgtaatctgccaccaccattagaatctttttaaaggagtatagaaaaccatatgtgcaacaagtaaacttcatgtaaaattggttagcgcaaaaagatatagatccatatatgctatttatattcataaaggtctgtttactccaaagtaacacagtgaaactaacttgagctgcttgttatgcaattatatttacagagttactaaactatgagcagaactgtatagtgcgacacaaaatttcacatatcccgtaacaaggttatttccgaatcgcctttacattcctcgtctatcttggcatacttgttaaatcaatcttcagaatgacaagtccagtacatcaacccactgcaaggcataaatatcaccaacaccataaaaaccagaaaaataagggtgtgagggaaaatgtaacacaaagaaaggtagagctaataccttataagcacaaacacagactgtaggacgccagcaacaccagtccatgcagatggacctgtatctgtaagtgcgtcttggaccaaaaaaccaacagccccagccaaggaaacaaaagacaccacgtatgaaacaaaaagccagagtttcaacctgcaatttaaatgtaatcattgtcatacagtggataatgaatgacagacagatggaattgtattaatatggaaaagttaccactttacaagggagtaatagtagacagacacaagtacacaacagatcagacaggtttttagatatcatcatgactcgacatactggtttatgcatggccgtcttggcttgtcagaggtttgaataacagaatcatcttttaaaacaccagcatgcagaaaaccaaatcgaacattcgataagttgcgggtagtaataatgaactaacgactaatatgatgtgccattctgttcttagtttgtgtggcacaactgttgtcagtataatgtagatgtatccctcagaagagtaacagatcgaagatgaatgaatgattcactcttattccatggtaatctcgttcactcattgacaacgaaaaatcatgcttcatatatttctctgagaaagtaaatcacagtttacagagccatataccgtttccattgtctcgtatcattgccattctagcatctattcctttatatcccaaaactaaattaaagaaatatggctctcttctccacgcatagaatacaaaatgagcactactgtgttcctaatcacatttcgcaagtgtaaacacgcattcttcagaaagcaccaaaaactaacagctctgagttgcaccaatggatgcatgcgcgtagcactaaatcacaactggcaaggttaagcattattaatcttcccaaatcaagctcccagaccagtaaataatctaaccataagcagcgatagcactgatacccatgaatcagtaaatcatgactgaagtttccaacactcctgcaaaaccagaggcaggattgcagaaaccctcgcaaactaaacacaaaacccacctaaaaaaaggagcgaaaaacaaagaaaaaaaacttaaaattatcccctcacctccactcggagtcgtcgtagggcgagtagtaattgtagttggcgtcttccctcttcacgcagttgaacatgagcgcggcgaacgaagcaaataaccctaaaaaagaaaagaaccaaacccccaacaccctcgatcggttaggttaaaggcttcaatctttcgatctttgggggattagggcgagagaggaagaaggtggtgttaccggggaggtagtgaaggaacgggacggcggcggcgctgcagacgacggcgtcgacccagaaccaccagccgaccccgaatacggcgccggcgacgcccggccccaccaccgcccacaccgccgggaagctggtggtatccatcgccgccgccgggaagaggaacggagaaagttgagagcttttttttcagtgtggtccttgcaaagctgctgcttttagccctcctgctgcgggtgtatacattttcttttaatcgcaaaaagaaaatacattttcttttacgcattggtccttccagtttgtaaaatttgatgtagtggcaccggttagacaatgccatctttacagaaatttcacggtaaatatgtatggagtttctgcaattcaagcacgggcaaagctgctaaattcacatatcaacgcggcgcaatcaagaacccgccaatttgcactgacataagcagcggtaaaccaattggttcgcctgaccagccgctactctcgggagtttgttaagaacacatatataaaaaaagttttacttataaattaatttttattttctaatgaactttttttcttattaaaaatatgagcaaccgatgaggacctgaatgtccggaaggcagtctgagccaaaataattttctgaaagcctttcttccatttgccaaggacagagcacgacggatcgtcattgcttcatctatgtcagacgtcgcaactcgcaatccctgggatcagctcgttgaaagcaaaaacacatgagccattgttgtctcagatcaggacacccactcccattggacgtgaagagtggaaaagtgcagcatctgcgtttatgaacattgttccagtctgtgctggaatccatcctaaaactgaagtagagtcgtcacactagagacattcacaggtttggagcagtactgtacaatgatctccacatacaccaaaatgaatagaaaatccacgtatgaatagaagcattgttgttcctggcatcatttcttgcctcccaaatgtgccaaaaggtcgcagcaagagcagtattctgaatgttggatccacgcatcaggaagtcaaaaatctactgtctcatgtttgtgatgtttctcctgcacaagttggggtcaaacttttgtctaattgcctcccacactgcatcagcaaacgggcagaacaaaaatgcatgtttgatcctatcatctctgttgcaaaagatacgcatctatccatagctggaatatgttgtctgaaatagctggtttagtccaattcacttcatgaatcatacaaattcagtcaagatttcattttccttgtaattttggacccaaaactcaaaattcagggtccagactccagacctgaatgcatactagcaggaaccaagtttgagaattaacaagcaataagcaaatttcacactctattgcaggaaatacagatttttccaggaaatgctagaatataagcagctacacagatactgttgaaattcatgaaagggccaacaaacagctccttcagtctcatgaacactgacaatagttgccctgatctatgtgatcaaatacaagagttaacacgatcacggcactatttgccacttggttttgatttcgatgagtgactatcctcggaggggcgtgagcgctggagttcctcaactattgccgtgaccgcacgatcgcccctcactaagaggcgctccagcaactctaccttctgcagcagctgctcagcatcaatactcgcacagctcaccagcttatctgcggtcttcagagccgtgcacagctggtggtagaaacaatgatgaagcaacatcgtcagcttaaatggctggagtaggcaattacagtgaacggcatacaaaaggagatcaagatacacaccttcagcatcaatgaaggccatgaagggtcattttcttgcagcgctttcatcaaattgtcatagtgctcctgataagatgatgaacaggtgcaaattttagttatgaacagatgatgaacatctgcaaactaatgccgtttataacctgaagatcattcatctgtactatagatttaatttgaattttacagcaaacacggtcaatttgaagcacatctgaaccaaaaaaaattcagttcgtggcctggcaaaataaataaataaattcagttcgtccaacatctgatctgctccacaagattggcaaagtcgccaagcaaaattaagcacaaatatgaatccaagtttccaagaaccactctatctaacccttgcatctatcatcatcaacttaagctcgcctgaaagtagagtagactatttcctcaatctcataaactgtatcaggcccattaattcttcacctacttaaccagaaaataccggcacccaacagatagctcaggaaatcgaaccaattgcaggacggacgcatgattagggaactaaatctcatatggtaggatggatcgatcgattggtgccgaccaaatctaggaacggggaggagaggaaagaagaggaagggagccctaaccccgaatagccggttcagctcggatgggtcggcctcctccgcctgctgccccgccgacgacggcgacgacgggacggacacctccccgccggcgaggtcggcgccgccgtcgacggcgaggtcgctgaggaggtcgccgatggtgagcagcgggcccccgactccccgcatctcgccgcgtctccccctcttcccctgtgggcttagctcagtttctagtcatgagtatttgggcctatttaggcccacattagttcatgggcccacactgcaccagcgaattccgggagcagggttgacgtaaacccacatttacgccttcccgtgttatagacgtaatttgaaccatgcgccgtaaaattcatttttccaaatgtctggagttactctgaactgtggaatcagctaagtttttcttttctttattattattattaagggggaaatgtacaccccgtaggaatggtacaattgtgctgtagcacaaaagatgcagcagtgttaactataagtctataactatagcggcatcctctttgtgctgaacaatttaatgatacactggcctatatagaatgccaatttcttcgttgtagtgagatcgctaatactttgagttcagatcatgacacgcaactcaaccctgtgtggaatcatccctcctgtgatggctcctctgatctgcaatgtgaaacggatagcgccatcaaagcaaagtccaaattaattcatgtttactggttttcattatattttttttagataatggactggttttcattatatggtaaatcatgtaaacacactgttagaaagttagcttttacggtgcaggcggaattatcagctccatcgtttgccactttgccctccagcttgtctgccgcaggcgaaattcaaattcatattactagtttgaattttaaatttacagcattagcttttattatttatgatttcttaaagctgtgtgtttctatcttcacgaatccattaatctagatatacgattacattgataacatttgaataaatcattttattctcattttagattaaattttaaaattttaaccactacaattttataggcaaaatttgttatatagcatcgaaagttcacgtttttggttttat

SEQ ID NO: 69022 - DNA, 954 bp, Oryza sativa
agcatcattcttaatttggttgagatattggagaacacagcaaattaaagggagattagtagtatatggtatggtttgtttgttacctagctcttctgttttggaaccagacctccacttggcgcggtcgaaggttgagccgattagctaaatcactcttttgtttctgtatacgaaatgaaaggtaacttttgatttcatttcggctgtatcgatcttatgcaaacaaagaactttagctttattgactttaatcgcgatatgctggaacttttttctaaaggaagcttaaactgtaaattaacatcccaatcacactcgagtgtgaaatcaaacatgtgatatgtaagttaaccactgaagtgagatgtaacatttattgccaagatttcaaaatttttattttgttacaaggatccgttgccatcagaagaccaatgtcctctggaactaatttggactatttcataatctaaggcaccgtgttagtagaaaacagagatgtgtgatgattatatagggtttcctgaagaacatatggaatccatcaaactgttataactctcaacgctttgtagcatcgaaactatatgtaactgatctcttcgaacaaagtcaagaagaggaggtaaattaagttgattgaacaatatccttctaatttatatgaactagacagcatctgcaaattaagagacctgatatacttgataggacatgcggtctgatgcttgataggtttgtaaaagttggaaagattgagcaagatacgacacataccggagtcagggtgctgtgttctttgaaactatcctccagaaacgaggactgttccttggatagcctcaacttcttcctcgcgccaccaccgccgttatcctcatcgtctgcagcttcctgatcagctacctgctgtctcgtggatgcctcctgcatagaagatggtgacgaagg

SEQ ID NO: 69023 - DNA, 2827 bp, Oryza sativa
ggagttaacgttacttgtcagcgagaactgggcctgacttcatgcatccaatatacgttcttggttttgatttatgccgagcaagggtagtggcaagcattcctgttatgttgtcacatgaagtgggttattatagatttcaacataaggccaatcggcacgtgaaaaaaaaaatatacccacctaagttcacatgcacatcatcatcaaccttcacataaaagtcagcatcccaaataccaactgctgtagagaagaaaatctttgtcttagctgagagttcatgatacccttctacatggtcctggttgaacaaatgaacacatggtaaaatgtcagtgctggttcaaggaaagcatgttcaaagctttgaaaggcaggaaagcattacttactagtctaagaaagtcacgatgctgagcatcctctgaatctatagctttgtccaatatactgttggatgtagcactgcacagccatcgaagcagttagtatttatacgaaatttaaaaagtatttcaagtttcgatatacacatatatgggaacatatgaaaacacgtgttctgcggtgatttatagaacaaggcagtatattaattctggttttatcattgaagtcagctatgcacaaccaaaagccctttcagattggcacaactgattattacaaaacagaggaagcaaaaatggatttataaagttctacataaacaaattatccactagatttcagtgcattctcaaaaatcttaggaacttggtgtattctgcacacaaactagctcttagcaagcacaaggatggaatccaaatgtccttgatgacaaagatacttaagaactacatatttttgcaacatgaggtatgttataatgttgtccactataccagttcccagttctgacatttcaggaggttatttgcatgctatttttgcaggcatatttttgcatgttatggtaataaaggtatagtggaagaagttgctatctaacataaaagagaaccgaatgtccaaatgtatgattgaaaccacatgcaaagataaaaaggacaagtgattactgattaaactgtaaaacgcactaggagtacaagaaccctctgtttacctatgccctatagtgaagcggataacaattcccttttgatcttctagttgctgcagctttgcacctaagaacaagaagttctagttaaaaaatgacgacaatgatagcttatggaatccaacaatggaagggctaacaattagcatggtgatgatatcataaatatttccaaaattactagcagaactatatgaacagaatgatcatatgcattatacatatttcctagaaagatggaccccagaaggaattttaagtgctgactcctataagagtatgcaagataccaccagcatctatcacattcgacttatgacttatctatggaagatggcgtcaacgtaaatggcaaagactaaggtcaatcttctagactaattgcatgctcgtacagattaagctaagctagtccaagtagaactatgaattgcttcctacttaataaactaattcgtagtaagtcaaaatatgttatttaaatttaaactgtcagataaaatagagagcttagaattcagtgtcatgtgccacatgacgtgcatgtgatgaaaaactagttccaacaaatatcgttatagcagcaaccattgggccactaggaactaaataatcaagctaagagccttggagatgatgatgattaaaaatgaaatgtctaacaataatagaaccgtcttgctagttcatccataaagttataatacaagaaatagcaaccttgaggcatccatgtctctcgcactgaatcacggcgcttgcggctgctgaatgcggtgtttactccaattacaacaaatgccttcttccttggttggctagtttctgaggttactggtgagccaccagcacggagaagttccagcgtgctacgcttagctgcaagttccatctgcagcgtggagatggacttatccaacaatctaacgccacaaaacaaatccaaaggagagaatcctttcagaaacaaatattcaagcaactcgtaaccataaagtgaactccaactagggtcaagtgagctcactgtatggcttcgtgggtcttggttacctcacccattatgtccttgtcttctccatgcttctgcaaatccaattgaagaagcatatggcagattacatgagatcaatggcaaaaagactagaaccatgtgaatctatttaaatttggagcccaccctctttgtattgcaatcctctgatatgagttgcaactccctatcctgcctccggcgttgagacatgatgtggttactggtatcaggtgccgtccaaaaactgtaaaaccacccaaaagaaatcgtcagggagatgaaagagcaaccaagaaaagataatctgatcatcaaaatgcatgaattcaaaaataaaaaggatcaggaaccataataacccgtgtcattgcctttccgttatttgattaatttcactatttcacagcctcgatatttgaaatgagcaactgaacctatgaactatgataccaaatcccagctagttcgtatgccaagttccagtctaaatggaatatactgaactactgaagacaattccatcaagaaaagtataacttgaacttgttgcaaaaatatatttcctccttaaaaaggttgaaaagctaaatccgaccataacactcaatgacaataatgcagttgttccgaatccaaagctatcataaatgaaaataagcccacacacagcattactactg

SEQ ID NO: 69024 - DNA, 3049 bp, Oryza sativa
gcttttagtataaatttacaaaatgtgaagtagtttgctagtgtaaatcatcaacatagctcaaattaatatatcgaaacaacccagcacagaattgaaacacgatgtgattgtccatgatacaagacaatacagtagagaaggcacagtgttcaatgaaaaaggacatggtattaaatcaataactataatgtatttactgaattttcctaaaaaaatttctcatgatcacatctgttcaaactgaatttggatattttattttttaaaaaaatgctctgcattgtaaaattagtgtcatactgaaaagcaacaaatagcgttcatgcaaagttgataaaacacaggcagtatacccaggaataatgttgcatgtcaattactatactgatctggtaggctggcagttgacatgtgctagcaaagaatctatcccgtgctatattttcatatggattcatggcatgaggttaggaattccaaagttctcatctgcacttcggcattcccacagaatcattagcaaccttcaaccaaataggatggcatgcttttactataaaaaattggatgtactcccaagtatttgaactgattggctggtgtgagtatttgatagacgacagataaggaagaccatataaaaagttccaagtgacaagcaaatttacaaaataaatgaatgacatcacattaatgataacaggcaaaagtaaccaaagagaactcttccttctaaataggaaaaaagtagtctatataaataaggagttagtgtaaaacattcttgccacatcaccaaaactactaagtgttaggacagatgaagcagagtagttgtgaagttcaaaatttaatatatctaccaacttaagaaaacatctaatggttttgacctgccagtttatagaaccttataactttcatatggaagagcaacataggaagctataggaagttggtgtatcacatagatcggacattaacagcattgtttgttacaagataatcagaattctgtgccttcattcggcattacattgacttttgagacactcagtatatctgtattggaattttggatgtacaactaactgaaagcatattttgaagctattgcatgaaaaagctcattataattggtagagattcccttggctaactaaatctcagaacaaagcacaggaactctaaactagcccttcaattagattgaagataaatatgaagcataattaaattttattaagtaaggggacccaagttccataagtataatttgcacttaatcaatagtagtaccatacaaaacatacacttgaacaattaacttccaaatggattatagtttttagtaggaataaaggcgctatggttcagcattagcacataaagttgattaattagaaaaactgtttagcttagcacatatatccaactgaaactatcgtccagttgtctgtttcatattttctagagttttacttttaaaaaaaaaacgactagagttttactttccatggtcactgggtttacgaaatctttgtagggcacgcaattgctttcttaaaccaaccagctcaccaaaagtcacatctgttcactgcttgttagctcaaattggccaaatcaagaataattgttgacgaaataattaattatcttaaagattctcaccagggcattatttcaactgattcaaaacagcatcaggagctattgccgtttactataatgtgacagtgagccattgcttatgcagctacaaattggtgtataatcccaaacactaataacaaatacaagaaaccgatcccatgtagttgattccttgattcactatgtagcaaattttctttctgtgatgcccctaaaacatattggtctccacagaacgaaaaggaaaaaagcgatcatatccgttgaagaatatgtcaattgcaaatgtacccagtatccatctcacagttgattctaacattaatagtcgcagcatcgcaggctgcaaacttatcttcatgggcgtcaagccatcaacaacttgagtcgctatagacgcaactgtgatagcccaattgcccaaagggataacaaccatcactccaaactcaaaggcttcattcctagaacagctaactgagtctggtttccaagtgaggttttaccactacacttctacctcgaaccctggactagtaagcatcgcgccgccgtccagcctccaggacggcctaggctacagtacgaagttgagaaccctagtgcctcgatggctagtccatggcagcatactcctctcagcctctcagcctctcaccctggccgctacaagtacaaaccccactctacactacaccaacccggtcggcggagagcgggcgccgggagacgctcgactcggagtcaaatttgaacctcatattggcgagcggaagcgtttaccaccgcgaggatgaatgcggaggaggctggccgtggccggccgccacgccggggatggccacggcggcggcggcggcggatcgatcatcggctcccggcgcccgggggaatccccgcacccagccctcaggcgcgccggccgccggccgccgggatgagacggagcaggtgttggtggccgcggcggcgcggcggggggcgaggcgaacggcggccgcgcgctcggtgggcgtgcgagtggggaagggaaggaaaatggaagagaatgttcgctttgcttgtgggagggggtagtgggccgaaagctggaggaggcccggcccaggaaaaattttgcattcgcatttggagagagtagagagatctacatcctatgaagcctttattattttgcatctaatttagctaacttttggtctgagatgcattcaaattctgaaatgtgtgtgtgcctacaagatttgaaggggggactacaaagtatttcgtcctcaccgtcactgcacacaggcaaattgccttgtagagcaattaaaatatattatattttattagggacttgtaatatttaaagtaaattttgtgatccaagttaaatcattggtag

SEQ ID NO: 69025 - DNA, 9396 bp, Oryza sativa
aatggaatatttttagaaaaactattttattatatataaagtatcattgtgaataaaaaaaagttttcataatacttatcgttttttgacaaactgataaaaagagtgggcatgggagtagaaatcatgtgggctctgcccgcgcaggttctcgaatcctgccgaccacgcctttcttataaaaataaattgcataatttatttttagtttttattcaattttgcacaagatttgtatttatataagagaaaattcgattcatagcacaggaaagaaatcggtaccaaaaaatagcacacaaatttttcgctttcggcgagaagcacaggccaccgtttttccttcgtcccgtagcacttccatcgcattcatccatccagtgaagtgttttgctgttagtcaacagatagaaagaccaaattgcccttcttctatctgtatagcaaggcccactcaatttgtcctacgctgatatcactgcttgaggggaagagaaaggggaaaggcgacggcgacggcggcgagcagaggggagacggcgactgctagcagctggcggctatatcgcggctgcatgctcaaggctctctcacggtatgtgcaatgatgaatttgtggttgggtttttgactggggcaacctagatctgaagaaatgttctttgtttgtttgttgtggtttctgaagcaggaatgtgattttgttagactctttttgatagactgtttagatggttgctccagacgacatccctctttggtaagattgttctacaaccaaatcacaaatcacattgttctttgaaataggggttaggaatgtgtgtgctaactataggaatcaatcttgctatggcagggttgatcccttttcggcatatcgggtatgcattactatgcgatcatatactcgaaagggtgatgtcgaagtgatttgtgatgggaaggaatgggacatagttgttgatagagataaattcaacttgattgcgcttactgatgagattaaagaacattttgaatggggaaccaatcaaaaagctagcatgttatatcttgatagtacaggacaataccttccactgactagtgatgctgcactgagaagtctggtagattcaaattttctatttcgcgaaattagtgttttggttagggtggaggatattgttgaggttgctgatgccgatggcaatggcaatgccaattgcaatggtggtgatggccctggtggtgatggcagtggtggtgatgactctggtgttgatgtcaacggtggtgatggcaatgatggtgatggcagtggtgctgatggagatggcaatgtagttgtaggtgagaaagagatgcaacaaaaagcatctagtaaatggcaagctatgttttgggatgatactcctattagtaatcctgaagatcctgaagatgaaccaattggggtgaatgaagaacacttatatggagttgtagatcttgaatctcagaaggaagggactagtggaaagaagacagataaagagaggtcaagtgggaatgaggtagctactcaggatgttccaaatgattttgacccgcagcatgtccctgaagaggaagtacctattgatgagattggcaatgttgtgcccttgtttgtgcacaacagggagaatcctacatttgttgtagatgcaacattcccaaatggagaggcttttaaacttgcaatgagacagtttgcaataaaaggagaatttgaggtcgatgttagccatagtaataagactaggtatattgcaaagtgtgctaaaacaaaagactgcacatggaggatatatgcgaggaaagagaccaaatctagtgtttggaaggttatttgactctttttcttgttattgcatatcattttttatctttttattataatattggcatctcatcctacttttgttatgcattgcagatcagtcgcttaagtgagattcctacttgtgctactacaagcaagctgagtggaagatggcatcctcaggatggattgcagatagggctaaggaaataatgaccacagagcctaacattggccccaaggcacttcaagataggttggagaagaaatataatgtaactcttaggtatggcagaacttgggaaggcctccaaaaggcaaaggatgacatccatggatcatgggaggctagctttcagcttctgtggagttttaaggctgaggtagaaagatcaatgccaggtagcattgttgacatcgatgtgaatgcaatgggggaaaaggttttctttaggaggttatttgttgcattaaaaccctgcattgatggatttctactaggatgcagaccatatctaggttgtgattctagttttttgactaggaaatatacatggcaaatagcagcagcagttggagttgatggtcacaattggctttttccaatggcatatgcaatttttgacaaggaaaactatgaaaattgggaatggttcatgcaaaggttgaaacaagcagtaggtactcgagatggattggtcatacatactgatgcatgcaagggttgcaaacaacaattagtgatgtttttggtcgaacagtggaatatagggaatgctttcgacatctcatgttgaacttcagtaaaaaattcaggggtgaagtatttgattccaatatgtggcctgcagcatgaaccttttcactctacaagtaccaagagtacatggatcagattaaagaagcatgccctgctgcttatgagtacctagaagtccaccatccacgtgcatggacaagaagcaagttttcagaagcatgcaagattgagtatgtgtgtaataatcttgcagaatcattcaatgcatggataagtgatataaaaggcttgcctattattgacctagtaaataagctaagacaaatgataatgaagcagatgtcaaggagaaaaagagttgcagaaggcttaacagataaaattcttcctagtgttgttagagctctaaatgccaagagtagaggactaaactatgaaattgcaagaagtggtcttactgatgcagaggtgacagtttttgatatgaaaaccaaaaaacacaacacttatggtgtttttctagaaaagtgggaatgcacttgtcgacagtggcaaatttctggcaagccatgcaaacatgcaattgctttcatttgttccatcagaggagctagtttggaagattatgttggggaatttttctctgtagataggttcaagtttgcatatgcaagttccattgtacccattgtaggatcgagatgtcgactagagaggaggtgaataggcgatttaaaaattaaataacacctaatcaaatctaacctaagttgctaggcttggtgagggtgaactctaactaagcaactaagttatgttttgcaaacctagggtgatagtggctcaattatatctctaggaaagtaaattgcataaatgtaaatgtgacaatcaaatgagacaatgagacaagagatttttcaccgaggttcggaaactcgccggtttcctactccccgttgaggcgagcccaactccaccgctcaaccacgaagccaccgcacgcccccttcgtcaagggtgggcaaggcgggagccggcccacggagaggactacccaagcctcgatcactcggggtagttcttccttcactctgaaggtggtgaactccaaaccactcacaaaccggcgccgggccgcctccacaatcttctcggagaggtcaccgggcaactcctccataagccgtctaggaggcggcaacctccaagagtaacaagcaatgacccggtgtggagatgatcaagtgccacactagctctacaatggaagcaaatgcacttgactcttagctaaacaaccctctaacacactagatggatgaacacaaagctcaagtgagtgtgagagaggtgcaaggggtgtatgcaattgaattaggtgccaagagagcccccttgctactggtgggggagtatttatactcccacccaccaaaactagccgttggtggcgaaatcccccaactttgtgctctgccggtctgaccgaaggtatgtggctggtcagaccgtgctactctgcaacggctagaaaactagccgttgaagtgctgtcagagggccccatcggcctgaccggtcagaccgacatggggtggccggtcagaccggcctcgactcggtcagaccgccatcagctcggtctgaccgactacggctccgtcggctctgtatcggccatcccgagcagcatcatctcggcctccagggggccggtctgactgggaaagtgccgccggtcagaccgcccgcggggccggtcagaccggctagggcacgccggtcagaccgccactatgtgccagtctgaccgcccctggtcaggccgaacccagtgaatttgcaagtgaatgtgtgtataatgaaaaagagagcacaaatgaaaatgcaatgacctaatgtggcaattaaaatcatctctttgctaggtcattacccctcttaatagtacggcgaaactaaaattaaactagcaaatttgatcgccctacacctcgatcaattctaaattaaagcgctagttttaccgtcttctttccctttgctttgcgccgtcaattttaatccatcgataatcatccatgcgcacatatgacgtggacctaacttaaaatgtatagctcaaagacaacggttagtccacaattagtgcttgtcattaattaccaaaattaacaccgggggcctagatgcttcacccatgtcagacaagacccaatggccaaaagttgacatagggttcaaaatgttgccaccaaagcttggaagatcagcaggaagacctcagaaaaatcgtgtgccaaatagtgctgaagggaaaggaaagggaaagtgcaaaaggtgctcgagatgtcaaggatttgggaatcaagctagaacttgcaaggaacctgagtgcgtagacctatctgatcttgcatctgctccagcacccccccccccaaaaaaaagaaagaaaaggtctagttttcctgcttctccttctgatatcttaatctgcattttttgtactgctaacaattttttggttctctttcaggaagaccaaacctgcagtggtagttgtctcaaagccccagacaaggtctaagtccaaatgtgatgcctcatcttcttcccagctgtcggtgacatgggaccgggagtatcatgacttagagacttgaggcagacacgatcacccacgtggcctaaccccctcgggggggggggggggggtcgggcccgagggtgatacggccgcccttctctttgtctccccgaggggtcggaccgctcccgtctcggccccgagggccgaggcgccccgaccccttgtgggttttgcgccgcgtatatggggtaggtgagcatagcggggctcacctaaccgcatttattgcggtttggacgagcgcagaacgccgcatgtaacacagtgcagcgcgctcgtttatccggtcagtgaccagtcacagaccgatcagatcgtgggttaggtggcgacaggcggtctgacgcacgcctcgccccatcccgtcaggacgagagcctccaagcactcgtccctagccggagccggcgtgttagctcctggagatggcacgttggttccggtcagatatataccaggcttcattctaaccattacaggcaagatattgtatgaagaagggcgaacatgcagattgttaaactgacacgtggtggacaagaatgatcgatttgtgaccggtctgacaatggtcatgtcgtcagcagacagccatgttcccacgtcgcgcctgcttccggtggaagtggaggtaggtatgggccgtcccatcagaaggtcattcggacggcagccatacaaatctccgtccattaatgaagagaagtcaagttggagggaagagaggatgagtccccacacaaaagaaagagagggagagatggtgcatgtggtatccccttgagatataaaacgaggaccttgcccacgtagaaagggagaggagaaaaacgatcccagaacaatcgggggctggctcacactttgtagcttcttcatacacagatccaccaaaacacaggagtagggtattacgcttctcagcggcccgaacctgtatacatcgcccgtgtcttgtgtgtttccactctcgcgaactttccacagaccaggagcttagaatctcacccagggcccccggccgaaccggcaaaggggggcctgcgcggtctctcggtgaggagccgcaagctccgtcatctggcacgccaggtagggggctctgcgagagatcttctgagctctcgcactctttcgtgtgcgccaagcttttcctgttcagcccaatggccgaacaagcaaaggcgcacaacctctctccgagcattagcggtgacgatggggagccaaacccatgccgtcgagctcgtactccaccgccccctccacgccaaagtcctaggagggaggaggtgctcgagagggtcgaaggatccgcgacttcgacatccacgggcgatggggaagggcggcgagatggggagcgtcgcctcctcgtctacggtgacggcagcacgccccagggcgcgctccaagctgcgggcgcgctcctacgtcacccgcccgttgtccctgacccggagtctccagcccaacgttggctggacgacgtggccaacttggtcatgacggcacggcagcgcctaggtgctggtgggcggtcctccgccaccaagacctctggcgctactaccaccggctccgtgtcgtcaaggcggagggcgcggcgagcggcggctgttgctcgccattcggccgccactccttcgtcagcgcctccgacccaggaagatctgcgtggggggccggatgcccgcatcagtatcgagcgccggcgtaatggccgacgtgctgcccacgcaacggagggcgcctcctcgtccggagtgtcacatcaacacggacgcggggatcagccctccgtgcccccggttggtggtgtcggctgtagagcctttgtggcgagccttcggaacgtccgttggcccccaaggttccggcccaccatcgccgaaaaatatgacgggagcgtcaaccccgccgagtttctccaggtctacacgaccgggatcgaggccgccgggggtgacgacagggtcatggcgaatttctttcccatggccctgaagggacaggcacggggttggctaatgaacttgccacccgcgtccgtccactcttgggaggatttgtgccaacagttcaccatgaactttcaaggcacatatccgtgcccaggtgaagaagcggacctgcacgcagtacagcgaagggatgatgagtcacttcgctcgtacattcagcggttctgtcaagtccgcaacaccataccaagcatccctgcacacgcggtgatctacgcgttcagggggggtgtgcggcacaaccgcatgctcgaaaagatcgcctccaaagagccccagactaccgcggagctttttcagctcgtggaccgagtggctcgcaaggaggaggcctggacttggaacccctccggttccagtgtggcagcttcggccgcccccgggtccgccgctcggtcagggcggcgggacaggaggaggaagaagaggtcggcccattccgacgacgagggtcatgtcctcgccgtcgaaggcgtttcgctggccacccgaaaggggaggcctgcgagcgacaaaaagaaggaagccgacactccctgacctcggctacttggaagagcgaaggcggcgcgcggcccttcgagccgcgcgctaccagcagagcctgcggcgctaccatcagcgccacgtccgggcccgatcactctgcgtcgacgacctcgtcctacgccgcgtccaaacgcgtgctggattgagcaagctctcaccaatgtgggagggtccgtatcgagtgatcggcgtcccccggccgggctccgttccgctggccacgggcgatggcacagagctgcctaacccgtggaacatcgaacaccttcgtcgcttctacccctaaaggggatcgggtgtcaggtttcgggctcgggccaaccccgcacccccctcgggcgtgcagggttggccgggggctaccacatatgcatattcttatttctcttacatctgtatctcaataaaagcattttcgatttcctaaaggctgtatctgtgctgttgtcgctgtcgtccgcaccgtcgtcaccgcactcctcgtcggagttgaaggcaaacgcgagccgaggggccgctcattattgtcggtcggttttcccttgctgatgcgcgcgatttgcgaccgccgggattctgcccgaagagagagagagcagggaggagaggcccccgagccgaacggcggcctaaggcccccgacgaccggagctggccctccgcctgcttgtccgacggtgccaggcgcccccgacccccaggatggccccgaggccactgcgggaaggccgcgcctgtcgccctctgaccccgaggtcgtcggcacagaagccgaatgcgccccgcgtggcctctcggatggagagcgccctggagatgtggcccctgacgaagaagatcggccccgccgaaaggtgcagcggcccgtctacttcgttagcgaggccctccgggacgctgagacccgataccttcaggcccagaagatgctttatgctatcctgataacttcgaggaagttgcgccattatttccaggcgcatcgggtcacggtggttacgtcttatcccctcggccaaatcttgtataaccgagagggtactggacgggtggtgaaatgggcaatcgaactctctgaattcgatttgcgcttgaaaccaagccacgcgatcaagagccaggccctcgccgactttgtggtggagtggaccccagctcccgagctcgtctccgcccccgaggccagctcaagcccatcgcagctgcctcacaccgccctctaggtgatgtagttcgacggcacctgtaggaaccggccccacctgtcaccaggccttagaagtggcgtcacgcccgaccgcttccctcggggagggcgatcgccctggcataacgcagggggctactgtcggtgacatgggaccgggagtatcatgacttagagacttgaggcagacacgatcacccacgtggcctaaccccctcgggggggtcgggcccaagggtgatacggtcgcccttctctttgtctccctgaggggtcggaccgctcccgtctcggccccgagggccgaggcgccccgaccccttgtgggttttgcgccgcgtatatggggtaggtgagcatagcggggctcac

SEQ ID NO: 69026 - DNA, 27513 bp, Oryza sativa
ctcctggagatggcacgttggttccggtcagatatataccaggcttcattctaaccattacaggcaagatattgtatgaagaagggcgaacatgcagattgttaaactgacacgtggtggacaagaatgaccgatttgtgaccggtctgacaatggtcatgtcgtcagcagacagccatgttcccacgtcgcgcctgcttccggtggaagtggaggtaggtatgggccgtcccatcagaaggtcattcggacggcagccatacaaatctccttccattaatgaagagaagtcaagttggagggaagagaggatgagtccccacacaaaagaaagagagggagagatggtgcatgtggtatccccttgagatataaaaggaagaccttgcccacgtagaaagggagaggagaaaaacgatcccagaacaatcgggggctggctcacactttgtagcttcttcatacacagatccaccaaaacacaggagtagggtattacgcttctcagcggcccgaacctgtatacatcgcccgtgtcttgtgtgtttccactctcgtgaactttccacagaccaggagcttagaatctcacccagggcccccggccgaaccggcaaaggggggcctgcgcggtctcccagtgaggagccccaagctccgtcaccagccactgcctacatccccttcacatcctgctggagtagtttctacatctcagccgcctacaaggacaactcctcccaggctagcaaagacaaaagcaaggacagctagtgttaggacaaaatgaaccaaaatactacctgttaatctatggacctgtatctctctatggatctgttaatctattctgtatctctctatggaccatggaccatggaccatgtaaactctatgtttgtatgcacctgttaatctatcctattatgtgtggacatgtttggtagaacaaatgcgctcaaaatctgatccttaagtattcatgttttattcctgtcacactatgcaagtgcataaacataaaaaagtactatcttgtcacataattatcatcatttcattaagattagaataattatcatcacataatctccattacttcaagtgcataaacatacaaaagtactaacttgtcacatacatcagagatcacaactaacttccagattacagcagagctcacagaaagccctttgccaccactacagcaatcatacctaaaagtacagcaccaaaaacaacaatgccaaatgctgcaatcttcaaatagagagtttgctgcttcacttcggacctcatcatcaatacaacatctataagcttcttctttgaacctaggtcttcaacttcatcctcttcagaactatctcccttgatttcttccctactagcatctccattcagcaatccatgatcgataaggtacttctggtagcattctttccaataccaaaaatcgcatggggcattcctctacaaatttaacccattcatcaccttattaggcacaatacaggtgcaaacaacaaaaataaatcacaacaaatttgtactttacctctgtgcggtttgaacacttgtagtacactcgatttgggttcttcttgctgcgggacacataccgaacaatttgctctccacaatccggataatacaccaatggcaacaatgaggagggagtaaaacgaatctgaccagtggaagaggatgatgcatgacgaggatggcggagcatggatccctcaacatgtgagccacgaacagttgagctacccgaagccgccattgccaacaagaactagggttagggtttgctgagcggaaaatgaagagaatgaacgggaaagagcaaggaaatggggaataagggagaagagacgaagggcaaatgaatccaacaatatttttctccactccgatctaacgccgttacctcgcaatgcgacggaagtgctacgggacgaaggaaaaacggtggcctgtgcttctcgccgaaagtgaaaattttgtgtgctattttttggtaccgatttctttcctgtgctatggatcgaattttctctttatataatactagtactagtatttataagacgcttcgcattcacattttcatttcagtttgcacaatatttttcagttcgtatttaataagacgcttcacatttcatttgaaacctgctcctgaactcctctgacatcggcccaccacaaattaaacagagcccaatttccgcaaacattaattaaccccaacaaaagcaatcgaaaagaagcccattaattatactttaatggctgcttgtgattttggcccgtacctgctggtaattctatcccgtggtagctcgtaaatttttgcccattggcattgaaaatctccgttcgtagttgctgataaatttggcctgtaagagtgataatttcggaccatactagaaaatgggtgcgcctttggcgcaccaactaaaaatagcccgtgaatctttatattttttcatttaggatatataaacattgtagagttatttataattagtttagtgtttattttccgacaaatatattacacctagataaacggaaaccggcaaaaaaaaatctaagctcaaaataacatctcaaaatagatgcgctttgccgcatattggatcaggaagtagaaaatattgatgtgctagcctatagaatgttttaatggtccaaatttgtaaacgtttcgcatgcagtactatttagcaagtcttcgataaaattaagggttaatttgatctgtgtcattgcaaatgtgtttattcagataaatatattacaattcgtctattcgtagccatgcaagtcaaattttacaaaaatggaaccataacttcgccgccacgtttttcatcttcttccacatctgcacggcacgtgagacacacccgttagattcatctttttcctctgtccttccctattttctttttttccccatctctatggaaccatgccatcgtaaattttacgatttaaaaatagagtaaattgcatccacggtgcatcaacttggcaggtgggtgcaatttggtgcaatatcttgaaaaatgagcattctaatacacgaacttggcaggtaggtgcaatttagtataagaactttataagtgatcatataaatgcaacaacttgcatggtaggtacgattttgataaagtaaatttaagagttatgcgacaacttaattatttggagcatttttttatataaattcaatttttaagtatatttatatttttatcctaataactaataactgaaagtcaattaaactggatttagaaattattatttcggttaatatttgagaatgtgaagaaaaaaattcttaaaggtaattggatgtaaattgtattactatgtgcaatatagttcttaaagattaaatgtaatatccataagattactttgtaatggcatattgacatcgtgaaaaaaaaactcacatatcatatgcttagccaagttgatgcaccaaaataataaattgttaagttcttatactagaacgcacttacttgttaagttgttgcactcggacgttcaattctcaagttctttcactatatcgcacccacctgtctgttgtatcgtgtgtgcaatttactctttaaaaatatatcattactattcatctatttgttcggtttacagtttaaaccataaatatataaccatgaattttagcatatttttttaatatatgcattcatgcgtataggttgtgctatggtttactgacggattctttaattagtttttaagtcacattcatggtgatacttaaaagcaaaatcaatttagaaattaaaataaacctcacttccatcctcatataaataattcagagaaattaatttaccatctttggaaattgaataacatatcattttaaattaatataaacataatcatatccattcaaagacatttactgataaattcttatgagacattgtacaattttacatctcacaaatcaacccacaaaactcaaaatattgataaaaaatgagtcgtgaattgaagacttataaacaaatcttgtcagaggttgtaacttctaaaccaccatcccaactaaagcatagttgccactggatagagaaagactcttacgattctactcgcaaattagcaaagctccttgtaaatcatccactcctcactacccaattttggaagtccaaggctaagtcaatgacccattaattgtgacagaaccactcagcataaaatttatgcacttcactgcgcccaaccgaaattagccacccaattgccaacccagtactaacctaggggaggagggatatttccaacataaaaacttcctgactgtatcaaaattcaatgcaaactcactactccctccgtccctaaatataataacttttagctctcaagatttatcccaaaatataataacttctacatcaacattctcttcccaaacaatcacaacctccaccattcacttttcccacctaccttcactactcaaccaatcacaatcctccatcattcacttcaacctactttgttaataaccgtgcccaactctaaaaatacttatattctgggacgaagatagtacttgttactgtaattttattaaacatttgatcaaagaaaaagagaaaacataggctatatttaggcgttggcagtgacaggctggactaagcagcttcactataggctgccgaggaatgcagaacatatgtaacattggttaggctgtgtttagtttctgaaattggaaaaaaatttagggaaagttggtaatttgaaaaaaaaagttaggagtttatgtgagtagaaaagttttggatgtaatgtgatgtgatagaaagttgggagtttggggaagtttggtgtgaactaaacaggtcttagtttcctccgacaaattacaaggcaactacaagatgaatcccagaattaccttatcccaaatcttgccttgattttttcccttcctcttggtaagccccaaatcttgatttgaactttttctaggctctccctcaaaagatacggagctattcacgtctaactataaagtaaaagtagagtaaatgactcgtctcaggaagaatacagcaaagcaacgttcgaaaaaaaaaagcaatagcaattaaagctactatgttctgctcttggtaagatcatgcaaaatcgatgccaaagaacagcacagctcgagtaatttcagccacaattaaagctttattcagagtgaaagcatgatttagtatgttgggccattgggctgaagagggcttggttggcatgggagtaggcgaggtggctgaggtcaccaagctgcacggacaaggcctgctcggcgccaccaggaagcagctgagcgctgaccagctccgacgtcatccgactgccggccgccaacagctccgctgacacctccaaaatcttctcgaactagggtggtgcggatggggcaacccctttctcctcgctggtccaccctggatccaggcatccaaccaccaagcttgcggcggcaagctctggcacctccgagctaggcattgttagatccggtaggagcagttgtcgtctggaagcggcgacgtgcttaagctccaccgagatgtggagggaggcgtgccgaggtggcgcggatggagagaagcagcggcgggggcatggaaaaggaggagtcgacggccggggcaggaaggaggagaaggggagggggtgcgggcggcgtctccgccaccaagcgcgccgtcacgtgagaggcgaaggaggcggacgatgtgctggaagactggaatatgcgcgaaaggttatccagatcgacacttggcagatttttgggtgaggtctaaccaaaattttagggcgccacgtggcccaatcggaaggcagatcctagacccagaaatcggtattagagatttgctggtaacttgggtcggtagttgctacttgctagtgcagaagtctagagttgaggcgttcactttgctgccatttatcggtgaaactatgaatatgacaaatttgggttatcgggcatgactagaaatcatgtgggctctacccgcgcaggttcgaatcctgccgaccacgccctttttggcttttctgtacgaacatccccaagactcctatttgctttttttttttgtgttcattttttttatatttttcagtttcttcttttgcattttttgtgttcattttttgtgttagtattgatgcattttactatttataccacatgcacatcccccattttgctgcattccttttatatatagttttctttattatattttcagtgcattttgcttttctgtgtgtgtaagaataatttttttttctatttataccacatgcacatcccctaggcacatactgtgctgtgctggtcctggtcagctggtgcggtggtgcctggtgtactgtactctttgtccattgagctgggccgctggactggcttgatgggcttgatgggctggcttctccaggcctccagctggtttggctagtttttaggaataagttcactttgactccattaaaagtgatccgaatctaatccatacccctaaactataaaaccagatatcttgacccctaaactgttaaaaccggtgcaacttgactccctcggtagttttgaagagcggttttgctgacgtggcgtctatgtggcaatgttcaccttgtctgccgttgacgtggcgtttgggtggcattaaaaattaaaaacatacatgtgggacccattcgtcattcagaagaaaattttgtgggtcactgacatacgggacccactgatatctgggacccgcacgtcatcccttcttatcctccctctttctcttccttctctctctcccccacgcggccacgccggcgtcatgagtccctgtcgccggcgcctccacctcgccactgccggcacctccacctcgccactgctggcgtcgtcctccccgacttctccatcggggttcatctcctcgccggctccgcatccatcgcctcgagtcagcgtgggcggtgacgctggacgagctcctccgggacgaggccgctgccgccgccggggggtggaggtggacgccccgtgcgcgtcctcgtctacgacgcgttcctcctctgggcgcgcgctgtggcggtggcgttcacgttcttcacgcagtcgtgcgccgtcaacgtggtgtacggccacgcgtggtgcggccgtgtacacgtccccgtggaggccggcgccatcgcgctgatcggcttgccggcgctggagctggagggcttgccgtggttcattaaggtcggccccggcccgtacccggcgtacttcgacttggtgatgaagcagttcgacaggctggagctcgccgacgacgtgctcgtcaattcattctacgagttcgaacccgagctgagctagtaaccccatcaaagctacagtagcaactatctgctggtgataatgaaattgcagacttgcctgcagcttgcttgccggcgtcactgttggcttgcagctggcccgctgctgtctgccgcctcccgtgcacgcccgcgcagtgtcacgccatcgccatctactgtgcgtgtcacgacatcggctcggaacacaagtcaacccaaaagatcggaccgaccatgtacccacagagtgtgtggacccggtagtcagagaccgggccacggtaagagagagagaccttgagcacattgctataaaggtcggcaggattggagagagagggatatgaaaaacattgtacacaacaattcccaattgattcaaatctctcttcctgctatcttgttctgttctttcttcctcctcaagctgctctttcctccctccaattcctcaaatctccacgaactcgctgaagaattagtgtactcatgacaatttggtatcagagcatcgatcctggagaagccacgctatacatctcgccttcagctgcaggtcgaagcgatggagaagcagaatatcgactttggcaaggtcttaatggagattcaggagtcgcttgtctcgctgaatcgggcgcaaggcgagacgcaaccgccgtcaacaagctggaccaaggcgtgaccaactggagaccgcaagtagaagcggcagtgaaggagttgcgtgaggaggtgggtgatatccgccagcaaatggacctgctcggcaaatcgcagtccgcgccgccggcgacgtcttcccctcgagttccgttgacggacgaggaaaggaaggcgccgttgcttcctacgccaccagcttcgcgcgtggctgcggcgggggacagcggagacaagtgggccagtggccgccaacatccacatgaacaccggggaagggcaccaggtgtggttaccaccgtggtcccgacctcggtcaagggtacgttcagttcacctgctccatctttgggaattttggattgggaaaatgattttgattcgggagagcgtaggtttaaccatagagtccctaagttagatttcccaaaatttgatggttcagatccacatgattggagaatgaagtgtgagcattactttgatgtgaataacacttatccagggttgtgggttagagtctctatcatttacttttctgggagggctgcttcgtggctgagatcaactagagctcacttgcggttccctaattgggaggatttttgcgctgcagtatctgataagtttgatagagaccagcatgattcgctaattagacagatggatcaaattaaacagacgggttcggtttgggagtattatgaacgattcgatgaattgatgaatcaattgctagtttatgatcctggggtaaatatgtgttacttgacacatagatttattgatgggttgcgtcgggagattagaaatgctgttttacttcagagacccaagaatctcgagtctgctctggctgttgcttccttgcaggaggaagtgttggaatcatctgactccacaccggtgaaggagggcaagaagtttgagagttctgggcagcacaagactggtggaaattttaagggagcttttcctttaccattgcctcctggtcgtcatttgggggtaattcagagtgcaagagtggatgagaagaaggaaggggaaattaaaagattgtctgcatcttcagagaaagtgtcagctcttaaagcacagcgtcgggcacaaggattatgttacatatgtgctgagaaatggtctcccactcataagtgtgctaacactgtgcaattgcatgcagttcaggagctgttttctgttttgcatgaagcttgtgatgaggcagtttgcaatcctgagaattctgttttatcggacagtcaggtgttgatggcaatctctgtacatgcagttcaaggatctgaagctagtggatgcatgaggatgttgggtcagattcaaggcaaggacgtttttattttggtagattctggtagcactgcaagtttcattagtgctcgagtggcagaagggttatcggaactttctcagattgctactaatttgcaagtgaaggtggctgatggagctactttgcactgtcagtctgaaattccggcctgtgaatggagcactcaaggacagaaattttgcactactctcaagatattaccattgggaaattatgacatgatattaggaatggactggctaatgcagcacagcccaatgactgtgaattgggttactaaatctctcacaattgaaggcaggaatccagttgttactttgcagggaattttgtcaaacactgcacagtgcggacttattccttccaaatagttgaatgggttgaaacatagacaggcagtagcaaatcttgttcaactgtgttgtgttacagacctggaaccttcagaagaatttcctcttgcagtacaacaggtgctaaataaatttgcttcagtatttgaggaacctcagggtctgccacctgtgagatcgtttgatcacaccattcctttaatccctggagcaatgcctgtcaacgtgaggccttaccgttatactccatcccagaaagatgagattgagtctcaagtccaagaaatgctgtctaagggattgattcagcccagctcaagtccattctcttcacctgtgctgttggttaatttcttcctcctcaagctgctctttcctccctccaattcctcaaatatccacgaactcgctgaagaattagtatactcgtgacacgcagtcgagccattcgtcgccgcccgccagctgctcgctatcgtcacccagcgcagcttcggccctcaccgcccgccgccggccgaagggggaagaaccgatgagaaagggagagaaagaaagaaggaagagagggaggaggaagaagggatttatgtgggccccacatgtcagtgggcccacaatttcttttttgaatgacaaatgggccccgcatatatatttttaattctaatgccacttaagcgccatgtcaacgccacataggacgaagacctagtcaatactgccacgtagacgctatgtcagcgaaaccatcatccaaaaccgccgagggagtcaaattataccggttttaatagttgaggggtcaagatatccggtattatggtttagagtcatggattagattctggtcacttttaagggagtcaaagtgaacttattcctagtttttattagctgtatagctggccatctaaggtgaaattttttgcttggagattatcactgaattccatcccaactgagaaggtgcctaagcaacgaaatatgagtacaacttgtatatgtaaagtttgtggtgctgcagaggatacttgggatcatgcacttcttcattgtactatgtcaaaatgtgtgtgggctttgatggataatgatcttgcagaactaattgcaaccacgaatattaaagatcccaaggattggctcttttacatgcttgatgttttaaaacctggagacaggacgaagctacttgtatcatgttgggcaatttggcgagctagacggagagttttgcatgacgaattttatgaaagccctttaacaagaatgcattttattaaatcatatttagctgatatggatttgattaatattcctctatgcctacaggataagaagcacttgacttatcctaaagtaccagtatggatgccacctccagaagattgcgtaaagataaatgtggatgcagcaatatcacgatggggtaacaagggagctgttggggcagtgtgtcatactgtatctggtgaatttgtggcagccagtgctatggtctgggaagggctctctgactcggcaactttggaagcacttggatgcaatgaaggcttggcaatagctatgggctgtaatatgtcagaggtctgtatagcctcagactgccttgaggtcattaggagcatctcaaagaaaccaaggtgccaatatttagcagtcctaaatgatattgaggcaagaaggaagcattttgcaaaagtagagtttcgtcatgaaaatcaggcttgtaattttgatgctcacaacttagctaagtttgcttctactttacaggaggggtgttatctttggttttcaaatcctccttgtaatatgaataggaatgtaaatgtggacagtaataaataaattgtccgctctttctcaaaaaaaaaaaagctgtatagctgaataattttgcgatcagtgttcgagggtacaaatgaatcagctattataaaattgagaactaggtcaaacacagttttttagaaataatttatacatattattttcttataaaaactacactattagaaagctaggaaagcatatcacatttacatacaatctattaacttattaaagtaataaaaaaagagcctttacatttgctccaacggcctagatatccttatattaattggatagaaagaaaaaaaataaagtctatagaaatataatttaagaaaacaaaaaattcagaattaaaaaaataaggaatattgaaaaaggatactagagtccatgtatacaatttaaaactaattgaagttcgaaattaaatgttaataaaattaaagctatatccccgcaaaaaaataaaattaaagttataggttacatagttcatatagaaatacaatataaaagtaaataaaattattttttttaaaaaaatattgggaaatagtttatagtccatatagaatataatttagaaataaatcaaattaaaaattaaaaaataaatattgagaagagtctaaggtccatataaaatacagtttataaatataaattaaaaaataaaaataagaaatattgaaagagaaatatatagtccatataaaaataagataaataaggaatattgaaagaaggggctaaagtccaaataggaatataatttaaaataactaaagtttggaatttaaaaataagaaatatgaaaagaagggtttagagtccatatgggaataaaattataaaaaaatgaaaattcgaaattaaataataaaaaatattggaatggtattctagagtccatatagaacaaaatttaaaattataaaataataaaccactaccacatatatatcacgttagtttggtaagttagtacataatttaaaattatgttatcattttaatatattctaatagtaaaaatgtgaaaatctatatataatttcgtgagaaaaatataacaatctaccgggtgtactgttttaccaatcggagaagaacccacgacgaagccgccgccaccgccgcgcatcgtcttgtccatttcgcaggacagaaaaacaggagttcgcaggtggcacgctgcgttcaccccgcgatcctagtgatctgattcaggcgactagtaactggcaccacatgatcatggttgtcactcgcggctgtcagacagcggagcagatcagcagagcaccatatgcgccatgcgacaagctagcccatactgaactagtgctaattaaattcctaacgggttatcaatagagcggttagctagcataagccttgattatagtggtaaagtgggggagtgaagtgcgctgctgttgacacttgacaggtagctcggccttcttttctctctctctctctctctctctctctctctctgggattctttccgtttgtcttgttgtatctatcttctgtctccgacatgaggtggagagctcgtatttggtggggggccttgggcaaggaagtggacggccgacgtgtcacgatgagccgcaataattgtgctcacaacgtgacaattagcagccagtgttaaagcagtgaacatcacccccacacacagctattagtattggtgtcgcagttgcaggatcctattggttacccatggtttattataaaccgcagcggtttattaataattaaaaaatagtttatagataaaacttttgcatatatattttttaactattcaaaagtaaatgttgaaaaacattaaatttaaatttaaaatttaatttttgacagcggtttataagtcatgggggttgtgtagatgtgaattgtgatcagggtttacaaaatcgtgtggttaaacttcttatttttaaaatcacgatatatctcgtgataaccgcacggtattcacggtaaccacgcggttaccgctagaccgtgggatcacggtaaacccaccccaaaacgctttggggaaacttgcggcctgttatttacacttaaatcatgccacaaatatataaagaaatattagtagtactaattaattaccatcctaatttagaccatctttatattggccatttccgggaacccgggggagaatatcacaggacccaggtgtacacagctccgaccagcttccttcaccaataccgttgtcccacctggctaactggctaactttccttgtcgcgtacgcagtccatgtccaggggccccacctgcagcctcacatcacaaagccatcaaaacccccaccaccccgactccgaaggcgaaggccagccaaaggaaaggagaaagcgcggccatggcggaagacgcgccgccgtcgtcgcttccgctgctgctgccgcggaagtcgttgtcctcgtcctccgcgcagcgcaagcagcagtacgcgcggtgcgtgtcgcacgctggggacgagctccacagcttccgctcctgcctcgcgtggatgtgcgtcgaccactccacccgcgcccgcggcgccgcgtcgtgggcggccttcctcctcctcgccgtcgccgccccgtccgcggccaccctcgcgctcccctccccggtcggcggcggggggtcgccgttcgacgggcaggtccaggtgtcgctcaccctggccgccgcgctcgcctacctcaccctcacggcgctcctccagggccgcggcctccgccgcctgctctacctcgaccgcctccgcgacgactccgaggaggtccggtccggctacatcgaggagctcgcgggctccttccgcgtcctcgcctgcttcctcctcccctgcacgctcgccgaggccgcctacaaggcgtactggtacctcgccgcgccgccgttccgctccccgtggtggtccgccgccgcgtgcgccgtcgaggtcgcctcctgggcctaccgcaccgccgtcttcttcatggtctgcgtcctcttccggaccatctgctacctgcagatcctccggatgaagggcttcgcgcgcgagttctgcaggttcgccgacgtcgccgccgtgctcgagagccaccgccgcatcaggaagcagctccacaggatcagccaccgctaccgccgcttcatactctgctgcctcgtcctcgtcaccaccagccagttcgccgccctgcttgccaccaccaggccgcacgcgcagatcaacctcgccaccgccggcgagctcgcggtaaatcttccttttctgctcctccttttttttttacttccattccgatttatgttaaaaggtaagcagtaattgcttccttcaccgagaaatcaaggtgatgcgattaccgatttggtatgaagatatcagtagcatcatgaacgatctgaatcagaaatatgcattgttcaaagatgcgattcactgcataattagtagtagcatttagcagtaagtaatcactacaaatttatctcttcaagataggaaaatgattcggtggaaatggaaaccgcaattggatacatgtaaaattgggacaggaatgatgagaaggggctgaatcgaagcagtttttagtaactgttaattctgctctatccctgtttctttctacaagctcagaaatatgaattccgctgttggggatagtgaaaatgccagatcaggttgagcaaggtcaagtggctactggctagccacactgtaagtaaagttagtcctagaagaagcttgcacgccctgaaaaggaagcacaaatgttcagataactctagaagtagaacagaacagtgcatgaacctccaccacccaccacatgtccacagcagacaactagatccacattcccatcaccactccatcagtagttgtctgtgtctcaaaagggctatacagctagctagatttgtattgcaaaatgttaaaagagacaaattccctggtagatgcttgaggaaatgcatattcctgaagttgaatatagaatgttatccttcaaaagtaagatcaggaagaacaattaggttgcaaaatggaatgttggaatttctgataaaactgaagtatattttatagtggtcattcagtgggcctttttttttataatggataaaacttggtctttgtttcagccatctgttccttgagaatcattttccatattaaacataactcaatgtgtttgctctgatagttaacccaggaacccagcagtaaatccctgcgttcatcgtgaactctgatttttaccgtgagacttggaagtttttgccgggggacttggaaattttcattctgtcagccactggcttcagtggcctcggtctgagactcgagtacctgacatctgtttgtcgcttcacatgttgtgcagctctgctcgctgagcctcgtggccgggctgctggtgtgcctccagagcgcggcgaagatcacgcacaagacgcaggcgatcacgagcgtggcggcggggtggcacgccgacgccaccatcaacgccttcgacaacgaccaggaggaccccaacccggacctcccccgcatcgtcggctacctggtgcccgtgaacgcctactggatggcctccggcgagtcctcgtcggactcctcctcctcctcctcctccagcgacgacgacgactccggccaccccaagtccaagtacatccctttccagaacaaccactgcttccagcagaggcaggcacttggtaagcgctcacaacaaaacaaaacaaacaaacaaaagaacaaacaaacatatgtgaaagctgcatttcatttcatcagttcgtcctgacctgatcgatgtggtggtggtggtgttttttttgtcagtgacgtacctggagaacaaccgggccggcatcacggtgtacggcttcgtcgtcgaccggacgtggctgcacgcgctgttcatgatcgagttctccctcgtcatgtggctgctggggaagacggtcggcatatcctgaggcctgaaggagcttttgcctcctgttgaagctttcagctctctctctgctctgcagccgtgccgagatttctgatgatcaaagatctctgcatcgtctcatattgcttcctggattgtacaatacaaaatcgagtgcagaaattgcagataatagttcagtttctgtgccatgtccggcacaaaaacgaagcaacagttctgaagtttttagctgtatgtttttctttaaaaatttttatggttctttgtttgaggcagattctgatggagcattagttgtatgaaaaataatgggatgggatagttgtccagcttgatttgatgagattatgagagaacagtgatcgttgtatactgtataggttgatttcatgaaacgattacagtgatgttcaggttgacttttttttttccagatttgttcaggttgatgttgtattcttgttgcgtaggaatctctaacgatgaatcatggttcttacaaagctcaatgacatcccttcctagtgattagatcatttctcatataagggcttgtttagttccaaactttttctttaaacttccaactttttcatcacatcaaaactttcctacacacataaactttcaactttccatcaaatcattccaattttaacaaaattttcaattttagcgtgaactaaacacaccctaaatgtttcgcaaaattcaaaattgccctgtttagtgcacaccaaacttctcccaaacttccaactttccatcacatccaaaacttttctacacacataaactcctaactttttttccaaactactccctccgtcctaaaataagtgcagttttgcattgttcatgttcaacttttgaccattcgtcttatttgaattttttttatgattagtatttttattgttattagatgataaaacatgaatagtactttatgtatgactaatttttttcaaatttttcataaatttttcaaataagacgaacggtcaacgtcggacacggttccccacgactgcacttattttgggacggaagtagtaccaactttccccaaacttcttctcaatagcaacaaactgatatgactgctgtagcgttcctgtcaaatcaacagtaacaggttgcagcatggtaacaacaaacaaaagatatgctcatggatgataataatagctaataagtcgctaggatcaaacgtgcgatccactagaacatggatacaaaacggcagcacatgacaagcaaatatgcccaataagttttcatgatgttcatgttttggaacagcaatcgctgccaaacaaaaaaacccatttgcgtcgatccaatggaaggaaaagaaaagggcattcacaaaatccatgcaaggcagcaccggaaaaaagcagcactgtttttgccctatataggcatgagcagtgccctaacagagatctccgtccaacctgtatcctcggttgctgcctgtctcagcaaagaaaaaggtactggaagaacatgatgatcctctgaaaaccaggcatcaaatgccgcggtatgttattttgcctcccttgcggatggatagaatgaacagaacccgtggtagctccctttcttagatgccatgtgttgaccttacatgagtcaccacaggatggtaccgccgcgaagtcctccctatggcccgaataccactgacacgtccccttcgagtgttagctgaatcatgctggatatcagaggcagcgaccgagctagctgtgacattacgcctaggcctctccctgtaccttctgtaagctctggtgtatgaatcaccactggcaattctcctgccatggccaaataaggatgccaagaagtcaatgctgtcatccaaactactatctgatgactcatagaagtcaagcctctcattcagagtgcgatctaaggatgtgaagaagttgagcctctcctccaagtcatctccatcagaaagtaaattgttgttgctgccaccattaaactcaaccacataatctcccataatgacagcccctggggtcatgcttctgatagtgctaatggcatcctgccgctctctttcacattcaaactttttccactcatctgcatgtgcaggatcaacttcacgaggttttgctgaaggatgcttggaattcacatgcttgcaaagttctttgtatgaaccaatgaatgagcagccatcatgcatacaggctcttttcttgcgattgagatactggcgagctggttcgaccacagtccatcctttgacatccccacgacaaagagggcatgcaagttccattgcacattgttgcttgctggctggctgagaattcaaagataatgaaaggccaggtgaagactcaattaatacactgtgggccaacttctcctttgcgtaagcttctttgaagtgttcgaggcagttagaatgctggtggttggtaccacacatatatggccggcaacccttgtggtgagaagtacagaggaggaggacagcatcatgtggatgctccaggcaaactgggcaagaagctcctttccattcttttttctcagagaccaatgctatatcattttgctcgcatgttcctttcatcttccagcagcaggaaggtaaatcactagaagatgaagatgatccacgtcgacgagctgggaggttccggccccttggagatctacccatctcttcaaaataatataagtagggaactgcaggatggaaggacaattatatgtcaatgctacatattaaaattgcgactcttgcacactattcaggtgctactgaagaatgcatggacataaaattaccacctgcacttaagtttaggacccatttatgttaatgacttaatgctacaaattaaagttgtgactctagcactctattctagtgatactaaagcatgcatggatataaaatcactgcctgcacttaagtttaggacccatttcgaaagtatgattctctcaaagatatcatacgagacaccatatccagttagtaggaatttctgttctatgtaatcccaatgctacaaacagggccttagatattcaattgccaccagaataaatggtaggaaatttacatattttgttagcaatagatatgatattctttgtacagactgctagggcaacttacttttgctgcacagatcctatatacaaaaagctggagattcttatggagggtaacaaataaaggatggtttcggcaaattcccctcccatgcatctgattaacttgacaaacatggtggaaaactgagactgagagacaaggagcatccagcatgaaggcaagctacccagtatgcattcaccactacaaccacacttatcttccatagtccgcattcaccactgcagtaaagccatacttatcttccatggaacatattagacagcctgaacatcacttggggacatgcacaaaatgggggaaatgcaataaagagaacatgaaagaagtttaggtaaatttatttaattcaatctgaagctatgggagttttctttagtgtaaattttgtatcatacctaaatgtctttaggatattaaaaaataattatttccactagatatgtcccaaaaagcgtattgggaccttcatagtttaaactcaactggcctttcacatgaagcttgctaggcatacaacggaaagtagtagagtatgatacaatcaatattgaacacacaaaacacactaaaaaaaaatcaaaaccaatcatcaaagctatgcatatggaaaataggtaaaccttcaaagctctgtaatatatctgaaatgaagcatcaaaatgaagaagaaaagagtacgatatttttcacatacatcagaaacagatttagcacataatgtaacacaaacaattgtacaggcacattcccagtggcggatctaacatgggacatgggggttcggttgaaaccccccaaacctttttgggaaccatcaaactgctactagtattaaggttaaggcaaatttcaagaacggaagctagggttaacgcaaattcgagaaagagtgcgtgggtcgagagagagagagagagagagagatgggaaagaggatctgcgtaccggatgcggcggaagcagcagggcgagcgacggcgaccctcctcgctcgctcgctcgccggatggatggatggggatcggcggaggcggaggcggaggcggcagcggtggggaagggcaaactgacgaggtggaaactcacaggattacagtactcactcactaatggtgagggtaagttagtaatttcgcctagtacttaatccccccggattgtttgcacataccatccccacgaccccaccctacccaaacgtggaaatctgaaaatttgaaataactagaaaatgagctgaccaattataactcaatatttgttatttacggtgtgtttgattcacggtcatgcatggatgggatacggccattcatattttattgaactagaataaatacccgtgtgttgcaacgggtgaagtctattttaattttgttgttgtcatatagttttagttaagatgaaattcgctgtgggagttcgcttggatatatattttattagaaaatcatgagctgcagttagtagtccgatcgtctcaagttagcatgcgagtttttttaaacatatttcttatatgattccttttgtattactaaaaagtgaatgatcttaaaaaagactcagatacggatatgtattttcaaaagtaaataaacttaaaaaccgactaatacacggatgacgtatcaaaataccgacaaaaacatcttcagtttttataatagtagagatatggcgatctaaatttttgtttggtttgtatatatatgatgaccaaatttcttgtttggttggagggatatagtatggatgggaaaagccaaaagtttgtcatatatatttttttatcaaaatataatcatccgatatcttatttaaagatttaattatagtaacaaatataattgtgtaatcaaatcataaattagataaatggtttaggagaaaaaatttttggagctttcttaacaaaaaaaatcaaaccaaccgcgaccaatcagaataggacaaaaacttgatggcttcatccaaccaaatcggtcggatgcactcatccagcacattgagggaatattccttattccgggcagccccgtccaccctacccttcaaccaaaaaaaaaaaggcggccatctcctatccaggctacatagtttctcatcatgtgttggttagcttatcggttgtagccaaaataattaattttttagtggctttagttttcttttcatcatagattattttccatcattttcttttaaacccgctactaacattgatatattatcataaattatttttattgcttagtttatttttatatgcttaccaataatagctcaaacgattaataatatatcctgattagtgggtttattgtgctatatagtcttgttaactttaataaatagctcaagatggtgttagggaaaaggttgagggatgtttttgataaaccttgagttccactttacactcacggctgttgttggcccgatctttcgatgagttgataataactacgatttaggagaaacgttgatgacccgactacaatcgtataagacgttgcattgcgccttatcgatcgatacacctctccgtgggttgttgatcttgccgatacagatcaaccttattccagcaataaaagcaatctgaattacaaataggaattgatgcagatcaaccttattccagcaataaaaagaaagcataatataatctagaatatatatccattttcttcttgtttttattagattaatttcaagtaacgttgtcggagacaaagtttatttcaatatgcagaatgaggataaaccgatctcatgaggatatacgcatttgtgttgcttacctaattggttaaaaggaaaatatttcttcactaaatcaacacttgttaaagagagttaataaattaatctcagctggtagaaacaaaggggtggtaaatatttttgcaacagcaccaggtggttttagcaacgacgacagatctcctcccgctccgtgccagtcccggcggtagcggtggcggccaaggcggaggcgaggaggcacgttgggcggcaggcggtggcgaagaagatggagagttcgtccgggtttgacttgctactgtgcattcggtttgttttactgctgatgtgtgacctacgtgtgggctactgtactgcagaggtgcaagggaaaaacagtcaggtcactatggaaatggatcctctgactttggctacaaagtcacggccgtgcagttgggtgatatcagccgttgagccaatctgacggctcttatttacgtgcctttgctgattgccgaagcaggccaagccggctgtaacatcttcaaattttaaactataatttgattgcatcatgctggcttttgactagattagggtaatttaaaaatttatttgattcttaattggtttaagtgttacttcttagaactctactaatttaccctaactattccctttattttaaaccttagtgaatttgagcaaattctctcaaattccaaacttcaaattattcccttagtttatcctattaatagtgagaatttgctatacttcaaaccctagtgaaacccctccaaactcagagattaaattcattcttttctagggaaatatttaaaaaattctgaaaacactgttcattgcactcaaggtgctcgatgaaatgcctagcccagctagagcagcccaacctctacccaatcttgcacaaagtttagatatggtccttggggaccacaatctactcaaagccgtggttttctttgtctcttcctccccttcacgcatgctgcctagcgtccgacttagccacgcgccgagccgccgcgtgtcggcctcgggaccgcttgcgcgtgcccaaccgccttggcgcaccgccagccgcacgacgctctcagaccgccgccgccacaccaattttggcgacgacaaagccgggactacctccgccgcacgacgccgtgcacgcccgtccaaagccgccgccgagtccgattttgattctacccggggtgaatcgagccaagacttgccgcacggttgaattaaagatagactgtggtttcccctctcacaattcaaaccaatcaccgccgagccggccattttaaccctcgtcgccgccgcgcgtcgcgcctagattggcgccaacacgtcgccagtcgtttctacccgtggtcaagccaatccttcgtcggtaagtattcgaacgtggcctcccgccactcaaattgatcttgcccgccctctcacagcctctgccacctttgccccatccaattcccgagctcatccatggcgatgatggcgtctgagctcatcctttccccctggccctataaataggaccccaatcccttccttgtccatcatcgatcatcaacaaccatagccccacaaccccgaagctttgcttcaccaatccatatcatcaaccattctcgctcgtcggtcgaacaccttgtgcgcgatcgactccacgccctttcaaccatcctccaccctaaataacccttagaacatcttatatcagctatgttctatcatactaagtcctaaccgaagccctgcatcgagctctacctcgccgcaccgagcggagcaccgtcgcccctgctctgctctgtttttcgccgccgagaagtttttccggccgcaatccttcatctcagcttatctcggtgagttctttcgtttaaaccatctatatactccctagattccattttagcaattagtttgcactaccatgccaccctctgggctgccgacgtgagcacgatcgccgccaatggaggcgctcgtcggcaagtattttttgcaccttgccgaaggtcggcaagctacctaaatccctctaggaacttcgtagatgctctaggagccctccccgagccttgtctaactctcactaccccgaacaccttcacagcttaaccatgtcaccgccaccctagccgccagcccaaccacataccaaattaacccctccgctgccgctcaccatcgctggagaaccctagctccctcccctcctcggccgcaaccccttctctcctctatcgccgctgcaatcccaaaccctagcgccgccggccgcatttggggatcggctggaggttgaagaagagaagagagagagagagagagagagagagagactgacaagtgggacccacacacagtgccatttcacatttaattgattttcaaactttagaagccaatatcttttaaaatatagatccaattccagtgaaacttggacaaaaattcttctaaaatcattctctatcttttgagaccccttttgctatttttctattttattctattttctctatttttcttatttttggattttatttgaattccttttgaatttgaattttatatgtctaaccctaggtcttgaggattcttctgacatactagataatatcagtcaatctcaggacattgagcaaggccagttactatacaccttttgatcatttaagcctatattttataaattatttatttatagccttctattcaatactctattttatatacacaatttaaccatagaaacccagataatttagtattgcttattttgcttacaatctggctaaaatatcttatccttagattgggacagtacgttagaattggatgatttccgggtggatagtattgtctcgatcgatatagttattaccaggtacttatgtcgaacaaacgggtacgaccgcagtttctagaatgcggacagacctatttattatgttaattagcaatgtggtacctctgtatagtggttcttatttttaagtcctcgcacaggaggcaactatagccgcgaagagcaaatttaaccattaccatgtataggtaaatggtttgtgatactcaagtataaattatatggtatatttctaaaccctgatcgagatgacgtggtgtcatacgatcagttccctttgaatacctcaggaacgccagaactcctcttgctgctgttaacattacgttcagagcatatgaggatataagttcatggaacagttgccacaattgttaataacctaatactgggccatgactaaagctgatgattatcatcaagtcgtggactgctggtaaatcgtacatctgctgcagtagaatatctttgaaactattcgaatagccgtactcatggaattgagtaccgggactcatatggtaccctggttagaaatttaaagtctacgtatttataaattcttgctataattcttccaaattgtttattactgctttttgcaaagaaccctactatatgctaatgcataacatatttccatgataacttgctgagtattgtgaatactcatccttgctcttataacccctttttcagatttgggtcaagaggaggacccctatgactattactacgatgaccccgataacttagagaatccctagaggttatacctccctagtcagaatgtataaaaacttccgctgtgtattagttctacatatgattaattaggtgagtacctattattgtaaaacccttagtattgtaaaactttaacgtatgcaatgaagaaccagctatattgtatgtatcaatatttactgatctagagattgatacattaattttagtcagatccaagtaattagttctgggacccgacaccggcccatcaactccacgatggtctttcgctgtacgttgttgcctgcaaaataaggggtactagcagatgagtgaacttcaatctaaggacaaaactgaatacataactaaaataaaggcgatgcattgtaacacaagctccataactaaataactagttttcaaaaaataaaaaaaccaaaataactctgtaatattaaggtatcacaaataataagcatgtagtagtcatattttactgctcgatccataatgctctctactagtcttttcttccttacttcaccacacagaaattggtccatggtaaaaattggattttcagttgactgcttcttttacaacgtagaagggaagaaccaagacaggaaaaataagatttggagtgttatattcggtgataccttttattagaaaaaaaaactctggcgacaaaataagaattggcgtggttctacagagctgatgggccggccaagcttgcttcagcgatcagcacaagaagcatataagagccgctggattggttcaatggtggatacaacgcggactgcacggccgtgactttgtggtcgaagtcagaggatccgcttccggtcactattatatagaatgacatgcctaaattctgtatttggtttcttaccataaaaggtggacacacacgatctcatacaatgcatcaaacttatatgttatcgtgaacgtcgagttacacttaacatgtaccagtatgcatatctaaccaattatgatctaccgatccgaagagcctaaccaaaataggtcagcatgagcaacatcaagacaatgaacgtgtgctatgtgaatcttctttatatttgttactaaaaaataatagcatcttactttggaggacaaaaatttattagaaaaaaatccaaataaccccatagactttatttgaaagtccatctagcattctaaagtttgaaaccttacatttagcatcctaaattttataataccggtcatatcggtccctaagg

SEQ ID NO: 69027 - DNA, 5020 bp, Oryza sativa
aaccataatacctgggattatgcatcacgtgtcaaaatccccatggttttgtgcaactttgaccataattaagtggggttttatgaaatttactcgttttttttttgcccctttactagaccagcttagcatatggataaataatataagatgatttcatggggttgtaattaaaggcctattatcataagaaatcttcttttctaaggacattacaataagttggtcatgacactgccatatcattatctatgctataaatacttgaaaagtatgcacaacctttgtactgttacaaaatattgaggcttctagccaatgttatcagcatatttaatccatcgtcacttcttttccatacatcgttgtacataaacacatcatagaaataatattatagagcttgtgtccctatttcatattggtgacattgattcatggtgtgagaggtcctatttgtatatataagtgtttcatagaaaacataatcaaataggccttactcatgaatcatgatagtcgtgtttaagtaaaggtgcattatgtgtctgataaccaaaaaagtacacaagccaacaaatctatgacatgtcattgttgccatgttctaattatgaaagaaggaagtaaaaatgacatagcaaacacaaccattgtcatcatgaattgactgccaaagtttataactaccctttacataacactgtttttttttgttatgttttgcttgtaataacctcttcattttcaaaagaataaatttcacaaaactataagtattttgtacaatttatcacgaactacagatttaagagcttgtttcacaaaactacagatgtaagaacttgtttcataaacttatagatttagtgtattcgtttatcaccgaactacacatttagtgtcttaatttatcacaaaactataggttttatgtctccattataaaacctatagctttgtgataatggagacaataaacctgcaattttgtgataaatgaagatattaaatttgtagttttgtgaaacaagttcttaaatatgtagttttgtgatatatgtgcaaagtacaagtagttttgtgataaacaaagacactgaatctgtagttttgtgaaacaagttcttataaatttgtagttttgtaatagatcgtataaagtatttgtagttttacaaaatttactcttttcaaaaatatattcttgcagtataggattcccgcatggttcaccaaccaaaagaccaaaggagaggtgtatgagggattgaggggagcattatgcaaatacactagtaagtgataattccataaaaaagctagaggttacttccaagcacactaaggccctgtttgtttcagcttaagattattgtaatctagatttatagaattagattactataagctggattataataagccgacatagaataagctactagctgtttgtttctctggattattatctgtttgttagttgttagtcacccaataatctaaaataagcacctttagagtggcttaccagattatagtaatctggcttatagattataataatctatcataataagctatttgtttatttcagcttactcataataatccagattataataattctaagctgaatcaaacagggcctaagtctctgaagattgttgttatgaaggtagggcttggcacgatgagtcgatgactagaaatagtagtggatgagctcaatatggttggacgacaagagaagagaactataggacggtgagaaggaggaatgaagaaaatggaaagggacaagaaggccacaatggtatatatcaaacacaatactatgttttaatatgttatttttacaattcagtttgtagattcttagtgcccttatttaaagagttaatttttagagtactataaattattttttcccttatctttgcttaccagtcttgacaaactaagttaaaataagaagtaaacataacacagaaatagggggaaaacgtatgtctagataagatccactttcacttcacccataaaaagggggaaatcaaattgcttagcattaccaataaaagcaatgtaatcataactattcaactcgatcaaccaaattgtccaaacacaaccaaaatggatacacatgaggactccggcttgcaaccgatgatgcaatcttagactaattaataatagcttttcgacacctaaaatccatacagagaattggtaacaattacatggaattcctaattacatatggtttctccccaaatcaattgagtgcatcagtgcaataggtagacaactcctataaccaccacaaatatatgcataatcttttaaaagttatctttttttttgtttgtgccccttttgaaacccaagcatcagtcacttcaattcaccaagttgatcttgagctatttctcaacagattcataggactatcgaccaaagaggaagtgttcctttgaaggagattggaggaggtggtgaccctagtatctattgcgtatgaattgtccgctatgtttagggaagccattgatgaccggtgaggatcgtagggtttaaggtggctactagtgaaaaggaggatgagaggaatatacaaaagtgaggagggagaggaagaagatgggcgatgacaagaaggttatagtagtatatcgactttgcttcttcttttttttttcagtttctagattttgagcaacattctttaaagtgacattttttatagtggcataaataaaaacattctctatctaccaatctttattcattcagttaatataaaaaataatattgaaaacaaggaagaacaactatctagataatacccactttcacttcaccaaccattaacaataataaaaaaaataaacatacaatatattatctacacagcaatatcatactaatttaatttgattagttaaatcgtaataagagaaaaataggcacaacacatacacaaccaccctgactctaagataaagttcatctagaagactaccggtagtaataacgcgtgagttttctattccaatgaaaaaaaaaggagaaggaaaaaccgtatctaactaagtatagccaccgtggtagccaagagcccccccacgacttaatcctataaaacccccgcgataataatccgcaacctagctccccccaccccctccctttttctctcttttctttttgttgttttctctctcgctcgctctcgcgttgcgcctgcgccccttccaccccgcagccgccggccgcttccaattcgactcctccccctcgccgccgcggaagccgccgggccgcgcgccgccgccgattccccggcggattcgagagactcgtccgccgatcagaggagaggagaggaggcacccgcctccaggagtagaggaggaggaggaggcggcgtgaatttgttttttttttcttttttggtgtgtgtgggtgtgtgaattgcggttcgtgtggttcgtgtctagtgggtgaggcaccccccctagggtttgagggcggcctcgctagggtttgggcccccccgcgcgaggggagggaggaggaggctgccctagcggaggaggaggtggaggtcgccccctggtgttgtggggaggaggaggcggctgaggcggaggtcggtgtggtgtggttgtggtgtcgcattgcggaggacgattgattgtgctggtgggcgctgattggatcggagggaggaggaggagccatccctctctccccgccgttgctaggtgggtagatggtgagaggcgccggctgccatggagcaggacttaccggcgctcaagccgcaatggctggtgcagggccaggtcaccaccacgggagccgccaacctctggaccgtagcttcgccccgcccaggcccaggtgagctccactggccttgccaattttgtgtttttttttcttttcctttgttgcacttgtgattgctagtatgctataaatgtgatatatatccccttttgggaattgctatgtgttatatactgtatagtggcatcaggatatcggtgtgaaaccggtgatagttgttgattcattccatagcaatcagacatgagtttagggttttttggtggttctgtattgagatgttcatgggagcaatcttctcttaatgtactctctaactcgtagttttggttgatatgattgaatttgttatgtagtttcataattgattattaggtgactgatatggaaaagttaagagtaatcaggtagatttcatctgtatctttttacaaccaatgtgtcctgtatcacgaaataatgcttattgtttgagtgctataaggtgtttctaggcacatgctctgttggtgtcactgaaatgtaacaaagcttaagatactactctcttcaaataactgtaaacatatagtgatattgttgaaaatcttatcatgcttgccacaacttatctacaagagagacatactttagttatatgcacaccaagcaagtgattactactcaatttatgacatgtttgcctctattaattatatacatgtcaatgtaataatatcaccgataacatttaacaaagttcatttggtgggcctagaaaaactgaagtgataagtatttgtaatctttataaaatgacatgacattttattttgaccatatggaatagagtacagagaagtttctttggctgtatcagttgatttattgtagtgcttagtttttttcccgataacaaacaccatgctttgcattgaggatgtttgtagagtacagagaagtttctttggctgtatcagttgatttattgtagtgcttagttttttcccgataacaaacaccatgctttgcattgaggatgtttgtgatgtttagtttccactgatatcactggatttatggtagtgcttagttttttttcctgataacaaacaccatgcttcgcattgaggatgtttatgctatttagtttccagtgatatcactggatttatggtag

SEQ ID NO: 69028 - DNA, 1039 bp, Oryza sativa
tcatctggccaccaccgtgaccagaattctaggacatcttcgtcacggatttcctcaaatgggccccgtaaacatgaccgggaccgggatggtatgggaaagtcgaggggttatgcaagttttggtagaaacagggaaagggagcgagagaaagaatttgactcccgtgacagagagagtaggtccattacagcagacggttttgggtcgtttagtacatgtagaccggaaagggatagattgaatcgttcccgctcgaggacagattcatggaataaaggtgtagttagtccaaataattgtaatacctctagaaacaatactggtactggtggctcctttgaacgagaatttccacagctgccttttgatgacaagaggcaagatatcaacagagtaccatctcctgcctctccaattcagagaactgttgcaccggatcgttggaattcactgctagcggatgtccctggctcaagtgagccaaagaaaaacctgggtgtatcttctgtattacgaccggctcctagtaaacagcctgaggcagcgccgaacagcgggatctcattgagcatggcggagactgtgatgcaagttcctttgtcagttgggcctcaggtattgcacataatgagttttttgatacattttgcgattatctcttggctttctggattcatgtgcatattcttctcctaacagttatcgatggaagcccaaaagatggaagaaatcagtttaagacagaacactctaaggcctatgacatctccagcaatcaaatcttcagtaagttatatttttccttgacatcaaaataatgattcacatttagtaggtgtctattgtctgccatcatttgtgattaacttttggtctttggcgagagtctaattgatttccattaaatgttggcacttctatttgccaaatactttagtgatcccataaatgaacttataaagagtttttattgttgggatggatatttcctatcaccattgttgcacagaaaacatttttcattgttcatggtgta

SEQ ID NO: 69029 - DNA, 21170 bp, Oryza sativa
  unsure (1)..(21170): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcaacaggcagtcaggcaccataacctgaattcaagcataattatgaaaactgatgaaatatcgcaaactttccttgaaccgtaacacagcatatctatgtgacatgtttaatcaatcaagatctatagagcaaattatgagcgtgctatgggcatcaccgcgggagggtacgtgaagaggatggcgttcttctccttggtgtaggtaacgatctgcagcgccacgttgagcgccgcgtacagcgcgatgcaggcgaggaggacgtccctgttctcggggaacttgcgggggtagaactgcgcgaggagcgcgacggcgatcaccgccgcgccgaccgccagcctccggttgctcagccgcgcgtcctctgggtaccccttgctcttcgcgacctggcgcaaacccaccacccaccacagcatcatcagaaacaaccgagaaaaatctcaaatctggaggatctcagaagggagggaaggggattgaattagggtttagcgtttgctgccgccgttcacctcggagacggtctcgtcgaggagatgcttgatggagtaggggtcgaggaggttggccttcttcgccgccggtgagggggtggcgccgccgccgtcggtcgccatccgcgtcgtcgccggcgaaacggaggaggatgcggtggggaacagaatatgatgcggatgtttcactgacgggtgggcccgggtatgaggtggacagtgttcgccacgtcggatactgcgttggcttgaaccaatgggagaatacgtgggagtccacgtcagcggaaaacccaaactagtagttttttttcattttaactaccatggtagcattattatattttctctcatataatagcatatatgttttctcaatgtattattcaaatatattaaaatgacaacataattttaaattttgtactaactttacgaaactactaatgtgtaatattcctattgtattttatatatgtgttagttattaattatttttattattgaattttagttatttgtaaattatattcttatataatttctttttttaattccaaattttcattatctgtaaattatatttctatatagactcaaggctcttcttgcaatattatttatttttaattcttaatttttattatttctaattgtatttctacgtggactctaaactcacctttcaatattctttaatttttaattacgaatttcagttacttctaaattgtattcctatattgactttagagttttcttcccatgttttttcttaatctcgaattttagttatttgtaaattgtatttttatacggactctaaactctacttttaattttattctgtttattctgaattttagttagttttaaatttctatatggattctatactcaacttctaatattccttattttttattccgaatttctattatttcttaattgtatttctgtatgaactctatactctacttctaatattccttatttttaatttctaatttctattatttcctaattgtatttctatatggactctatactcttcttctaatattctttattttttttaatttcgaatttcagtaatttataaattgtatttctatacagactctagtctactctttcaatattccttattttttaattctgaattttaactatttctaaattgtatttctatatggactatgtttttctttttctccaattaatatgagaatttctaacccgtgagagcgaacgtggaggctcctttttctattcctttaataagttaactagctgggtggcccgcgcaattgcgcggctagcacccatacaaaatcatatatttttctagtataattttacttaaaagttattaaatagctatctcattgtcttaagactttaaaagaccaaaccttatcatcctcgtgtttctaattatatagtttttaaaagtcacgtcagttgctaccccttatgtcatctacttctttatttgcttgctcgatctactactatttctattcattcttcttagaacctttaaaaattagattttatagtttttagagtttattgtcatgttgggtttcatttttataatttctagatgtcccgtcaaacattgccattatactcctctactgcccgtccactatattttttctttgttgtcattgagattttaaaaatcgaacataattatcgtttggatttattttttactttctaaaagtcccgccaaaccgtcagcggctttgccattgtactcctctacggctcgcccgctgcctcccttctttattgtcattgagattttaaaatcgaacatgattctcattgttttttattactttttagaagatccgaacctttaaaaattggacttgtagttttatttttttatattttttaagaagtcccatcaaacaatgccactatgcccctctacagcccatccgccgcctactatttattgtcattgtgattctaaaaatcgaacataactatcgttggaattcattttttttttattttctagaagacccgccaaccgtcggcggctttgcaattatactcttatacaccccgcctgctgcttctcctttttattgtcactgagattttaaaaatcaaatatgattatcaatgtttttttttactttctagaagtcccggcaaccgccttactcgtttgctttatggcctgcctgacttccctccttttaatcgtcattaggattctatttgatgttctattaataatttttatatgtcgtatcaaccatcaccactctactcctttataggtctataacttaatttatctcgtcatatattttagatggtcttttctttcaataatctttatttttatcacaaattttagttatttataaattgtattccaaattgaaatcatattcttttttttctaatttcagtttttttttaaatttagttaataccgtattgtgttcttttaatgtttttatttttttattttcaatttcagttgtttcaaaattgtattcctacttgaactctcttttaatttttctaattttggatattattttttattctaaattttaattaatctcgtattgggttcttatatggattcttctttcaatattgcttatttttaattccgaactttagctaattttaaattatattcctatttgaactcttcttttattttcttttgctaatttcggatttatttatttttattctgaattttaattaatctcgtattgggttcttatgtggactcttctttcaatattgcttatttttaattctgaatttcagctatttttatattgtattcctacttggactctcatttcctttcctaattttgtattttattttatttttattttgaattttaattaatctcttattgggttcttatgtggaaacttctttcaatattgcttatttttaattccgaatttcagctatttttatattgtatttctacttggactctcatttcctttcctaattttgaattttattttatttttattttgaattttaattaatctcgtattgggttcttatatggaaacttctttcagtattgcttatttttaattctgaattttaactatttttatattgtatttctacttggactctcaatcctttcctaattttggattttattttatttttatttcgaattttgattaatttcgtatcggattcttatatggaaacttctttcaatattgcttattttaattccgaatttcagctatttttatattgtatttctacttggactctcctttcctttttctaattttatattttagattttattttatttttatttcgaattttgattaatcttgtattgggttcttatatggaaacttctttcaatattgcttatttttaattctaaatttcagttatttttagattgtacttctacttggactcttcttttctttttttctttttctccgattaatgtgagaatttctagcccccacagcgaacgtggtgcctcctttcaaagctgttttaacaatataatagatagatagattattttatttttgtttcttaattaaaattgtgatatttatgtctctttgcctccctagagtcgaagagaatgtattcttttaaaattttcaaatatcagttgaatttggatttcaatggaatttctttctattttggtgacattcagaatgaaattccatcttttcttttctttttttcaaactagcttgaagaagaaggaagaaaggatatccgatctccagtatacctagcaattcgtaaaattgaccaaattcatgtaaaatttcactcaaatatttttacatttaagccaaataacgtatatatactccactctccactacactgtcatacattttcatagccgccgccgtctcgcggcgatcgaactccacaactcacgccggcggtggcgcggaagaggaggacgccgccgccgccgcatcctcgctgtcgcggggcttgccccgccggagctggcgagcgagcaacgccagacacgcgccgacgagggccacctgcaatgccgcggcgacggcggcgagcgcgatcccgaccctctcgccgaggttgagcttgagccgccgcttcctctcccctccgtagccccgcgggggcggcggacgaggcgcggcgctggtggtggtggtggggtggaggcggcctcggccgggggacggggagggtgccgccgacggcgcgtgggccggcggaccactgttggcgccgccgctgagccgtctggtggcggcgaagccgacgacggagctgggggaggtcgtaggtggccgcgggaggagcaccagcaggaggaggacggggatgatgacgaggagtgctactgctgctcgcggtcgcggcgccatggccggcggatgagacgacgccgccgctgcgcctgcggaggcggcagcagcatgggccttttccgcgatgctggtgtgggcggggcgatcgatcgagcgtgtggccgcggcgcggcggccggtcaggtcagtgtgccgtgcacgagagggaggggaggggaagcagctagcgagcggcgggtggtgtcgcgtcgtggcgctgcgctgggaagtcgcgagagtcgcggatggcgatggtggatgggggtggggaggtgggggggggggggggaggactgatggtgatttcgcctccttctccgccggctcaggtcgcagggggtggttgcaacttccaactcctaacagctcaagcctacgacgtacgtcaagaattgatagcatatcctaaagggtaaaaccagtgatcccttgtaacaagaaagaagaaactgaatgatcactcggttcgatcaaccgaggggttgttattttgttggtgtctaagtttgccacagctaactttagataaaaatgtggcatggctcgaaaccgtgtctgtgaattagtatgctataagtgtggcttagttcaaaagaaaactaagtaagtaaacaacttatgggcccaaaatataaaaaggagtgataaagtctaacttggggtctagcactctccttcgcctcgtcctctttaggctccagcaaggccggcggctctggtgccgtatccaagctccaagacgccgggagcaagccatgcctgggcatcgcctcggctgactcttccataggtcgtcgctctgagcttcctctaccactgactcctccactggttgcggctctgagctactctagtatggcgtatcctcctatcgttgcctcctccaccggccgcgagcgtggccactggcagttcctcgatgccggctcgctcgctgtctcttcgacgttgttgggccctggatctgttgccgtcccgcgctcttgccgctatttcccggaatagacgatgaggtggagaaaatgaggcaagagaaaaggaagagaggggaagaaagaagacgaggcactgatacgtggacccagtatgttgagtcaaccgtttagaccaagtcaacgtgccatgtcaactaaaaccaccctaaaaaaagttgagcaagtcattttacctggttttaatagttggagaagtcgatatgcccagttttatggttgagagataaaaatcttatccgttctatttgagggggtctaattggactttttcctttttttagcccagctcactaaggaaaaagtacaccgaaagtccctcaacttgtcatcgggataaaaaacgtcctcgaacagcaaaaccagatacgcgaggtcccttaactatataaaaccgatcacttgaggtccttaggcgattttgaccctggttttgtcctacgttactgctgagtcagcgtgggaaccacataggccccacatgtcaggatgccaactcatcaccttccttccttttcctcctctctctttctgggcggcttctcggcgaggctaagcggcgatgcagaggtcagcaggcgaggtgggagagaggagggcggcggcacgacggcggccggcgcccggcgggagaagggtagggcggctgcggcggtagccagggggaagcgcgaagaggacagggcgatgtcgcgccgtcgcctacacccgccgctcctcatgctcgttgagctcccacaccggcacgctgcgcttcacgtcgcgacgccgtcgtaatcgccgcaccccacgtgcgccaccaccccgccgccgcccggccgccacggtgagacgcatcggcgcttggcctcctcggcctcgaccatgcggtgggatgcctcggcgagtcggtcgagcgcctgttgcacggcgtcgcggccgccgataaggagccgcgtccccgaaggatgtcccgatacagcccgagcgcctcccgccgcgagctcgtcagccggcggcacacctcggcctccgccgcgtctctgtcgagcgccctggaggaggaggatgagggggacttcttggcgacggggagagcggcgcctccgtcgcccccatcgtcaatggggaggcgcgggtgtgtgcgggcgtcgacgggcggccggaaggcgcgggcgtcgacggggcgaggcgggagaggaggaggacgacgccgcggcttcctccaccgcgcgcagctggggggaggggagaggaagaggtccggcggccgtcgtccccgcagaacgacgacgacgaggaacgggccgctgctggcctccccgcctcctccctcttcacgtgctcgctgtgggagttgtggggaaaggcggcgctctagctgcaagtcgactccatccttgtcgccgtcgcacaaagttgccgctgccattgtgtagctcgtcaccggcgaccagacctcttccgctcccgccgaccggctcgccaaaacgaggaagagagagaggaagaagggagagaagagggggggacccgccaaaacgaggcactgcctccctcctttgcgcccccggccaaagcagtcgccacagcgccgcccatcgccggctgccccgccagcctcctccgcagtccgcacctgccggtcagcctgagaaaagtgagagactgagagagaaggggagaggaggggaaataagagagaggtgatgagttggcattctgagatgtgaggcccaccgtgggtcccatgctgactcagcagccacgtaggataaaactgggtcaaaaccacctaagaacctcgggtgactggttttatatagttaagggacctcgcatatctggttttgcggttcgaggacgttttttattccgatgacaagttgagggaccttcggtgtactttttccgctcacatccaaatacttctgtcactgaggcccatctagcaaacaatattccggcccatgaaaactcccgtgcggcaacgcacacagcttcgcaatctccccaccttatcgtcgtcgtcgccactgtcccccgtgcccgatggccgcgcccgcgcccacagcttcgccgccgccgccgcccgccatgtccggcctcctctccttcgcctcgtcccgcccctaccctcccctccccgcgcccagacccgccgccgccgcccccaggccgcgcctccgcatagcgggttccgccgccgcggcccccaacgccgtgtcccaccgggcatcctcctccttctcctccggagaccgcctccgctcgctcgtccgccgcggggagctcgacgaggcgctccgcctcgtcgggtccgcgcggaggcccgacgcgggcacctgcgccgcgctcatcaagaagctcagcgcgtcggggcgcaccgcggaggcccgccgcgtgctggccgcgtgcggccccgacgtcatggcgtacaacgccatggtggccgggtactgcggcgcggggcagctcgacgccgcgcggcggctcgtcgcggagatgcccgtggagcccgacgcctacacctacaacacgctcatccgaggcctctgcggacgcggccggaccgcgaacgcgctggcggtgctcgacgaaatgctccgccggcgatgtgtgccggacgtggtcacctacaccatcctcctcgaggccacgtgcaagaggagcgggtacaagcaggccatgaagcttctcgacgagatgcgagataaggggtgcaccccggacattgtcacctacaacgtcgttgtcaatggaatctgccaagaaggacgggttgacgatgccattgagttcttgaagaacctcccgtcatatggctgtgaaccaaacacagttagctataacattgtgttgaagggcctgtgtaccgcggagcgatgggaggatgccgaggagctcatgggcgagatgggccagaagggttgccctccaaatgtggtaacttttaacatgctcatcagtttcttatgccggaaaggattggttgagccagcactggaagtccttgagcagatccccaagtacggttgcacacctaattcgttgagttacaacccgcttctccacgcattctgcaagcaaaaaaagatggataaagcgatggcgtttttggatttgatggtgtccagaggctgttatccagacatcgtttcatacaacactctacttactgcactctgccgcagtggtgaggttgacgtcgctgttgaattgcttcatcaactcaaggacaagggctgcgctcctgtcttgataagttataacacggtcattgatgggcttacgaaggctgggaagacaaaggaagcactagagctgctcaatgagatggtcagcaaagggctccaaccagatattatcacatactcgacaatagctgctggtctttgtagagaagatagaattgaagatgcaattagggcatttggtaaagtgcaagatatgggcataaggcccaacactgtgttgtacaatgcgataattcttgggctttgcaaaaggcgtgaaacacacagtgccattgatcttttcgcttacatgatagggaatggctgcatgccgaatgaatcaacttacaccatattgattgaaggcttggcttatgagggattgatcaaggaggcacgggatttgctggatgaattatgttcgagaggtgttgtaaggaagagcttgataaataagggagccattagactgcttgattgaactatgaatacatataagaggatcaactgagtatcgagggtctgagaatgagattttgtgcatcttcgctcttcagcaggagaggagattttactggatgttcacctaattgatgttgctttcttgacaacatgtgagtcctttcatccacttcccaccttacaggcttacagcccacttcagtcttcgagttgcttggaatttctgcataactcttgtcttatttaacatactttaccttattgttgaacatggtctcatgtttcacattcttgtccttacatgatatatcatactagtgtgagatacatattagacctgttttgattgggcatttcttgcttcaatatgctttagcacttcatatgaactagcggaatgaagggatatgctaagtgatgagcattaggctacctgttctctctactcctgtactgtaagccagagttgacttatcttagtcattgacacggtaatgacaccctaattggtttcaaactaaacatgccgctttctcagctgcagttctacagaattgacttgggataaatctaagactgtgagctacagaatttgccaattcaagtagaaaacatgaaaaatgaccagttgattactatctgaaactccctatttacatctaaattgaatgacaacataaaatttgaactaaattttagaaaaggctggaagtccagatttccctttggattgtgggtaccatcagaaattggtcagtgcccagtgatgtgattcaaaacttctttctcaatgagttattttccatgcttgtgatgggaaaatgatgaaattattggattcagtccttcaccactaagacattgatggcacctggccactttatgtcaaatgtcagaccagaaacatgattttcacttatgcagttaccatccttaggcgtaacctttccaatgtgtcatattatactaaagtcgctgatttagtttatattttaattaatttgctctgtttttattgcagtcttgccgtgctcaaatgctaatggaggtccttttctcagattgccaccagaaggtacttgaacaaacagtgaatctgagcctcactgtccatcaaaactgatctgtttatatatatgcaaggcactgataaccttgtaagttgtgaacctttgcatataaatttgtaatgattcaggctcaccagtatatgatgccctcctgtagctaatagtttttcccgtgtcaaatcaaatgaattttggtttaggcataaccatttagcttattattgtgtgtcttcccaattatgcaatgtaccaaaaaaaatgcatcttaggtgtacatctatgcaatgtgcaccatttaatctccatcctggccaaaacctgaattcaggaacaggattttagccccagctttgtagttccaacagaaaaaaagaagaagaaaaactactattaattccaaagttctatacaaatataagaaaaagaggcagccatggaagttcttgggaatgcatcatgcaatccttggttctatgcaagcttttgaaggaccttaaaattacaccatgacacgacaaagaataacttaattcattacaccagttagcaaaataccccctctatatgtaatataccctgtggtaccaatggatcagtgttttacaaaaaatcatgccgaattggtgctcctccaagttgcatggcttcttaaaacatacactgcctgatgtgaaaacacaggaaaccatgcaaagtttgtgtggttttttttcccctgtctgcctagagcagaactcccatacaatctgatcaggcaggtggtggctctgcaggcccagctggttttgtattcagaagaggctggattgccttcacgacgatcgtcatgttcggtcggaagtcggcttcgtactgaacgcacaatgctgcaactgctgctagctgaaaaaaaatcatgaaagaaaaaacaatggcactcactgctgctttctgaattttgtcagatttgctacagtatagctacctttgcgacagccttcggagggtaatcattgttgagctttggatcgacgcactgcttaactttatcttcgctcaatcttggagtagcctgcctcacaaagatcatggtatatgtaagatcattggaaatggaaagattgaaataggatatattgtaataagttatcttttgttgaaggataaaacttctccttacccaagtgacaagactttgttgcccttttggcatggtgtgatcaactggtttccttccggttagtagctccaatagaatcacgccaaagctgtaaacatcgctcttctgatttatttgccctgtcatggcatatctgaacatcaccataatcagaccaacaaatcgtcagcaagtaaatcctgcaaaaggcaaagcatgctgtacagtctgatacgcgagaaatcaatcattctctcccttactctggagcatggtatccaaatgttcctagcaccctagtcgaatgcaaccgggcagcggtgtcggtgccctggttcgtcaggttgaaatcggcgatcttcgagctgaactcgtcgaatataagaacattgctagaccgaacatctcgatgaacgatcgatggctgcactttctcatggaggtactccagccctctcgccgccccataagctatcttgacccgttgcgcccagttcagaaccgggccgggctccgcgccctggactcccttcttacctgcatcacatccaaaaccattaattagcttagccctacgtgtggagattttttggctccgccccctgatcacatgggcgtaaacttgtcgggattttactgttgctctttatctcgtgtttgctttaaatttgggagtgtttttttaagtttactttgaagtacacttgcttcgagtgatttggtgtaataatcggctgtagttcgttgagtaatgactgggatggttttctattccattatgtaagaaaaacataaggtagtagtgaaatggaaaagacttattaccgtgaagaatgttgtgtaaagaacccatggttgcaaactggtaggccagcatgcggttgccgtcttccaagcagtagcccaagagctccaggaagtactcgttcttgagcttggacaccatcgctatctatggcgacgagatgaagatgagcaaaaagctaagatggctcatgtcgcgaggaggaggaagaagaagaagtggggtgttttggggcacacctgggcggagaactcggagtcggtctcctgggaggcgccggggtcgagcttcttgatgacggcggcgcggccgtcgctgagcgtgccgttgtagacgcggccgtaggagccctcgccgatgagggcgcggtcgctgaagttgctggtgatcttcttcagctcctcgaacggtatcgccggcacgtcgatgttcaccggcttcggcggcccgcccggccgcgccgcccccggccctctcggcccgcctctattccctgcttccatccgccgtcgccggagaagaagaccaagagacggtcacgaaatcggtcagcaaaggaggagaggaatgtaggaggccgccgccgccggagaagaggaatgtggagacgcaccgggagcattgacgttgggcggcggagcggcctggttcgccggcgggccgtagctgtcctcctcggcgcctccgcagcaagacatcttcttcttcctcctcctcctctcgccggagttggatgcgcgggctgatctggtggccgccccccgctcagcggatcatcgcgcacgacctgcaaaccattttcgattaattcctcgcgtgcacaccaacagattaaatccctgaagaatcaattcacgaaacggatcaatctctttccgaggaacagaaaattaactgaaaagaaattaaaatcaacgcacaatttccagatgatcaagcaatcatcggaagcaatgaggggatcgtggatcaagaaaacagaggatgcatgcatgctccatatgcgatctggatcggcatgcagaaaacggtagaaattcttacctcccccaaagattcccgcacgagatcgatcgcttcccgcacgagatcgatcgatggcgatcgatcgagggggggcaaagggaagaacagcggtgttttgttccccgggagaagaggttaatggtggggaatggcgggagctccccctctttccgcgccaaaggagccacacccccctggccccctctcccacccgttttaaccgccacacgcacacacgcacgcacggacgcgtcaattaattggagtaattaactaacctctgtgcttgagcaccttccccattattattgactattgttagcacgatcacatgatatgaaactatggaggtgtgccataatctttagagttaattggatccatatcattataaatttactcgttttgaaatacacagttaatattcattataaatttactcattttaaaatacacagttactattcatgaaactaaaagcatgccatcatgattttacaggtattccaaatataccactgtttacctctttgaagtattatcaatttttttgaccaaaatgcatgtccctttcttcttcctttcccttttcctctcttccttccactggcaccgcagcaatgagcttgggcgcggagggcatccatcttagcgattgccgcggccttctatcctcgaggcgtcgttagcggatgcagagccgccacttcatttcatactggagctagagggattgaggaaaacgattcaaatagtaggtaatggttgcgtagaggctgacatgtcttctggtagggaagaggaaggttaactccattgccaccaaagcccctcccatggctcccatcctcggtggtcggtgtggtggagtagcatggacgcgggaagggtagatctaacgcggcggcgggaagaggcccgacgaggaaaggaggtggagctcaccaccatctcgccgtcctctgacgtcactggagaagagatgtggtgcttgagctcgagcattgtctacacgacggctatggtgtgcgccaatccgtgcttcatgggcattgcctcctctttcagggtaaccacgagctcgcatgcactgtcatcgcgttagcttcgctcgtttcgctaccgatggcacttgtactctcgctgattggttcgccttgcgctcactcctagacattgctatggcactggtggaaaggaagagaggaggaaggggaaagaaggaagaaggaagaaggaaggggcattttggtcaataaatttctgacaatgcttcaaagaggtagtaatagcacatctggaatgcctataaatttgtaatggtatggttccaatttcacaaatagtaatggtatatttcgaaacaggcaaaattataatggcatgaatccaattaaccctctttacttaggagctcattaaatgatgactatatgtttgataatacaggaaatacaagcatatacaaactcttctagtatgattcgaactcatatgcaggtagtatcgagtattcactttaattttctctctcccgtatcctttccacgagtctaatatctaacgttttgaatttgcatgaggatactaacgcactagaatagataccatcatcttaatcggacggtaagccccatctcaatcgggcacggcgttcgtcacatgctagaagtaacagatatgaacagttatctcaatcgggcaaacggccgtcacggatgaacctatctcaatcgggccctaattaaagcccgtcaccaatagctttgacccagattaccagtcaaactatagcccgtcacggatgatctatctcaattgggccacaaatagcacccgtcacagatgactactaacctcaatcgggtctaagctagagcacgtcagggatgatactcatctcaatcgggcctaaactatagcccgtcacagatgaccatcatctcaatcgggcattaactatagcccgtcacagatgacccttatctcaatcaggcactaagttatggcccgtcacagatgagtataatccacaaaaaaataaattttgttttttggctaacctcaggcctttgctagccatgcccgttgcaaaaatgacagaaacacatgcatatacaatatccccagcatcacccattcatatacatgcactcacatacacagctatcaatatatttcacacaaccatattcacagaacatctattttaatctcatatttcacatccattcacatattttacgtcgattcacatatttaacatatttcacctgcaaaaccgagttaattggatgaaatatttatttagcaagtattaacatagacataagaaatatatacataaatataaacatcatagttacataatcaaggtcttaatcaatgttcatcattgcctaaatataaaagttcaacaatattcattattttagtttaagcctaaacattcctttggggttaattatttcgcggaggatgaagccggctatctcctcacgaatctcctcaaagttggtaggcagagacttggtaattttgccctacattgtcataattcaagattagttgatcgatcatatatatgtacatcgatgtagttagtatatcacaattaagaccaccgacctcaaattcagccaaagtcttcaccttttctctgtatatatagaaggcgcatgttgtggcacacatggaatccgtgctggtcacctatttgttacttcaccgggaagtcttttttgtggatgagggtgtcatgtcctatcttcctgaggcctcctctttacacgtattggccccacacttcatctatcgttagttgaataggggtccaatcatatgcctgcttatcaattctggagttcaggtagtggcatgtactccacttaggtgttatgaccagaaggattcaatgggcactgcagcattaatatagtgaaagttaaatactaaagctatatgtgtcacgctgttgtgtatatttagggaacacacttactattgattataggcgcacataatgtactccttgtctcagcgggaccacaaggtgtcgtagatgtagttgaacattccttgacggttattctcgagatttgtgacagtgaccacttatggatcaaggaaggcgacttctggtgcatttttctgacaccattgccaacttaacctacacgcaagatacacgggtacccacttttctatcccgtatcctttttctcgagcctcatgtctaatgggctgactagccgttttcacaccctaagattaattgtttctaagttctaacaaacagtaattcaactgatgtaacagaaacctttttaccattgtttctgacctgacaagcatccaatttttttgtatcattgcaacgatcagaaattccactggggtgacagacaaaatacatgaccttgattttttttctcccactacaattagtcatctcctatgctctatcaatacatatgaggtaaagcttatgctctcttattttcttaagaaaaaaaagccatctcatatcctttcttcagttttgggcctccactgtgacgcttgaaacgattggggaccaacaggtccacaccttctgtgggccgcatgggccgggccgtaggcaacgtcagcgcgcgcgatgcagcacgcgtgcgcgcgtcaacgtcgccgcgcacgcgcgtatccaaaacctgcaagttgcgcttattgctgactcgggccatatatctatccaacttatgcgttggttgaatatatgtgtgcttgtataccaaaagggaattgatgtgtctccatcctattctcacttttggaagctatatgtttgatttggagaacaagttgtgtagtagggctcgtttttttttccatggtttagaattaattttgaagatagttccaccgcttgctcttaagcttaacaaccacatctaaaatttaaaatttagaaaatccaaatttggttgtagcttatagtcgtccattaatgataacactgaagaaaatcatcggaaaaaaatatctacttgattttaaaattaagtactaaaatccgaatttggttgtaccttataattctatatattgctctaggtgtggttgttttcgaaatgtaagctgtattagttcaacttgtgtcacaaggatgaagaaaataaatcaaatgacttagttgcctttaatttatagtacaacattgaaaaatatgagtcatgtacttttttttaataataacatttatttagcaagtacgtacaagaagaaaaacaatagtgactaaaaattccaaaactacttacatttacattttgagttgagaaggataaaacaacttaattaagtacaaattcaatgtagcttttagtttttttttatttacaggattaatctagattctttttatgctttaatttgttaggttatagtttactgtttcatatttagcaagatccacgctaaaaatataataacattctaaaaaataagttataatttcatttgtataaattaaagaaaaaagttaatatattaattgtttgagcgtggatctagtagttaaaaagtgttgaagaaataaggaaaaaaaatctttcaacaaaaagatggccggtgaaaacggtacggaaatttccgagatttccagctgccatctccagtttgcatcgatcgtttcagtcggtattggtaaccgattatggtggaaatggaaacagtaatatcttctggaaatgatagtgaaaatgggatggaggtttttccaccgttttggtcggtaaccgtagttgtacggtattttttgtcaaaattccgaaaagatttcaaaagttccccagcgactcagccagctcaacccatcggaagcccataaataaaagaaggctggtaagcttgcagcccgaaaaaagaggaagtgacaagggaaatgttgttaaccctatgacatggctgacatggcatgtggattttggtgaactttggtctcctcaacttatcaatgttaaagtattgttgaattttatttatagggaaaatttgaaccatgccacatcaattttgcaaaatttttgatatgccaccctgacccacatgtcattgactcatgtgggtcctacatgtcattgagatacgggtggcatatctcaaattttgcaaaattagggtggcatggttccaacaaaccatttatattgcttgtcaaacttattatcatatcattaatcatcatataacagtgttatgtggagtgtgacgatgcaataataaagttaaaaagtcatctacgtgcatagttaaatgtgtgctatgccatactccgttgattccgacatgaattttcgatttctgaccaatagtatattccgttctgatggtattgtttccgatataccgatattattgatatcgttaccgttttcgggtctaccattctaattccatttttgagaaaaaaaaataaaaataaaaatggtacatagtttttctaaccatttccctccttagatggccccatatttttcagccgtcggaaatactgtgtgtccatattacgtcgtccccagtatcatccggccggaacccgtaaatgcaaaagttaacgaatgcgacaaaacaatggcaactccattctcaaatcgtgcgattttacttgtttttaagcatcacacatatcgcaccattcttttacacattaatttacacacgtacgcttgaaaattaccgaagtcaaacaaaaacatatcacttaattaattactatacacatgttttcccatcaaatgcgcacgtcaatctctgattaattattctacctaaccttaggtcacattttgagccattaggtaattagacatttagaccccaaactgtaatatttaattaagaacccgacacgtatgtgtcatttggttagctaattaatatttgacagaattaaccatgcgacagcagacatttttttttttgtgtgtgtgtcaattgtatcaatcgatctgttgctgtcttgccagcataaattgtctttccatgataatcatcatcgttggaaaatttataaggcgtgtcaagggtttattcctgttggtgattaattagtacacgtacgtgcgctgacgcgcgcgtgctgcatgtgcgctattagcagtttcatcttttctgctagctactcctactatgcatcaataatcgttggcctattgctggtatacaggggtggagccaaaaaaatttctacgcctagaactcgagtagggcttaacttataggatatttgctctctcaaaaaatacatagtgatttaaaaggatttaggcatgtttatagagacactgcccctgcttgtaaaaacgtgcaacactctgtgttcgtttctccaacaagacatggattaaattttagatactcgtggcatatttttcaaactactaaactgtgcgtttcgtgcaagaactttatatatgaaagttgctctaaaatatcagtttaatctatttttcaagtttgtaataattaaaactcaattaatcacatattattaccacctcgttttacgtgaaacaatctttatcttcatcttcatcttcaggagattcaaacaccacaatatatgtatttatgccactaattaccctgcaaatatttttggatgagcaaaaatgctaatcacagtatcggtttttttaaccaatagagaaaacttctatcaatattttttaatgaaccggcaaaaaaccgagtcaagccgagccgcatgtggggtgaaatatcatataagtcgtgtctctccctctccctctcttccttctcttaattcttctctacagatctaaccacttcattcggaggtgtctacatttctaaccgtggctcgactttggcttgctcttggtaggcaactacatttcagcatctcgatgctgaagggtcatgttgtagtggcagcgggcgcagataatatgaattgcctagagaatttatgtggcgagctggcgactagggattaacggagcaggcaacatggttgtcccttcaacaggcataccgctatactgagaccgttagatctggtcaccatgagctcaagggtaaacagatttgtaaccaacacccattataaacgtaggcgaatatcaagattaagtacgagcat

SEQ ID NO: 69030 - DNA, 4808 bp, Oryza sativa
aaagcagcatttagcaaacatttgagaatttgataaaacagttaagtaattaaacaatattaatccaacgctatacaacataccctgttgtataggcccaaccattctgaacaaccatcccggctgcacagttctatctccaaaccaggaatgtaccattccaaaccaggagctaaacaaattattaccagattaagcatcttttattatgatgagaggtgtgagactaatcacgaaagacattgttagacccgcccataaccgcgggcacggctattcgaatagttttactctggccagaggtgtaccactgtacccacaagacacaaccccacatcatgtcaccatgtgcctcaataccaccacggtatctcggaaaggagttgtgacaatacccctcgcataacacaatccattgcagcgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacgataaatgtttcacaaccgaaactcgtgaaccggtccttaattgtcatgagcacgaccatcaaaaccatgtgctcacaaccaaccattaccaggttttagttggcacattaattaattaactaatcacgattgaccatcgtgaactatcaataagccatcatgaaataatagtgaatcattagttatcccataagtgtactaatgtttctaagcagggctaagcaattatatctaatatctagttgaaccaatataaataaagctcaactagtcaaattgtaataacccaaggtatcaaggaataaggtaatcaatgtacaaaagggccataacaaagaataggtcaattccacccaatgacattcgaaaatagatgcaatagttgaatagaaacaatagctttaaataggatcaacatgctcaaagggttgtttgggatctgtgtgacttgccttgctggccttggaactcttcaaactcttcttctgcgaaaacggactctccggaaacgacggaatctaagcaaaaagaagcaaaatcaccaaaacagcacataaacaagcatgaacagtacatgtggatatttttaatgtgtagatctcaattttagaaaaattagagacttgaaccaactaaatcggagctaagatgaattagttatgaatttttaaagattaaatcggattaaaacacttaaatcggtttaaattgaattatgacgcaataatgaattatttttgaaaaggaaaaggggatttattgcgtcagcgggctagggtttggtggaccggcgcacgggcggcggttcacacgaacggacggctgagattgttccgatccaaatcggacggccgagatcgatcggtccacgaccggctcacgggagaggatcccgatgacgtcaacgatgacatcaccaacgacggcggcggctcggcgaagaagacggctcgggcggcggacactcgccggcgaacggcggcaccacggcaccaacggagggcaccagcacgtagaggacaacgcggcgaacacaccggtgaccaaaacggcggcggagaaggaacggacgacgacggcgacgagaaggaacgggttccgacggctgcgaaggggcggacgaggacggcggcgacttggttagggtttagggtttagggtttagggtttagggtttagggctaccttcgggttgtcgacggcgacgaagctccggcgggttccgacggctgcaaaggggcggacgaggacggcggcgacttggcgatgacgacggcggtcttcccgagcggcggcgacagctggagcgacggcggagcacggctgaagcggcggcggcgaaggcaaagctagggcacacggcgctagggctactccggcgacgagaggcgaaggcgagggtggcgacgggtagaggagacaccgggggtccttttaaaggggctcggaggcggcggcgaaggcccacggcgacggcaacggcgaaggaaaccttcggcttggagagagggaaaaccgatccgaatcgaactcgattccaaagctttccaaagcgatttaaccaaagattccaaaggagaaaaggtagaggagatcccggagatcatttcccctctattgattcggccggagaaggaaaggaacggccggatttggaaagcggcggcgacggcagctcggcggcgcgaaactagggtttcggcccgaggaagacgacgactgacaagcgggacccacctgtcagcgacagcgagggcgcgcgcgcggctgcggactgggccggactgggccgaggagagagagaacggttttgggccgactttcggcccaaagccaaaagaagactttttaaaacctttttcaattaaaattatttcttaaatgcaattccatttattaaaaatactttcttaactcaaataaatcccagaaaaatctaggaattatagaattaagcaaagtatttaatgaaattttatctggcccaattttatattggaatttattaattaaacttagattttcttttcaagacttttaaaataaattctagaaattccatttaaacaacaatttatatattttgaattttcagggtgtgacaaacctaccccccttaaacagaatctcgtcctcgagattcggaagaactggcgaacagatgcggatgagctgacttcaattcatcttctcgttcccaagttgattcttcttccgagtgattactccattggactttgcaaaaacggataactcgattcctggttcttctctcacttgtttccaggatacggattggtttctcaacataagtcaaatcttcttggacttctatctgctcaatattagcttcttcggtaggtacccttaaacactttttcaattgcgacacatggaacacattatgtactcctgccaaagattgaggtaactccaactgataagcaacctctcctcttctactgacaatcttataaggtcccacaaaacgcggtgccaattttcctttggtacgaaaacgatgaactcctcgaaaaggcgtgacacgaagatacacataatctccctcttcaaaactcaaatctctgcggcgattgtcggcataactcttatgacgagactgagccacacgcaatctttcttgaatgatctttaccttttcttctgcttcccttaggatatccgttccgaaaacctgacgttctcccgtttgatcccacaaaagcggagtgcggcacttccgaccatacagtgcttcgtacggagccatctgtagactagcttgataactgttgttgtacgaaaattctgcatagggtagattcttatcccaacttccaccgaaatctagagcacaagctctcaacatgtcttccaaaatttgattcaccctttcggtttgtccatctgtctgcggatgataagcagtactaaagttcagcttagaacccatctcttcctgaagtttcttccaaaaatttgaagtaaactgactgcctcgatcagacactatcttcttagggacgccatgcaaacacacaatccttgccatatacaattctgctaagcgacttccggaataagttgtctttaccggaatgaaatgagccactttggtaagtctgtcgactatcacccaaatagagtcatggcctgatgacgttctgggtaaaccagtaataaaatccataccaatttcttcccatttccattcaggaatcttcaaaggttgcaacaaaccggcgggtttctgatgttctgccttgactcgctgacaaacatcacatactgctacgtattctgcgatttcacgcttcatacttgcccaccaaaatctttccttaagatcctggtacatcttagtactaccaggatgaatggagtataaagtatcatgagcttctttcagaattgcatcctttaaatctttgttgtcggggacacagattctctcacccaaccatacagttccgtgctcatcctccaagaaaccaatagcttttcctcttctcatattcttcttgatcttttgaatatcaggatcattaatttgggcttctctaacttgatcaattagagtgggcttcgcttctaaggctgcaacgaaacctctaccgacaattcccaaatttaatctttcaaattccttgcataattccaatggcaactgtcgtccttctgtagcattgcaatagccttttctgctaagagcgtctgctacaacattagcctttcccggatgataatgaattcccatgtcataatccttaattaattccaaccatctccgttgtctcatgttcagatccggctgagtaaagatatactttaaactcttgtgatcggtgtacacttctgtacgagtaccgaaaagataatgacgccaaatcttcaatgcatgaacgactgcagctaactcaatatcatgagtagggtagttcttctcatgcggacgtaactgtcgagaggcataggcaaccaccttcccatcttgcatcagaacacaacctaacccaagtttggatgcatcacaatacacttgaaaacccttctttggatcaggcaaaatcaaaataggagcggatattaagcgacttttcaactcttgaaaactccgctcacattcttccgaccacttgtacttcacatctttctgaagcagtcgtgtcatgggcttagcaatcttggaaaaattctctataaacctccgataatatcctgcaaggc

SEQ ID NO: 69031 - DNA, 3169 bp, Oryza sativa
ttgtataaaggaaagaaacttgaataattgtaaaaggcaacaaaggttgagaccagtcaaatattgaaggggtaaataaattgttactaagggcctcacttgatgaataaaagatagcatggtatggtaattgtcctttatagtattgttttgcatggctgattttagcatgagaaaaacccatcctcttggacaaaaatccatttatatcgtggttggtacttggtagcagtggacagtctttaatcttgttcagtttggacttgatcaaaattcctgctaagtcttgtcgaaatatattcatatcttgctgcataaagtaaagggagaacattttatatgattttcataatgggaagctttggtgcaaaatatgaatagagttcattgtggttgcctgaaatcattgtattgatgtcagaaatcattgttgattcacacagataatagacagaaaagggaatgaattgagcaacccatataccaacgttacatgtccttcagttattggatcaaccacaggaaggttaaaaatattgaccatataagaggaattttgcttaagttctaaaagaatatctgaatcacatcgtaattcataaggaatttcgcttaagttctaattaactttggttgatcatgttgcctgactcactacataatatttggagtgttaatgccaattcatatagtgctctactatcactattttagtagtgcatatactgttaatcaaaataatttcattttgcaacttgtatatatatctctacatgaggactttgcaaagcaacatctcaggggcctacaatgagttgttgctcaggtaacaagtttcagtatcaaaattcataatatgttcactacaggtttcaggttcatatatctgaccaaagtactgtccttgccagattcagttccaaaatgagacacagttctcaccaggattacaggtgacggaacactttgtcgtggctacatagcacttgcatgcagaggggtagcagcttatgaagccacctcttgtttcatcagaggtaagattgagctaaagatgatgaatttagaaacttcataagctggcatgaactgaacttactgacaaatgcttaatttagaaacctgacaagatctcacgaactaacacaagaaaatctggtctttatgcacgaactttgggtgttcagccagcaggacgttgcggagctaccaggtctacttcagcatgaggaagcagtcaaccaacaatatcggcagcaagcacatgctgggaatgagactgtgttaatcttattaaatcaaaaaattagttcatgttatgccatttatttagtgtaattatagttatatatgtcctgttgtatgcttatgctgccatcggccaatctatgccgttaggatatgcatgtaagaactcagaagcggtgtatcaatcgaaaatcgattgattttttttctcacaaaacaagcatatgatagataaatgatcaattgaaaatcggttgaatttttttctcacaaaacaagcatatgatagataaatggtctctgatcttttcagcctacctaatttttttctccaaaacaaaccgttctgttttttattctatgcgcggtcgacaaaaaaaccatgatttcttaaaatcgacccaatctgaacgatcatcctgggcttaataatttttttgtccaaaataaaccgatctgctttattctatacgcgatcgaccaaaaaccatgattttgaaaaatagacccgatccggacggtctcggacttaatatttttttccataataaacggttctattttattctatgcgcgatcgactgaaaaaccattttttaaaatcgacccggtccgaacggcctcggacttatttttcttatccaaaataaacagttctgctatattctatgcgcagtcgaccaaagaaccatgatttttttaaaatcgacctggtccaaacggtctcaaacttaatatttttttttgtccaaaataagctttattctatgctcggaagacctgaaaaccaattttttttaaatcgaccaggtccgaatggtcctggacttaatattttttttccaaaataaactatcctactttattctttacgcgatcaaccgaaaattcttgattttttaaaatcgtcccgatctatacggtcctggacttaatattttttctaaaataaaccgttatgctttattctatacgtggttttttaaatctatccggtccggacagaccgaacgtgtaccttttactacctagtagatgttcgacagttttttttaaccataacattcgatatttttagccgcatgatccaacatcaacaacggtgactgttaagtggctaacgggtccacatcaaaatacagtacaacaaacgaaggatgatgtccgtaaaatctgggagaaaaataggaagttacagtgagttacagcatgtaactgcatgtaattagcatatactataactagtataaatttgccttcaatcctcaaattggatatagctcagtgacaaggaagtcatgcaggtgacgcggaagtttgagggatcgattcctatgttcgcttgtttttgctgctatttcgtttctcatcctaagcacgaatcttgatgttaatccaatgacccagaaatcgacagtttttctctgagaaatctgtcacaagttatttagggcccctttgaatcgcagggtagaaaaaatggaggaataggaaaaacacaggattctgacaggatttgaagtgtaaaacagaggattgcaaaacacaggaaaaacacagaaatgatcgtttgattggagcgcaggaaaaacgcaggaattagatgagagagatagactcaaaggaaattttccaagaggttggagctcttgctaaatttcctccaaattcacatgcaatatgccattccataggaatttcataggatttagaaagcttcaatcctttgaatcaaagggccaaataggaaaatttcctataggatttaaatcctatgaaattcctacgtagatcctttaattcaaaggggcccttagcaattccgatccagataggtatcacgtacccaaaatccgatcggcctgagatgcggtggctgcgtcgtgcctgatgcgatcaagccaaaattaccaaaattacc

SEQ ID NO: 69032 - DNA, 1049 bp, Oryza sativa
aggaagtagcaccctttgcaattcacactatgcagtcccccgcctcctccatcctcaccatgccgcctcccgacctcgccagcatcaaaaggcatcaacgtctcggtgcggcacccggcctggctggcctcctctacatcccccctcccatttgtccccggtttgctccttgctgcagctctggtggtgatgccaccgcgcgcattgctgaccgcactaaataattgaagtctagagataatgagatttaaagagtgatcctatagtactgcagtgcacaaagcaatacggctctcctccatatcgacttacccttctatatatatcaccccttctttaaacattcacatcttatttccctagctagttaaaaagggggcatcttttttataatgtttgtgacgctacacctaatagtatgtttgtagagattgatatacataccacaacagaaatgaaggggccaaggataaatatgatgaggcaaaatttgggaaattttgtttatgttatacgaatgagagtcatcctgaaaacggtaaccacgctagccaatgggccaagccaaatagaatttcggacaagtacaatgattcaccaaatcatcttataacaaaaggtcatgatggctagtaggaaatcccttactcctgaggaacattttccagcatgtcaaatattcattcgatctacctagccacagggcatgttaaggtaaatatattttacttttcctatttttttccaggcaggtctgtataccgtgtaattaattgttggttcagttgcttagtttcagttaccgatcgatatgctatattctacttgttatcaggagcattcttcatcaaagccatagttttactaatgtatatatagcagatttttcattgtctactaacactctctttttgttttataaaactaggtgtatggcatttttttcctcgagccctttagttacttatttattagaaaatggtgtatttactatgtaccattttttatggggaaccgtcacaccccttattggatatgagaatttttta

SEQ ID NO: 69033 - DNA, 2359 bp, Oryza sativa
cctggaaattttatcgtactagatgcatatgctagtttgtccaccattttcctgatgcttcttattcataccactcttggatacacagtggaactcaatctattgttcacgccttctgtaatcgtattcagctccatcctttttctgttgcatggcttgcaattttgtgatggatactaagtgagcagtgacattgtctttcaatggtaaagttacactcatcgatcaaaagatgggatgatggatatacataaggatattatccatttcacaaccatgtctttttccacattccgagatcaacccaaaacaacaaaataagacatgcgtgttacagtaacaacttcgacttcaaaacgttactttataccttgcacatcaaaaccacttagtgtaaaagaagagacttgaatattttttttaaaaaaaagtaaaaaacatacaaaaaaacagttagaaatatatatatactgtctggagttagaatatcttttgagttgagggtaaaaattatttacgcatcatcccatcttcgtactagatttttgaagttgtagctagctgttgatctctatgcttcacaaactatactatcttgtactatgttgtaactgcatagttttattcttttatttcaacttgtggtgttaaatgtaggtaaatcgtgaattttgcagcttaaaagaaacatattttttttgcatttaacgaaaattagtacatgaagtattccacagtttgggtgagttcctttcactcaaacagagccaagagtagagattcagatcagctgcaagactaacattgctgaaagttagcacacatgtactgttcactacttaaaaaataatttttcccgacacttggattttattttttcaagtggactaaaaatattctcgcttgtgaaaatatcagaagttctataggtctagccccaactgaaaaaaataatcaatttatacaagtgggatctaaagaagtttgcctgtgaaaatacccttcattttcgcaggtagacctccttagcctccacgtgcaaaaatcaatggcagtcgggacctaaagaggcccgccagcaaagcgtggaggcacttttttatccagcatcgccagccaccgacaagcaatccttctccctcacctacgccctccctcactcaatctccctcacacctctactagggcttcgatccccatccctctccgtccagcctccaggccacttggcgatagcgggcaaggcactacgttcagcggcattagcggaagcagggaagggatgacgttcggtggcatcagcggcggctacaagcgcggttggcggcaacgggctggaggagatgagaggtcgctagtggaagctggcaggctcgggatgcaacagcgacatcgacggcgatgatggcgaccccaccattgacgacgactacgtacgagctcgggggaggcggatccactcagtggccagcttgggagaggggtgtatgactatagcaaggttggaagaggcagatccatcgccgacggccttggatccgccattgccgagctatgtagtgtcggacccaccgttgccgagctcgggagggggtggatccaccaccagcagctcgggagttggggtgcatcgtctacagcgaaggggagtggcgatggctgtggaggccttggattggcatgaacatactagaaatctgctggtcagaccgcctgatggttgtcagttggaccgacatgagactcccagccgaccgactcctaatcgacggtcagggtgtccggtaagattataaggtgtccagttagaccgttgttcaaatttagatcaatttagtactagtgcctaattggctatctaaagatacattattgcatatgagatctagttgatatgatgcatatttgtttctcgttttttaacatttctaccacgggatagcaaaatttccaagatttcagattttttggaatattttttaaaaaattgaacaaactttagcctaagttgaataacttttaccaaattcacacaaaaattgaaaactttgggcaaaatagtttcgttcacgcgggggaggggtgttcccgatattgcaggaattggaagtgaaattgcatgcataggttataattatgaactgaacatatgcaggtagcctcacatttctttcatcacaaaaattcttaaaaaaacattctgtagatcttgaatgtcaagcgtggaaacatcgtgtcctccacagtttaccatgtgccagagcaacattcatccaactgaaaccataagcttgcaaggtcaaattttcctggatgcctccttgtccgatcaaactgagatatacatgcggaacttgat

SEQ ID NO: 69034 - DNA, 1263 bp, Oryza sativa
agacgtgttgtcggagtcgtccgtcaagcctgagtggaagagctagccctagaaggaattggagcaggcaagtgacgtaataatataaatgattgttatatttgtaatgcaattaattaagattattagacctgtaattggacttatcatataagattgtgtagtgttctaatattatttgagttttaatataagattactttatttgtaattagacttagtatgtaattattgactacggaattggggcgacaagtagcaattgactattgtagtcttaattagacttagcatatacgcacgaaacacttagcatatactgactattgtagtcttagcatgtaatattatttgagttttaatataagattattttatttgtaattagacttagtatataattatttactagctagggttgtacaatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacagatggctgaccgcgatgaggaacagatattgtacgacacaatcgcggagggaagcagccagtactggaatgaagaagaggggaacgaggatccaaaccagtacttgaacgaggaaggaaacgtggagagggatgcggaggggaaccagcaggggcacgtggaaagggatgtggaggggaaccaggaggaggaggctagtggtagtcaaccctccgttggacagaagagggcacgcgggcaacgaggtgcagcgaagaagcttgagggtcgacacatcataacggaagtgcaagaagatggacgtcctagtgccccggccgaagccgccaagaactatgtacgtcacagcggttgggttgtgcgggataacgtgcctgtcagtacggtgtactggcgaagaacaagggcacgcggagatcatgagagctttgtcccagattcggagaaagagatgctgtggaccacaatgctcgagacattcacccttcctgcgggtacagaggacaaagtgaaaaggtggactctgaagaaaatggcagaacagtttcagagcttcaagggagatctgtaccagaagtatatactgaaggggcagacaccgaacttcgacacattcccaaagctaagggatcactgggacgagttcgttgcatataagacaggtgaacaagggcagg

SEQ ID NO: 69035 - DNA, 1319 bp, Oryza sativa
agcggtttaccgagttcgtacatgtatttcacttccgccttttcgattggtgcgactcctagcaattgatccgtagttagaccggtgtcagtaataaattgttctatcgtcatttctttaccggtaaccaacggctcgatctcctggtttggttgctctccaagctgagggactggtttggactttccagaagatgctttcttcagcgttcgctcatagtccgatagcttgatggcctccttgacagatgcagacatacccctgaagaagttcctgacactggggtctataggaatcttcttttctggacttcgaggcttgaattgtctcttgacttctgatgcaacgtaagcgtcaagctcctcttgcgtgcaatcgtaccccgggtccttgttcttggcggcgtcaactttcgccttcttcgttgcccttgtgtgggcaggcggtggagctggggggcccttgagtttgaaggtgccggaagaggagcttgcgggggagtaggtgtaggagcacgaggaggagtcggtgcaggatcctgaggaggagtcgatgctggagcctgaggtggagacggtgctggcggagcatgaggaggagacggtgcaggatcctgaggaggagatggcggagccggaggagatggtgcatcgagtacgtccgttttttgtccgctccagggtaggatgatgtaccgcctgcgccatagaataatggcatggcttgtgtctcgtagatgcgtctcaccgtctcctccagggtaatccagctcggaggctcccatcggtgacgtcgccccttgcggactcatacgtgcagacctgtgcggaacgctatgcggaggtaattcctgctggaatcggcctgcagtggtaagtacctgaagggtccgttgggatggccatgcccgacgccaccttcatgttgtgagagattatttattagtaatcaacatatataagcagcaactagcggaatggctaaatcttacctttattgataagttcttgaaaggaatatgcagctcacatggtgtccgctgagtgatgtcatcaacgggacatgtcgattcgtcctgtgtttgcatggcgtccatgctctgtgatcctacctgccccgttgaggcgcagctgctacggtttcctgacgggctcaccattgcaggaggaatggtcggctggggatcatgggaccgatgtgcggacatgcgttcatcaaccttccttgccacctcctcttgcatgttgagttcgtagctcgatacccggaactctaggtctgcaatcttcgcctcggtatctctcttgctcctcatccga

SEQ ID NO: 69036 - DNA, 781 bp, Oryza sativa
ctagcatcctcctatcaaatgaagacaccccttactcacgcagcgatcacaaggagggaacaatagtaaggagaaagtacgtgcggtcaaccgtcaccgccgatgtaatgccgtaattattgtgtacacgatgtaaactattttggatgtattgattatccatataaatcaattgatgtatggcatatgttaattacgcacgattattagaggtttcaacaagtttaaatcatgtatatgctagttatatgtgatacttacaatttttaaaagttttaaatcacacaggtggcaatttcatatgtatgttaattagagtttttaacatttaatttactagcattcatatgctaattataattgactagaggatttttaaaagttttaaatcacgcaagtggcaatttcatatgttaattagagtttttaacatttaatttactatcattcatatgctaattataattgactggagaatttttaaaagtattaaatttaatatatttttaaaactatcattcatatattagagtttttcacaatttaatttactatctttcatatgctacttatatatgactattcgaatttttaaaaggtttaaatcatgcatgtggcatttacatatgttaattagagtttttagcatttaatttaatataattcctacgctaagtatatatgatgattacaatttttattaattttaaatcatgcagtatgtacatacatatcttaattagagtttttaccaatataattacatcattcatatatatgc

SEQ ID NO: 69037 - DNA, 6495 bp, Oryza sativa
ttgccttgggcgacggcccatccaagaccacacggatcggtggtcttctggatggcaaataggaagacgcgctcgtctccttcctgcgggcaaacgctgacgtcttcgcatggaaaccagcggacatgcccggggtccccagggaggtgattgagcaccgtctcgccgtgcggccgggcgcaaggccggtccggcagaaagtgcggcggcaggccccggaacgtcaagccttcatccgcgaggaggtggcaagacttctggaggccggattcatccgtgaagtcatccatccggagtggctggcaaacccggtggtcgttcccaaggcgaacggcaagcttcggatgtgcatcgactacaccgaccttaacaaggcatgtcctaaggatccttaccccctgcctcgcatagatcagatagtcgactccactgcggggtgcgaccttttgtgttttctagatgcatactctggttaccatcagattcgcatggctagggaggatgaggagaaaactgcgttcattacccccgtaggaacttattgttatacgtcaatgcccttcgggttaaagaatgcaggtcctacttttcagcgtactactcgaatttctttgggtagccaaataggacgtaatgttgaggcttatgtcgatgacttggttgtaaaaacgcgcgaccaagaaactttactttcagatttagcggaaacttttgagaacctccgctccgcccgcataaagctgaaccccgataagtgtgtgtttggtgtgcctgcgggcaagcttctcgggttcttggtctcagcccgaggcattgaggccaaccccgagaagattcgagctatcgagcggatgcgcccccccagcaaacttagggatgtgcaatgcgtcactggttgcatggccgccctaagtcgttttatatcaaggctgggagagaaggcgctacccttgtttaagctcctcaagcgctcggggccgttcacttggacggaggaagctgaacatgcccttactcagttaaaggcgtatcttagctctcccccggttctagtcgccccggagccaaatgagtccctgttactttacttagcagcgaccccccaagtagttagtgcagcgttggttgtggagcgcgatgaggacaatccccattctgcgcacccccactctatgccgacttggcccgggagcaggcagggaggagaggcccccgagtcgaacggtggcctaaggcccccgacgaccggagtcggccctctgcccgcttgtcagacggtgccgggtgcccccgaccctcaggaaggccccgaggccactgtgggaaggccgcacctaccaccctttgaccccgaggctacccctgtgctgattcaacccgggagagagcagggagaagaggcccccgagccgaacggaggcctgaggcccctgacgaccggagctggccctttgcccgcgtgtctgacgacgccaggagcccccgaccctcaggatggccccgaggccactgtgggaaggccgcacctgtcatcttcggaccccgaggtcatcagcacaggagacgagtgtgccccgagaggtcacttggacaaagagcaccccggggatacggcccctagcgaagaggatcggccccgccgaagggtgcagcggcctgtttactttgttagtgaggcccttcgggacgccaaaacccgataccctcaggcccagaagatgctttacgctattcgggtcactgtggttacgtcttaccccctcgggcaaatcttgcataatcgagagggtacacgacgggtggtaaaatgggcaatcgagctttctgaattcgacctgcactttgaaccacgccacgctatcaagagccaggccctcgccgattttgtggcagagtggaccccggctccagagaccgtctcaatccccgaggccagcacgaacccctcgcagctgcctcacaccacctactgggtgatgcagttcgatggttctctgtccctccagggtgccggtgcgggggtcacgttgacctctccgaacggagacgtcctcagatacttggtccgtctcgactttcgagcgactaacaatatggcagagtacgagggactccttgccggactcagagtggcagctggactggggatccgccgcctcttggtattaggcgactcccagctagtcgttaaccaggtctgtaaggagtaccggtgctctgacccacagatggacgcctacgtacgccaagtgcggcgtatggagcgccatttcgatgggatagaacttcggcatgtacccagaagggataacatagttgccgatgaactctcaaggctcgcgtcctcgcgagcccagaccccaccgggcgcctttgaagaaaggcttacccagccgtcggcgcgacccgaccccttaggggagacggatgcgcctgaccggcccccgaggcccgtcggagtccaggcctcgggacccgaagggagcgctccaagctcccttagattgattgcttggatctctgagatccaaacatacctcacagataagactctacccgaggaccgcgaagggagtgaacgtgtacaacgcatttccaaacgctacgtgctggtagaagggaccctctatcggcgcgcggctaacggaatcctcctgaaatgcattcctcaggaacaaggcgttgagcttcttgccgatatccatgaaggcgaatgcggagcccattccgcctcgcgcaccctggttggcaaggcctttcgtcaaggattttattggccgacagctctcaatgatgcagtcgatctggtccggcgatgcagagcgtgtcagttccacgccaagcaaatccatcagccggcccaggccctgcagatcataccactgtcatggccatttgctgtctgggggcttgatatcctgggaccgttcaaacgggccccgggcgggtttgagtatctgtatgttgcgatcgacaagttcactaagtggcccgaggcttatccggttatcaagatcgataagcactctgctcttaaattcattaagggcatcacggcccgttttggagtgcctaaccgtattattacggataatggcacccaattcactagtgaactcttcggcgactactgcgaagacatgggcatcaagctctgcttcgcctcacctgcccaccccagaagcaatggccaagtggagcgcgccaatgcagaaatcctcaaaggccttaaaaccaagaccttcaatattctcaagaagcacggcgattcatggatcgaggagttgccagcggtgctctgggcaaaccgaaccacaccaagccgagcgaccggggaaacgcctttcttcctcgtctacggcgcagaagcggttctcccatccgagctcaccctgaggtctcctcgggccaccatgtactgcgaggctgatcaagatcagcttcgcagagatgacctcgactacttagaagagcgaaggcggcgcgcggccctccgagccgcgcgctaccagcagagcttgcggcgctaccatcagcgccacgtccgggcccgatcactctgcgtcgacgacctcgtcctacgccgcgtccaaacgcgtgctggattgagcaaactctcaccaatgtgggagggtccgtatcgagtgatcggtgtcccccggccgggctcggtacggctggccacgggcgacggcacggagctgcctaacccatggaacatcgaacaccttcgtcgcttctacccctgaggaggggggggggtcgggtgtcaggttttggctcaggccaaccccgcacccccctcgggtgtgcaggattggccgggggctaccacacatgcacatatatccctttttcctttatttcagcatttcaataaaagcagtttcaattttctaaaggttgtgtctgtgccgttttttccttttgaagaatcttgacttaaaataaggtcactcgtactcaaccttgccctcgggggctcggttcggtcagctaaaatcgccaaacggggcccagaaccgagccgtgccccggggcgtggtgaactccgggggggaatcggcaaaaacccacaatcgggtcacccataaccctcggtcaccacgttcccggcctggccagtctcgacatgtggatctccccaggcactagccccgacccgcgcttttcgaggactgggacttgggcacgggcccttatttcaagctaagacgcaaaaagaccacggcacagatcatcctcatctcatatatagcaaaataaaactaacacaaaaattttttcatcatttctcattgcagattaagttaaattgtacaaaaaagaggcatgaaggccttagaagaaagaataagaaaaaagttaagattggcgggggcctgggggctcattcaaatgcgcccgggtcgccggcctcgtcgccaccgtcgtcctcgccgctggcgtcgccctcctcgtcagagctgggggcgaacgcgagccgaggggccgagccctcgaagccgttgacgatgtggtcagcagcatcctcgacacgcgcgcgcgcgtcgtcctcggtcccgggagggaactcctccagcgccatccagggagagaaattggggtcccgggcctggtaactcgctagcacgagttcaaccgccccccgggcgaggtccctcgaggatgacttgatggtcttctcgagctcctcggggagtcgttcgaggacccaggccatcctgttgaggtgcggagcgaggccttccagattggtggggggcaccgtcgtctggcctctccagaggcctgcttgccgaccggcgcgcttcatgcgggagaccgcatcccaaagcatgtcgggcccaatctcgcccgccaagcgaagggcctcggcctccccggtggaggagtccagcgctcgctgcatttccgcgacggtgtgttcggcagctgcgaggcgggcggctaagtcgctttcgcccgcggccgccccgccgataggcgcccttgcgtccagctccttttcccgcgcctcgaggtcagcagcccgctgctccagtgcggctctctcggcgcggacgcattcgagattgcggcgcgcctgctcctcctgcgccgcctcgcgaagggacaggctgtccgccagccgtttggtcgtggcctcagcctcctcgagagctcgctcccgctcagcgagtgcgtcctcgcggaggcggagcgcgcactcctcctcggcgcaggcggcctcatgcgccgccagcgtcgcctctcggagaccagcggcggcctcgcggtccgtcaagcccctctccacggcgccggcgtgttcttccagcgccatggcacgggcctcaagggcctcctcgcgccgccgaaacgccgcttcagtctccgttacccgccgctctcgggcagcggcggagtcaaggaccccttgggcggcgtcgagctttttcttcagctccgcctcccagcttgcgtgctgaaggcggagagtgtcttgcgcctcgatcatcgcggtggtagagatgagggcggccgcccgctcctcctccacctcacgggcgatctccgccagcgccgctttccgggcttcaagctccgagacatgacggcggtgagccttacggcccacctccaccatggcgtccaccgagcgccgcccctcctcaacacgcgcccatgcggcctcgagctccgctcgttctgcacgcagggcctccacttgggtgttgaacccatccagcactgcggtgtttgcggcggccagggcctgcagaaggggctcggcgctcagcggggcgacagaagatgaggagaagagccgccttgggcccccggaggatgcgctgggctcggggatgtcccccgggcccgtttggtcctgggcgtcgcccggtgaggtaggcccaggcgatgcgcccgcggcctcgtcgcgagccgcctcggaggatgtcgcctgagggccgcccgagggagtaggcccaagtgacgcgccagcagcagctgtcgcctcagcctggcgagcccgggcggcctcctcccgggcagcttcttcggcttggcgagcccgggcggcctcctcccgagcagcttcctccgcttggcgaacccgggcggcctcccgggcggcctcttcagcttcccgaaggcgggctgcggcttcacgccggtcagactctcgcctccgctcctctgcggccgctggatcttcggcctcggactggccggatttggggtggcgggaggaatgcgacgggacatcgctgaagcagaagaaaaaaccaaaagacgaacaaaatgagtaagaaaaaacttctctttgggagaaaggtggttgcaatgagagtgagacgaacctgcgagggggtcggttgaatgaccaccttggaggagaaatcaggttcccccggcatggttccgtctcccccgtcttgcggagccgtttcttcttgcgctccccctcgggctgcgacgtcggcgcggccccctccgggcgccgactgctgg

SEQ ID NO: 69038 - DNA, 4650 bp, Oryza sativa
aagcacgaccccctcctggggcagattgttcccctcggcggcgctcgcccgcgccgtcgtggcccttaggggctctctcctctgaggccccgacccccatcataatggttagaatggaggcgcggtcgggatcgctgcagagggggaggatctcctgaggaatgcgagacgcctccgcggagctaagattcagcaccctttggaccacgatcttgaagtcctcgggggcccaatcccatctggctccctggtgggtccgcatgtagtcttcaggcccagtgtactcccaggcgctccgggcgcgccgttggagcggcgcaatccggcgacggaggtaatcgccgtacaccatggccccggtgagcccctgggatcgcaggcccgccaggcggtcgaggacggcgtcgtagtcctcccccagatctaccggtgcccgccagctggagacctgcgccgggggctggcttggaagtcggaggcgcgcttcgttggcgaggggggtgtagaaccagtcgctcttccagtcgtcccacttcttgcgaaggacgcaggggatgtagcggttcaacaccggcccccgcggctggaagtagcagccgccaaccaccgacggcggtgacaccgactgcacggtgaagaaccaccggaacagctgaagagaggggcgcaccccgatgaacatctcgcacagatgcgcgaagatggccaatgtcatcaccgcattgggggtgaggtgcgccatctggagatcgtagaactccaggacatccatgaagaaagaagaaaatggcgggaccagcccagccattgcgaaggggaggaagaagatggaccgccccgggtagtctggtgccgggcgcccctcgcccagcatcactatctcccgaccggtggcggactccggcatgaagcggcgcggcagtccggcgtgcctctcgttcacgatgcgggaaggcggtagtacactgccgtcgagcagagcagcgccccgtgccatggcggtggaggaagagatgattgagaacgagcgcgtgtggcgaaagtagggcgtagcagagaaagagttagagctcaggcggcgaaggcaagaggaacaatggcgaaaggaagggagcaaatccttttctcgatgcttttatacccttgccatcgctgggcctggctcctcgtttctcgcgcccactacctcgctccctcgtatctcgctatctcgctccctcgtttcccgtgcccacgcttccactaatcccattcgcccgcttgcggcgcatgaagtggatatgcagttgtggcaatcgaaatggattgtatcgtgcgcgcgttaattacgctcgccgaccgaagcggcgttaccatatctccgggcgagacaaatctgctcacccagattcgcgcgctgctcaagtggtgtggcagtcttgaatagaccgcccattatgaacaaccaaagttaccaataccaatgtgcatggattgagaccgttgggtattttgcccaactacggagaccggtcccacctgtcaccaggctttaggggtggcgtcacacctgaccgcttcccttgggaagggaaattgctctggcataacgccgggggctactgtcggtgatatgggaccgggagtatcgtgaccagaggcttgaggcagacgcaatcgcccacgtggcctggcaccttcggggacgtcgggcccgagggtgaggtgtccgccctcctcctgatttcccccgagggggggggggtcgggttgcgcttgccccggccccgagggccgaggcaccccgaccccttaaggaagtctgcgccacatatatgggataagtgagcacagctgtgctcacctaacagcatttattgcagtctggtcaagcgtgtcacgctgcatgcaacgcagtacagcgcgttcctttatccggtctgtgaccagtcacagaccagtcagatcacgggttaggtggcgactggcggtctgacgcacgccttgccccatcccgtcaagacgaaagcctctaggctctcgtctcaagccggagctagcgtgttatctcttagagatggcacgttagccctggtcagatttataccaggcttcatcctaaccattacaggcaaggtgttacacgaagaagggcaaacatgcacgttgttaaactgacgcgtggtggacaagaatgaccggtctggcactggtcgcgtcagcaacgggcagccacgatctcacgttgcgcctgtctccgccgggagtggaggtaggtgtgggctgtcccatcagaagggttcccggatggaaaccgtaccgatctccgcccattaaagagaaaaagaacagtccagtttggaaagagagagggcatgtggtatccccttgagatataaaaggaggaccttgcccatttagaagggggctctttttttgacttcttcccttttggaaggctgaggggaaagggagttaatcctttgtaactcgtccatacacaaatccacaaaaacacaggagtagggtattacgcttggcagcggcccgaacctgtatacatcgccggtgtctcacgtttcttgcgaggcgggtgatctttccacatacagagggagagcgagagcttgagatttcaccctaagcccccggccggactggcaaaggggggcctgcgcggtctcccggtgaggagccacgagctccgtcatctggcgcgccaggtagggggctcagcgtgtgttttctgagctctcgtactcttccgtgtgcgccaagtttcccttgttcagcctaatggccgagcaagcaaaggcgcacgacctctctccgagtgtgagcggcgacgatggggagccgaatccacgccgacgagctcgtactcccccacctgctccgcgccaaagccctaagcagggggaggcgcttgagagggtcgacaaatccgtggcatcaccagtcgcaggtgatgcaggagaacggcgagatggggagcgtcgcctcctcgtctacggcgacggcagcacgcctcagggtgcgcttcaggctgctggcgcgctcctacgacacccgcctgtcgtccatgacccggagtctccagcccaacgatggctggaagacgtggccaacttggtcatgacggcacagcagcgcctgggtgctggtggacggtccgccaccaccaagacctccggcgccgctaccaccggctccgtgtcatcaaggcggagggcgcggcgagcggcggcggctgcacgtcattcggctgccactccctcgtcgacaccgtcgactcgggaggatcagcatggggagccggatgcccgcctcaacatcgagcgccggcgtaatagccggcgtactccccgtgcaacggagggcgcctcctcgtccagagtgtcacctcgacacggacgtgaagatcagccctccgtgcccccggccggtggtgttggctgtagagcctttgtggcgagccttcggaatgtccgttggcccccaaggttccggcccaccatcaccgagaagtacgatgggagcgtcaaccccaccgagtttctccaggtctatacgaccgggatcgaggccgctgggggtgacgacagggtcatggcgaacttctttcccatggccctaaaaggacaggcgcggggttggctaatgaacctgccacccgcgtcggtccactcctgggaagatttgtgccaacagttcaccatgaacttccaaggcacatatccgcgcccaggcgaagaagcggacttgcatgcagtacagcgaggcgatgatgagtcgcttcgctcgtacattcagcggttttgccaagtccgcaatactataccatgcatccctgcacacgcggtgatctacgcgttcagggggggtgtgcggcacaaccgcatgctcgaaaagattgcctccaaagagccccagactaccgcagagctttttcagctcgcggaccgagtggctcgtaaggaggaggcctggacctggaactcctccggttccggagtggcagcttcggccgcccccggatccgccgctcagacagggcggcgtgacaggaggaggaagaagaggccggaccgttccggcgacgagggtcatgtcctcgccgtcgagggcgctccgcgggccactcgaaaggggaggcctgcgagcgacaaaaagaacgaggctggtacacccagcagggagcgcctcgccggtaggtggtgctctgtccacaacacctccctccacgatctcgcggactgtcgtgcggtcaaaaacctggccgagcgaacgaggaaatgggaggaggacaggaggcaggaacgccgtgagggcaagtccccggcggttccttccggcaaacggcgaagtgaggccaagcagaaggcccccgctgttgacgtcgatgatggtgatgatgacctaggtttccaagaacctggggccaccattgccaccgtcgatggaggagcgtgtgctcacgtctctcgccggagcttcaaggctatgaagcgagagcttctggccatggcccctactcatgaggcgatgcgtcgggcgcggtggtcggaggttgctctcactttcgaccagaccgaccacccaccgtgcattgcccggggagggcaggttgcgatggtggtttcccccaccatctgcaacgtgaagttgggg

SEQ ID NO: 69039 - DNA, 7362 bp, Oryza sativa
atggaaaccgtaccgatctccgcccattaaagagaaaaagaacagtccagtttggaaagagagagggcatgtggtatccccttgagatataaaaggaggaccttgcccatttagaagggggctctttttttgacttcttcccttttggaaggctgaggggaaagggagttaatcctttgtaactcgtccatacacaaatccacaaaaacacaggagtagggtattacgcttggcagcggcccgaacctgtatacatcgccggtgtctcacgtttcttgcgaggcgggtgatctttccacatacagagggagagcgagagcttgagatttcaccctaagcccccggccggactggcaaaggggggcctgcgcggtctcccggtgaggagccacgagctccgtcaccctgtctgatcccagaagagcggagtacgacaccttcgtccatacagtgcttcaaatggtgccatctgcagactagcttggtaactgttgttgtacgagaactcagcatacggtaagcttttgtcccatgctccaccaaagtcaagcgcacatgctctcaacatatcctctagtatttgattgactcgctcagtctggccatctgtttgtggatggtaagcagtgctgaaattcaaccgggttcccaattcttcttgtaatttctgccagaactttgaagtgaattggcttcctcgatcagacacgatcttcttaggtacaccatgtaaacacataattcttgccagatagagttctgctaatttcttccctgagtaggtagtgtgcaccggaatgaagtgagccactttggtgagtcggtcaacgactacccaaatagaatcatgcctcgatgacgtcctgggcaaaccggtgatgaaatccattccgatttcttcccacttccattctggaatctgaagtggctgtagcaaacctgctggcctttggtgttctgcctttactcgttgacagacgtcacagagtgctacgaattcagctatttcccttctcatgctgacccaccaaaacttctctttgaggtcttggtacatcttagtactaccgggatgaatggaataccgagtttgatgagcctcggttagtatcaggtcttttaattccttgttttcgggtacacacaatctttctcccatccagattgttccttgttcatcctcaacaaaacctcgggcttttccaactctcatgttctttttgagctctgctatttcaggatcacttgcttgagctatgcgaacctgctccaccagtgtgggctgtgcctctagggcagccacgaatccgtgctcaactataccaaggttcagatgttccaaatcgcgttgaacctcacaacatagttgctctacccatgcaacattgcagtagctcttcctgctcaaagcatctgcaaccacattagccttgccgggatgataatgtattcccatatcataatccttgatcagctccaaccatcttcgctgtctgagattcaaatcagcttgagtgaagatgtactttagacttttgtgatctgtatatacctcacaacggttactgatgagatagtgctgccaaatctttaaagcatgaacgactgcggccaattccagatcgtgcgtcgggtagttgccttcatgaggacgcaactgccgtgaagcataagaaaccactttgccatcctgcatcaacacacatcctagcccctggcgagatgcatcacaatagacctggaaatctttcgtctgatcaggcaggattaagactggtgcagacaccaaccgtcgtttgagttcttcaaaactcctattgcattcagcagaccagataaacttttcttccttcttcaatagctgtgtcattggcttagcaattttagagatgttctcaatgaaccggcggtaataacccgcaagtcctaagaaactccgaacctgagtgactgtccttggtggggtccatttggtaactgactccacatttgctggatccacagctactccttgagcattcacgatgtgaccaagaaactgaacttccttaagccagaagtcgcacttgctgaacttggcatatagttggtgctcttttaacttttcaagtaccagctgaagatgctgctcatgttcttcctcggacttggaatagataagtatgtcatcgatgaaaaccacgacaaacttgtctagaaattccataaacaccttattcatcaaattcatgaagaaggcaggtgcattagtgagtccgaaagacataactgtgcattcgaacaacccgtaccgagtgatgaatgctgtctttggaatatcctcttcgcggatcctcaactggtgatagcctgatcgcaggtctatcttagagaacacagtagctcctttcaactgatcaaacagatcatcaatccttggcaaaggatacttgttcttgatggtgacctcattgagtgcgcggtagtcaacgcacattctcttggttttgtctttcttctccacaaagataaccggagcaccccaaggcgacgtgctcgggcggatgtatcccttctgtaactgttcatcgacttgcttcttgacttccgccaactcgttggctcccatactgtaaggcctcttgtggatcggtgcagttccaggtaccaagtcaatccggaactcgatatccctctttggtggcattgttgtcagatcgtccggaaaaacctctggatactctctgactatgggaatatcctccagcttcttagtggttttctccactgctacctcttgttcttcaccagcagcctggtttaaactgatccctggcttccgcggcactagagactggaaggttaccacctctccttttgcatgggttaacttgatggtgcggctggcgcaatcaatcactcctctgtgccttgtcaaccaatccattccaagtatgacatctaggtccttggattcgagaagaatgaggttggctggaaaaatcaacccttgaatttcaactgtcacagatgggcagtagtgagttgtggtcatgccacctccaggagtattaactcgcattggtatcttaagcttcactaaagataacccatgtgcaccagcaaaacgcttggaaataaaggaatgggttgcaccagaatcaaacaatattactgccggtgtcgagttgacggggaatgtgcccaatataacctctggtgctgactgcgcctcctctgcagatgcatgattaacacgggcctgaacgaacttgggtccagcacgtcttggcttcgggcactttccaaccgtgtgtccgggtttgttacaattgaagcagagttcgggtttttctcccaacctcttgggctgttctggcagagctggctgaactgattgagctggaatctttagtgaactcggagtagggttgagactgtgctgctcactgttgttgtgactgccattatggtggttcttgttgaagctacccgggtggtagggacggtgctgtcggataatcatggtggaaggtccaccgtgacgtcccatcgtgaaacgaggcttctgactcttcccctggggagtcctgaactgagctgccttcctcttacggtttattttgttaccgtgctcctcctgacggatagccttatccaccagctctctcaaagtcctcataatctctagagatccaactggttaagtcaattcatcatcaagaccagacaaaaacttctcctgcctctcggcattggtacgcacgtcctcaggggcgtagcgcgcgaggcggttgaactcatgcaaatactctataactgttctggttccttgttgcagggaacggaactctctcttcttttgtgccacaattccctcgggaacctgtgctttattgaaactatgacgaaactctgtccaagtaacctctgccccagctggacgggtcaccatgtagttgtcccaccaaatagaagcgggaccttgtagctggtgtgtagcaaaagcaaccttctcctgctcgttgcattgcaaaagattcagcttcttctcaatggcatgaagccagtcgtgggcctcgattgggttggtggtgcttgagaaagtgggcggcttgacacgaagaaattctaacagtttggactgaggaggtggaggaccaactgcaggttctgttgttgctgctgtgcttgctgctgcacctgttgcaacacctgatggtactgttgctgcatctgttgcatcatcattgtcatcatctgagtctgattgtccaacacctgagcaattgttgggttctcgggcggtggggacggactgttgccagatgcactgttggcacgtgctccatcgatcggctcttcgctgccacaggcgttgttcgagtcgcgtgaaccattccttatctccatctgaaggggataggtagaaatatgagaaaaggaagaaaaacagggggctcaaactaatcttgcttatgaatttaagtgcaattatcttaatcttgattaaaacactgaaaaagaggcacgcaactcctaattgaggcagtcataccactgacacatgatatcgaccgccgactagcccacaagcaacaaacctaaacatgaaaactagcaagcaaacagactaagaaggcgataaagctaagggcggcgactctgaagctcggggcggcgcttgcaaacgagggataggactgacatctaaagtagacaagggataggaaccaattcatgctcaaatccaaattaaacaaagcaaaagaagactcaaataaataaccgagcatgatgatttttatgcatagaacatttttcatgaacccaaataaagacactaatgcaactaaacaataaattaatacatagactagttgcatggaaaatgatgcgcataacattgcccccatcgaatatagacacgacctaatgcataactcccaataaattcccaactgactgtcgaataaactccaactaaaatttttctaaagccctagactgagctaattttttttaaaaaaaatccgatccgaatgaacgaccaagatttttcccgcaaaccaaagaggcaaaactccaaattttcccaaaacaattccaggtgcaaaaaggcatatgcagatgaaaaaggggttcagagggctcttagggtttccagttggcttgtcctacggtcaaggtcggctctgataccaacttgtcacgcccagaaattctcgaaccagaatttctaagctgaatgtgcattaaatccctgtccaggaccagccagggtacacaaacgataattgttgacatacagatccacgtcttacaaaaatagaaaagattacaaatgcagcggaaaagataaaagcgagctaaaccgggaagcttgacttcagcagcgggcgactccactccacaggcaatccttgacggcagcgacgaaaccaactttgacaaaacagctccaactaggaagatcttcagctctggtgtgggggaaaagagagcaagactgagtactacccactgtactcagcaagtcataccggaagaggaggtatgatgcaggatataaccaaaggaggctagaggttcttttgcataaagctagcatttaaaagcagtagttgaaggcagtaaaacagttgtagtaattaatcaatattaaccaaacagttgaaggggaggatgaccacggccactagagcggccggccggagttgggtggaaatggagagctcaccggcgtgcgagagaagcggcgtttcggcgacgattggcggcaaccgagcggcggccgaggtagctctcgcggcggcgaagctaacggcggtggcgggttggcgcggcggcgaccctagcggcagtggcgcgcggccgaaggcgacggcaagcggcggcgctagcaacaagcggcgcgagctcggtaggaggcacgggaggggacgggaaatgggtgaaacgagagaggggactcggggaagggtttttatgggcgagggaggggcggacgtggccggggatggcccctatttggccggcgatgtggggagtggagggagagtgagagaggtggattcgaaatcgaatcccgccctctcgagcgcgcgcgcgggccgggagatgcgggggaagaggcggcgacgtgggggggacgcgggagcggcgcggcgtgggcgcgggaagagcggaggaggcggcggcgtggcggattcggcggcggttgccgtcggaggcgggtggctggaggaaggggacgacctgacaggtgggccccacctgtcagcgtcccggagagagggggaaggagaacgggccggcccacaaggggaggccgagcgcgggcgacgggtggactgggccgacggcccaagaagaggaaaaaaaggaggaaaaaggaaaaagaaaaagaagaaaggatttttcctgggattaaaattgcactttggtgatttttaattggttaaaattatttccaaggctctgaaacttccattaaaaatcttgttaatgcattggagcatggggaactcaagaaaaattccaccacgccgaattcaattattaattgcatttattaattaaggaattagctctaggttaattaagataatttcttcggacaatttatttaaccaatttttttaaagcaagcaaaaggggaaacttccgggcgtgacacagttcgagaatgtttgtaggaagtttaatggatttttaatatataatagatagatagatagatagaagatagatagactatgtgttgtagcggagacttgccttgcaaattgaaaaaatgaaatagtttaggggacctagttatcacatctaccttctcgtgccattaatccatagccgctaataagtgtatcagccacatttgtacttgagactctcatactatcatcccagcttcttaagattccatttgtgttctatattttagtcagtaatatcgtgtatttgtttgtgttctatattttagtcagtaatatcgtgtatttgtttgtgttctatattttagtcagtaatatcgtgtatttgcaggagatagctagagaatttattttgccagcgggacaataaattccctatccatgatcccacggaaacaactctggcactggtggagaaatgctttttagtcatggttcgcaacccctgtagtcccggttttcaaaccgagactaccaatccaagactaaagatcgctatctttagtcccggttcaaatacccggtactaaaaatagatctttagttccggttagtaacaccaaccgggactaaagagaggggatctttagtctcggttggtgttaccaaccgggattaaagagggttacggcagtgagatgatcccctttttctttttttttctttt

SEQ ID NO: 69040 - DNA, 2318 bp, Oryza sativa
taagataaaatatattacgtcttgattttatccgaatagttcggatcaggtcatcaacgaaaaaacaaatggtttttcggtcgtacacataaattaaaccagaactattttagtacaaaatatgttacgacctccggattttatctagtctcttcggaccgggtcgataatgaaaaaacacgtggttttttttgatacacacataaattaaaccacaactattattttaggacaaaaaaatatgttacatccggatttgatctgctctgttcggactgtgtcgacaacaaaaaagcatgcgggttttttggtagtacacacataaattaaaccaaaactattattttaggataaaatatgttacgactgaactgaatttcatccggtccgttcggacctaatcgacaatgaaaaagcacgtagtttttttttgttgtacacacataagttaaaccaccagaagtactatttttgtacaaaatatgttacggctggatttcatcttatctgtccagaccgggtagataaaaaacacgtggttttccgatggtgcaaacataaattgaagaactattattttagaataaaatatgttatgttttcatacagacggtccggatcgggtcgacaacaaaaacacatgttatctctagtttttcctttttcagtccgtacgtgaatacgtgatcctaatttcccattccaagttcgttttcgttttcctatttttctactttccgatcgacgcaggttctgttttacgtaccgagattcacctttcttcaccgtgatttatttactaatttttcataataccccttcttgatcaattctactaccgttaagtgagaagatagtaaaaataaatctaaaccctttaattaaatgagattaatagttcaaattgcttgatactacgagtacggaccatcggagtgagactcttgttcgagacatcagagccatgcacaaatgatcgacaagaaggcctcgttccctagatagcagatagcatgtacaactacgaacaaggccgtcataggcgatgcaaaagccttaccgaaggttggtatgggaaccatgtcttctcttgtgtgaatgatattctggataaatccaagccgacattcaccttttccctcatgcctcatattcccaaaactctttgatatcctctccgcatctttcttcttgttttgtgacttacctcattaatgttgctatgtctttatacagtgatctgttttttatatatggagtgaattgttgcatgctcaaagacgtgatataaaaagagttggagaagaaaactacaaggaggttttttaccgtaattgaggttgagggcatgcaataccatatcctagctgtcgatctgggaggatccaacgactgaaattggttggtacctcatggtaccgtgtctctatgaggggcggtaccaattgtgataaggtggtgaaagggtagaattgtacattcgcattaacctttctcccgatccgcctccctccatgtttgatgaaatcaaaacaacgaacacacaaaaaatagggaaaccctatattttattaatcacgattcattaacatgaatattaacaaatacatgagggctcctacaggagtttgcgttttgcctttgcgagaatgcttaatagaaagatatgatgactagagattgcgtgcagtccgctgaaacccagcgcgtagcattgaggctgtcggttaatcatccataggatgagcctatggaacacctctgattaagctgcgcttttggtcatcatcttcaaaattatttgctcaccgagggttttgaggtttgtgtagatttaatgataactgtgatatgggtggctttgcttcgccgaaacctggtcacaatatattatcaccacatccatacgtggatcaggtatcataataaagcggatgacttttgcctcgtcggtgcccagtcatatataccggcctttattccagcttgccaatggctttgcccaccgcctcctctgttcccgctcgcagtgtgatgacgccggctgccacctccgctcgtagtcgagcgtggacgtcgacgaccgtcgtttcctcctctcccgtttgagtgcgacactagcaactgccatctcctccgccccttcttaatcttcctccccctccccctagcgcctgcactctgcccatcccctcagccagatccagccaccggcggggttggggcgctagttttggcgggggcgaccggccggccgcgggaggcctttcttggctcgatcgggggcttggcgacctctggtgcggtggtctggtgtg

SEQ ID NO: 69041 - DNA, 3355 bp, Oryza sativa
ctacataatggatttggacttgtcttgttgtttagtcctctcgtagtgttctttagtcctggggaggttcataagtaccggggaggttctgccaatttttttattaaattttgacaacttttaacatatcgcattagttggcctgtttggtagagctctaactcctaaatttaacttcagaagttgggtctagagtggagttgaggtgctgcctaaaaccagctccacctctttagtttattttgtgagagagctccacacagttccgctctcattctaggtggagctgagctccagctctaggagaggtggagctagagctggacctgtgccaaacagaccatgtaagcgttaattaattaatgatctttgttacctacaaatacaccgataatcttattcatatgcaatactagtattaaattcctatgcagcacaggctccgtagcagtcggcccattagtcctatactcctattcgccaatccaccacttctcacaggtaaagcaccttttcttcctctcacattcgtcttcctcgatgcaccctctccttttcatttttacgcaatctttccttccgccatctcctttccattcactggcggccggctacaatcaatctccggcgagctcccactgcaggttctcctttcgcccccgtataaacctcccacttgatgcagcactccaacacactgtatgacccattttcatttctcttcatctggacctcccaaaagctcgactgcagccgcttggaaattgtgaccatggcgagaccgacagcggaccacaacaacgaaggaattttgaggtggcgcgacatggagagataagatgggggagcactggaagaaagcgtcgggacttggggagaaatatgcgggcttacggcggcaatgctttacccattctaatcttaccccttgcaaatggatggatgtgagtggtacctcgtggtacctggcacctcataataaaaactctcatttttttactctactttgctctatgttcaagtcagtgatctaagcataacgctgtaattaactatcctatataaaaactagatatatgttgattaattttgtttcactacccttgaaatcccatctccgtcctgtattcaatatttcgtatatatttaagttatgacatgaagtgaaattaagatcctaaagctctaacctcagtgtttcacgtcatcgtcagttctcagccgttggatcagtgacttgtatcgtttctcagccgttggatgaggaaaatgcatcactgtcagattgaagacagcccaaccatcatctcacacacagatagcacatgaggcccatgtaataacttggaccacgtgaggcccatgtaataacttggaccatgtgaggcccatctgtgtcgatctaggcccaatcaacagtgaaggagttagggtttgtttttttttttttttggctcagtgggggtttcctcatggagttagagtggtggcggtggcggcgcttctttccatcaacggtgctcgggaccgtagcgttagcttctcctattctaaaacatctttcgcttcaacttccctgttcgactcttcatctccttagcaacgaaactgacagccacctccttcgctaataaaagcatgcaccaccaacgattattcttagcgatgcaagcagagctgcgtagccaagcgcctgcttgcctagatcaactattgagctcaggtagtcaggtaattaatcagtttaagcatgtcaggttaatttctttagctccctctcactctctcaacattttcttttaatttcatggatcccaatttttccttttttatttcttcttattaatcacacaaccaattcaaattcgacaaatttaatgttgttaagtagttcttgttttcactgaaatctctgaagttgttggaagaaatcagtggaccgaccaagattattactgtccgcatcacatctgatagatagtttcagcaaattctcggtaaaatgctttagcagtgcagcatgagtggtaagaagaaccacatctttttcgaatcatgatatttatgtgtttctatatattgttatggtcttagagctgttggttgctccaagtataatttttatatgctccacaaattattgccttcattgacaatgttttaatatacagcttattactctgagggatgagtggtggtatgatatgctgtatattttatctgtgcagggcactttttttctctgaatggaccataatatctgttgagatattgcattcttactcacctgttcataagataaattattgcatggaaccatggactgaatcatatatcgtgtgctctatgcagtatggacatttgctaaaatcctactcaatttatggtgtaatgtatatgtagctcctgtaagttcttcctagatgaattctgaatattaatgtttgcttcaaatgtaatatagcgttgacagtcactccattcttaccttaagttataaatatctcaggctcttactttctctgttctgctaatacaacttcgaactagttatctatataaactaatttgttgtaatagccacagcttccatattcttaatttacctacctgctcttttatagaaaaacaattgggaaagcccctcttgtatattaattgtataaagtttattttaatttctctaccccttatggtttacatcttttgctaaccaaataggaatatatattaatgtacttcaactggctattttttttattattggaatagacatttctcattgatgtttatattattttatatatattacaattttatgactgaattgtatacccaaacatcccgcatcaacgcgtgaggtgtcaactagttatacatatgtcagggatctctacagtttactctgcggctcttcctttagtctcagatccgctgctcccgacatgagctgcgacccgctacatcgcaccactcgtacggtttccaccggcatccaccacacaccacaatatggtttgctgaccgaaagctgcaaacaatgtactcccatcagccagctttgtgcgcatgatgcctcaccatggccggcactcacaccgggtaaggatggtgctcagagtcagagatacttggcaactcacactctcgagtaaccacggcagctgccacagcgagacacattagaatgtcagcactactagtcactatggatgtaatgaaaaccttcgaattatttttcttgttcggtccacttcttttctgatgcttcctactcccatcacatcacaatgcaagacaacttgaagaaactagattctcttatatatctacctctcccattgtcttgttgatt

SEQ ID NO: 69042 - DNA, 1882 bp, Oryza sativa
agtcaaacattcttaaaaaagtcaacggcgtcaaacattttgggatagagggagtatattgcaagaatgctttcaaaataagtttgcatggattttgcaggggagccaaatgtgcatcccgttaaatcaagggcagaatcgaaaggtatccatcccaaaggttcagcagcaggtgttctatttcacatcctactcagtaaattagtggtcacttctttcctgatgcctcatactcccacacatcctactctgatgcaacatatacagcttcaatctctatttgcttttccattatcatgttagttttatttcgcttgctagtcgctacaaaatgcgctatatatatatgcaccagaaactgcaatgtctctgacggctaaaaactgtcaggaaaaagcaaaataccgtcaggaaaataggtccttacgtgtcatcgtcaggaaaataccgtcacaactagcttgtcggggaaaaattaatttgcctgacgtgtgtccgtcaaggaaattattcctgacgtgaatgcacgtcagggttaattttcctgatgtgaatttcacagtcagtgatatttcccatatcactgataggtttgaccgtcaaagatatttttctaatttttctgacaggtacaaccgtcaggaaaattggtcatccgctattgtgataatttaccatatacagggatgatccatatatatacattatctaatagcaaaaatggtcattatgatattcatcacagataacatataaacagctcaaattccatatttcattcagaaaatagaaagatcaagtccatcatagaatagttctagttcactatttcaacataacacacaagttgaacaactagagtttgcatggcctaagacacctaatagcacgtactttcaaagtctcacactccatctatatggttagaaccatatagacaaaatatccaaaagcattagtatgccgcaactccacattggtatatcaaaaaccttagcccatcttgcatgacatgtgctgtagcagcatcaaggagaagcattcaaacaaccgatacaattgttggtcgatgttgttactgccaccattgcttgaagcaatatcacatccatcattgttgtggtagccattgcagtcaacttgctgtgagcctaaatgggaggaatcagttccctgtagcagtttgaaaagtttatgattaattattccaattctaactagtaataaaaatgcatgcccatgcagcaactaaaatagcaataatggtcatccaacccctgcagcaagttggactaattgtaactatctaaactatttccattttaagcaagattcatatcatgacaaaaagttctattttctactactgactctaagattacacataacagaaaaatacagctaatataaatcaatcactaattcactaatgattattacatgatgtcaacaaattattcattgcaatcacaaatttgcacgcatgattaatgtagcgcccattctgtcgtggcgcctagcgggaaaactatctcttaaaaactctatttgcgaaatccgtttctttgcttgttgtctagtgtccgtgccatctcagatctcaaatccccgatctatcgtcaagttcaatcccgaatccaaatccttcccaaatcaaatccctccgcaaaagtctatttagcctccctcgagttcgatgggccgaatccctctcggcccatctccccctccctccccggctccctctctctctctctctctctccccgctctgcccgtgagccgcgtcgagctctccttctccactctcgcggtcgttcccgccgatgccgcccaaatcgccgcgccgcccgcgcgcgcgcgcgccgtggtggccgaccggc

SEQ ID NO: 69043 - DNA, 2683 bp, Oryza sativa
atctaatggcacgcttagaggtcaataatagggctttattctcgccgtttgctgagttgtcccgtttcgcgtgtagtttcggagcccgaagaccagcagtgcgaggatttcgaggatcaagctcaagatctcgagcgaggcaagccacctttgaacatcttgagcctatatttgaacttaattatgttgcttgaaaaatattatgcattgataggatcgcacttagtctgcttgtcccgtctgcaaggcagattggcagacctacctaacttgttgcatttgacccttccattgtaattgttataccatgttcccttgtacccacctagttgcgcctcggtaatcgtgcactctgcactggtatcgacggtcgccctcaaacttaaaatctgagaaacatcttgggtaaaacttgggttttacaaaagacttggaaaacccgacacctgggtcggtgcttgcgaactaaatgaatttccaaaaccgcggaccggggaacgtaccgggtgtacagtttcccgctcttgcacttaaggaccgtttccttggaatttcatccgaacataagacaagtacgaccacatgggtggaatgggacacccctggctgagtaactagcttatcgggggagccatgatgctaagagacatgtggattcgccggggtggtgtcggggaggacccctgggcttcctggcacagtatggtctgggacctaatctggtgttggtctgggacccctctcgttggcatatggtgaacctgtgtcggctttcgaaatgccttgtcatgaaagccttaaggtctctagtcgtagccgttctgcacgggctggatgatccgggttagtaatgtcgtgtgggtaaagtgtaccccctctgcagaggttattaaaactgttcgaacagccgtgcccacggtcatgggcggatgtgaggtgattcctagcgtagttttgtttgactactgccttgtgaaatttgctgttgtggaatgggtttgatgtttgaaaaatctgcggctgatgggatcagccaggcccgggtggccgtttgaaagctgttggccgggtgccaatcttgatcaattcaaaagactgatacattgcacatactccgaccggacgagacgcactgtctcatccgtgttgtttgagaagcactcccttagttgtttcagaaaagagtttaaataaaatcaatcgaaaaaaaaatagcagcctttccttgaagcctgcattaaacacttatttcccatggcttgctgagtactcctgtactcacccttgctctatataaataatcccccctagttgctgaagaagatgaagcggatcccgctgacgaggagttcttccaggagcaagccggctacgatgagttttagggtttcggcctagttcccaagtcgcgcctgtgatgtttggtccaagtcttggcttccgcttcccttttgtaatgcagttgtgagctcgggatctgtccgcagcccaacatgactgtactcctactctataataaagagacctctgttcctgtgatactagcactgtttcctgggactggtatcgattaacaggttaatttggagcgtcacgggctagttccggtcgggactagttcggggcgtgacaattaacatatgtatatggcaatagtggttatatcatactttaagagaaaatcacattaacaggatatttatgagaaacttagaatgcttaagtaaatagctacacatactgatggatctgttcaactaacaaccatagtttaaaggtattcggcatatgttgcaaggcatctgtataaagcttaccaatagaactctaattggaaaaataaaccaacgggtaacagatccagagaaacatcaccccagaccgaaggaaaattactataagagcagaaagcatgctcatagcacaccaattatattgctcacagaacagaattcatgtgaatgctatcattatgttgcttgtaatacaatggtggatagtaaaatcatcaataatttagtttaccaaagatctattaaggaccgcaagaggtggacacaaaaaaagcttacgatactttggctgaaccctttctaatcctgtaatttaaggtgtacctgacattaaaaatgcagcaactttcagtcatataaatggtgaaaataattaagctgtagttccactcttaattactgaaatactaaaattatatgttaaaatacttcagttgcttcaattagtagctgtggtatgagacaatacacattaatagtggccggctctcttgtaagcattctatcgtcatagtatacaagcttattacattttctcatactattatagtagtgtgagatgcagttatgcttggagctagctaccatcaatttaacgacaaaggtcccaagtatgtaaatcctcttctagtagaacatatgctgtggccattgcttcccatgtggccatccttagctgcatcgagccctctaacaattgtagacaaacctaagtttaggaaaaagaaattcgctaaaacaattctctgcataccatgaaaatatgattggcttcagatgtagcaaatctgccatcataattttctagagatgatattagcccatatctacatatctgaaagagctaaagaacaaaaatatggccggagcaaagaacagctcaggaagag

SEQ ID NO: 69044 - DNA, 2847 bp, Oryza sativa
tttttaaaatataaaaatatttatatcatgcttaaagaacatttgatgataaatcaagtcacgataaaataaatgataataacataaattttttgaataagacgaatggtcaaacgttaattaaaaggttaacggcgtcatacattaaaatacaatacagagggagtatttcccttagggcacacgatagctagacttggatggaatcaaagttcccaacatgctgccagatgttaatgtggaggatgtacatatataagtacatttaaagtagccatatcacgatggaccttctgttataaggagatcttttggatataagttctcgacaaaaaaaaaaaattattcagcctagcccgtcggctagcatggttactgttttcgtgatgcatctcattcgtatcacacgcatagagatttttctggttttatcgcaccgtagtctggcctccatccttcctgttgtgaaatgctacaaaatattctatgatgtgtagcatcacaaacaataaaaaagatgttccttttttacaagttagctatataataggagtaaattaattaaatgtttagagatgggggtgatatatataagggccggaggatgagagaatgcattgctttttcaacaccctccgtatctcagatagcaaaatacatggttggtccttaaatatctaccagagtatcatttagatccataaacttataaagtacacatctatatctataattttggttgatgtatcacccaaggtctcaagaaaacattttttagataatggaggatttatttaaactcagttaattacatcaagatggtacaatcacactgagtcacccccggtctctgcataaaatgacacaaccaaaaaaagaaagaaacaactaggaatatctcccaagcataaaagtttgacagaaacatcttagtgcctatcaatccatagactagaccaaaacccatgttcctaggtaaaaaaaactcctgcgccacctggtccaactgtcgtgataccaccacaatagtatctcgtgtcccggtttatggaggatagcccagatacgtagccatcgggtaactaaagtgataacctgcaaaggagaaaacaccatcttgttatcaaaaattatttcattcttgcttagccaaatggaccaacacaaagttatcgcgcccatcaaaagcagattcctcatgtctttaggatacatgatagccaactcccaaacatatgactaacattgcgaggatgttttaaattataagctagatgaattacaaactacacctagcaagataagcgacactgaaagaataaatgttggctggtttcatccttgtgacaaaaacaacatgtcttactacctttccaatttctcttagtaaggttgtccttggtgagcaattacgcctagcgttgataccaaaggaagattttttactttcaccttccaaatgcgtctattgatattcggaaccccggtatgtgttagagctagataatgagatttaaccgagaagaccccattcggggtgaggttccagtgaaactcatcttgctcatgtaccagaaccaaatcagctatgtgaggcaatatgttataccaagcagctagtttttcaccaattaaatttagcatttagccaacttagaaatccaccatggcaacaaatttgcgtttagctccttgactacagatttgtccccaaccctagtcctctctactctatatcttaccgtctttctaaccgggacgggttggggaggggggagggctagaggggcaaaattttgctctttatttgaagaaaaaaaatacaagagtctcgctaggtaataacaaataaattacaaccacaattttcgtgtgatatatagctacatatattatatctattttttgttccaaattgccgatggataaaagttggatgtatggaagtgatcgagtgagcccagagtttagaaggggcattgtcggtttcataaatgttgtagagcaagacaagaacataaggaacaatcaatgcatgacttgtccatgctttgattgtaagaatgagaagatgtttaccagcaccgtatgaggacaagcatgacgcatatctgatctgtcgaggattcatgaagggttacacatgttggacaaagcacgaagagcaataggcactgaataatggaaggcaatgaagcgagcagccttgtgaacgaggaaggacacgaagatatgcttgtcgcttccccattgggtggtgatcaggtggatgtcgataatgataccgatgacacctctgcgacgggctgaaaaacctatcggtgaacggtgagagttggggcccgacaagtatatctctatcatcggtcgtgacggctactcgccagacacaaatgagattttcacattagtgaccaataatcagtgatcacacactttgtggttaatgatgagggttgtgacccgttacggatgactggctccgtagtagtgtgaggtgtgttgcctgccttcacagtgatgatggcaccgcggcagattcatgggatcaccttctccttatcatactgcatgcatgtatccctatggggatctctgactaccgatgatcgatcactgccgtcctaatcatcatgatgggttaaaagcaaaatgtttgccaccatgtacagccacattagagcaggtacaataggaggctataagccatctgcaaacatattttaagtagataaatgaggagagagaatagcagcgggctatagatttgtagccaactgtaacacggactccaagacgcaatgtgtgtatgataggtgggatcatgtattaatagtgtagtatgta

SEQ ID NO: 69045 - DNA, 1887 bp, Oryza sativa
tttaatctaacggcttataatattggacacaccaatttatgtggaaattaagggatatatgttttgttttttttctcaaattttgtagcatttggtaacttgagagcgttttgaggaactttaatggacatacgtcgtatcgtttggttgagacacttatataaggacaatattaaccggagaacatccagcacgttttgtccctaaattgttttcgtcagttttgctttttataattttgtaacataatagttatctttatactatattgtatttatgtaatacatagaagcaattatttataatgttattcatcaactgtaaagaatggtaggcttattttctttaaaaaagcatgcatactaaattaagtgttaaatgaaaattaagacttttttaattggatataggttattgttttctattaatggatgaattgggtggacatgaaagtccactaaatgcattggttatatagtctaatatgatttggtgtagttcgagatgcggcccaggaatccaagaattgagaatttttttacggtggattaattgttttttggattttaatatttgtatgttaaaattcagcagctatcagtgagatggagtaacctcagttttgtatttttcttcagaacagaagaattaaacattggtgctaattacgtctaaatagaaaaaagtacatttagttctaataacaatgattaaaagaagcaatattaaacacataccacataactgttgatcttcgttctttctgccccataatgttttcttgtctgtaaactcaaagtagtagtccgagaaacattcttttttgcttcgacctattttattattgtatcgtgataaaaaaagattttgagatatctttcggtacacagtacttatcatgttccataactttgattatttttaaaaaatgtataatgagtttatcttaatttttggcctaaagtggtttgccaattgctttgggattgaggcatgtattgagttgcctcgaagaaaatagtatttacataatagaacaatatattaaatgacatgtttgcaacaatcataccttgcatctagtagactcatctgtataccatagaactcacagccattgtaagattaaccgcatcctatagcctaatcactcttactttaattatacacaatacttatcatgttccataactttggaacttttaaaaatatataatgagtttatcttaatttttggcctaaagtggtttgccaattgctttgggattgcggcatgtattgagttgccccgaagaaaatagtatttacataatagaacaatatattaaatgatatgtttgcaacaatgataccttgcgtcaagtagaatcatctgtataccatagaactcatcagccattgtaggattaatcgcatcccattgcctaatcactcttaatttaattgtccacctatcattttttctgtgttaacgcagtaatcaaattgtaaagtaccatgttatctgcaaatgttcatatgcaatataatatatacatttatgttattcaatagatgcaatatagtgtagccttaattaatacaggatagcattattgtgttcttctataggtgcacgattaccttcttttgccaaatatgagcagcctgaattgactaatgtcaccaaacacctcttatgccaagatgagtcgccagatagagtcgtgtattgtagagattaaaataccatctggtcgtggtgttgctgaaggagataacactggtggagaaaccctttgtagtcccggttcgtaacccccctttagtcccggtttccaaaccgggagtaccatccgggactaaagatcgctatctttagtcccgggtgaaataaccgggagtaaa

SEQ ID NO: 69046 - DNA, 2353 bp, Oryza sativa
  unsure (1)..(2353): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgaaacaagcattatcttaatcttaattaattaaaataaaaccaaagatatttattttgagatgtaaattttgaaaaggctaaaaataaagatgctccaatcttatagaactcaaacaagaaccggatataaaacttgtcacaaaagattttctctaatattttaaaattttaaaattgaaatggttgaataggaagggaaagaaatacaaatgattaaaatagatgggggaaaaacaaataggactttagccccaaaatatttagcatggatttttgatggttcgataataggctaaaggagatttggatttttgaataaaggaattgaaaatgggtttcttagctcaagagcaatcactcaagtatttgtgataatattgttctttgtgccaaggatgtgatcaagccatatagattatataggtggtgtgatcaaaatagaaacttgaccacataatggatggtagcatattttggttgaaggggaagtgaagattttggggggaaatataggaattaatattttatgtactccagagatgtcggagaatgatatttcatgtgctctggagatagttgggtgagatcaaaagggtatttgtggatgttggagatgttagggaatggattcaaaggaaatataatttagagccaatgttagggatttaaataaaataaatggagaggttttgtaaaatttaaaagagaacaattaactttgcaaataaagttttagatccaagataaaagaaaaggttaaatgcaagattgctccaacgtaagaatcgacaaaagcatgacttaaaatatttcgcaaaaaaaaaatcctgaaattttgagtccgttacacgtacacatgggaaatatgtcatttttgacatatgtgaatgattaacctctcccttttgcaaacatttgaactgtgacaactgacaatcaaatgtggagagtactagctttaacgtgttaatttggttcccatgttgacttaccaaagttttgatgaaatctacaagcacaaaaacatgttgcgtcaaaaaatcaggtcagcatctgtattatttcgcggagggacttgataagaaaatcatgaatgaaggccgtaaacacaaaaatttggactatatatgactatcagatcacattgtcactgatcctgaatgatagaccacctgagaccctgtgattttctctcttttctgttcctccattcttattgcttgtccgtttcaagtttctatatttggttgcaaaaacttgatgcgattcattgcaatgcgttctacggatatctattatctagctcttcaaatgctttaaattcgtgtcggtgaggaagtcctcgcatttgtgcaaatatggtgaagcatgtgtctgcaccaacgtcatcacatatttatcctttatggagaagacatagtgtcattatccgaaatattacaaatgcgatccaaaatagtttaaaagacaaagaatgaaaatggaggagaaaaatttgcttcatgtatgcactctaagaaatattgcttcatgcaggtggtaaagctccactccacatatgttgttggactaaactctaactgcaatacattcttattcatctataccgctagcgaacatgtacatgtgtatatgtgctgacttctgaatattcatgcgtcgaaaagcatctagctgcatcatcattcagctgaagattttcaagagtcagagcagcaaatgagtctgtaatgatgtggcatgctgtgcgagaacttggtttctatcagtggtcagagagaaacaatctgtactgacttgggagacttcaggttggtgtggagcctcctaagagatttgtttgagtacagtgatgagataatttcttcacaagttcacatattcccttatgcctcctatccatatcgcattatatgctaatttggttttagatagatgatccatgccactacacctaggggtgtatcacaatgtagtgtacaccatgaaacgttcgatctctctctctcctccttcctgttccaaagtctttgttggatgcctggttcttgctagttgctatagttagaatgtgttggtgtggtggcaagggctgctgcatgcatgct

SEQ ID NO: 69047 - DNA, 1300 bp, Oryza sativa
gtttttgtcagctttccttcctctttgtacagtcgttgttagctttatcactgcttaattctagttgtatcacatcaaatggtaaaaaaaaatatcgaatataataaaaagcaaaggaataatgacaatggaggaaattttatttttatgtgtcacatttgttcaatcttaagaaaatatttgcttggcacttaacactttttttagaaacacattacatacacagatgtccacaacgcacgtacagtcacctctatgaacgcacacacgcacatcgtaccttgcatatcactgaaagaataattatccgtaaatgggagcatccgtgttaaatctaaaatttgaacccgggtggattggttccaccacaaggaacctaactagttaaactatgctcacttcgcgcttcgaacttaacacttagttgactcatccatctaattaaaatatactttttattcatatgcaaagtacagctaatgaacatgtacacgcatatgagctatactcgcctatataggttcacttccgaatattcaggtgtgtctaaatagcctggtcgatctctttcatttgcagatttcatccttgattacactgggaaagtgcaccgaataccattttcaactatgctcttactatatttagtagaattgttatatgacacatggttttatttatgggagaactacgtcctcgagcctgaggtctgaatttattcataatagtactcctattgacttcggctttagtgatgaacaaatttgctttgtcgaaatccttataatgagtagcatttgctgctgccgaataaaccaactttaagatgggataagatgctcgataaggcatgaggtttaatatcataacagtttcttcgtagtaacaccaacaaatctcatccataactctttgtactttgaaaacggacatgtggatgtgttttcgtgctttgaaaaccctcgtacttaagtagacgatcggttggtatacttttcttctgagtttctttggcccactcttcttcttctttatcctaggggtatactttaacagtttgaaacttgtcataaataagattattccccgcttacctatttcttttttttaacacatttgtttcgttatagactagccatcacaccatcatcaacaaggaatcaaaagccttctcataaccaagcctcgtcctgatcttgtggtcttatgaacttaacatgcagctagccggacatctttcattgcacaaattcttagaagaacataagtatgtacccttgaatgccaattctggaaatat

SEQ ID NO: 69048 - DNA, 745 bp, Oryza sativa
cccttcacgaagggactatcacgaaatgtgataaacaatgcatcgaaggagatgggtttgagacccatgtgagttatactatggtggtaacccagtctatgtgatcggagatcccgtgaattagatcctgggaagaacaaaccattagtaaactagaggagagtatcaatatatataccctctccaagtgaagatgcatgtactctcgtgagctgcaaggcaggttggctatgccttaatgagttctgttggctttaattagcgaagatgttgtcctgcagagcattcttgaaagaactcacctttgtgagcttgactgttggtcgcagtctatgaagattttgggtgaatcttctaggaagcttactaaagacctaggagtatgacttatacgctccacccgaggggtagtctacagacggtctagtaccagataagactttgagtgaaacttgcttgcacaagacttgcaattcaaggcgtagtccattgttcaagttgtgagtaagtgtagcttggagttctaggtggatgttcaaccttaattggtctccatcgaaccgctggtatataaacagtacattggaaaaggcaaatctcagtgggattttgagatttggtgggggattgttggaattaatgaatgggccttagcccactcgaagattaattctttggaaaatcacaaaagcccacctcatgggatggcatgcatgtggagtttagtaccaccttgcttattcta

SEQ ID NO: 69049 - DNA, 731 bp, Oryza sativa
cacaactcattcaagcaatagcaaggcaggcagcatgagccatccaagaagaatttagaacatgattgagagagggggagggaaataatgggtgtattacagtgtgatacaccctcaggtgcagaggcatggaatggttggtttcattttccaaaacaaattacaacacgagatatgaataggaggcatcagggaatatatcttgtggaacaaatcccatgaaagaatctcccaaatcagtatagattgttcatctccggaatctgtgttgacaggggtgacagaatttaccaataccaacgttctcacagcattgtctaaatgactcgtacgcatgtgcacgcacattttctgcttcatgcgcaccaaaaccaatgttctcgcagcttcagatctgattcagcattttctgattcatctcgtatgtgacgttttctgatctgactcttgtacatcttcagctgaatatgatgatgcaactatggctgctattccaacgcatgaatattcagaagtaagcatataactcatacgcatgcacatgttcgctaggtatatcttgcagatgaatataaaaaaaacatattgcaattagatggagctttctccacatgcatgcagcagttgttaagtgtgctgctccatttcattctctctttgacctcttttgtaacatttggctactacacgacatgctaaaaacaattgtactaggagggaaaaaaactgaa

SEQ ID NO: 69050 - DNA, 1028 bp, Oryza sativa
gaatgtatgttcaagaatttggtgcagaatgctcctacccgaaccagcgtcgtgtttatttgtcatacctggattctgttaaatacttcaggcctgagattagaacggtgtctggagaggcgttacgtacatttgtttatcatgaaattctggtaatgttctatgtttgctgagtttttctaaatttaaatgcgttgttttgccaggctggtcatactatttttgtatgcaactctttgggggggattctgccttcctccttaggctagcgtttttctgcactatctaatgctaggtctctatgtgttcagataggatatcttgaatattgcaagcagcgtggattcacaagctgttacatatgggcgtgcccacctttaaaaggtgaagattacattttgtactgccatcctgagattcagaagactccaaaatccgacaaattgagggagtggtaagacctttgttgacacttctgttactctgctcacttttagctcttctagtttacatgatttctgatgtactttacactcaggtacttatctatgcttcgaaaagctaccaaggaggagattgttgttgagctgacaaatctatatgaccatttcttcattactatgggggagtgcaaggctaaagtgactgcttctcgtttgccttactttgatggagattattggccaggagctgcagaagatatgatcaatcaacttcgtcaagaagaagatgaccggaagcagcagaagaagggcaagacaaagaagattattacaaaaagagctcttaaagctgctggccacaccgatctcagtgggaatgcttccaaggatgctatgctgatgcacaaggtaggattgtacagtggtttgcgtgctccttattttgatagatcacatggctgctagcactctacccctctttccctttctatcatccttgctcagtatttgtttttttcactttactggatggcatctttaccatgaacttgatttgttatgtgcagcttggggaaaccatttatc

SEQ ID NO: 69051 - DNA, 16660 bp, Oryza sativa
tctggcagttgtcaatacccaaactgccggaaagtcaagggactgtttcgtcatgggatgcagtgcaaaacacgtgcttcaggagggtgtgttctttgcaagaaaatgtggtacatgctccagctccatgcccgagcttgcagggactcaggatgcaacgtgccgagatgcaggtgtgttggtgcttctcacttttgttccgtcaccttgccttgtgcttgatctggaataacaccctgaccacttacggaaactatacactatgcagggatctcaaggagcatcttcgaaggttgcaacagcaatctgattctaggaggagggctgctgtaaatgaaatgatgagacagagagcagcagaagttgctgcaaacgagtagtggcatctgtacagctatatactgtggaaagaagatagggagcgcgcagtgtcgctgccctcgctcattcccactcccaagtagaagcttgggatatggttgaattagaggatctagctaagaagttgtctcagatggattcgtcccatgaaactgtcctggagatgcaagacgtcgcgcattcttccgccagttgttaacctatggcttggaagcctgcctctgcctcctcttcttcaaaggaaagaaatgaaatggatgaaaggggtgtaccacaataggtggtaactactgtgttctgtgctaactagttgcaccctgctgacggtgcccggtgaaatcgtcgtcgtcgataggacccccagcccttgggtgtggtgattcttttatttgacctcctgtactagtggaactaatcttgttttgctgcttgcctcctcttcatgtataataggtttctggaactcttattgttgatgaaaaattggtctagctgttccccctccagcaccttgttgttgttgttgcctccatcaggagtgagaggggtatagggaagaaaaaaggaagaagaagagggttgggcattggatatgaattgtttatttctgccccccattttgtaggaaccaatctttgttttaaagtataaaagcatagcatatcctgcattctgttgtatcattaacattacatctcctgcatttcttcttgtttcccctctgttgcatttcagctggctatttctgtgcaatattttctctctggaaatttatgttttatagtactatccgtcctagaaaataatgattttttttgacacggatattaagaaactccatctacttttgaaggcaatatttctaaatctgaaaattttacttttgatgggcatatttcaatccaaccagatatcttcttaatgactttctcggatttaatatgtaactatccattctttcacacaagattggcattattccacacaagattggctacatgctcatggagaaatgtaaatattaaggcaaatgaatcgtttatttacgatgaataactagtaacatgtttaaatgaatgataagtagaattacttatccttggtcattgtgctaagatgaaatataactatcaaaagtagatggagtgaacatgaaggttgtgattgtacgagggaaaaattaaatggtcgacaattatgattggttagaaaaataacgttcgtggacaaataaagaccaatgttgttatactccattacggaacggattgagcaagtttttttttggaatttcacctatataagtgtgtcctgcttctgttgtgccactgccagtaacatgtgcacccctacattaattgctgtgtttcctcccctactattatactctggtcactgtaaactgtgcgcattgagatttaaccaaaatttcgaaattcgcttgaatatcctatcagttcgaattttgataccaaaggcctcatgtttgaattacgatgagctcaaagcctcgaatccataacttcaagcccgaaccctgaaatcctggccgtccatttgttaatcgggcggttggcaaacaccctgcttgctgttctatccgcgccttgcccgccgtcgcgtgtggctctcgcctcgacgaccatggcgatgttcgcgcggcgcctcctcgtcttccacctccgcccgcccgcgcatcccctcgcagccgccattgccgctccccaccgccgccgcaagcacgacgccgtcgcgtgcagagccgctgcggggaaggggacgagcaaggccagggcgagggacaaggacggcagtaagcggcagcagaggcgggcgctggaggagcacctcaagcggcgcacgcgctccggcgccgccttcgacgccggcctctaccggcggcactcccacgcggagcacgtccccgtcatgctcggcgaggtcctcgccgcgttccgccgccctctcccgctccgctccttcgtcgactgcaccctcggcgcggccggccactcgctcgccgtcagtagtagttccccctcctgttctcccttacaattccagttacctttacattgctcgccgacgatagctgctcgacgaaatgctgcttcttcttcttggctctttagtgttatccgttgtgtgatcgttgatgcgcaccagctgtttgatagaatgcctattcggcttgtgcaatagatgatggaggcacacccggagatggaactgtacattgggatggatgtcgatccctctgcgctggagattggccggagccgtatcgaggccttccttgccaatagggaaactaatggagatgacgaagatgcctcgcagggaacactgcgtgcatacactcacgccaagaatttcaagtacatcaagcatgttcttggcagcgtggatgagaacattgctgttggaacgtctggagttgatggaatcctcattgaccttggcatgtcatccatgcaggtcaggtgttccgtaaaacgcagtgaaattgatggtaagcctcctttatttcccatttagtcatctgaatgccctgttgtactatccacaggtgaacagatcagacaggggatttagcgttcttcaggatgggccacttgacatgcgcatggatcctaaggtcagtgttgctttgctctagtttactgcccattccttccttccacttgcatacgaaaatgcattgccacaaaattttcttctagttgaagggctatgaacattgattgacaaaactacagtcttacatcttcatcttgttaaagtctagttttgctggagcttggaaaacatgatcccaaaacatttttatgcataatgcattcatattgcaatgcaaacttgtataaaatctttccagaaatttctaaaacattgaatcacactccagtccattttatttggatctgtcttgactgtagttacacttgtgttgacaattggtatttcactttttgcaaacaatgttaacccagtaaattaatacattatattacttgaagtgcaacacatccttaccaatggcctgttcttttccatatgaataaactaccgttagatttgccatgtccaaaaatttcaaaagaacgtagatttagtgccactttatcatttgcagtaatccataatcaactagcaaagtgacaaagccccaaaatagcacataatcttaatcttggttgccttgaaatctttgtactacacctaacctatatatgagattagacaggcaactttgaaagcagaagatatcttgaattcttggcctgatcttgaagttgggcgtatcctgcgtgattatggtgaggaaagtaattggcagtcccttcagaagcggattgttaaagcccgggctatggggggtttgcactcgacaggggagcttgtcaaacttatccaaagaacgtgtaccagttcagggggtatgtatgatgatggtatctctaaatgtggttatatgatttgtgtatgtatgacctgatgttttatgacaaacttataaactgcaggaaggcaaggttggattaagactgcaacaagggtgtttcaggccctaagaatcgcagttaatgatgaactccgaactctagaagatgcacttcatgcatgctttgattgcctagcaacagatggtcgccttgcagtaatctcattccacagtttggaggatagaatagtgaagcagacctttctggaacttattcatgaagatgaaatagatgatgatgaagacgacttggtgagtgctgacattgatagtgaagatgaaccctggtttaagcagagagtgcaaggaaagaatggaaccattctaacgaaaagaccaatatctccttcacaagaggaggaagaactgaatcagaggtgcagaagtgccaagctcagagttattcagaaggcgtgaacctggattaatcatatgatgactaaattctgagctctgaggagcagtgaggacatccatgcgtgaactcatataacatgtgaatgatcgcgcttgcagttgcaacaataataactggaaaaactagctcgagaggatgaaatggccatcctgtttctgcagttaacttagagagtagagcttaggtaagtccaaaaattaatctcactatttgcaccaccattttgtaccccattcatgtacactaaactctctaacaatagtttttactgcatctcttcttgttttttttttttggttatgcaggaagcctctgattaaattgcatattttaccagctaattaaacatatgatggttgtttgacttgggatttcttgctcatatcaattgtacttgtttacactcaagcagggtagggaaccaccacaaaataagtcaagttcagataaaaccaaaacatgcatattcagaatccaacgttggtgctcatcttgttcttggcagagatatggctacaaccttttcgtggctcacattgtcacccaatagttgatagtacaattaaagatcacctaaatttaagtcatttacttctcatatttcatattataagttgctttgacttttttctaatcaaattttaagtttaactaaattcataaaaagaatatagcaacatttcctacataaaataaacatattatcaaaatgtattaaaagttaattgtaatgaaaataagtttgtattgtaagtaatgctattttttaaaaaatttggtcgaactcaaaaagtttaacttagaatatattataatccgctttaacttttatctaagttaaaactctataagtttaactaaatttataaaaaaaatatcaattcttataacactaaattagttcattaaatctaatattgaatatattctaataatacatttatttggtgttgagaatattgaaggatttttctttaaatttaattaaatttaaagaagtttgattaaaaaaaaaaaaggttaaaatgtcacgcggacgtacgcaggcaagccagcgacgagtccgtagccaccagcgagagcggtgaatccggcggagccacgtcgccggcgccgccgatcgccaagcccacaagccgccacgtcaccctctcctcctccgcgccacattttctttaaattatttttctccaactcttaaatcgtaccatgagtcactgcagcgtgggccccacctgctcttctgacaaccacatccacaagcaccagcagccgcgagattttcttttcttccatatataagcagtgaagcagcgcacacgagcagccaagaatctctctctcgcgcgcggatcgcctcgaattcgcgagctcgcggaaatggcggccatgtcgtcgcgctgtgcggcttcctcgtcctcatccgcgttcctcagagctccgcttcccggcggcaggcaccaccagggctcttgcggcttcgtcgccgccggcggcggtgctaagacgacggtgagggttgcggcggcgctcgacacggaggccacggcgaaggctggcaagtcgtcctcccgggcgcggcgggcgaggaaggacggcggcgagcccggtggctcctcctccaccgcgctgcttgctcctacccatcccgacggcggcggcggcggcggcgtggcgctcgacgacgtgatcgtgaacccggtggggctggggcggcggtcccggcagatcttcgacgaggtgtggcgcaagttctcgcggctcgggcagatgtcgacggtggcgtcgccggagcaggaggagcaggagggcgtcctcttccgcggcggcggcccgatgtgcgacttcgccgtccccggcgcgcaggacaccaccgtcctcgtcgtcggcgccaccagccgcatcggccgcatcgtcgtccgcaagctcatgctccgtggctacaacgtcaaggtcacttacttttacctcttctttcttgtcaagctttctcatgtcaaatcaacaaattttgatcaagggtgtgtttagatctttgggggtaaagcttttaaagtatactgacacatatttgaagtattaaacgtagactaataacaaaacattacagagtccatctgtagactgcaagataatcttattaaggctaattaatccgtcattagcaaatgtttacggtaacatcacattgtcaaattatggcgtaattaggctcaaaagattcgtcttgcaatttatctatgttattttttttttgaaacaggctctggtcagaaggaatgatcaagaagtgatcgacatgcttccaagatctgtggacattgtggttggtgatgttggcgatgcttcttcagttcaagctgccgtgtcaggctgcaacaaggtaatctactgcgcaactgcacggtcaacgattaccggtgatctcaacagagttgataaccaaggcgtgaggaatgtcaccaaggccttccaggtagttcttgtgaaaaatctttgaagaaacatgcaaatcaatcttatttagatttctgatatgtttactgaactgtgatttactttgcaattcaggattactacaatcagttggctcagtcaagggctggtaaaagcagcaagagcaaactgtcgattgccaagttcaaatctgccaaatctcttcaaggatgggaagtgaatcagggatcatactttcaggatatttatccttctagattcgatgaaggcaccgatgcatcgtttgaaatatctgaaaatggacaggctgttttctcaggtatcacctgatatgaaagctattacatcatgatctctgaattgtacactatagtgagattgccttttttaaaaaagtattcagatatattgcttcagttgatgatttttcatttgtttttaattctcttatcaaaattttctgtgattagggtttgttttcacaagaggtggatatgttgaagtgtcgaaacggctttcgctcccactaggttccaccctagacaggtgtgataagattcttcagtttattttttcttaataagtttgcctgatgttgcaaaatcatgacatgatctgttctttgttatgctgccatgttctacctgaagatacgacggcttacttctatccgtgggtggaaatggaagatcatatgttatcatccttgagactggtccactagctgacacctcacagagcaagaaatattttgctcggatgaacactaaagtagggttttgcagggtaagtggcaagtgatgatcccacttcactaaattacctgtttctgcattgctaatcggagtgatcagttaactaaatgctgaaaatattcttgttctgttcaggtgagagtgccgttctcagatttcaggccagtgaacccacaggaccctcctcttgacccttttcttgtgcacacattaaccataaggtttgaacccaaaaaacaggtcagtgcaaaatgatttgttgaatcaattggagataggcaatgcttctggaagttgttagtttaccaataaaatccttgtgcagagacctggtgactcgtctcaaggagctagtgacccaagaaatttccagcttataatggaatttataaaagctctacctgtaagtaattcacctgattctatcaattgatctgccatttaaatttccaatgttgcagatatttaccggaaatttcatttgttttttgcagactggtcaagaaacagacattgttttggtttcatgcacaggctctggaatcgaacctaacagaagagaacaagtcctcaaagcaaagaaggtatcacttctcataaccacacatcaaatgcaaactgttcttgatgcactcttgatacaaacattaaccagtttattatctctctaggctggagaggatgcactgaggagatccggcctcggatatacaattgtatgcccaggtcctctgcaggtacaacatctgaatgaattggattgtctttttttttcttttcctaaatgtatattttcagcaccagttgtttctcatgtagtgcattgcatattgatattgctgctgaatttcagtacaagctgtagctacataaaccttagtgtcaaaccgatgaaactaaatattcatcaagcaagcagccaagatttaagcatgcaagttgatcactaatcatagaattgagtgtgaaatttgagtataaattatgcttatttccaagccccaaatatactttcttcagtccatactacagtatagtataacatagtatcccttcttcattccaggaagaacctggcggtcagcgtgctctgatctttgatcaagggaacagaatctctcaggtgacatagcattcactgcgtgcaattatgcctgatataattgcatgttcaatgttagtatacatgctaaccattaggcttttcaactgaaatataaatgcagggtatcagctgtgccgacgtagcagatatctgtgtcaaggcattgcacgattcaacagcaagaaacaaaagctttgatgtaaggaaaaaaaaaaccttgtattgtgaactggccatttgtgcaacaggtagtgaaatgactaaccaggacaccaacctgatttgtgtaggtgtgctatgaacatgtctcaaagcaaggggatgagttgtatgaacttgtaagccccaaaactgaaacttcagtagattcatctttgtacagcaattcgcaaaatttcttctctgatctgtctgtgttttgcacttttgctaatgatctgtcgaattgttttcaggtggctcatttgcctgacaaggcgaacaattacctggcaccagctctctctgttcttgagaagaacacctgattgatcaaatgatcagtgacccatcaaattttatgtcattctgggtcagattattgtccatgtgtatatgattcatcttgtaaaggttttccttttctcatagaaaccgtgtggagtccacttgtgccatgatgaccgtctccagcacaaaagtgaaggagttgttgacaaaaaaaatccatggtcctactactttcccatctctgtaaaacttgtagaattttcataacaattgggcatgaattagggtgtgtttagttcacactaaaattgaaagtttggttgaaattagaacaatgtgacggaaaagttggaagtttgtgtatgtaggaaagttttaatgtgatgaaaaagttggaagtttgaagaaaaaatttgtaactaaactcggccttaggcccatcctatatagcaattttgagaactttgaagaagtaatgagcatgaggaaagtgcatttgtctaagaagtgaatatctcccaatttgtgtacatttgtatcgtttcttcaattttgtcacgctcaagaagctatgagtatgaattttagaatttaattctatgattaattaagggatgttcttcgtcacttttgttgcctagttctgtgataataatgctatcaaaacaagtaaaactcaacctaaaatttttttgaagtcaaactttattaggcataccaacttaagtttctttttcttgtttccatagcaaagccaaagggagtctaaatttacacctccatcgttgaaacattggcagtggctttgctaggcatgccaactcacgtatcaccctctggtaccacctttgtcatgccaactcatatttctttctctaactcgtgtttaggctcattttgatctgtatgagaaaaacctcgaaaatttagaggattttaatcctattgaaaaagtttctaagggtgtgttctatagtacaatttttcaacttctacttcctcaaatattgcgcgtacgcttcccgaagtgctaaatagtgcatgttttgtaaaaaaaatctatacaaaagttgattgaatgtatttttagctaatatttaattaaccatacgttaccatttatgtgacagaagtgttttcaatccttcttaccgaacctcagataagaagccctttgaaaaaaaagatagaaaaagattgaaccatatcaagtctatctctctcatcttttttttttgttttttcctatggtatattcaaacgacttatattttgcatttacatttgtatgaaaatactatgcttttatattcctttttttttcttaatccttcaattcaaaggatcccttaaatttaacatattatttaaaaaacagaatggagatatgttatactataaggacccacatgaaaagccatccaagtatttcattatacaccactcttcattagtactccatccatccattctaaaatataaatatttgaacttctttagaaaagattaaagttgagagaaaacgattttatttttagccacatctttgatcaaattctgaattttgaactagttagattctttctccaaccttctgattggtcgaaaaaatactgagattttggaactgctctcagccggccaggcaagtgttaccaaaagataaaacacggaaaggaaagaaaaaacccagagatgcgccctgccaggtcagctttccgccgcagtctgcccctctgccaccgggccccaccccccacccctgccacaggttactgcctctctctgaccccattgaccaactccgttgaccagtcaaacctctctctccctttcacattttcacccgcctctcgccgctgccgtcctcgctatgaaatgaaatgaaaccaccaccaccaacgacttcctcctccacccgcttcgtcttcgtcttcttcctcctccacctccacttgatcccagcatccgcatccgcagctgcagcagcagcggcgaggtggaggtagctagatccgtgggaggtggtggttgtggtggtgagggggagatgaggggggaggcgaacggggaggaggagcagcagccgccgcggcggaatcatctgcgggacgacgcggaggaggaggaggaggtggagcggagggcggcgaggccggtttccggtcagcagcagcagcagcagcggcggcgaccgacggatgtggggggaggggcggcgatgaggagcgtggggtacgtcgggaagcaccgcctctccgccgccatcgcccgcctcgaccaggagctccagtcgctgcaggtcagcgccacccccctccctcctcttcctctcatctcccatgaacttgattctccgtgtgcttattgcttatcaagcactagtatgtgtgcctttactgtctctgtgctgtggcctgtggatgtgtagcgagtcagcagttcaagctgtggcgcgatctagatcttgagaaaatccagaaaccgaagttttttttttccgttctatcaatgccttcttggcttcttctgttgcgtatgcatgtactgatgtatgtgtacaatcagtacatgcaaagggaaacaaaagagttcttcctttatccacagcttttgttcttacattgaaaaattatgaaagcgttgaaccaaatcacccagactactagacttatagtgctttaaaattaggagtttgtcctaatttgttttttttacattttgtccatgaaacatgtccaccattgcccatattaagccacataatctgcctacttttgtttaagcgggttgcgagtttgagagctttcagggggtattgacaagaacacaagtaacaggattctggtggtctcaatgcatatatagatgtctcctactggacagcttgagctgtgctgaaaatatgattctgcacaactttctgaagtgcagcaagtgttacgcataatgttccaccccctcagtgatttagatcctaaagcagcaccagtggacaagttgaggtacttgcatcccttgtcttcacttgctcttctggcctgtgaccctcagaaacacacatatgttgcttgcctctatatggtagctttctagagcttgttagtgaaacatttgatgggaactgttgactgaggcttataatttgaatggttgaatttgatgaatctactccattacaagtatttgttattttccactatgttctctgattttcagcttctctctcctaggaggaccttgtttttctcctaggggggtaggggatccacagtagtcttctattctcttgggtttaattctctgtattttttctaagttagtggaaaacaagctatgcgcagagagaactacatacattggcaagaagaaaattcagtttcccttaatattctgcatcatagacaggttggatagattattgtgcaatgcaagattcttcaagaatctctccaggctgcattcgtattaaaggttggtgtgcttagcgtaatcctaatagtataaccacctctataaaatcctattcggtccttctggtgctaggccctggaattggtaattaaagtcctggatttagtaatcggaatgaatatgtgctattactcaccagattacgtgtaattatttgtgagcacaatcagttcaactattcttctcatttctgttcgcaaaaacatcttgtttcatcatatcagttgaaactatacagtgagaaattcacttacattttctactggtattttgtttttacttagccacgtttattagaaatattaggctaaaaatcctaactaactcatcgagaggacttttcttatgatttcatttggtttattgtcgccatgctttagttttttttttttatttattgtgatgtatagtatatgtgcatttgacacaggatgaactgaacgagcttgaaaccatggaaccggcatctgctgcatgccaagggtaagtaaattctgagtgtagcatttgttttcccttgtacctaacgtttctctgttttgtgattcttttgtcctcttgatcatgccagagtgatcacaagtacagagggaaaatccgacccgcttcttcctgtgtaagtcgcgatgtttagctactcattctagtacctcaccctgcaagatctgaagatcgtactgcataaggacttgtgtaaccatgatctttctcatctttacagcaccattggtccagagaacgcttcttgggagagatggtttcagcgcgtgcgtagctctcgcagtaacaaatggtgggcatccaaaggctcagatttttcctagccccctcctgcaaagatgagactaccagctttgtgcagattaaaatcacctgaactgtatcatccacggatggcttggcagccaacaagaacacaacgtcgcttgccgccttgcgggctgtctagttcttctcaggacacgcaatagtttttggagagaattgctattgttgttaatgtatgtaatccctaacacgaacatggacgaatgtaccgacattatcttccagagctcttgattagctctgcttgattgattctaatgctttcctgcaatgccatgcaaaacattcagattgcgatgcacaatatgtccatggaaaggatctgggaagaaaaaaaaataacaccaggttctgacctttgacgctcagaattttacatgtgctgtgctgttaatcttcagtcactggccagctgtttatgcaggttatcaacttatcatgcaggtttagtctcgactctgaaatagagttgccgtggttgtgaacaaaatggacggcaaatcagctactccgtcctgaaatataaacatttttaaaatagtgttaagtcaaatatttttaataacaaaaatatagaaaagattaatcatcattaaacacagtatcataatatacaactctttttatttaaagctttttacttttaaacatattattagtcaaagtttcatttcgaaaactatgctaaattcaaaaataattatattttgggacggagatagaactcgctactcagcaccgccacccagcccagccatctcctctgctctctctgccatggcttccaccgtcgccttctccgtgtcgccaattgtccgccgcctgcactgcaggaggccggggaggggaggactcggaggagcacttctatgcccgtcccgagaaccaaggccgtggcccgaacgccgcggcggcgtccgtgcagaccaaggccggaaaagatcaccgacgagcgcggagtggccgcccggctgccgttcccgacgccgcgggcaccggagatcgatcaggcctggcatgctcccccatagaagcattggattcgcaaagggggagaaatctcttgctgtcttcgtaatggacaggtgagttaaccctattccggtcgatcgatatgagaagtttactggcaaccataggtgattgatatgtaacacaacctcctaaacaatccgcattaatcacattgtgttcatctatgcaacagtttagtacacaatccatggtttaacaacaattcaaagtggccaccgatgagttgattgcacatggtaaaaattgctgatagactttgggcttttatccctctaaaaaaagaattgagatgaaaaaaaaaaaagaagagctactacacctttcacgatgatggctgataacacacacgagcattttgtcttattttatttggatgcgaactctgaaataccagcggctgacttagattccattagtactgatacccaattaccccttttgttacgcaatgcactggatagaaatagaataatggctgatatcatttgagatgtcagcggctgggttctattctccttttgacttgtatctgattggtactgatttctgttttgtcagcggctcaagattggagacattacttatttaccttctgtaccattagtgtcaattcccttttgttatgcaatgtaatggacatctatcttacacgaaattgaccatcatattataaagataaatcacaatgaaagtgaatacacaatgcaatagatttgatgcttctgaaagcatttctgttagtcttaacctcttatttttccatggtatgaactaatcagctgcctagagtgacccacagcactgctctgcctgcaacattgcatatagtaattcgagagcacatagtaaaccaaccataatgatttcccactttgacttttggtttattcatacgtatctcttgcatctctaggactttataaagcatcatttgttgttttatgcattgttactctacacagcaaggacctcagagaaacatacaagcaaggtgaaggttcccaagatgatgtcctcaattgctgtagcagcagctagcgctgggctacgaggactagcacagcccatcatcggcaatctcagcagttttgcatctcgctacgttggagtggacatggcacgtgagatggtagacctggagaccatcatccttccccagctcaacctgatcattgcatctgccgagagccaacctcagcatgtgaataacatagtgcagaaatgtctgcaaagactcaaggtagagctgtctcaagctgaagacctgcttgatgaacatgagtacgatcttctcaaacacaggatgaaacagaagaaattatctgtgttttctgtacatggtcagtgccagggtcctatttcaaatccttttatttgggttctcagtaatatatctagcttatcccctcacaacactaagatgttgaatcatttgaaagaggtcaagagcattttagaaaaagcaaaaaatttccttggtgttctttcagttgcaacacaagtgagtgctgacactgcaggaagcagggttattcaagacacaacaacctttcgtgaggaaaaggtttttggacgtgacaaagatcgagattctataatcaacctcttatttgatcctgccatggttggaggaggaaattccaatataaaaggctacagtagcatcgcaattgttggagctggaggcgcaggtaaaactactcttttgcaatatatctgctctgatgatagagtacagaacaatttccatgttatttgggtatgtatgtcacacaagcttgatattcgcaagcatacgacagaggttattgagtctctggccactgaggaaactcctaagatacaaaatctcgatactcttcaaagaaaactcaagaatttgctcctggaaaaaagggaaaaggaattattacttgtactggatgatgtttggtttgaacaaaggcaccatagtgagtgggaacaatttctggcaccactcatctcggctgaatttaacaagggcatcaggattcttgtttctagtcgttccaaagaacttccttcagttctaaactgcaggaaaacagtttctttagaggacatagaggagaatgatttcctaacatttttcaggtactattcccttggtcatgtcctgatagggaacgaagtagtagaagaggaactacaaggaatcggagatgatattgccaagaagctccgacggtccc

SEQ ID NO: 69052 - DNA, 13556 bp, Oryza sativa
  unsure (1)..(13556): unsure at all n locations
tgtgctgtccctctgctttttcagcagttacacactaccaaagcacataggcaagttgaagcatctcagatacttgaatctggaaaggacgtccatttccaagttgccaaaatcttcgtgcaaactataccacttgctagtactcaaaatgaacaaaaaggtgcccaaaacattgccaaagaaagcaaacaatctcatcagtttgaggcgcatcaacggccctttgaaagacgtatgtaatgtcgggatgcttacttctcttgaagatatgaaagaattccaagtgaagaaagagaagggatatgaaataggtcagctaggcagcctgaccaaacttcgaggacatctccatatcatgaatcttgagaatgtgcaaaataggaatgcggcaaaggatgcaaagctccaagaaaaagccaatcttgatgcattgcggttggtgtggaaccatgacacatacaagaacaacaatgttgacttggaggtactcgagggacttgagccttcttcaagactgaatgaacttgcatagaaggttacagatccacttcatacccaaagtggttaagcggttgctctcaaagtttgaggtctcttgagctcttgaactgtacctttctagagaacctcccatccaatcttcaatgcttcgcccgctgccgtagtctagctcttctgaatctcacagggctcaagaggctgtcacctctcccagaaaatctcacaagtttaaaattcggtggatgcccgtcactctgcttcatttcaaaggaggaagaagaacatggagtaaacccggccagggagaaagctttgcagcctctgacgagctctaccgagctggaaacacttactgaaatcctaagactggatgggtcagaactggagcagtttcaggcatgcttccaggagctccagtatccagtaagcacaatttctgccagacgccgtgatgttgcgcaactggtcctgccattaacgctccggaggctcgagctatcaagctgcaacatcacagatcaggccttgtctgaatgcctgcgaagcctcacctctctgaaagacctggcactgttgcatatcaccaccttatctgcactcccgtcaaagcaggttatggagaatttgtccatgctttcatcggtgggcataacttcatgccggtctctctgctccgtggctggcttgggagccattgcttcacttgagaagttcgcaataagcttctgtccctcactagagctctcggaccgccgcatccttccctcccagctgaaggaggtcacggttcgtggctgcacgatccatgatggttttctgcatgatgatctaccatttctggtcaaccttgagatatccaaatgcagaaccccctcggttctacaagtcggtgcatggccttctctcaaatgcctgaagctgtgtgattgcctggatgtttgcttcctagtagggttacctgctctggagtcactccaagaagtgcagttggtgctcccaaaccttggagctgattcttttaccggatgcaaagggaactggagatcactccgagttaggacatcatctctgctccatgatttgtctgaactagagggctttgcgcccccgatgctgctgacaattgagggttgccaagagccagacttctcgttggagggcattcaaaatctctcatcaatcatcggcctgagtttcatgaactgcaaagtccaatccatttcagcaatgaaagacctcgcgtctttggagactcttgccttctttgactgcccattgctgatttcattgcctgaactgcctccatcagttcaatatctggacataattggctgccaaatcctggagaagagttgccgatcccgtcgtggggaagaccggcgaaagatttctcagatccctcacgtggtaatgtatgagtaatggtgatgcttggaacgctgcgagcattctgcaaggttgcaattggtgttcacttgtttatcctagatatcctgcaaggttacttggagaaatgaacttttcaccaattacactcgcagatagatttagtgattttttgaaagattaactgtaagatttcgtccttcagtagatagatacccctctatgaatattgtcaaaatcagtgagtgaattggggatttaactgttgatccattgagttggcccttagggctaatatgagatgaatacaacgtgaaaagacagaaataccccttaacatatacacactaagggcctggagctggagctcagccaaacagtttcagctccaccgaaatagggagtggagttgggtgaagctctctcacaaaatgtaccacaactccactctagacctaactgctgaagctaaatttaggagttagagctgtaccgaacaggcccttaaatcttggtagctcaactcctaatatggtgaaaaattgcctctcaactctgaaaactgcttaaaacttcatttaaaatctgatgaaaggggagacataacgattaacgtgggacgaaatccctatatgacaagtgaatactttcgtcaggttttcagttcttcctgtccttctcttcgattcctcgtggtctggtctgccatggctaccaccgtcgcattctccccggccgtcgccaatgctctaggagagggaggaggagcgattctctgcctgccttgagaaccagagccacggtcgttagggccggcgaggtcggggaggaccatcaaggagtgcgaggcggacgtggtcgccggaaatgttaggaaatgataggcaacaaacgataaaaaacaatagatcaatcacaaaagacacgagatttaacgtggaaaaccctcccaaaacaggagagaaaaaaccacgggcgccaaccaggaaaatatcttcactatatctggggtnanncacaacgccgcacggcggcttacaagaggtatatatatggtagaaccctaaaagggatgacgatctgtttcgcgggggcctccgctccactacggcagaagttaccctttattaagtgcaaatgaatttgtatcagacctctgaatttgtaagttatcacatgaacccaacaagttacagagagcaatgtttcatctgctaggtgaagcctggatgtcctccggctgcaaaatctgatgatattttcctagtgtattactcatgttcagtacaattttctctagcataactgtccttgaaacctgtgtatatgtaaaagtataatttcccccaaagctgccgaatgagcttgtcccataatgacatcaaggctatgaaactttcccattccagccaggattgacaatgtgtgtagcagtccttgaaacttgaattaatgaaatgcacatatgatgcctgatcatttgtcacatatgtgcagctgccaagttctatgtgtgtcttatctcgtttcttgaatggtcgtattcgcaacgacattaaccatggtattgtcttgtaggtctccggcgagtactcgatgatcaaagccggcggcgcgctgaagatggtggaccacgagagggtgatgatggagtcgctgctgtgcctgcctccggcgagccggcgccgacatcatcctcacctacttcgccggccgccaggccgccaacctcctctccggcatgcgccccgtctcatccaactgatgcccaactgtactgtacgtgtgctcctctcttttcccctctgcatcgcgtattcgcggtacgtcgtcatcaatgtgttgcgatgcctggacattggggatgaataggatacgagatttgataggatcctatactcgtggggttcacatggtcattgacaggtggggcccacgctcctgctcccgccagtacgtggccctggcttccagtggccgcgctctactggatagagactggagtacctctgactcccaagcaggattcaccaaatcgttttgggtagagttaccgtcatcccgcggtttagcggttatcgtgaaaaccatgtgattattatggggtatactatgattttaaaaattgagaaggttaccgcacgtgtgataaccataataacagcactgttttataaatcctatgtcagcatgacgtatcggtgacgtcatcatctatgaattaccactaccctggttaattactccgttaattaattttgtcaaggtaacagcggcgtggcggcgcgaccaagctattcccagtggccgcatctgcgccatccagcccactaccaatgctactgtcctccaatcaaaccggctcattgttgctaagaaactagtaagtcagctgcaaacatattttaaaaagataaataaggagagagaagtgcagcgggctacttgtagccagctgtagcacgaactccaagacacagtgtgtgtatgataggtgggattagatattaatagtgtagtatgtaactattgtataaatgagctactagattagctattgataaactgaagctagtagttggcaatactattgaacttgctcgtagcagtgtcacgttatctgcagacagccggatgcacacgtcgtgttgttcgatgtgcaatcatcgagaagattgcactactgggggcacagggtagcgtagttggcactttgtgaaatgaacatggttcaccggtcccaacagccgatccattcgattcgagcaccctccaacactagctttgccgtacgccatcaggaaggaaggaggatgacacaaactgcaatgcctagcagagggttcccagatctcgagctggtgcgaacaacacaccttccaatcttccatatctcgtagtcctatatatgcactccccccttttcgtttggatgataagtgaaaaagacaatgctacctccgtcccaaaataagtgcagccatatgaatccatgtctaatatttgaccatccgtcttatttgaaaaaaatttatgagaaaattaaaataagttagtcacacatagagtactattcatgttttatcatctaataacaataaaaatattaatcgtaaaaaaaattcaaataaaacgaacgatcaaacgtgagacatgaacagtgtaaaactgcacttattttgggacggaggtagtacaacatactcgtttactttgaataaaaattttatatacttattcttaacgatgaaatagtaaaggctaaaaaaataaactttgacaaaaaaaaatcaaaataaactttaaaattaaagttgaaaatttaaattttctttaataagcataaacgaaaagatgaggcctcgcacacaaacaagaggatctttagtatatcctccatcttgttgcacgtacaatatgtgtttctaactctttgatagacgggttttttctccgaaacaggatagatttatgctaagaagatattacagtagatctttgttgttaaaagaaagagagagaaaaacatatgaacacttcaaacaaacgggttctacattttgaaatgtcgcaagagctgcaagaagacaaaccataacgctcgtagactctggtacatacaaaagtataagagcgagtatggaataataccgttttcactcttcaatcacctgatagatctataaaacggatggcactgatcaagttagcgtcttttgaaacaggtgctaccgattggattatcgacaacataacatgcatgcattggtattttatctgaaatattgatcatggtacaaaaagaatagtttaccactccacaaaatgggaaccgactatttcccatgctgggtcacttggacagttccatatgccaatgtcatcgagtgacagcataatcaaagtgacaacctttgggccaacgaatcatcaacttttttcctcaaaaatatcatcaaccctgtccttcccctagcataaatcggtctggctgattgtattgtgtattatatattaacgtgcaatcttttttgccgaaaaaaatcatcaaccttggtctaatgctttttagagaaaaaccacctgggctaatgttggctttggcaggagtcatagctacgcgatccaaaggttgggccagagactgaacgtaattatgtaacgtgatcgaacccaaccacacaaatacaggcggtcgctagcagcagcacatgacccccaggtcagaaacgcggagcaacgtgaccgcacgtgggccccggaccgaccgaccgaccgacggacgatccacggccaccggcgtcagccggccacgtgcggccgggatcatcctggccgtccatggcacctacttggcccacatgaacagccacgatgccgctgtggcgcttcgaccacggcgtctaccggaccaccgaccacagtggcacagtgttacgcacccctctctctcactgacccttgggcccaaccatgtaagagctagttcaataatataaccaactgctagcttaaaaaaggttaaaacataagtaatctataaccaacatactaacaatctactcatataataattagttatatatatatatatagcatataggagtataatatatcgtatcattaatacatacctcttccgctaaaaaagtttcaattctaagaatgaatttggacaatccatctttagaattttttttattggataaggagggagtaattcaatcatctctcacatactgtagtagcttgttttctctcttctccatataagggcatatttagttcccaaaaagttttttcctaaaacatcatatcgaatctttggacacatacatgtagcattaaatatagattttttaaaaaactaattgcacagttagagagaaaatcgcgagacgaatattttgagtctaattagtccatgattagccataagtgctacagtaacccgcatgtactaatgaccgattaattaagctcaagagattcgtctcgcactttctaggtgagttatgaaattaatttttttattcgtgtccgaaaacttcttctgatatccggtcaaatgtccgataagacaaccaaaaattttctcagagcctcagaggtctttagctcttaatccaggtgattatccttggaaagatggcacgagcccacgagagccatggacacatgcatatgatccatcgctgatggcgacagcgagaacaggaggcacacacgaagtacaagacgatgcccacttcactccctcctcggtttccagtcacgggcgccgatctcatcaaccacctgcatctcatctcattgattctgattctctcatctctctcactctctctcatcgcgtagctgaagacaaacgccatttcgatcctgatttgacaatcaccttgccctttgagatccttgtgaaggcagcaaaaaatttgagatcgcctctctcatgcaaacattctcatgtcattttgcatgaaccttaacgagaaactaatccatgctaaacatgagctgtcgtagatgtcatgtcatgtaattaagctcaaaattacaccgaaattaattaattaataaatccgatgatttgattcagatttgagaacgaggaaggaatcaaagaaagaaggaagaaagaatacatagcggagctcttttaatccaatttttcatccaatactcgcgaggaagaagaaatgaaaagaaaaaaaagaagaaagaaagcaaaaaaaaaaataaaaatcaagaagcaaaattactacagggagatcgaggtattatactggcgggcgccgctcgatccgccggcggcgactagttgtacggcttcaccggcggcggcggcgacgcgtacgacacgccgtacaccggcgggaacgggagcttcccgccgggcggcgttgacgtcgacggcgggtgtccaccaccgtggccgccgccggtgctgctaccgtgagacggcggcgagcagttgtgcggcgtcggcggcgggtggaagcttggccccgatggcgatggcggggtggatggatgcgagtgcgatggtggcgtggtggtcggggtccccgctcccggcacgtgctgcgtcggcggcgacgcgccgggctggcccgacggcggctggtagccggaggaaggcgacggcggcgagccggagaacggaggggtctaggggatggggccgtacgagccaggcggcggcgcgaaccgcacgtctggtctgtcggccgaggtcggcggaagaagcgtgtatgtaaccgccggccaagggtaggacggatgagtaggcgtgctctgcggcggcgagtgggacggcggancggtggagctcgacggcggtgacgggtgtgatggggtggtgtggccctgcggcggcgagtggtaggacggggtcgtggagctcgacggcggcgaggggtaggacggagtggtggatcccggcggcgaggggtgcgacggtgtactgggcttgccaccattgggcgacgggtaggacggtgtggtcgagctcgagccccccggcggcgagtgggacgacggtgtggtggcgctggatggcggcgacgggtaggacggggtgttcgaccccggtggcgccgggtaggacgacgacggcgaggggtatgacggggtaggagagctcgatggcggctgcgggtacggacctctgcgccgtggcggcgagctcaccggcgccggtggcccttggccaccacgtccagggctaccaccgggcgtcggggtgtaggacgcggcctggcattgcgccttgctgcagtcgaacgggtgcgccgcagcggcggcgcactgcgacggcggccgctgccccggcgcgccggggatgcagttccacacgccgtcggcggtggccacgccgcagcccgggcgcgaggtgatgaagttgtccgtgtaggtgaagttcttgaggctggcgaggccgcagacgccggccggcacggccccctcgaagaggttcctggcgacgtcgagctgctcgacggcggccatcccggcaacgctcgccgggatcgggccctgcaggtggttgtcgctgacgtcgaacaccgtcaccttcctgagcagccccacctgcgtggggacgcagccggtgagctcgtcggcgatgagcacgatctcgttgagcgtgtccgccatcttgccgatggacggcgggatgcatcccccgaggttgttgtgcgcgagcacgacgacgctcgccggcgagttgccgaggttggccgggatggggttgcggaggcggttggagttgaggaagatggcgtcgagcgggcggtcgaacagcgcgggcgggatggagccctcgaagtcgttgaacctgaggtcgaggtagcggagcgaggggagcgcgagcaccacctccgggaacgcgccgacgaagcggttgttgctgaggtcgagctcgtggagcaagcggaggcggcggaacgtgtcgggcacgacgccgcagaagcggttggagttgaggtggatgagggcgaggtcggggagccccagcgggagcgacgccggcaggtacccggcgatgtcggcgtggttgaggtcaatgccggcgacgacgagacctccacctccgccgccgccgtagccgggcgacggcgcgcagtagacgccgttgtaggcgcagacgttggcgccgacccagctggcggtgaagttggaggggtcggagaagatggccgtctgcttccacgcctggagcgcggcgtacgcggcgcggaggcgcgggttggggaacgcccacgacggcggcgcgtcgtaccgcgacgcgaacgacgccgcgtactcctccgacacgttgccctcgtgctgtgccaccgccgccccgagcagcagcagcagcagcgcccacgccgcggcggcgtggccgcgagagatcatcgtggaacgacgcggcggcgacaggagcttcgctagtgggaggcgagtgtgcagtgtgtggcagtgtgtgggggagcgtgggggtgtgatgtgtgaggagagggagtgggcattcagagcgggtcacatgggtggagaggggtcacatggggggtggcggtgcggcggtggaggacgaggcacggacgaagaggagcgcgaagggagcgttttaacgtgggggagtttgatgattttttcccattttttgaatttttaaatttaaaaaacaaatattttcaagacttattttctactcccttcgtaaaaaaaaatcaatcctaaattaattattttgggactgatggagtagatcagaacatttttccgctccagctcaacagcagctcaacaacactgttacaccggtctaaatggcgtgaccagtgctatttgatcacgttgattcatggatacaccaattataatgttgttaggataatactatcacactaattatagattgtgtgacaattttattttagcacgctagacagtattggtgccatggtgtggctgaaagtttacagattttgaaaataagtttttgaattgtttattttttgaataagaaataaaaattcgagtttggtggtttggcggtgtgattggggacgtggacggatggatgggttgcaatgtggaggtacgtgttggttgctgcgttggagtagtgctgggctgctggctggtttggcgagctggatggagttgtttacgcatccccatgtatggccgtggcgtgatatggtactacgcgtcggtgtttgtgttcgaattagtaattcaaaaggttcgcgcctgtggcggcgcagagcagacagccaccatggatttcagtattctcccgccatctactttttaatagttatattttatcttaaaaaacagaccaacgatgagtcattctacttattatctatttaaatacactactagcatttctcgtaaacaagcgattcattaatatttacatttttcgatacccatgtagccaatcttgtgtggaagaatggagagtcacgcattaaatttaagaaagccattaagatgataatttgttggattaaaatatgtctatcaaaaataaattttttagatttggaaatatgactatcaaaaatagatggagggagtatttcactagccgtatccagagtttgcaaaaccgctcggtttcagtcttaaaaatcaaacgatttttaaatttttttgacaacaatttaaccacatttcgccaggagataaaggttttcaaaaaacttctaaggatgtgtttagttcacgccaaaatttaaagtttggttgaaattggaacgatgtggcggaaaagttagaagtttgtgtgtgtaggaaagttttgatgtgatggaaaagttagaagtttggaactaaactcggcctaaaccttttttttttactcgggaacggtttgatgaaatcctggctgtattgctgttttagaaaactctttttggtgaaaatgtaaatttaagcatataatccgtctatgcttctgtgtggaaccaagcgagcgatgaatatgaaatctcacagatattgagctgattttaacaaggttcatatagaatcaatgctttcctgatggacgtagcccttgtttagttctaaattttttcttcaaactttcaatttttctatcacatcaaaactttcctacacacataaattttcaacttttctgtcacatcgttttaatttcaaacaaacttttaatttttaacgtgaactaaacatacctgtagtgcaattcatgcataacaaaaggacgacctcagattccagcgacaagaactgtcctgagcccaaaattgatggtgttcacctacggagtacgttgcaagaaatggaaacttgaaagtgatgtggtggagacaaggcttaacacatgcccagctcaatttactctccagttcaattagccagtcttgactaaactaattactactattactactaactgggaatcagatcatggaccatgcctgcattaactggaccacttggttacttacaaggattaattaccaccagctagagtcgtcgcccatgaagtcgttgcagttaattatgcaaggtaagagggtaattaagaggcgcatgattaggtaaggatcagatccagagaacctaacgtgccggccaggttagagtaatagttgcactagtaatacatctccattccgtactgtttcctctcaaacgatttcaaaggcatccagcttcaaaactttttgaaagcaatgagaatgcaagaggaaacagcttgttgatgcagacaaaggtgtcagtaatttaacctaaacttcttggaagctggtgcattattgtatttgtccttttgggttccaactccagtctccagtgctcttaaacttttgatttcttttttcaacatctgataataatcccttcatcatccagagatcaatccagtgtttccacaggaagctctgacaccctctcccttgttcaattgctaattagagggtcccacagctccttgattgcattggctccagttgtactactacactgaagctctgcaatagtacagtaaaattaaatggaaaaacttagtggtattttcaattttacaggagagagaattagagaagacagtggcatattcatgagtaattagtcaggcagtagactaccaaaatcttctgcagtaatagcaatggagtctcttgcactcaatgatactacaatttgcaaagctgatcaatgaaataaagctagctagcttagactgtaaacgtgtacgaggtagtactacaaaagctatatataatgctactaccagtataattatactggactgccaagtagttgctgtttttttttctctttccaagagtgtttatataattagtaccccacttcagtacttcagtaggagatctatatacatgttcatgtactgtgctgtacttttcatccgagttggcgacaccttacagaatacagagagatatgcaaggacgtaatagcagccttcaatatgcagttatgccaatttgcaacatggagtagtagtaatgatcatggcaaagtataaagccgtatgtatgctagtatggctgtaacatggagagatgaatgtagttcacatgatcttgtctccaaattcaactgaaaaaaaaataaacgtacgaatcgtttggtttggtttggtcctttttattcggagttattaagatccatgtgatgaccatgtatgcatactctagttagcagttacttcctccgttgcatctatatgaatgtgaacaatgctagaatgacttacattacgaaatagagggaatactagtttagtattaaattaaactttgattcaccgtacaaatgaagctgggagatatcaatgaaatagacggtatcaaacagtagagtagaggtggtgaacagtacgacgactggtactcctgtagagtaccatatgtcatttttttcatgtatcatttttttcatgtatatatctgcatttccggcgcatttaataggcatgaaaaatgcaattagcagggcgagatgagattaatttggtttacacgtcacctcatgcacttcgttgttgatggaggcatggccatgtgcattaatcgtcgttggatcaaagatatgagaagcgttttgatcaatctgcattgatgctttacgtttgtatggtactccctccatctctttttatccttttt

SEQ ID NO: 69053 - DNA, 3196 bp, Oryza sativa
aattgaccattaataattatgaacttaaataatgaatttgtttaatttctaaaaaaagtctattaaaaattctatgaaaaacacaccgtttaacaatttagcgagcatgcttatagaaaacgagatagccactagccaacttaagaagctgcctcgaactcagctaaattgttttacattatttttataactatttacattatcatttaaggtaattagagacatccacttagggattcttggaaatggaggaaatttggagagattctgtataattaaactgaactgaaaaacgtgcattcggaaggaactcttgaagttaaaacaaaacagtttcccatgaattgaacgggaccatggaatgatcgatctgagcacgagcagcagatacgcgagctcagctagcagctagctgtagcgccaaacgctgcccttccctgcaacttgcgatgatctctggcccttttctgctttctaccacggcgacgcgtaaagagaggagaagacagaagacgcgttttgatccacctatagctatcaatcatcacgcattgcttgcagctgagctgtgatcgagtttgcctttttctctcctttctctgttcgctgcatatgctgttgctgatcgagtactgtacatgcatgcagcgtctgatgcgattgcgagaaagttcaggacatttttcggcttgtctcccattctgccattttcatcctcctcactatcgatccactccaaagtccaaaccgtcactgggagagtccatttctcacaagccaaattgggacaaagtccaaatcgtactactccctctgtcaaaaatatatataatatttatattaatatttaccattattctttatactctctccgtttatattataaaccgtgttaactttttcctaattcaaattcatttaaatttatagaaaatatagcaacatcaatgacactaaattagtttcattatatttattattaaatatatttttatagtacatatattttgtgttgaaaattttattacgttttctataattttagtcagacttagaactttgacgttaattacgatacaaaatggagatagtatcaaaataagtacagttttatctccttacctttattccgcaaaataatttcctgttaatataggatatttcagtctttctttgaatattaagccgttagtagagtaaaaatttaaacagggaaaagaactgcacagctggttggtatgcttatatcaccatattcgagtgcaggtattctccaggtacaatgcaggtcgatttcgattcgattcgatttcagcgtacactggtggaaaaatgttttttactaccaatttagaacgtgactaaatatcgctatctttagttccgggatcaatctttagtctcggttggtaacaccaactgggaataaagagggggaatctttagtcccggtcggtgggaagcgacagttcctcgagatcttttttttattttattgttgaattgctaatggctagtgttaatccctgtattttctcccgaatcaattttctcccgaatcaaatgggatgcacctccccaaatcaacatcccaaatattaagttacttatacgcacagatcaaatacatcacaaatcctatacacaaatcaaatacatcacaaatcctaaaaaactacacacaaattaaatacatcacagattatacaaattatacataccagatccatgcgatgcaatgaatcacaaaatctaaaaaattatacatccagtgaaacacaaattaaaaaaaaaaagaaaagcaaacaagccggcaccctaccgcagtcgtggccgccgcccgcctgcccgcgcgcggccgcgccgccgccacccgccgcccgcctgcctgccgccgctgcctccccccgcgcggccgcgcagccgcctcccaccgccggccggctgatgggagggaggagaggggaggaggagaagaggaaggggaggggaggaggaagaggattggatgtgagaagaggaagagaggggatgtttcaatcttatctaaatatctgtctgggacttaaccgatcagatgtgggagagaaatatttactcccggttgataactccaaccgggactaaagatcaatctttagtcccggttgataccgggagtaaaaatcaatcgatctttactcccggttggtatcaccaatcgggactaaagtggtaatctttagtcccggttggtagtataaaccgggactaaagattctcgaccccctgacatacatctgataggggatgaaccgggactaaagatcctggatctttagtccagatcaaaaaatttttaaccaggactaaaaatcgtttttagtctcggtttttaatggaaccgggactattgtgggatttggttgaccgaccaaagatggtttctccaccagtggtagtaggcaagtaaaaccaggtggttggttattcacagaagatggacacatgcatgggcagaacgaaagagagatgagccggggagacgacaggcgagaggtggtgaacatgcgtctcccatatgcgaatgttctccaactacacgtacagttggcacttggcagactcacacacgctagctagcagcatcataacaacctcattgtaaatttagctattatgtctatttcaaaatataattaattttaactataatatagataaattatgataaatattgtttagatttatagctaaaagtattatattttagaacgaatgtgtcaggctagcaactgctactgctattggtacgtcagctcgcttgccttggctagctagctgcgctgggctgggttggcttcctctagctaaggctgtgtttagttcatactgaagtttgaaggtttggttgaaattgaaacgatatgattgaaaagtcgtgtgtgtataaaaagtttaatatgatggaaagttgaaagtttgaaaaaaaactttgaaactaaacaaggcttaggttcaattcgttccttgccaagcatgctatactttgctttgatgcccgaaataatggcaccgccctccttcctgatccaatgatagatactccattcttcctaaaatataaaaagatttaggtacatgtgatacattatagtatcatgaatttatgatatatcacatccacttaaaactctttatattttaggacggagag

SEQ ID NO: 69054 - DNA, 30602 bp, Oryza sativa
  unsure (1)..(30602): unsure at all n locations
gagtagtttgtgtcaatggttgttgaacgacatgcatctgcatgtgacattgtgtgcacattgccgtacgtactgcagatcgatggagggatgggatacaggtgtgcactgacagtactgaactgcaaagcttcggtgtgaggcaaggacatgttcgatcagcttcctttccaaccaagcgagtgaacacagaacagaatggcatataatgtttggttggtaactaaatttgtcacatctaaccttagtcaagtcacagttttagtaggtagtatttgactcttgccataagtctattttgtctaactcttagccacctagcccacatgtcatacactctattttcttgccaaacgttgcctaagcttagtttgtcattttgtttgccacaaaagtatggctagactaagcttagctaccttagtaaaaaaatgtgtcacaatattagtcccaaccaaacagaccccactcatcaagaatcttaattgaccacaccacaatttggctaactgaaatcgtgtatttgtaaaacaaaaatagcatggtgacccgcgcagattgcatggctagcatcattatattatctcatataatagcatatatgttttctcattatattattcaaatatattaaaatgacatcataattttaaatttcgtaataactttgcaaaactacaaatgtgtaatattcatattgtattttatatacgtgttatttattaattatttttaatatcaaattttagttatttgtaaattatatatattcctatatggactctagactcgtcttttaatatttttttaattctgaattttctgtaaattgtatttctatatggctcttcttccaatattatttatttttatttatgattttttattatttctaattgtatttctatgtggactctaaactcatctctcaatattctttaatttttaatttcgaatttcagttacttttaaatggtattcctatattgactttaaacttttcttcccatgtttttcttaatttcgaattttagttatttgtaaattatatttttatacggactcaaaactctacttttaattttattatgtttattccaaattttagttagttttaaattcctatatggactctatactttacttctaatatttcttattttttaattccgaatttctatttttttcttaattgtatttctatatggactcttatactctacttctaatattacttatttttaattccaaatttctattatttactaattgtatttctatatgaactctatactctacttctaatattccttatttttaattccgaatttcagttatttcctaattgtatttctatatggactctagtctccttttctaatatttcttattttttaattccgaattttaactatttctaaattgtatttctatatggattctagtctcctcttctaatatttcttattttttaattctgaatttcagctatttctaaattgtatttctactagcaaaaatgcccgtgcgttgcaacgggtaaaaaaattctaataataatatacttttttcatgcataatgatgtcaatgacaatgtttctattttaatgagcagcttgtttttttataaacagtgtttttttttcttttgcgattttctcaaaccatttttcagaaatggcgcatttctttctaacagttttttcctaccatgttttttttctttttttacttatgaagaaaaccatatttttctccctttttttgcttttcttttctcgtgtgtttttttttcttgttttctcgcacgtttttttgcttgttttttttcgaaggttcttttttgcttttttccaacacaggagaatatatgacaaaataaagccatgtagtagatggcaaaaaatcgatgtatcctatccgactcaagcgtccatcaatttagcttttttctgacagttttttcagagcgattttttaatagacggtatttttttcttgcccggttttttaaaaccattttttttagaaatggtgtgttttttcgatagttttttcctcgcatgtttttttttaaatattttaccgacaatggaaataatttttctcgcgcgtctttttattttttttattgatgatggagaacctttttagtgtgttttttgcgctttttttctgacttttgccccacacgttattttaaccttttttattttctcatgcattttctctttttaaatagttagattagagatagagaagagatatatactggttagaaatcagatttggtttcgccctttccatttttttctctcttgcattttttattttatacgaaccagctttttattttttacgaaccattttttcaccattttcttagggaatcgaacggacttttttagatgtttttttgcctctataggaatcagactttttttttccgtttttaaaggattcggatctagcgtttttttgtcaccacttttttttttgccttttatatgaatcagattttgttttccgtcggatctacagtttttttcaccactcagggaaaaaacttttgttgttgttgtttttctttattttctttattgtgcggtttttcttttttccttttatgcacctttctttctgtctttgttctctttctcttttattattttttaacaaaaacgacctcaagtagcttgttgcaagattatagggactcaaatgtaaatataaaaaatatagggactcaaatataaaagtacaaatccaaaaattaaaatcatataaaaatggaatgctctcgacatgtagattctatttttgcaaacagatctctggcacatcaatttttttcaccaatctgagtcagactttttttttggcttttctttttctttttatgcacctttgcctttgttctctttctcttttattattttttttaacaaaaacgacctcaagtagcttgttgcaagattatagggactcaaatgtaaatataaaattacagggactcaaatataaaagtataaatccaaaaattaaaatcatataaaaatagaatgctctcaacatgtagattccgtttttgcaaacagatcttcaatccggcacattaatttttttttcaccaatctgagtcagtttttgtttgtaacagtgaatctatatccggatacaggagtcggattttttttttggttttttttatcggacaaacctggtttttttccgtccgttttttttggtttttttcgccccttttttcttctggatcggacttcttttttccattccggttttttatcggacaaacatggttttttctgttcggtttttttcacccggtttttttaacggacgatggaagcacctcttattttttaagtagtagtagatagatagatatggactcttaatgtgagaatttgtaggccatgagagcgaacgtggagattcttttttctatccttttaataatataatagatgtggagtactcccgggaaaaaatatattaaaatacacctttttgcccgatgatttaataggaatatacacgtttagaagtgaatagcagaagtataccactgtcgcagaatgtaagtgtgagacggcgcgatctcacgcgactaatagattaattagtgcaattagcaattaatcaattattattattttaattaacatcgttagtaattaaattaatcactaatcagtatgattagttacattagcgtcaactcgagccatctcgcttggccaaccagcgagactgaacgttctcacgctctcgccttacgagaccttcgcgcgttggtctcgtgatttcgcactaccgaaccgcaacaacggtgtattcgtgtaaatccattcaaatcttatatatttctgagacaaaaaattcaaaagtataatttcaaaattttctggattgtgtttttcttttttttcttttttacatgaaacatagaggaattgtcccaaatctgcctggactggaagaacagtagaagactctaccagggaagagatgcagttgggctgtggagagtccacgtaggctcactaaagcctgaggctatccacccttgggaaatgcctctgctgccttctccctccacagaatggcctcgatgtgggccccactggatcccggtgggcccgggccaaacgaaccagtaaactaatagcttcgcttccgagttcgagcctctcatgaccatggccgccgccgccgccgccgccgagctcgacgagacaagctagacgtacagaaaccgcgcgaagaagaataagaatgcggccgtggcttgtgccgccgccgccgccggcgtggcacggcgtggtgatcaggatgctgcaggcgccggcggtggtggcgctggccgccgtgctcgcggcgtcgacgtcgccagcgacggcggcggcggctgctgctgatccggctccgcaggaggaggcggcggcggagggcggcgcggcgagcacgctgtgcaacgtgccgccgacgctgtcgggggaggacaagcaggcggagaagataaagcacccaaagtcggcgagcgccatgcggtgcacctccaagtgcgtcagcacctgcgtcctcggcggcgccggctcgcccggcgtcgacggccccttcaacatcaggaggtagcttcattggtcgccttatcttgtcgatcttaactaatcaatcattcagagttaacgagatgaacacttcaatgcttctgctgatctcttcaactaattccttctgctccgttcatggatggatcgaaatatatgcagaccactggtggtgttcaaggaggattttcgcagccgtcagtactggtacacgcaattttcctgtttcaattcgcatgcaaatcctcatcaattcacacgcaaaaaaagaaaagaaaagaaaagcatcagttcatcttcatcttgtgcatgtgtagccttctggaatgctcggacatctgcaacctaatcaaggacggagaagatggccaatgactcgagatgtattatgctgcttcaccaagcagattagcagctaagacacgcgtgaatccgtcaaggaagcaatcaagcattacagaatggatgatttagaagcaaacaagtgattagcttggaacaaacgtgcatgccggcccagattaactgaagaaccatggcgtcggacctgtcaactgaatcgtgatacggatgaacacaagtccggtccatactgtatactgtacagttgcattaggtctctaacaacaccgagttagcttgatgtagccagctccctacgtagtgcgaaatcccgagttaaatttaagattggattaagtacacatctccttgtcaagttgttcaaacccgtctctttgcatacgcatttgcacttacatgtttgtatatgcagaatagcttgcaaacttataattagacctttttttttgaactgatgatcacactgtttgcctaaattgtttgatctgcgcaatttggcatcttaaattgttgacgaactatgtttaatgcacagcagaccgtccatccagcagtccacataaatggccaaaaccaagcccagtagcccatatcgctatatgggccggcccatgaagcaggcagtctaacgatacagcccgctagcccgctaggtcacacgattgacaagcgattccccttcgtagttgtccgcactcgcgcgtcgctcgccggccatcgccgccgccgccgccgccgtcgccggtcgcaggcccgcctcggcctcccctgtctctgtctccatcctcgtctgccctccgcctggcgcccatcgccttccgccgtccatccgcggtgcttccgtactctgttcccatggcggcggcggcggtggaggagggaggcggcggtggtgccgtggcgcggatcttcgtgggtggtatttcggagggcgtggcggccgccgacctggaggccatgttcgcctccgtcggccgcgtcgccggcgtcgagttcgtgcgcaccaacggccgcagcttcgcctacgtcgacttccactgcccctccgacaaggctctcgccaagctcttctccaccgtacgcatcgcccccccccaatcttctcgtctctccactccagtagcagccatcaacaattcgatttctagcttatgtctgttcgtggtaggaatcctagtgtgtactagtggagatcaaattacgattaattttggatttattagatgattttacctattatgatttgtgccatgcttgctgaattgttgttggcctaagactgtttgagactgatgcttgtgtgcagtacaatgggtgtaagtggaaagggggaaaacttaggctggagaaggctaaggagcactaccttactcgcctgaagcgtgaatgggagcaggaagcggcagcggcgcaggaaatgccagctagtgctgatgtggagagcaagaaggagaagctcgagctgaataaggctgttttggatagtacgaagattaacatctacttcccaaaactgaggaaggtgagcaattggtcaggctgtgagaaacttttcttatgctcagcacttatgctgttcatgcatcattatgtgctctatagccacttagtcctgattcctgaatgggtgtgactgaacaagtaaattgtattccatccattaatatgcagaataacatgatctttgtgaactttaggttttctctatattttacattagtgtaaactgcatccttttatcagacatgctaatcatatcttttgtctttcagaatttgggctaaactaagcaggtgtaatttttaagatcaattgttgaattaagaactgaatcagaaactgggtatacattaactccttacataaacttacttggatacacatcccattgaaactatgcttgtaaaaaatgaagaggtgatatgtattgacaatgtttattcaatatgtcgattaattcctaaacatgcattgacctaatcaagatttcacttgacaggtgaaagccttgccttttaaaggcactggaaagcacaaatacagtttccggcatatcgaagtcccttcttacccaattcatttttgtgactgtgaggagcactgtggacctccagaggcagctaatgatgaatatgcttctgttcttgatgctgctgcatatgaaaaggagcgcagtattatgaattctgtgatgagcaagctctttgagaaggagaatgaccatttagattcaatggaaattcagaatcatggtgtcgattttgatgccgcggaaccctctaacgccaggaatgagttgcaaatggataaaagagaagaaacttctgaggaagatttggatgaccaaatggaagaaacagaagatccttctgaggaagaattggatgatctcgtgcttaacatcgtgacttgcaagccaaaaagctctgtagcacaattgaatagcgaaaagcaagcagcggataaggtatgcacattgcaagtatttcgaacattattctgtgatgaactactctgttgtgcagttatgttcattaacattttctgcattttcaggactcgcgcttcagaaaacgtcaacaatttgaagaatcttctctgcagaagaggcataaatcctctgatttctctgaaactagaaataggaaacagtctttccctgctatatcaggagccatccaaaatgaacaaaaatcttcagatttgtcaggaaaaggtacacatgagttctcatcagaactcgatggagataaaagttctgctagtgtccaagatgttgaagcactagcagattcttctaccagaaatgggagtgaacaaaattcgcttgctagtgaacctaaaagagtttccttgtggactcagaaatctgcctggagggatcttgttggtggcatggggagtgcatctttcagtctatcacaaatattgccaaacaccaatccagcaccaccaaaagtttcaaatgctaccgaggcctctgcttcacatgctgagtccaggacgaaagtgaaaccaagcgggaaatctttgaaaccctcggaagctgcaactcagctcttgcctgagcagaagatgcctacaagttccatggcaatgctgtctagtgagcgtaaggagaataataagctggaaaaggagagggtggttccaaagatcactattggtgaagtgtgtccgttcatgagaaattcagagtcagaaaagcaatggtcaaaggcaaagaaggttctgactggtttcatcaagaagggcaatgagagcactggatcgaatgtcgggaaagggaagccatcaacaaggagataacaacgtagcatgtcattccagcttcatcttgttgaactacaagctcggtagcatgtcattccagcttcatcttgttgaactacaagctcggtggtttcgtgtctcataggaacatgtgttattttgttgattggtctcatagtctgcctgttaagaatgatctgtctttgtttgtgaagcacaatgctatgtacgagttttgttcaaattgttattattctttgtacgagcaatttaaagtcaaacatgtttcaaaaagtgacatctaacgtgcaatttaaaaacgaacggtcaaacatgtttaaaaaagtccaatatattttaaaaagtcaacggcgttaaatattgggaaaattataaaaaccatccaaatatcactctgagtttgagatgcctctccataagaagatttattgcaaatacccacctcctaaaccttggtttgatttaggcacattctctccacacacgcgtgattcctaaataatctcgtggcgaaatcaaccgagtcccactcagcgggagcaagagattatgttgttttctatataagacgatcatttcgttgcgttatcatggccatttcattgtgtttttcatgatatactagctatatattccaaactaatatcatgtgtactgaacaacatatccgttttttagaatgtaatgggcatatagaaacatttaagcatgaagcagtaatcatatagccagattataactacatgacttcatctgttgcaattggtcagatgacccaaaacagcaggtttcattacagtttaatcagaaattaaggccacacaatctaatgcaaaagagacttgttgacaaatcatcacgatgagtggaacttggctaatttcgccacgagatgctccaggaatcacgcatgtgtagagagaaggtgcctaaatcaaagcaaggtgaattaggacgtgtggatttgcaacaaatcttcttatagggggcatctcaaacttagagtgatatttggggtggtttttgcaattttcccttaaatattttgtgacagaggaaggaccaatgtgtaattaacagaacagagggggcctttttgcaaaagtgaacgtggcacccctaactaactctccggcaatcccggtgttttaagtagacaaatgtattcgaactcctgcgggctgtggcgctcgtgctcgccgtgctcgccgaaatggttctccggtggctcaccaccgcactaccgctcgccgccgctgccgctcgccacgcggccgcggctccctcctccgcggccacgctcgccgccgccgccgctcgccacgcggccgcggcttcctcttcctccgccgctcgccacgccgccgcggctccctcctccgcggccacgctcgccaccgccgcggctccctcttcctcctccgcggccacgcttgccgccgccgcggctccctcctccgctgccgtggcggttctaccggaggcggcgcggcgagtctccgcggcttccctcctcgaggagttaaacgccttcccggagatgtccctagtggtccggtggctcggcgccgctcgccgcccgggagcggaggtcgtctccaaaattgcggggcgccgccaccacctcaccaccaccgccgccgccgcggctccctcctccgctgccgtggcggttctaccggaggcggcgcggcgagtctccgcggcttccctcctcgaggagttaaacgccttcccggagatgtccctagtggtccggtggctcggcgccgctcgccgcccgggagcggaggtcgtctccaaaattgcggggcgccgccaccacctcaccaccaccgccgccgccgactcgaaccttccaagtcaagcgcccggacgactcgtcaatcgggggggtgctcaagtgatcggcgcgggcgacttcttcggctgggagagcaatgattgcggctgcctcgccgacctcgcgccgttccctcaccgcggcgcgccgttccctcgccgccgctgcggtgctgcatcgccttctcttccctggtggttcgcggcagagcaggtgcgcttcggcgtgggcgaccccttcgagagcgatgatggcggcatactccccgatctcgcggcatttcttcgtcgccgccgccgctgcgcccacagcagaagaatcttcgaattcgagagcacccaccacggctttggcaagagcaacaatggcatgagcggcggttttcgttttatgttggatgacaccgacaagaggtttcgccatgtccgagctcggagaaatcggtggcaacagctggtgataaggaagatgttctcaagttcagggaagcgcagctcgtcgacttcaaggcaacagacgccttcgccgacctctttaccagcggccatccccagccaaccagcagcggcgatttcttcctcttcatctgagactaattcatccagtgagcaggaaaaaggggcttcctcgtcagcatgctacattgatgaatcattcggtaatcaggagataattgacgctgagacttatgtcaaggcaaatcctatgcttgttaaggcgaatgtactgggctcagcgaagacattctggagaatgtcggatatagcagtgagactcattcggcgacttgcgaggattctgaaaattctgcacgaacagaagcgttatctcctggccccgctctcagtgcaaaatctagtaattgtctcgggtgaacttaagctcaggaatgtcacccttgcagatgatgatttcagttttgatcggattaaatgtgattatcagtatatgtccgttgtgctggaagagttgatcatgttatctgtcggacaaaatggattgtccaatatccctcctgattttggcaaatacttgggtttgcttaaaggactagtcaaacctgatgacgaatttctgataaccaaccatgcttcgttattgcccatggcaaacaggtacacccgaatgtttttacatactttagttacttcaattagatccagtaagttatccaaaatcagtactcaagtaacacctagatgaagttttgcttagtaaactgtgtttgctactgctgtccttatttagttcgtagttagtactagctaaatacacgtatcttgctagctaatatgatttatgctactgttgtccttattatttagttcgtactacctaaatacacgtgtcttgttaatatgatttacgcatgctacattggttcgaaccaatttggtagtatatatattagtggcgaaaattgataagaaagcaacgacattgctgaaatttggtagggtaaaattgatttcgcgaacgctttttctgtgattttgctctattcatgatttgattgttcttattaacaagtttggtactagtagatatagagtttgtattagtgcgggaaaaaattggtagcaaagcaaacatatatgtgatagtactaaagttgccgaaatttcagtagggtgtaattgctttcaattaaacaagtccatcatgcacatgtttttgtgattttgctctattcatgattaagtgattgtttacattatttgggttcatttttttcatcagtatgcatctctactacatgtgtaggacggatgcatttatgatgatgtacaatcatattatgggctatcttggccgcaaagatcctaaaaagaagatatacattctatcacacctgaagtatgacacagactggcttcgcacagcgtcaggaaacagtgagatagggaaatggctttggcgccggagatacggccagactgttaaggagtttctgcacttaaatcggaatatcaggtcccatccatatgaacattccgaggaaaagatcgaagaagctctatacggtgaatggccggaactgctagttgaaatgcaagaaaaactgcacaaagagggtgaattacaaaacactgagatggagtcgaaatttgggcagcagtgattttctgcattgagtctgcatcatggagaaacatatgttctattggcgctgaaaatgaagacatataacatctgtgacatgtaaacaaatctttcatacatgcagacattgatcttgcaacatagtgcacattaatatcataaaagtgcctcagtgttttttttttctctcttgagcggaaatgatgttgatgtgcaaatgaacaatcagtttaatcttgggatcaatgatcgaggcacttgttgggtgtccatgcatgaggctcatgagcacaagattatgcaaaacgaacaggaagaaatatgtatggttcgtgtgcaaatgactgttgattgtcagcccaatattcatggagatggcgtacttccgttggcacaaattacttaattaattattcatgcatgggcgggcgcagcctattacacttgttaattaggcccacacggccggagttgagttaataacctgcgcgtatggctggattgttgtacttgtatcttggactcttggtttgggcgtgagcgagccgaacgatcaatttgttggtgaactgactgatttccggccggctgtctgctcatttattagcaggaggtagtttttttttaacggaaaatagcactagagtgccttttcattgaatagaggaggagaaaatacaacccctagggacaacaggaaaaaatcgaggaactgtagctatacactatacatagtgcgggattaactcgcgcagccgcttagcccctgctaaagcccaaaggctagcctcttctttaattcttgacaggaggaaactcgttgccacctctttgtggtcaaagattcgccgatttctttccttctagatttcccatacaactagtaggatgagtgatcggagttctttcttcggaacatttggcgtgtttgcgatgctctcccaccactgttgtactgactgtgcctcctctcattgagccggctcaatttgctgatatcccacccatccagcaacaaggcctcacattcttttagtgtatctacaagtggcaacgaggtgcaaggaggtagtttgatcactttggcggcggcggcggcgacaggcactgatcgatccatgcttctgctataaaatttggcctgaactcgaagagaagcgctggctctcacaaacacaaccaatacattgtcaaattaagcctgagctcgaagagaacggctctcacatacacaatcaacacactctcttgcctattctcaaaaaatacactctcttcccttccctctcactctcgatcctcaccacaaccacatgcacgcacggcactagctagctgccgtcgtcatcaccatctcacacgtgcacaccatttttctttcatcccgatctccattaagtacactattgctctctctctctcatctattcctttgggcttcccttaagctcgtccttgtccaccgtccacgcggctggtttctggtgttgtcaacttggcaacaaatatgatggcggaatgcaagacagagacaagtgtcttttaaaccatacaagattaatagctgcgacaacaagcccaaaccatcattaaaaaatatagttttattccattattttcattttttttcatcctcatacaaccatgttttcattttattgaggataaaagttgttgctgagcagttattacctacagtagcaatattttatctcttttctttctcttttccatgtcagcaaatattcataattagcaacattaagagatcatgtcgtgttaatgaccattgtacatgtctttaggggaggggaataagttcatctgaggtcctttaacttgtcaacgaatccgattttcgtccctcaaccggaaaaccagacacaacgggtccctcaactatcaaaaccggtgcagatgaagtccctcggtggttttgaaggcggttttggctgatgtggcgcctacgtggctaatttgactcggtcttcatctgacgtggcgcttagtggcaattcgagctgaaaaaataataaaactcgtggaacctacatgtcagttccacacacaaaataataaaaaaatggtgggacccacatggccccacatgtcatcctcactcctcctccctctctgtatcctctctctcccctctcctcggcgccgacgcttccatccacgcattactcaacgtggtggccgccgacgccgacccacctcgcgtcgtcctcgtcttcggcggcaggcccatccgcgttggcgccgagctcctcgacgccgtcccgtcgctccgctgcatcatcaccatcagcgcggggatcaaccacatcgacctccacactttaggaggcaacaggggtggaccccaggccttgggccgcccggtccatggctcgaggcctaggatgcaatctctattataaagtctattttttcaccatgtaatggtccaaactataatgggctggcccaaatcgtgggccaatcctgggtccaaccctgagaggcactagtgactagtgaggtcgtgtatgtttattgtgaataggttaagtttatagtatatatttttcactatttttctgggtcatttattttacttcgtttagttagcagcaatatctttttcccctttgttagtacctactatcgaccattaagagaaagatggaaaaaccacttaagaaaaagagagagggaaaataattgagaaacgcgagcaaggcaagaagatgacttgggagaggcgaggattttgtgccgtgaggaaaactatcacatcctgatttttgtttcaggatttataaattatttaataaattaataatagaatttatattaaatgttctttaatttacaagtgaagttaaatgtgggaaataaaatttcctaaatataaagcatggatggatttaatttttattaaattctccatgattaagtaaactctctgaaattttctcggatttttcagagctcaattcctaaatgatacaaagaacagttcagtaattatttgatcattaatgatctaattataattgttaagtgcttttcttgtttaaaatccttaaattataaattgttgtttaaaaggaattattagaaatgatttcaaaagcctagaagagaagatcttttttttaatttgctaaatctcaatataaaatggggccagataaaatttcattaaatactttgcttaattctataattcctagatttttctgggatttatttgagctaaggaagtatttttaataaatagaattgcatttcatgaataatttaaattgaaaaaggtttttaaaagtctcttttggctttgggccgaaagccggcccaaaatctctctctctctctccctcggcccagtccggcccagtccgacgagccgccgctctcttctctctctctgtcactgacaggtggggcccgcctgtcagacccgtcgtcttccttcggccgccgccgccgagccgcgccgccgagccgcgccgccgtctctttccaaattccgtcgctcctttccatctccggccgaattgatagaggggaaatgatcctctcgatctcctcttccttttctcttttggaatcatcacctaattcggtttggaaactcgtggattcgatctcgaatcggatcgacttctctcctccgaaccctacctttccttctcgtcgccggtcgccgtgggccttcgccgccgccttccaacccctataaaaggatccccggtgtctcctctacccgccgccaccctcgccttcgtctctcgccgtcggaagcgctctagcgccgtgtagcctagcgccgccgtcgccgccgtcgctccagccgcgcgccgccgccgttccagacgtcgccgtcgctcgggaagaccgccgtcgtggtcgccgtagcgtcgccgtcctcgtccgccccttcgccgccgccgaagaccaccggagcaccgccgtcaccgtcgacccgaagaccgccgccgcttttcctcgtcgccggcgccgtccgttgcccttccgccgttgttttggtcaccggtgagttcgccgagtcgccctctacccgttggtgccttccgtttgcgtcctcgcgccgtcgttcgccggcgagcttgcgctcccgagccgccgccggtgctgacgtcatcgtcgccctctcccgtgagccagtcgtggaccgatcgatctcggccgtccgttttggatggatcgatctcggccgtccgttcccgtgaaccgccgccgtgcacccggtccaccgcaaaccctagccgctgacgcaataatccttcttttccttttcaaaaataattcattattgcgtcataattcaattaaaatccatataagtgttttaatccgatttaatctttaaaaattcataactaattcatcttaactcagtttaatgtggttcaagttgcaaaagttgtataaaataaagatctacatattaaaattgtccataaattgaattaaatttatttaattctttttaaatgggctttaattagatttaatcttgtaaaattcataataaattcatttgaagtcagaatgaggccgttcaagtctcataattcatctaaaattatgatctacatgtttgtttactttttatgtattgtttatttggtttttattagtctttttcttcgttttgcgtgttagcttgtcgtttccgtcgttgcgaaggttcgcgagtgcgtcggaagtgttcaagaagattatttgaagaccgattattgcaaggcaagtcacacagatcctaaacacaatcctttgagcatgttgatcctatatttaaattctctatttatttcaactgtgcatttgttttcgaatgtcactgggtggtgtgaatctattcctttgttatggcctgtttgcattgattactttattccttgataccttgggttattataacttgactagttgagctatatatattggttcagctagatattagatatgattgcttagccatgcttagaaacattagcacactattgggataacttatgactcattattatttaatgatggcttaatgatagttcacgatggttaatcgtgattggttaattaattacttgccaactaaaacttgataatggtgggttgtgagcacatggttttgagagtcgtgctcatgacaattaaggaccggttcgcgagctactattgtgaaacattaatcgtgccaaccacaagccagcgtgggcaacggctttaccttttgtatagcatggttcattgcggagcaccagactgagaagtggcggagataagcccacgggggtcgctggggagtccatgcctctggtttttgagggggtgattatgatccaggaatggtgcgctgcggtgggttgtgttatgcaaggggtaatgtcacagctcctttccgaggtaccgtggtggtactgaggcacatggtgacatgatgtggagctgtgtcttgtgggtacagtggtacacctctggccagagtaaaactattcgaatagccgtgcccgcggttatgggcgggttgagcaatgtttttcgtgattagtctcacacctctcacaataattatggatgttatacctgataataatttgcttagctcctggtttggagttagatctgttcagccgggtatggttgttcagaatggttgggcctgtgcagcatgggtgtgctgttcagtgttgattaaaatttctgattaattactccactgttttacttctcttaaatgttttgctaaatgctgcttttgcaaatgagccaatattatgccattctttggtatccttgtgcacttgcgtatttgctgtgtggcttgctgagtatgtcatatgctcaccttgcaataatcaatcaacctcagttgaagaaaaaggatccagaaggagaagacgtttggcttataccccagttgagctgcctgtgggagtggagccggagcttcgctagattttattttccgctgcagttttcttcatgacgaggactaagtgcctcataagtaagtatttatcgttttagttaatttgatgaatctgtatattaaattgtcagtttgtgtacctcggctgattcctggacgaggattttatgcacaaataagttcggaaattactagtgaatttctgggcgtgacaaaaactagaaaggaatgtgcggcgacacgccgcgcacacaaatatgacttacatcaaaacttcttttaaacacaaatcagctatgggctatttagttttttaaaaaataggagtcataggttatttggttaaaaaaatcagagaaaggacaaaacaagatgcagacaatgccagtcgggcactaagatgcaagtgatggtctgatgagtgatgaatgccagatggaagcaggcaagcagcaacgagtgcagggtttcccaaaccgacggggccagggttatcgcgcccccgtaaccgtatgtaaccgtgtaaaatttatcaaaaatttaaattatttttaaaatttatttgaatttaaggaggtaaccgcggtttttctattatggtactcccgcggttaccgatggtaagtcaaacctagcaacaactggacaaacgactctacacgtctgaacaccctgttaatctttactaaggtggtgattgggaaggagggactaaattttaatccctcttacaaaagcataagtttctatgggaggaactaaaatttttgtgagagtccctcctttctaaacaccacctaaataatatgccaacgtgtatgtaccagtcgcctaagcaaaggaggtcgttctctcatctcgtgtgcttttgttcgtcaatgcaaccgagattcaatttattgccaattcagtctgcaatataatcctaaaagaatgtgtaattgtgtagtgggagggtgtcacaaaactgatagctcttctggtgggattagagtagaagtagccctcttccttgggtttgtcaggaataatctgcgtcctagatgacgcgtccatgcggctgctatgtggtgcattcacagcggaggagaaacggtcccatctcattgtgccgttttttttactgatcaacgagttcaactataagctcggcttgctgttactctaagctttcaatataagctgggccttgtgccttttatctcaaattagaaaggtaccccgcgtatgatagattttgaaaagcactatttctcaataatttttctacatcataatttttccaaactatttattagcttttaaaatatatgatatttaatacattcctataaataattatctatgatctcttcagtacagagctatatttagtttgtttagaaaacatttctaatttaaaagtaatatgttttgtcttatttaattgaatgtttagtggccttttgttaacaaattaaaaactattattattaataaatatgttttatttgtagaatcaagttatgcatccttttagttggtttttattgacgcaagttattacatacttagtatacactggtaccttagtgtggcttcttatatatgtaataatatgtggaaaaactcataatgctatggtatggtatagtatagatttaaagccattaatatctaagcatttaaaaattgttatgaaaatgaaacatgcaaaggttggttcaattttagtaaaaagtaagaactatttttttctgaacttattagactttctccaaataattcaatttagtccttttggcattttacttctatcattatagatctaatttaattattgtgcagttatatagaacgataaaatctatatcattttttttcataatttcagaattgtttgaatgtcatgctaaagtaaaaaaaatataaccccaaagtggcatatgaaaagttaaattacagtgaatatgggtttctaaatgtaaaacaatctaaagacataaacggatcgcgtgatttagatgttatagttatttatttttttagtataagtttggcagcattgctcatagttatattcattttacttttctgagatctaatttaaattgtgaagttaagtacgatgataaaattattactattattattgttgttgttgttgttgtagttgttgttgttgttgttgttgttgttgttgttgttgtttttgttgttgttgttcttgttgttgttgttgttgttgttgttgttgttataataataataataataataataataataataataataataataataataataataataataataataataataataataataataataataataattattattattattattattattattattattattattattattattattattattattattattttcatattttttataattgcccgagtgacacgcaaaagtctgaaaataaaacccaaaatgacatttcttttcaaagttgaattatagttaaatttgttcttcaactgtaaatttagtcataagaataagcggatcaaaaattagttatatgatttagattttacaaaacatattttttgcttttctaactaataaaacatgtaaataggagaaggaacagggagaaaagaggtcatattttttcttaaaaaaagtaacatacgtaagtacatacatgcctaggtgggcccaattttaggaggtaattttttttcgttaagattgtcagagggtgaactcctcaagcgggggacagtgaggccccccttgttgattcggtcgggggcagcgggtgaaaatcgaggactctatgaaacaggtgatgtagaggaggtcgggcccctcgtaaacgatgaaaccaaaggggtttatataggttcgggccgctgagaaacgtaataccctactcttgtgcttgactgatcgactgaggaatacatacgcttgaatcactgagaaccaagcgtgagttagccaaagaaccgatctccccctcccactaggcttggacctctttttatatctcaagagactgccatatgtgcctagaggtctacctaaggttgagggaggatactctccacattaaatgcatgtcttgttgcttggcctcgaagccacacgcacaggtgccgcggcatggggtccgtcaaatccaaacggctaacatgggggactctcatgtcattcaccatttaatgggtgaagatatttgggtcctcacttgcgccgggatatggaaaccctgctctaatcgggtcagacgaatcgactccggctgggatgagaggataaaaagcctctcatcatcacgatgtgacaggccgactgacatgcaaccagtgcgcaggcacactaccctggtcccattggtcattcgaccagtcagtctcaccacacgctgcatttaatgcggcgtgtcgcgcccgctcatgccgccttgaatgtggttaggtaggcgttgaggggcgcccacctaaccctacacacgtggcgttatgcggtggggggtcgggacagcatggagggggcggnnnncgncctacctcgggcccgacccccctcgggggagtgccacatgggtaccggggcaacctcctccctttgggcttgataccccagggcctgtatcaccgacaaagataattataggctgtaacgatttcaagtttttcttatccataataatgacatacttatatcataaatatgggttttatactgtaaatttattaatgataaattatctgaaaacataagctgatcaaatacatgtataatttagatactacatataaataatctaacaacataagcatataagaatacatgcatgatttaaattctttcgatggtgttcataggggtagggtatacgtgtgtgcatcctagggggtgagtgtgcatgtgttgtgagtgcccgcatttgttttgtgtttctaaaaaaaatactatagttgcttaaacgtttttatataaattttgctttccaactaatagaaggaaaataagagagataatagagtgaaaagagtagaacagaataggatggtacggagtacctacgtacacgaacgtccattcaaatagggtggggcccaatttagaggtagattggtttttcttttccatctaatctaatagttcaaaagaatgggtccaccaatttaaatgaaaatcgatggttagatgtttttctgccacgtggcagcttagaagtgctcgtagaaagtttaatggacttttagtatataatagatagataatagatagatagactataagctcggcagtagtcttcttgaagaccagtatctgtgcacatagaaacaagaaagaaggatccaattagcaggtgatttttttagataattattagcagatgaataggaaaggagataaaaaggattattcagagtttcagacacaataagtttcagcttagaacataacagttgctaagaatgcaaagactatatacacaaagcatccagttttgatctgtaattattccaacgatgtcgagtggagcctctcggtgtagcattagttgaggatttgagaacatccttccattgaaagaaaaggttgagatcacgcagcatgacatgggctgccatttaggcgggcaaatggtggaggtactaacttttgatagcaagggatagtgtaggctggcagttgtttctcaggtgttgtgtggcaaaagtactaagcaagatgttaccaggaatgaatttatcagcagtacctgtgatgaccgcccacaacttttgccatcataagtggggatgaaaatatcactctccaaggacaatataatctaacgctaccatctgggaggaatggttctggaaaaaacctgagatatctgaaggcaataatgtctcttttctcacctgaccatcaacaatgagaaaggaaattttataaatatgagatatgaaaggaatgcgcaatcagtagcattggagaagataaactgaccacattgggataagctgaggtaagggcagccattcttctttggccaccgtatatttcaccatcggcaatgtatatttgataactcctatcaatgtctagtgccttcaataccattgcagcctcctccattgttaatgggcagagctcatctttcctctttgcattcgagtcaatcaccttctctttccaccatgggtaagtatatctttcaattttcaaacacaatgtagttgttaatacagattgcaaaaattacttgagaaaattttagacaaaactaaatacctcattattgtgaactactccgtctcctcgttgttgcaaccatgtgcgcaaccagaggaaggcaaagcatgcccatttcatatcgctcgcaagtgaagaaccacaaaaaggcccattattacgaagaatttgaaccacacgtctacccacctcttctatttcaggggtaaatcacaatgcagcaaaattgacacaacacctcaaattctgaatctccataggcaggcaattgcaaggtgtgcatcggttttgttcaaatgaagaatcctgtacttccatatcagtggtagagtcagttttccacaaataaacacttacaatcttcaactgattttacacgtgattttgagttcatgacgaaaaaccaatggaaatgagagatgaaaccaaacctgactatggcaataagatatatcagaccaactgacaggcggcatggagcggacatatccaagctcaactcttctttacagccttagaggcagctctttcagtttcagtacccggaccactatcaataatgcaatgaagtaatcgacatcacattatactaactgaaacaaaagaaccacaagaggttgagtaatgagtcaggaccattcttaattgaattctggtgagtgccaactgcaaaaagaaggctcaccttggatcagcccaagatgaggttatgtccaattctaacacgataagggtgttgttgagggatatatcacatatctgacagacaaacaattaaaatttttgttcggccgcgtgatttgccctctcgtcgcagggtggcgagctccgggaagtcaacctcctccgcgcgaagctcgcggcggcgcgacgtgtcacgccccgaactagccccgagcggaactagcccgtgacgctccaatttaacccattaatcgataccagtcccaggaaacagtgctggtatcacagggagacagaatatcacagcaacagaggtctctttattatagagtaggagtacagtcatgttgggctgcggacccgagctcacaactgcattacgaaagggaagcggaagccaagacttggaccaaacatcataggcgcgacttgggaactaggccgaaaccctaaaactcatcgtagccgacttgctcctggaagaactcctcgtcagcgggatccgcttcatcttccttagcaactgggggggttatttatatagagcaagggtgagtacgggagtactcagcaagccatgggaaataagtgtttaatgcaggcttcaaggaaaggctgttgtttttgcaattgattttatttaaactcttttctgaaacaattaagtgagtgcttctcaaacgacacgaatgagaccgtgcgtctcgtccggtcggagtatgtgcaaggtatcagtcttttgaattgatcatggttggcacccggccaacggcttttaaacggccacccgggcctggctgatcccatcagccgcagattttccaaacatcgaacccaaaccacatcagcaaatttcacaagcagtaggcaaacaaaactacgctaggaatcacctcacatccacccatgaccgtgggcatggctgttcgaacagtttaataacctctacagagggggtacactttacccacacgacattactaacccggatcatccagcccgtgcagaacggccacgactagagaccttaaggctttcatgacaaggcatttcgaaagccgacacaggttcaccatatgccaacaagaggggtcccagaccatactgtgccaggaaacccgggggttctccccgacaccaccccgttgaatccacatgtctcttggcatcatggctcccccgattagctagttactcagccaggggtgtcccattccacccatgtggtcgcacttgtcttatgttcggatgaacttccaaggaaacggtccttaagtgcaagagcaggaaaccgtacacccggtacgttccccggtccgcgattttggaaattcatttagttcgcaagcaccgacccaggtgtcgggttttccaagtcttttgtaaaacccaagttttacccaagatgtttctcagtttttaagtttgaaggcgaccgtcgatactcgtgcagagtgcacgattaccgaggcgcaactaggtggttacaagggaacatggtataacaattaacaaaggaaggataagatgcaataagctaggtaggcccatcggtctgccttgcagacggggcaaacagattaagtgcaatcctatcaatgcataatatttttcaagcaacataattaagttcaaatataggctcaagatgttcaagggtggcttgccttgctcgagatcttgagcttgatcctcgaaattctcgcactgtgggtcttcgggctccgaaactacacgcgaaacgggacaactcaacaaacggagaaaataaagccctattattgacctctaggcatgccattagatagatctcgagatttgaggagttttggaagttgaacggagtcaaacggacttacggatggaaaaatattgaatttctaagattattggatttttggtctaaaggaaaaggatttatttaaatcctttttgaaaatgaaaagaaaagaaggaaggagggagggaaattagactttcctcgggcggctaggacgcggcccgagagaaaggggcggctcggccgaacctaacagaccggtcggcccgagaaggcggcccaaagcacgcgcgcgggcggggaggggagaggaagccgatgggccggatccatcccgcgtggtcccgagtgggacccgcttgtcggcgactcggctcaccgtgagcgaggtgcacgcggggcgtgctagggtttggggagggaggtgcggtgcatgcgcgcggttcgcggaggacgcggatacggcgggcccacgcgcagcctcacggctcaccgcggaccatgcgcacggggggggggggggaaacggagggagcggctggccgggtcagccgatccggtcgtgccgaggtggctccgacgtggcgcctacgtggctgccacgcgggccggctagaggaagacgaaggcgccggccgcgaatggacggcaggcggcggcggtttctccgggacgccgtgcgacgatgaggggcgacggggcgtacaccgggatgacgagggagaacgagagggagcgagccaacggcttggattcgccggagggagtccgtcggcggcggattgcggcagcggcaaccggcggagagaaaaggaggaaacggcgacgaggtcacgaggggccgattcccggcggtgagagcatctacgcggctacgggaacccaccccttgcgccggattaggaggaaacgcatcgagggaggccggcgacgagagacgcttccgagctcgggcggcgacggcggcgagcacatggcgagcgacggcagcagtcggggcggctccagctagctactggggtactacacacgctactaaccaagtctaaggggaggagatggatcgaggaaggagaacgggggaatgcactaccgagatgaggcggggcgctgtgacgagatgccgacggcacgggagtgatctcttcggcctcgggccggggtagaggaagaagatgagcgcccggagtccccttccgcgtcctagcgcgcaccggctcctccggcacacgcgacggcggcggtcggcgagagagacagagggacggcaatggcgcgggtgaaaaactgggaagattgggaggggaaaaaggaagggagggcgcctgggtttatagggcggcaatgtcggttttggaaaccgaccttgggcggtcaaggtgcgagctggcgttcggcgctcgcggccaaaacggcgacagaggcggatgacgccggcggggaagaggaaagggaaaaaggaggaggaaaagggggcttaccccttgccactttggggaaaaggaggaggaagagagggcgacgcggcagagggggagagctctgcctccgtcccttggaggttagcgcgcggagagaggcggggccgagtcgatgacgacggcgatgacggcgggggcggtttggaatggagcggcgacacggacggcaggcgcaggcaggcgcggcagaggctgacggcggcggcgaccaggcggtcggccaccacggcgcgcgcgcgcgggggcggcgcggcgatttgggcggcgtcggcgggaacggcagcgagagcggagagggagggctcggcgcggctcacgggcagagagagagagagagagagagagatgggccgagaggaattcggcccatcgaacccgagggaggcaaaatagacttttgcggagggatttgatttgggaaggatttggattcaagattgaacttgacgatagatcggggatttgagatccggaatggcacggacactagacaacaagcaagaaacagatttcgcaattagggtttttaagagatagttttcccgctaggcgccacgacggaacgggcgccacacgacgcgaggccacgatgcacgcagtgaactctggctcgaaggttctcctcatcctcaagatcgttgtcctctctctacgtgttcttctatgtcttcagtgttgatttcgtgtatgtacatgtatcttggatggttatgatgggggatctcaggttgttcttggatggggatctcaaggatgtttttttggtttgagcagaagccgtcgtcgctcgacgcatttcccgtcagccgtgagctcggtgcctccgtgtacgtctaccgccttgcgagcgcgccgcctttttttattactagattctcattgcgcgccgccttttttgttactatactgttgatcagttttgaaatatgcatgatgatttcacaaacataacagtactatttcaagcaatctccaatttgaaaccatatagtatcacaatgtacttagcttacaacacattgatgaaacgtaccgactccgagtgacaaatctacatataagcacgctgtacaaagtggtacatctgagtttgaatatcttcaattctgtggagatcttgcctgggacaatccttgatcatcagttgcttgggtatttataatgcccatggagtagtcaaaaagagatggcactcgtgttgtagcctcaaaacaatctgcaaaaatattagttgtggaatatgctgaatggtctacttgatgtctaaccagattcatgttatatggtaggtgtgaaaaaaaaagaagatgatcctatggttcatatttgtgaaaaacacaatgaacaaggttgtttacaggaaaaagttgctttcatcaagatgttagcatgttctaaacctctaaatctctaattaaccattttaatgtacgtatataacatagccagcatccttaatgggtgttagtaatacgtagagataaaaaaatatgtattattattaatcgacagcgcattgcggcagcatttccaccataacatgtagaaaatgcatggcaataatcaacaacaccagataccaaacacaagatactaactggaactcttaaccatacaactgaaatttgtctaattgttttagagaaattagtggattcatcagataaacaaattataagaagcaaactctcatgtaagaagttttagatatgcagagatagaagttccaaaccccgacaggggtcgacgaaatcggatagacttttggcctgatgttcttgaagatcattagttttctatatacatttctgtggaaggaactggctgtgtatatctttcgtggatatagaggccggattaatgaaaatccattatctaaaaaattttctttggaaggaaagaaaaacaaaatgcaacagtatagaaagggaaaaaaaagggtaaatgaaggcacacaattgatagtgcatactcaggtatcttgttcttctgtagatggctagagctttgataggacaaagttttgtcatgtcaaagaactgcaataggtcaaaaatataatttgatcaaagaatctagtacagccatctatgattaaaaacagaaaagaaaattggtaaatgatagaaatgccatttccacgagattaatgatgcaatcattgaatgaacagtaaatcttgaaactttccttcagaaccagagtagccaaagttcagaaatcggaaccaaggtcagacatacaattaccagaggtaaggcatagcacatagtttccaaacgatgctccttgaggctgcacacacaattataacattagcaaatggcatgcacaattcaaaaccagtcaatttataataatttaacttatcttgcaaaataaattcaaatcaaccatcattatgttaacatattataattatacacatgcagaaaacctgtccttgtacattgtttgcatgacttctttgactatcttagtctgatgacatatgtatggatatcattctattctacaagtagtcattccaaggcatgaatgcatctttacacaaatgtgatgctaaaagcaagcagactatctcccttttcgtaccataaatccaaaacagtacacaaaagctaaaatgaagattgtgatataaagtatcctgtcatttacagatagaagatcaagatgacatggtgatcactatgagacatttataggccttgattggaacttgtaacttttttttgttgtttactatggtaattaaccaactcctgtatttcacattgcctctacccaggaataagaccatagattttgtgattggactgtccaagatatactgatcaaatattttcaggttgtaaagggatagaggaagaacagagacaaggagggtggttaggatctgttcatatggctaagtttttccttttttctatctctactaaattaaaaaggttcttaccttagtaattacaactaatgtctatgttcagaggttaaccttagcacttggacaaaacatcccccactacacaaccaaacctatagataaaattttctgcttggagttcagaccatcgatcaaccaacaaacatatcaacaagttctaatacgaagtaatatcacctgaccaaccctcaccttccagaatccatagccgattgttgtcctttcatcactaataagagaaggaaaaaattcatcgatcgttaggtattacttggacaaggggtcatctatgg

SEQ ID NO: 69055 - DNA, 2680 bp, Oryza sativa
gttgctgcgggatatttggataataccttcatattaacatttgtattggctgaaaaagaagaacaaaagtacaaagaaaatagaaaacgtgttataacttgacgactgactgaactaaaacaacagatctcacaaagcccttatccagttaaactgagaaaagctaactgggctggataataaggtttgtattcatgcaacgatcaggaaaaaccataggattagatcgaacggcttaaaagtgctgatgacgtggagcaatctttataagagtaaatgctctagtgggtaccaactgtataggaagaaaggataagcataaatgcctctaaattggtaccggttaaaaaaccgacatctatagtgggtatccaaccgacaccaatagggaactacttcctctgttttatattataagactttttagcattacccattttcatatatatgttaataaatctagatatatatgttcattaacatttatatgaatatggacaatgctagaaagtattataacctgaaacggaggtagtatgtactagtggacgacgagctcccatctcccggccgaggccaacgacggcggcgcggggacgacacgcgcctcccggccgtcatcccgtgaggcatagaagtagcagctctgctggccgtgttgccaccaagctcgccgaggaccgttgatgcctccacggctccaacgttgattccccagacgacaacgtcgtccccccaccacaagatttcgccatgtccaccgctcggccttgagcatcaccgtcctcagcatcctcgcgctgtcaaagatagtaaggcgaaaggaaggaatggcacactgacacgtagggccataatattttctcttttcccccaaatataacagtgccactttaaccaaaaaaaaaacgctttgaacgagtcgaggttttgcggcaaggcttaaggggctcaaaatagacttattccattcagagctgtttggggcacagggccggcggcccagagaggcggtggtgcccacgaagcctacacaagaccgatgccctatttaggtcaatcgtggactatggacaaccccacaccccaaaatccccaatcgccgcgccgcactgcgactgcgattctcccaatccccggtggatatcgatcggattcagatgaacactcgattccggcggccggaggtaaatccggagtcgattttttcgcaaatcgcaggtactctacgcaatttttgttcctaatccccaaatccccaattgccgcactgctactgcgccgcgtctcgccggccgatttggatggctgcgggtgggacgcaagcaatgaggcagttcgtctatctggtggtgaagggctgctacgatcgccgcctgcggtgttgtcgcgacagctacatggcggacaccttccacatgcgccgcatcaacgtgtcccgcttcttcttctaccccgaaccgccgccgccgccgccgctggcgatggtcgtcgacgctcggctgcctcgcccctgcatcaccttctgcgccccctgggtcatgcacttcatgctgctgggccgcaacagcgacaaggtgctcgccgtcgaccacaagggccgcaccaccatgtacgaccccgccgccaacaccatccgcgccgcgcccaccctcgcccaccccaagagactccccgccatctccctccccattggtgacgacctctacatcctcgacccgacctcctccgaccaccgctgcttcgaggccctcgtctacaagcccggcggccccgcccacgactgggtcaccacccgtggccccatcgaccggtacaacgactggcactgccaatctctcccgccgccgccctaccatccctactcctgcagcttcgtcggcgcaaacggagccatcggcggctatgcggtggtcggcggtggcggcgactcagcagagatctgggtgtcaaccaacgacggcagcggcagcggcaccttctctttcgacacggcgcggcgcgcctggaccaagcacggagactggacgctcccattccgtggcctcgccgagtacgtccccgagtacaacctctggttcgccctctcctccggctccaacaacaaccatctctgcgcattcgatctcgccggcgcagctgagccgccggcgacgcgcgatttctgccaagaactcaagccacccaaggactggaagctggtgtcatcccatctggtgcacctgggatccggcaggttctgcatcgcaagattcttcgaaaagccggtcaagattccagtgtgctgcgtctgcgacatggatacgcagacgtacggcgtcttcaccggcgtggaggtgaagaagccgggaagaggcctacggctacggatggtcaagcacagatcagaatgttatcgcttcgatgaccacattaaggaatgggtgctgtaatatttatctagtcttttttagaaagatttgtgcaaatagatgaactcagtagcattggatatgctggtgcttcaacaccttgaacactagcacaactttttatctctatcaagttttagaggagaactcatctgtaccttttcctgacaaacaagaagattttttattttattttggatgtctcctgatataggaggcaaagactgtttcagtgttcttttttctgggttcagaaaaatcagaggatt

SEQ ID NO: 69056 - DNA, 8414 bp, Oryza sativa
  unsure (1)..(8414): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactgatggttgttcttggattgtgttctgcaggaatttatcttcgaatagtctcagtggcaaactcccagattcgatggcgaagctgaactcgctttcgacactgtgagtattatcctccttaattgtgtgcagtaatgttctttgtttatctctgaatttgcaatgtgtccgcaacttgtaggcatgttcagaacaatcagctcactggcacacttgatgttctaggagatcttcccctgaaagacttgtaatcactacatcaattcacacatgctctgtccaggaaaaaaaatcacacatatttaccttgatgcatttctcacctgatcctctcatgatttactaatatttgcagggatatagagaacaatcttttctcaggaccaatcccagagaaactgatcaacatcccaaaatttctgtaaatctctcagccttcctcaagaacagtagaatttaatctagtggcatcccagtctgacacaacagttggttcttgattgtgtgcaggagaaacggcaaccatcttaccatccccacgatgcccggctcttctccaactccggataccatccccggctctcctccgactccggcggcagcggtggcggcgcctcgatcaggtgcttcacaccctcctatatatgtaattccggccactccacatggcgctgcacagggtgaccctccgagacacggcaagaaggtctcgccggcgaaagccgccggattcagcatcctcgccgccggctcactgaccattgccgtggtcctgatcgtcttcgccgtgtcgaaacggcggcgggagacgtctcttcatggaggatttctgagaggagttgagatgagcactccggattggagtgggaagccttcaggacaaagtgcagttgtcaaggtagacaaagaacaaagcacaggtatatacaccgactgaaaactggagtatttcctatcttgggcccacatgtcagtgacatattaagaggtcaatcttagaacaattattaatgctcaaaaaattcagtacataaaacgctagcttgtgcagtcatctcatctacattttaatcattttgtttgttgtgttgatcactgaagttgctgaagagaaggataccaagggtagcatttcttcatatcagaagaatgttcaggagagtttacaaaaccatcctttgcaattcaagttcacaatcttcacagttgcatccttgcaacagtataccaacagtttcagtgagcagaatctgatgaggcaaaccctgttcggaaaaatctacctagcagagcagcaagacatcaaggtatctaatcaactgtaccctgaaatctccattccattcctacatggattgaacaagtttatttcttgatcagttgtaatcaagatcttgtcatttcatctctgatctctctacaccttatactagtttgcagtactgaagcttgacgaagcgatggcgagaatgccggtggacgagttcttgaggatggttcagagaatctctgaactccagcatcccaacatcgaggagcttgcaggatgctgcgtcgagcacggacagaggctgctcgtctacaagcatttcagcgatgaaactctcgacgacatgatccatctgaagaaactggcatcatcagacgatcctgctgccaagatcactcttccatgggatgcccgggtagctgtcgcactcgaagctgcgaaagctctagagtacgccattgccatgatcatcttcaatttgctgaataattcgagtgtttgtcttgctggcttctgaatctgaagtgagtaatcggtaatcgcttctgccattgctgttcttgcgttaggtacctccacgaaggtggtcagagacaggttgtgcaccagcatttcaggcctgaacatgtgctcgtcgacggcgagatgcgtgtgcgcgtgtccggctgcggccttgctgcggctgtgaaatccggcttggatcttcaggtaatcgtttcgtagacaccgcttgatcgatcagcttgttcttggatgtgcatctgatcgatcggtgtcgatttgagcagtcggaatgctggctcgacgcgctgagctacgagccaccggaggcggcggcggcgccatggacggacaagggcgacgtgtacagcttcggggtggtgatgctgcagcttctgacggggcggaggccttacgacggcgcgcggccgcggggcgagaggcggctggtggcgtgggcgagctcgcggctgcacgacctgacggcgctggagaagatggccgacccgcgcctcgggacgccggcgacggtcaggtccatgtcgcggttcgccgacgtcatcagccggtgcacgcagcaggaagcggagttccggccggccatgtcgcaggtggtgcaggatctgcggcgcgcgctgcagcctgcacgcgatgcttgcggacagcagagctgcagcaactgattagtgacgaaaatttactaatcccgcagttccgaaaaaatatatataacaccatataagacatactctaatgccctatatttatgccactatcttgtgttaaatctattatattttggaacgaaggttgtagtaatatttgtcatcctcctgatttgcgtgggttcgatttaaagttttagacagcgaaataccatcagaaaatagatggaaaagtggaataccaacggaatacaaagggaggaaggggcagttcaaattgatgtcattttcaaccatatctttttttttgcaaagttgccaaatttgataaatacataagaaatcctgctaaaattttggcaatattaccatcttgctaaattttggtaaggtttannnnnnnnnnnnnnnnnnnnnnnnnnnnaagtctctcatgttcaacatacacatttttctcaagtgctaaatgatatgttttcataaaaatatgtatagagaaaagttgatttaaaaatcatattaatcacctttcccttccggtgatcattaaaaaaaatcatgttaatctattttttaaatttgaactaattaatactcgcgtaaccacgtgctattggattaactcattttacgtgtcttttaaaaaaattctttcacataccctcaaacatatcctaaagtaagtatcgctaggcaatattctcgcaatatcttcaacctcccatatgctaaaatcaccgcttgtcagatatacgctgatgatttgcaaccataatccacttatttctttcatttcaaatctccaaacaaccaaaatgaagagaggctccaggtccatgtagatttgtccacataagttgaaaaataatggtcaaagttttaacatctccatcacataaagttgcgaataaaaaggtgagttgggaggcgtcgtttttatatttttaaggatgcaacataagtaacaaggcatttatttgatgattgaaacagctcaacgatacattattttatttttgttgtttcacaggttttacatgcaagagacaaaatatattgcaaaacagtatagttatgatttcatctagatgaaattcatttcgtttctcacttcatttatctcttatcatatcataaaaatattggcacggcacccaatttaatgagaatgaaacttatattgaaactaactatcagaattatgaataccacatacctaatagtagttgactaaatctcggcaagacccaccacataccatgttttatacggaaacaacctgcggatatgggaggagttccggataaggaaagacaactagagttctacatggaaacgacaaggactacgcggattgtatccatattggtttccctagttctatttggacaaggggatacctatgggtataaatacaaggtcccctaggaggagaggggacaatcaacacacccaccatgaaaaagacccaccatagaagacacggaacaataaatcaagacagaagatcagcatagaagccagcatacgccaagacaagacgcaggatatcgacttcagagataagtacagttagtcccctacggtgtctccggatactgtcaagagagacgaaagcgctgtctctgatctcgtcgggcacgaactcgaggaagaagactaccctgttgtcgactacgagtcagacctttagaccgccatgtcgacaacagttagataggctaccccaaatattgtactggtgtgattatggtgaataagagcaataccggcttcggccaacaggatgtagggttattacctgacaattcaggggcccgaatctgtataaaaatccctgtctccatctattttatctcagtctcgcgtatatcctagtaccgacgatccccataccatgcaaataccggaatcgcgacatcaaacgtcgacactaacattacttagtaattcaattcatttcatttcttaaactagacaaatcttactgcatataattgtgtggttgattgcctatccaatcggtcggtcctggacaaacggaggaacggatagacacgggggcggttgttcccatgcacgaatctcaaagcactccatggttcggctaggacaagtcacaagccagatctcgtccacctccattcttcccttcccattttccgcttttccggtttcctcccacccaccccgcaccgtactcaatttctcgtcaatctcaggaaaaaaaatggtgcctcgccgcgacgagatctgagagcgcgcacgcgcgtcctcctcgccctcgccctcgcctccgccgcgcgcgcgcgcgatggcgtcatgcgcctcaccgtcgtcgcggttgcacggcaatgcggccggcggcggcgccggcggcagcgccaccgcgatgatgctcccggggccccccggccgcggcaacggcgggtgcatcgacctcagccccgcggggctcctcgcgcatggcgcggggagcagcgtcgtcatctccgacccgcgcaccatgcagctcctctgcgtcctccccatgccatcctcctccctcgcctccttcgtcaccgccgtccgctgggtgccacccagctcgcgcttccacgccgcggggatcgacgacgacgacgacgaacgccgcccgctccgcctcgccgccggcgaccgccacggccgcatcgccgtctgggacgcgcgcgcgcgcctcgtccttcactggcttaacctcgacgagacccgcggtgtcgcgccgggatccggcggcggcgtccaggacctctgctggatccaccatgcctccggttggctcctcgcctccatccatgggccctcgctgctctgcatctgggagacctccaacaaccctagtgtcctctggatgttcgacgcctcgcccgagtacctctcctgcctccgccgtgaccccttcgacgctaggcatctctgcgcgatcggcctccggggcttcctcctctccgccatcccgcggccggactctgatatctcgctccaggagcaccgggtgacctgcggcgccagtgacattacagagctgcagaggctggagaaggagatagcggcgcccccgccctccccggccctcgccgcgtttccagcattcacgccgaagctatgcttctccccgctgtggaggaacatcctatatgtcacgttcccgcgggagctcattgtctttgacctcaattacagtactgcgctctctgtcactccattgcccaggggatttggcaaattctctgatgtcatgtctgatcctgatttcgacctgctctactgcacgcacattgatggcaagctgagtatctggaagcgcaaggagtgagtttacagtcatacttttcatgtggatactgtagaattagaatatagaaaacatgtctattgaattgtgtccaaatgcccgaactcgtatgaactaaatttgcaataagactgtggtggtcaagtgcaatcaataggctacatagaaaatgcaggaacaaaacagaattcaaaatggtgcaagtacatagtaataaattctagataaacttggaaattccttacatccttgggagtgtgctgataaacacataattactatgaagccattggagtttcaattatgttgctgtgtaaaacgaatgaataatcagtatacacacctgttagtgaccgttgatctgtttattaatggacacaattttaatgaaatcgtacattatactatatatgttttacaatctgttcaggttattgacatatgggcttcacaattgtgaaccaatatatgcatgatcacattacgtttgtacataaatgatacacttctttccagtatattaagttcctctcgtaattcttttttcttttccggttctaggggtgaacatgtgcatttgttgtgtgcggtggaagatctcatgccttcaattggtacaattgttccacctccagctgttcttgctactacaatctggcagtcagaggctgttttccgtaacatagagaagcaatcacgggacttgggacaaatacaatctacacattctgtcatctctgatacaaatacaaaccaaaatatgtatcaagggaccatgacatatctaacctcgatctctgaagatggcaagatctggtcatggcatttaagttttgacaagtctgcatgtgctagaaaagataaactaggtgcgaaccagtggtcagttcagtgaaatagctatttctggctctcaactgtgtaatttactgatgattccatttctgtcactaatgttgggaagggaccaggtacatcgaatcatagtgatgctggaatttccaattcgcgctccaatggacttgattttaccgtaaaggttgtagtgtaaacttcttccttggtttctgttgttagggtatcaccatgattaagcaggaatagtggttctttggaatctgaattccctatacttctatacaaattccctatacttctatacacagctcgattatcctaaattaatgggattgagatgtactccctccgtttctattttaagtttgatcaagtttctagaaaaatttagcaatatctaaaatatcaaattagtttcattaaatctaacattgaatatattttgataatatgtttgttttgttttgaaaatattactgtattatattgttctataaacttggtcaaacttaaataagtttgactaggaaaaaagtcaaacggcttataatattaaatagagggagtacatgtttagtcatcaatcaatatcccctattcctggcgcttatgtacttcccttatgtggtttgctcatttgtgctatgctctgcagattaatttgatgggccagcttcatcttttgtcctccactgtgactacgctagctgtgccatccccttctttacttgccacagtagcccgtatgcccatgaccataacattgtaccgtgttctgaaattataggttttaaatttgttcaacattcccataacagaaaactttctttttttctatctgaaggtggtggaaacaatcctgctccagcagtaccacttgttgctgtaggaactcagaatgggactattgaaattgttgatgttttagctaatgcaatatctgttagctttgctgtccatagcagcactgtcagaggattaagatggcttggaaattcacggcttgtttcattctcatatagtcaggtactcaggtgcttccatgttacttctgataaatcttgtcttttataaaccaagtacctacatattttgataatgtgaccaattaacattgtggcaatcaaaggtgcttcattactggaatctctgatactattctgtttcttatagtgccctacgttaatattatcattgatttgactacaggccaatgacaaaactggaggatacaataataagcttattattacatgccttagaagtggacttaatcgctcattccgtgtacttcaaaagcctgaacgtgcaccaataagggcattgagggcttcctcatctggaaggtggttctatctctcttacctagaccaatctctgtttgtgcccatacctttttcaagttttaaccttttacatttcaatatgcatggatttggcacatttatcacagctatatttttcatctcaagcatagttttactttcttaggtacctcttgatactgttccgtgatgctcctgttgaagtatgggctatga

SEQ ID NO: 69057 - DNA, 3647 bp, Oryza sativa
acttgtttggtttagttgttgtaatatccagttagtgtatgtgcagtagttatgctttatctgaaaaatgttgatgctaatttggtgatatcaggttaatgagcagacattccttttctgcagcccaaagtgaacataaatgtcttgcctgaagcacttaaaagtgacactattttgttctcctttctcttgatgtgctatggtaattctaacttgctgtgcgtaacccatgcagggtactccagaggtggggtgattatattcttcgcagtgaacataatatgtggaggtatgttgatcccttacagctacaggatttaaacaaattcatcactcctgctctaccaacacatcgtttgtccttccacagagctctgatactatatgtagctgctggagcactacctgaggctttagaaacgcttcgcaaaaaccaacgaccagacatcgcggcgctgttcttgcttgcgtgccatgagatctattcccagatcaccacagaatcagagtcatcagatgacacgccagggtctggatcgccgacatcggaacagagccccaagctccggttcccttccaagaatgtggacgacgaggacctgatcgcggtcagcgaggtcttcgggcattaccagcagaaattgattcatgtttgcatggatgctgaaccaaatgtggattgagccctcttggcgccatgccatgccatttgccaattgccatgtgggagggaggccctctcctggatggacaatatccgaagctgaaagagaccgagtgcccccactggtctctactactctttgtagatgtcaacgtctagcttttgcttctccatttttgtctggtgtgaagcttttttttttctttctacaggatgtatgctgcctgcatttttgtctggtgtgtaatctttttctacgggatgtatgtcgcctgcaaatcttgatgctggacagagccgcgttgcgccgtatcctacaaaagacgccgatgattagcattgctgatgtggcatctgtacggagaacctgataatactacttgaaagggataggcattgcggtgttgtattgtactagtaggtgaggacgcttggcactggcaatacttttctgtaagaatatatatatctgtacattttttattgctctttctcgctcaggctgcaaaaacagaaatttggaagttgtagcacatatgtatcgacttaaaacatatttaggtttggttttgaggaatcaaaccatccagaatgagaaaaatccctactttctcatctagaattggtgatccatcggtggacaattcctcaattctttttttgacaggacaattcctcaaatttggtagaatgtctccattgctcatttcttttctactggtacttgtgagttgtgagtgactggggatcatgggatgatggataaacctattcaatttctcaaaccaacaccccccccccccaaaaaaaaaaagaagattaaccgatcaattgaccaacccaatcctcaaatatcctccatgttactattaggccatgtttagatgggactaaaacttttaagtccctatcacatcggatgtttgaatattaattataaatattaaacgtagactattaataaacccatccataatcttagactaattcgcgagacgaatctattgagcctaactaatccatgattagcctatgtgatgctacagtaaacattctctaattatggattaattaggcttaaaaaaattgtctcgtgaattagctttcatttatgtaattagttttataagtagtctatatttaatactctaaattagtgtctaaagacagggactaaagttaagtccctggatccaaacaccaccttagacgcttgacgcattgagtcgtcgccatcaatcaatcatgccctattaaaatcttgtagccactgctatggagtttgatgaaagcaacctttttctgtcctagatgcctaaaatcatccatgaacctctgtaattaactactccctctgtctcataatatagcaacctacaagacgagacatttcatattacaacgaatctagatagatgcatgactagattcattgtactataaaatatcacatctgatcctagattgttatattatgagacggagggagtactgtagtattactttcacgcaggttcatttcaggtccaactttcttggccacatgacatcttaagataacatatttggcatagttaatcatcctcagacaaccaatcaaggaagcatgataagcaaccactaccataacaagtagcagcaactttctatccaaattacattactggcccgaaacaaaattccattttggctctgccaagtgccagccaaccaaccaaccccacgtttccatccaaattaatcaccaaacttatccaaatcacttaattaactatattagaccgtttgacacgactccgaaccggagctctacctttttccgaagtttgagcctaacgaaacggtttcaaaatacaagcaagatcaatagtgcagcccactattagctctaaatcatctatagtcaatataatagccaattcatataatagttgcttactatactattaatatttggtcccacctgtcatacatacattatatcttggagcccgtgctgcagctgactacagatatgtagcccgctgctcttctctcttcctttatctctttaaaatatgtttatagctggcttatagcctgctctaaggaaatagtactaactataatactatcacaaaataaactgtagaaatgaagttgggtttagacagctctacaaaccctattttagatctaactcataaaattaaatttaatagtttaagccctaccaaacaaattgcagttacacaaaaagaattttagaagcgatcgctacctaaatagcctgcgacctcatgaggccgacaaactgagcacaggtgacaacaatctatgactagtggaaaaaactagcaacacaccataacgttcccaacaaagagattcgaccctaattctcctaatctcttaggaaatatggaagaagcgggaccaaagaatcttccaaaacaaggagctatccctataaatcttattatgaaaattaaggagaagccaaatcttgggtattggcgggagccaaacaactaactaagatgttaccatagacgtctgccttatttgtaaatatttctttgttttctattttacatgtaaataacactcctatattcaatgaacaggcacgctgtgtctttcgtttttcttttttaaaaaaacacatgctaaacgacccataacgacggcattttttgcgagagtgggaggtggtcccacctcgagcgggcaagcaaagcagcaacgagaaaaggaatctggacgccaccccaccacaccaccactaccccccacttgcaatctcccctctctctccctttttaaaataaatccggataacgcatcggtgaaccctgcggattaacagagtaaactgcaacaaaccacgcgacccccaaacctctctctctctcctcgcctccgccgtcgccgtcgccgtcctcgactgctcctccggtgtgatccgatcacgcgcggcctctccgcctcccgctcgcccttc

SEQ ID NO: 69058 - DNA, 1868 bp, Oryza sativa
tacagctcgtgagcaccacaggaaccctgatccctaaccttttctctccccctcaattttttttgagcctaccttggttgtgcatgcgctgtgctgtttgtcccccttcttcacgacgattttcaagttatacgttatcattcagatgcaaggaataaccgaaacgcgtgttgtcgtagctaccatgttatcattcagatgcaaggaataaccgaaacgcatgttgtcatagctaccatgctatcattcagatgcaaggaataacagaaacgcatgttgtcgtagctaccatgctatcattcagatgcaaggaataaccgaaacgcatgttgtcgtagctacaatgctatcattcagatgcaaggaataaccgaaacgcatgttgtcgtatctaccatgttattaatcagatgcaaggaacaaccgaaatgcatgttgtcgttgctaccatgttgtcattcagatccaaggaataaccgaaacgcatgttgtcgtagctaccatgtttcctttatatgtatatttattagtaccttttatgcctttcataattgaatggattgacatggctggcaaatgtctgtgttgctttaatatgccctcatttgggcttttatgtactagggttagttcgttatttcagtatatgcgcgatcccgtgttggactttagttaaagatcatgtgctggagtcactgcaggacaaggttgtcggaaggagagagaaaggagagcaaaagagtttggggatgaagggaaaaggggaaagaaatttaaggaaaaacacgtggcccaatttattatttgaagctgaaaatctcataaagcagaattatgatgtctaacggcataattgaaaatttgaaactctttatgtgcgtttctttccttttcttcaagtcaaatgctgaataggcaaccgctcttgcttcaatatccaatgcttaaaaaagaacttctgaaaaaaaatcattgtagtgttcccttacctttccttttttaatatgcaagatatgctctcttttttttgtcggatgtcctttatcatttcttgtactttctcatttattttgactctgttaacacttttgtgtgaacatattggaaactctgtagttgtacttctctctgcatacttgaagcaataagtcctcatacaaaaattgttttacaggtccagaatcttattgaacgatgtcttcagctttatatgaaccagaaagaagtggttgagaccctatcattccaggcgaaaattgaacctagttttactgagcttggtaatacccttatacagattttctttttcttgttgtgcactgaatgtagcataactataacttggttgacttcccattgcatattgacatagcaatatagcattcatggtgcaccaagcctttgaatttttatgagccaatggttaatatcggacaggaatatgtgtgctttctaatacaatttggagggcattaatttcattccgtcgtaattcataaacaattggttctccgattgctgtttttaatggtaaaacacaaacacgtttgcctctatttctcactgttgtttttctccagtctggcagaaacttgaggaagagaatcgtgagttctttaaagcatattatgtgagacttatgcttaagaatcaaataatggtcttcaacaagctccttgaggatcagtatcggcttatgtgtaaagagcagccttctggagtaccttctatgcctcctactactaatggctccaacatgggcacatgtaagtatatgttgttttttttttcatcagctgtctatacaatgatgttaccttgcttactgttcaacaaatccctctaaactatttcattctaaattgatg

SEQ ID NO: 69059 - DNA, 1222 bp, Oryza sativa
gttcttggggatgttcttgccgacgatcttggcaggagcgatgcggaggaggttcccgggcttccctggaacggcgcccttgatcatgacaactttcaggtcgttgtcgatcttgacgatcttgagcttcctgatcttggtcttggttcctcccatcctcccgggcatcttcttccccttgtacacccgacccggcgtcgtcccggcaccgatcgatcccagagctctgtggctcttggagccgtgggtcatcagccctcgcttgaagttgtgcctcttgatgccacctgtgtcgatgtccaagaaccgtcagtcgcaaattgagagcatagttgcacaattatgccatattgccattagatgatcaggaactaaaagagatattggtgctcttgacttcatgagaatgctataaacgattatgttgtttggggagaaacacccaggggtcttccaactagctccacaaggtggtaggctagatgacctgggttcgaagcctcacccattctgattatttgatattaggtccttctctaatatttgtgtcttttttattatgttgtttgggaagaatatacatgaaatggataatgtttgcggtattggcaaatcgttggtcgcagcaaatcaagagcgcaattgcaacgggtttacgatgttatattcacttcatgaaaattatacaagtgatgctgatggttgcaataaattgtgaactataacgaatgtgttgacatggtacaggtctgcaactccaagaacagcattgacattgccatattggcaatgccattgtgcaagtctaggacgctaatcaagagaagaggctaaatgattcttcccaagaacaattctgtacactaacattggtgagcatatggtaaatttgatacagcaaaatttcaagcttgttctcaagtcttcctcacaatgtaaagcattgttcaaattcagacagggcgaaatggtagtcacattgtgaaaagggagtaaaaaaaaataatcaagtttactgaccttggaaccccttgccgatggacttgccggagatgtcgacgaggtcgccctccttgaacatgtcggcgaagtcgagcggctggccggggtcgtacccgtcgacggactggaggcggaactcctgcaggtggcggagcggcggcgcccctgccttgccgaggtggccgagctccgggcgggtgagcttctcctcgcggacgcc

SEQ ID NO: 69060 - DNA, 1631 bp, Oryza sativa
gttgctactattctccattgatagcacatgtaaaaatttagggagtaactatatatatatttatagcgccgtatttttcaccaaaaaaatagtcggcatgtatttacattgcaagtccctaaattacatatataattttagtgtatttacaatgtaaattccaaaattacatatgtaagtactaaaattacatatgcaattctcaaaattacatgtgtaagttgatgtaattcccaaaactataaatttgtgatgacacggatatttagtttttaagactaattagtaatcctaattagcaaataacattaaaacaacagaagagatcagaagagaacagaatcggagggatatgcgtacactgcgatgatttctgcatccgcatctgacggttgaaacaaccgactgaaatccatcgtaatttgtagcgacatatttttagcaataccgaaaatttatggatcactagtaaacgttccttgtctcccaggtttaagtatgctgctagctttgccattgagaccatataactttaccgagttttattttagataacgtgctatccagtgtccttacttaaagtcaagtgtttttacctagatcaattgtaccttagcacggtgcccctgtgcaccaggtgggaagatatcaatgggaactgagtttggtacagatggtttgttttagtatataagtgggtttttgtaggttagccacttgcactctcgatgaccttcattgcactaacacagttcagaatagctcactacaaaatagtgattgaacacttcaaattctatcgaaccaataacgttgttcaagaattgaaagcaacgagagaaatccattgccttctacgcgagtgagattcaaaaacacaaatcttgcgctccatcactagtattttcacaattcacattttgctatatctttattgttttctatgcccttcgctctacctgatcacttatatataacaaaatattgctttacttagcatatgttcttctggagggattgaaaacccccttcgcatgcaaaacgaagcaacatactaacactgtcggagcttggggctcctcaccgggagaccgcgcaggcccccctttgccggttcggccgggggcgctaagtgaggttcttcaccctcgatctgtggaatattcgcgagagagcaaatgcacgagacacgggcgatgtagacaggttcgggccgctgaaaagcgtaataccctactcctgtgttctggtggatctgtgtgtgaaggagttacagagagctggagagcaagagagttcaggctctagaacccccttcctctttctctcctctacaagctcaagtattttcagagtcgtctcccctcctctctcttgcttcggtgggcaaggtcctccttttatatctcaaggggatcccacatgcaccacttctacctactcttcttttgggtggggacccaccctatcctgaccaaaacttggctcgcgtcttcgcctggaagctaaatcacagcttgtccttgagtgaggcccagcgccgtcactcgcctgacacaggggatacccctgtcatttcttcattaatgggtggagatttgcaatggatgctgtccgaatgaccctccgat

SEQ ID NO: 69061 - DNA, 4838 bp, Oryza sativa
ttagcatgccgcacgtctgcccttcttcatacaatgacttcctcgccatggttgcgatgaagcctggaatgaatctggccgggactgacataccaactctaggagttagcacgccggctccggctagggacgagtgcctggaggctctcattattccgacgggacggggcgaggcgtgtgacaggccgcctgttgccacctaacccgcaatctaaccggtctgtgaccggtcacacactgcgaccggtcacggaccggataagcgtgcgatgcgctgcattgaatgcggcgtggtgcgctcgtctaacccgctataaatgcggttaggtgagcgccgctgtgctcacctaacccatacacgtggcgccaacaccacaggaggtcggggcgccccagccctcggggccgaaacgggagcggcccgacccctcgaggagacagagggaggggtggccacgtcatcctcgggcccgacccccccgagggggtcaggccacgtggatgaccgcggctgcccaagcctctagtcacgatacccccggtcccatgtcaccgacaaacacctaattaaatattagcttaaacttaaaaaataaattaatataaattttacaggaacattttttatagaaaaatatttgcaaacacacactatttattagttcggaaaccgtacgcaaaagaaaggagcgagtgaaggttaggaccacagacttattctacgcttttaaaaggcatcttctatctttttatttttgcttgcttctgaagagggggaatttctagaactgttcggctgcactcattcaacgaagctgcaacacagtggttgcaccttgcagccgaacaggccctctaattatatataataagcttgtaaacttctcaaatacagccatacacaactactcaagccgagagagaatccaaaaattgctcaaatttgaaaattttggtcgtcagccatcaggctcgagccagactgcgaccctaagccgacctattagagcatctctaatagtctctccatcctactctctaagataaattttagccattctagccaaaaaaacgtgctccaacagcctctccaaccggatggctaagccatatggctggctaaaacccttcctccactagccaaatttggccactctatttggctggccaatggtgggccctacgtggctaatcaactccatccccacgcggcaacagagagacacgggaggagcacgacgacgagcacgctaccgacggcctccgctcgccaccgcaccaaacccgcacggcactgcccgccgcctccgctcgccgcgtctgccggcctccgcgcgatgaggctcggcgccgccgccgctcgctgttctccgccagtccgcagtagtccagtaggaggaagggaggaagaagtagtagtagaaaatgggttggaagaggaggaagaagagtaggagagactgacatatgggtcccatttgtaatggacttgtaatagagagggtagatgaagaggctgttgaagtaaacaaatagtattactagccaaatcagattgagagttggctatagaaatgtttagagaggctgttagagatgctcttatgccgcaaccgcaccaagccgcaaacgctccggttgagttggactcgtccgagccggatctgataacccacccgcgactcctaccccattcgagcaccacccgccccgccaccgcctccaatctaaaaccctagatctctctctctccccacttctctctcttctccccccgagtcttcctcacccgccgccgccgccgccgccggaggaggaggaggaggaggattccggtgcggccatgtacctctacagcctgacgctgcagcgggcgacgggcgcggtgtgcgccgtcatcggcagcttcagcgggcgcgactcgaagaagtcggcggcgtccgggtcgtcgtcgtcgtcgtcgtccacgcaggagatcgccgtggcccgtggcaccactctcgagctcctccgccccgacccggagaccggccgcctccgcacgctcctctccgtcgacgtcttcggcgccatccgctcgctcgcccagttccgcctcaccggcgccaccaaggactacctcgtcgtcggctccgactccggccgcctcgtcatcctcgagtactcccccgaccgcaaccgcctcgacaaggtccaccaggagaccttcggcaagtccggctgccgccgcatcgtccccggccagctcctcgccgtcgaccccaagggccgcgccctctgcatcgccgccctcgagaagcagaagctcgtctacgtcctcaaccgtgacgccgccgcgcgcctcaccatctcgtctcctctcgaggcgcacaagtccaacacgctcaccttctccctcactgccctcgactgcgggttcgacaaccctgtcttcgccgccattgagcttgagtacgccgagtccgaccgcgaccccaccgggcaggctgccgagcaggcgcagaagcacctcacattctatgagctagacctggggctcaatcatgtctcgcgcaaggcctccgagccgatagataacggtgctaatctactggtgactgtgcctggtggtggtgatgggccaagcgggctcctcgtgtgctgcgacaactttgtgctttaccggaaccaggggcacccggaagtgcgggctgtcattccacgccgcgctgatctcccggctgagcggggtgtcctcatagtcgcagccgccacgcacaggcagaagagcttgttcttcttcttactacagactgagtacggcgatatcttcaaggttgacctcgaacacagtaatgacactgttactgagctcaggatcaagtactttgacaccatacctgtgacatctgctatctgtgtgctgcgctcaggttttctctttgctgcttctgagtttggcaaccatgcactttatcagttccgtgatattgggcgggatgtggatgttgagtcgtcttcagctacactgatggagacagatgaggggttccagcccgtattctttcagccaagagcactcaagaacctgtaccggatcgatgaaattgaaagtctcatgccaatcatggacatgcgtgttgcaaatctatttgatgaggaaacaccacaggtattcacagcctgcggccgtggtcctcggtccaccttgcgcatcctgaggcctgggcttgccattagtgagatggctcgatcgatgttgccggctgagcctattgctgtctggactgtaaagaagaatatcaatgacatgtttgatgcctacattgtcgtgtcctttgccaatgttacacttgtgctctccatcggtgagactattgaggaagtcagcgacagccagtttctggataccactcactccctggcagtttctctccttggcgaggactctctcatgcaggtccacccgaacggcatcaggcacatcagggaagatggccgtgtgaatgagtggaggacacctgggaagaaaactatcactaaggttggatcaaaccggctccaggtggtaatcgccctcagtggtggagagcttatctactttgagatggacatgacaggtcagcttatggaagtcgagaagcaggacatgtctggtgatgttgcatgcctggccattgcgccagttccagaggggagacagaggtcccgattccttgcagttggttcctttgataacaccatccgaatactctccgtggaccctgatgactgcttgcagcctctgagtgtccaaagtgtctcttcagccccagagtccctcatgtttctagaagttcaggcatcagttggcggtgaggacggtgcggaccatccagccaaccttttcctcaatgctggcctgcaaaatggtgtcctgttccgcaccaatgttgacatggtcactggtcagttatctgacacacgatctcggttccttggcctgagacctccaaaactgtttccgtgcatagttagccaccggcaagcaatgctttgcctgtccagccgtccctggcttggctacatacatcaaggtcacttcctattgactccactgtcctgtgatacacttgaatctgctgcatccttctcttctgatcagtgctcagaaggtgttgttgccgttgctggtgatgccctacgaattttcaccattgaacacctgggggagactttcaatgaaacagccatccctctgcgctacaccccaagaaaatttgtgattcttccaaaaaagaaataccttgctgtcattgagagtgataaaggtgcgctcagcgcagaagagcgagaagcggctaagaaggagtgccttgaggctgctggtgttacagaaaatggtaatgcaaataatggggatcagatggagaatggtgatggtcaagaagatggtgctgaggacagaaacacacttccagatgaacagtatggttatccaaaggcggaatcagaaaggtgggtttcttgcatcaggattcttgatccaaagagcagagacacgacttgtctgcttgaattgcaagacaatgaagcagctgttagcatttgcactgtgaactttcatgataaggagcatggtactctcttggctgttggtactgccaagggattgcaattctggccaaagaggaacctttcagctgggttcatccacatatacaagtttgtagatgaagggaggtcacttgaactgcttcacaagacacaggtggaggaagtacctcttgccttgtgccagttccaaggacggttgcttgctggtgttggttcagtcctcaggttatatgatcttgggaagaggaagttgctcaggaagt

SEQ ID NO: 69062 - DNA, 1980 bp, Oryza sativa
tgatattgatctaaccataggctacagacatgtttttggtgtctacactgggtgagaaggaaattttaaattttattagttactcacatttactggttcagattgaaatatgtggtttgagagcaagtaataggagacaaattacccagcatattttctagatcatgttttcatcatccatctccttttttctttgtttcatcttaaagttttttgtggatatatgaaatttagatatttttgcctgtcctatgaatagtactccaaaataacaataataatgggttttacagttagattgtcccttccaaaataacaacaataatgggttttacctacttctggttgaaacatctctaatttatgaattctctgacagttatgttgcagtttcatatttttaaatatagtatagtatacatataatattcaccatatttcatataccttttttgtttgacaaatttctaacatttctttgtggtgccatctcctgcagtcatttcattattgcaagtacagaagggatgaaaaccaactgtacatcttcgctgatgatagtgttcccaggtggctcacagcagcaaatcacatagattttgatactatggcaggggcagataagtttgggaacatatattttgctcgccttcctcaggatctctcagatgagattgaagaagacccaactggggggaagattaaatgggagcaagggaagttgaatggggccccaaacaaagtagaggagattgttcagtttcatgttggtgatgttgtcacatgtttgcagaaagcctctttaataccgggaggcggcgaatgtcttatttatgggactgtgatgggcagtgttggggcactgcttgcattcacctccagggaagatgttgacttcttttctcacttggagatgcatctccgccaggagcatccaccattatgtggaagagatcacatggcctacagatctgcttattttccagtgaaggtgatatattattttttttgtttagattagctagtatgtcaaccaacacagatattatcacaaatgcatatatttataacttttttaccactttgtcggatagaatatccaggtgtaaaggcagttggcagtatctgttttatgtttgatgatggagtttcgttttggtttgtttcaggatgtgattgatggtgacctctgtgagcagtttccatccctcccagctgatatgcaaaggaagattgccgatgaactcgacagaactcctggtgaaatcctgaagaagctggaggacattaggaacaaaattatctgaaagatcattgcgcatagcgaaagaactagacaaactgttgggctctcaatggctgtaaaaacagaatctcctttcctgtccgagacctagcagcttcagatccgtggcacattcaagaaataagaaaacactagggccaatcgagtggagaggtggtaaagtccttaatggtctgatttgtagaattcttggtgctaatgacctggtgtctggaattcgttgttaatggtctgatttgtatatttcttagttaacaatggctaagttgacctttcagatcgaagcgagaataggtcacataactgcatcagcatcagagtgttcttctgtaactcttagagcatgctttagcctttgtgttagtatttgctgtgatgtagttggacaagttctttgttttgatggttgactcatctgtaggctgctgctactttcatgatgtacgatagaaccttttcattttttcaggtgatactgaagcagatgtattggtgctatccaatttgattttcctgtgataatattacacttttgatgatgaaatattctactgctagtagttcaatggcatataaacaatttcatccatagattttattggctggtaaaccatatataagtgcgtctatgtacgaaaagcttaaccccccctattttcaccaatgggaacggg

SEQ ID NO: 69063 - DNA, 818 bp, Oryza sativa
ttgtgctcatgcttttaggactgattgccttactttgtagtcttctatatccgtgctgtaggaattctagcatagaatgctaacagcaaccagcgactgccaaatatgtttgaaatttactaccccccttccactagactgtagttatatccatatgacagttggagcatgctctccaagctttctgttgttttgaactgaatatattacaggagtgagaaactaatgctgacctggtgtcaaacaggcgctctgtatactttgacttttttattgattgtccatttccacatgtgcttacttttatttgtccatacaggttcaatgtctaacggttaccagcatctaactaccagtgttccattaaattcaaccacaagcagcatcccatctacgatgggtcctgtgggtattcagcggcaagtgactcatatgatccccactccaggatttaataatcaacagaatgtgcctgtgaatcctgatttttcaaatggagctggatatttcaatggtgagccaactgtgacatcacaaatgcaacagcagaagcaatttcctagcaaccaaaacagtcatcaaatccagcatattggggggcacagtaattctggaatgcattcaaacatgctggagaattcttctgcatatggtttatcagatggacatgtgaatggtggaatgggtgtacatgggtcaaacatgcagctaacaaacagaagtgctgcatcagaagcatacattaacatatccacatatggaaattcacctaagcctgtgcaacaacaattcaaccagcaccctccacagaggatacc

SEQ ID NO: 69064 - DNA, 1997 bp, Oryza sativa
tcggttggcttggatttcttcttcttggcctttttcttcggagccaaagccgatgtatcaacagccgatgctttagtctgtctctttttactagcatcagctggttctcttagttgcccttgaagcagacttgaggtcctgggggcatgatagccgatgaccatgggagatggtccacctctgtttggaataaggccagaagcatactcgatgtccttaccgctgttgcttttgcgaggaggggaagattctgttgtctgcaagacagaagaagagattagccaaaatatagatcggttgacaattattttacaggattgacaaagtaaggattttacctgagggatgacatctggaaagaggtctgtcatgtacatggaagccaattggtggaacagatgcagcttccattcaccccaccatctgtcaaatgccttgctcctgaaccttgccagctctatattttcgatgctgcctagtggaggtcctgggatgttaagcagccgatccatcattaaggctgaagttatatcacctcggcactggattttgtctacaaagtacaagccgatcggcatttgtcccattccaaattgcctagcagaactcattgggtgataaaattcgtatgaggtttgaatgtttctgccctggtggatgacgactagaaggatgcatgggctgacggcagtgacgaaaatgccctagattgatcatatttctcagaatgataacctaaaatctaaagtccgatggcagctcaaaatccatcgagtacagcataagggaaccagactcgagcatctctaagaaataccatcgtagaagctgaagaaccagtccttcagaaattcagttgatagctttgctcctgcatcagctggtgtgaatgcatattctccataagacatgcacctacggtgggttcgctctaccccatcatcatctgtaatcgactctaatctggggaactcagcttctgccacagatggccaattaacagctttcatggctactaaattcagccaagtttgtagcagccaccatggaccacctgctccaaccactgagccgacagctatcttggctgatgcattgttcaacatttggtacagatagccgaggaggattttgcccaaggggaattgtctctttatttctagggcttcggctagaaattgccagttagttgtagggccgcagcttgatccacaaaagagaaatttctccagccacatcagcagaaaggctacatgctctcggggagtgacatgtcctttgcccatatatgctacaatataccctaaccagcctccaatactcttggtcttgaattcaaaggtatttttggtgttcaagctcatggtattagccgatgaagtcacatccaagccagtaatcattgtgatatttagcaaagttggtgtcattggcccttggttgaagaggaaagcattaagggcattcgaccaaaaatatgttgcagcggctatcaagggctcatccttagtcgaatttgctatggtaagggctagtgcttggccgattccaatttcatcccagtgggcttgtttgctagccgatacccactattaccacacagaccagtttttctcgggagaagttttctcaagagcaggccaagacttgaaggtattcttccaatgacctagattcgggttggccaatctaaaaggaatcctattggtttcagctatgataaactcagtagggtcagggttgccaatcggaccaaggaaatagtgatgctcatgagacaaacttggaatcgcgactagattggacaagtgctacagatgtaaacaaggatagagaagaagaaaacaaggtgaggcaaggaagaaacaatctattgcgaaaaaagaggatctagccagtgagcacgtacctctgcgtactcggccgatggcgcggcagacgggctggcggaagtcgacatcgccgcgagcggaagcttggccaggagaagatcgcct

SEQ ID NO: 69065 - DNA, 713 bp, Oryza sativa
cttatattatataggatatctaccactctatgaagcttccaatagtttgattgtctagatattgtcttttttttcatacttatggctgcatcagttgagtttgacctcataagtcgtgtttagaactatagtctctagcctgcttcttggttgctgattagagtagcatcggggtttcagccgatcttacctgatttagctttatgtcttatatgctcaattgttatgctaaatctgccttttatgttaagatcctattgcatttaggtgtattaagctctatgtttgatatattttactttctttaatatcttaatatagagtggtatcggagtattagccgatacacgctatatctatctgatgagcatcggtggccacctgtatgacgcactgccatcgatgtccgcaaccatggccggccatcttcgccaccaaccaccgccccaaaccctagttctatgtaatattgtcatcgagtaaattgtttactcacaccatcaagccccaaaccctagttctatgtaatattgtcatcgagtaaattgtttactcacaccatcatgccgtgtaggcttgtttgtaaaagaattactattctcgtattgccttacaggaaaacatttactatgcaataataagtgtccgtggaaaaattctaatggctggatacatggcaatacaaaatttactaacaatatatggaactaatc

SEQ ID NO: 69066 - DNA, 717 bp, Oryza sativa
tttgtcctgttgatataaaagtattgttactctctcaaatcataagtaccaattgtatatgaccatccccagttctactcatttacaattatatccaacaaggtagtgcatgataaaacgggaggaactctacaatacatccatgtgaacataccaatatagtaatatacaactcctctatgttaggatgcatatataaagatcactactactaataaacatatatacacaacaaccaccattgattcatgccatgtgctacacgcatctggtgcggcaatcttaaagatatccaaatcggcgtccctctctccatacctgaaaacgtttgctttaagtgctttctaagaaataaccgaaaagcttccctctaaagtctttatttaatccttagcaaattacctcgaaacacagggtgctagctgcaaaagagacgtaaaaacagggagatcagagagggctaggctttgaaccggaggcggcctcgcggcggagagccacgaacccacgagcgacgcgccacccgccgccgggctcgcgacgtgtcgcccatcgagccgtccacctggcgcatcgtacggctcgtacgtatcctctcgaggcgcccgcggtcactgacacgtgggcctgatgcgtaagggggctgaggcggcggcggccacgtaggaggtatcctctgtacggaaggagcccagccaggacgtactcccaccgtcc

SEQ ID NO: 69067 - DNA, 5519 bp, Oryza sativa
gtggatcccccaatgatgcaaaactgaaaaacagtaccaagcattgtaacttggaaaaattgagacagtggaaaaaaaaaaccatcattattaccttatagtctggtctgtgtgaatacccacaagcaggaaatctccaagctctcgagcgaggcgcaatatctaagtagaagaaactataaatacacaggaagtccaaatcactatgtcttagagagatcatttcagtttgcacccttgcaataagaaaaagaaaaggaaaaggaaaaccacaggtaaaaccatacaaccaacaaatgcatagccaagttgctctacatgctgagacagacatttgacattgcgtttacctcaacatgtccagcatggaatagatcaaatgcaccatctatgtacactatccgagaatctggacctggaccctgcataggtaaagctgacagtcaacagaaagaataagtggccgtactcagcaagtagttttatctagtgaatagtatcaaatgtaaacagcttgaaataaatgataaacgactaatgcaatgattaattaatagttgagcttagcagcatgttagttcttgttggaagttcaaggatataacttatattctttactaatataacctcagaacaaatctaagttgtgaaataatccatttgtcgtcaggtcattcaactcaatgtttactagataaagaatgcaaccaaacaacaaatgtctttcaaatggcaaaagtattagtaaaatggtaacaggatcctgaaagccaaataactcgcgctctactgtttaaaggcaaaaaaaaaaaacatctatgaggcatttttatgctgtcaatgtttaattcatgccttcaaaaaatatgatatctcaaaaaaaatgacattcaaagttttacatgagcagttcagaaaatgatcctctgtgaaagaatgtaaagagctgtaccctgctatttgagaactgaactattctccgagatgtaggaagaaaatgagatatcctagttccacttccagatccactatcatcaattttctggccatgcccgtgactgaactgcctttgtagtgaagagtggttgtgactatcagaagctgatctctctctaacacaaagaagcattcttcctgtagtttatttactagaaagatgagctgggcagttagcatgaaaataaaacctattcatgaccataagcaatttattgatacagaagggaattatgtagttaattgtctggagagcttaatagcttatcagttcatcatataataataaagcaatagtttgaatgttttcctaaagtaccacttcaggacaaatcaggtgggcactgatcttgtctacaaacaattatttggttgacctagaaataattgtaatgttggaaattgctatggtattgagccaaagaaataacttgtaaagttgtagtacataacaagaaccatatattcccttgcgatggaagttttaggttaaatttcactatgagtaaaaactttaatgattaaaacagaaaagaacagaatcagtaccaacaatgtctgtcgttgacactccttcggttcttttaatctgtttaaatcgaccaacctttttggcaagagcatatgcatcagtaccatctgggagcagacaaggatcatcgccatggatgatataatctatattatactcattgaataatttattcatgaaatcctcagttatggcgtaaggtgcatctggaataacatcgtgtacccattttacagcacggaccattatcaacctgtatatcagaaaaagaaacataaaaaaatcattcaagacaaaatggttttttttgaagtggaaaatatgggtatatgataatacataatacaatcaaagaaacaaaactgcaagtctaaaagaacaaaaatgcctaaaattccatatgacatggggtcacacgtaaaattggtaacacaactaaaaatagaaagaaaaaaaaaacaatatgtgcagtaactcctaaactggaaaaccagacacaatgaaagtcagtaaacaacaaaagaaaaccagcaaaaataacaaatttatagtgttgctaaaccaccatgatgatgattaaatgaggaaaaaaaggttgcagcacctaacatctaaaatgccacacataccatgtcatatgtgagcagcttgtgattatcaacaagacaaaggaaagcaaggaatcacttagcaggtacttaaggcaaactgagcagaaccaaacctgcaagtctagtatggtttatcgttaggaattaataagttttttggatttgtttgaatgtacagaccaaaaattcattgtttagtactttcagcagagcaaacctttttttttctgagtttctccttcaggcacccaaaagaaatagagctaatctttttcgttactgctcagatattgaatccgtactcaaatgaattagagaaacataagcagctcatccaccaccaaagttatcagaaacttggtccgacgactaactacaacccacatgtcacaacatttcccttagcaatttcaagtttccagatagaattactggactagtgctcgaattaagaccgacagacacatatatgatgtgtggggggaaaacgtcgcagcttcaaaaactaatctaaggatatccttataaaagtgctccactagtaacttgtattgtgcaacagtacattgaacgcaactaaagagtcgaaactgaaacaaatcagtgtgcgatacaaattaagttatgaaatagtaaaagcagtaacatattccccatgattaggacagaatcagtgtgcagctgaaattgaaacagaagataggaagtttgatgcaacagcttctcgactaaaccattaacccaagtaaaagatcgcccataaggaacaacccacaacagttacccctaagaacttgaaatgcccacagaacactgcaagatatgtagaggaaaattcactacctataggctgatttgcctaaatcattattaaagcacacaaccagtatcaggtaacagtttggtaggattacatcgtgcatcattcaagaattttttttaaaaagagaatgacaaagggtttggagtgaacctctcgtggaggggcgtgaccggcgggcccttgttggcggtgatctcgtggtcgctgacaacgccgacgatgagctcgtccccgagggcgcgcgcctggcgcagcgcgttgcagtggccgtagtgcatcatgtcgaagcagccatccatgtagacgcgcacggggcgccgtcgtccgcggcggaaccggcggcggagcgcgtcgacgggcggcagggcgggaatggcgacggggccggcgaggtggagcgcgaccacggatgcccccagcacgatcccgccgatgacgcacgccgccaccagcttggcgctgctgctccccgcccccgcctccataatgaattgggagattggacagtgcgagagagacacaacaggaaggaagagggagattggtcgtgcgcgagagggcgtgggaggagggatctagggttagggattggggcgcgtgggtggaggaggtatcgccattcgaggtgaggggagggcgcgacgcgaggagatcagggtgggagatgcgggagaagagaagcctctggttctctctcttgtctctccgagctccgcgagagagatgagggggattcgctgccacgtgggaccaatgagtcaatcagcgtggtcccacatggcggtgtgacgtggcatagcagaagaagaagttgccaggtttggcccacgcgtcagggagggagctgttgtctgtactctgtactaatccacgtatggcgtcgaaaataaaaacgacaataacaacacactaacacgacattagcatgaggatgggggtttatggattggttcagctaaccgcccgaccgaccaaatgatgttgtgctttttcgtgttgaaggatgattaattaactcgatggcaggaaattctaaccaatgtgctgtgtagctaagatcatcggatggaacttttgttgattgattaggacgttggatatgctgcccatatgctgcttcagttgcagccagcatcagatgcgagccccatacactcaggtggagcacctcaaatgtgaagatgaagctgaaaatgacatttttggtacgtgtttggttctgtttctagcttaaggccctctttatttaggcttaggtttattggcctagacttttaagtcagcttattggtttatatgatttataagccggtggatttaatgtcctaagtttagtagttgagtcatacatctacctcacataagccaaaaaagcttctccaacctagcttttggcttaatagtattagagtggcttatggtttcaaaaaagctaaacggaaaagctgcttgtttgtttaggcttagacttttcgacttataagttagcttataagcctaaacagagaggcctaaagatactactactgtctattgttgatattgaatacggagtactagcatttcttgccttcgtgatggtggtgtatgcaaaaggaaacttgatctgaatgacccaatgaaacaagtaacatagtcagcactcagcacaatgactaaggttttcctcttcttctttttttccttgttacccgggacaagtatgagtgacagtgtgacgctgacaccaattccagcaagtggtcaaagaataatagcaaaaatatctcaactatacagaaaactacgaatgaaactggaaactaatttttcaacacaaaattaataagactttggaagccagtccaatcggggcattttgtgtggttgttactgaacctctgcttcttcctcttccctcattcacaggcatagggtttcgatttcaactcatttatggggtaccaggcaaaaaaaaaatcgtgcgtttaggaagcaaggtaacagaaaagaacaaattataaaaggaagggtttttttctacaacaaactgaatttacaacatgttatttccgagtacactacacaaacaggatgtcagcaaaatacaaacaaatccctccaaactgtgattaaagcgccatctctgcttgaagtttggtcagttcagccaaatcattggctggttgagatgaagttgtaactctcgctgatggttccatgcgtgtactctgaggtggttcaggcagctcatggtcgagctcttcctcctccagatcttccagctctgcttctagttcatccttcaaaatagaaaatatgagagtcaaacatcttcggaaaattggcatcgtgtgcaattatgtattttgtgtcttggtggcatgcctatttcgagttagataataccatcttgcacacgttttaattgacgccagaggggaaagagatagatgaacagtacctcgtcgaaatcagcagaagcgccaattggtgttgcaagtgcctcctgtatctgcctcatattttctgtgtgttcatttgcctcttcaatggcattttcaatgtcatcaatact

SEQ ID NO: 69068 - DNA, 1437 bp, Oryza sativa
  unsure (1)..(1437): unsure at all n locations
gcaatcagagacttacactgactgatgaatagctttgacagcagatgatccagagcgcaaagcatcaacggtatctgtggttgcctttgcgctctcaagcattattatctaccaaaacaaacaatttcctgtcaatttgaatttataacaaccttctggaatatcagaatgcttcaaaagtcaagattgaatatgcgcccatatatctcatcacctgatcatgaactcgcaattggaaatttgctagctgctcaatttgtgtttcatacagcttctttttctttagacactgaattgcagctgcaacaaacaggtactctctcatatagtttatagaagtgtcacaagcttgagaaatatttttctcatcattaaggaaccattaccataggtacacatgcaagattactgacccacagtttttctactctgtatcatacatgagttgatgtgcaagattactgacccacatattttctactctttatcatacatgagttgatgggtaatgtaagacatgaccaggaagcttgtatttggccataacaaaacagggtaactgctattgttctttacaggcttcttaatctcctagttgcaaagttcttcaagtattaatgcataacaaacaaacatcttcaacaagtttatgtattatatacatttacataaaaaatgtgatataagtgtaaatgtttcttaacaaacaaaaaaatttcttgaaagaaatgcttaccgcttttgttcttagcttttgtataatccttagccttttcaacttctgcagaagccttcttctgaagaaagcactctttcttctccagcatttctagagtctgcacatgcaaattgtattaaaattaggccgcagtgaatggtacatataagataaaaaaaatcagttctatttataactggagcaattatctcgttagtatcagctgaaagctccttagaatataagagatttccatcttctttagctaaactaaggctctcttcaacattatacatcatttttgttgtgatactatatgcagcaatagcaaaccgaaggcataaatattgataccacttcagcagggactaggctggaacaatagcgatcaccctaatatgaagtttgtttttccttttcataaggcaatgatttttttcctcaaacatactttactattttttttaaagttattatatgtctactgagaggtagactgaacttcatagtgataaagactaagaacaagagtacatcagaagtgtcaccatcaacaatgtagcttatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 69069 - DNA, 1187 bp, Oryza sativa
aataacaaaagattcctttatgctattacaaaggtgcactgtagaaaatttccatgggagattaacatttccaatatcaaatgagctaagaaagataaaatttaaattcaaatagctctgagaccaatacattcaaaagcccaagagaatacctgctgctgtgcagattttcgatggagcatgtggcttccaaagtcataaaaataaaatgatccaagtttcatagcatatacaggtttacaccacctagagaacacaaaatccaactttcaaggtttataagaaaaacagagtgagaccattgcatgggacccttaatctgttccttcttagctttgatctgttagttcttgtgacattgacaagaagaataagataacagtaaagcgaaacgaagaaatatgcactgacaattaactgaccatttgaccactctagatggtcatcatcccagaagccagaacccttagaaagaaaggaaaaaaacagggagaaaacgaagaactttcatgtcgagcccatatagtttggtagttttgtccacccatcttcaaaaaaaaaaaagtactgacaattggttgatagcaagaagatacaacatttcgtggtttctcgttacatgcatatcctctctcttgtaatacacaattttttttgcaatggcacatcaaaatgaaacaaatatgggttatgagtttatgacagtacaaatgtacaattactgtcagactgcctttaaaaacaaatcaaccatacagccatacaggggagagatgtcttagcataatttcctcacttacctttacctaaatcacataacagaagaattgactcagtgggcagacccatatgtttactatcaacacagcagcgacatctcttccgagttcttcctacatttttattccttgaccacatttgactcagtgggtagatccatatgtatagagttgcattccggccatataagctaggttaatggttccttagcatgcttgctaaacatataattggattattcaaacatctgtcttataggatctttttttttttgccattggtcaatgacatgaaacctgtatattgatttgttactataagtacaaaaaaaggatggacaatttacatgtctctcattcttctcaaataatgaccaggcggtgctattgcatctcttatttctctac

SEQ ID NO: 69070 - DNA, 1816 bp, Oryza sativa
tgaagcaagctctctttgattgcctctttcccttgtcatcatccttcctccctttgccatagccactcttgcgaagaaagtgcttgaatctcttgacaataaaagccatttcttcatcttcactttcttcacaacttgactcttcttcttattttgccttcaaagctacttcttgatttttgatcatggcggcattcttcaccatttgcctcacttcacgagcttccacttcttgcatctcatgagacacaattcttccaagaatgtcacttggggtgagcctcttgaaatctttcctttcccgtatcattgatacaagagtgggatttcttggaccaaaagcacggagaaatctcttgaccacaaagtgatttgtcatgtcctcactcccaagtcctttaatcttgttgacaaggatcatcatcctatcatacatctcttgtggtgtctccttgtcatccattacaaatcttccaagccttccttacaataattcaatcttggcctcacgaacggcgggtgatccctcatgagccaattgcaaagtatcccatatctccttggcctcctcaagaccatcaaacttgttgaactcctccggactcaaggcggagagaattgcattggaagcttgagcattgcggtggatgagctgctcttgctccgaagtgagctccatgtcatcatggggtacatcaacacctgtacaaacaattttccaaatacttggatgcaaagagattagatgcaacttcatcttgtgcttccaagcggcgtaatgtgtcccatcaaattgaggagcacgcccggaaggcacggagacaaagttgtgagggggaatggtaagtttgctgtaatcaaaaggtatagtagctcccttggataatgaagttcccttgctgctcgctccatcttcatttccattttccccgttctttccccctaaatccgacatcgtggattactcaaagcggcgaagcttgaatcaagagcaccttgctctgataccaattgaacgcgttgatgaagactagagggggggtgaataggttgtccctaaaaacttaaaaacaaatcaccgcggtaaagtccaaacagaccaggaacttcctggtaaggaactccagaacttccagcctgccaggcccggaacttggacagatggagtattgcaaaaaaggactccaagggaaacttgacacttggttcacactaagagcacttgatatatcttagagcatcacctggaacccctcttaaatagtacggtttttcctaaaaacttgatttcaaaagataaactatcctatgcacttctcgagttccggtccgctttgattttgtactttttggggggtctccaagcatccatcttccacaccttggactaatgcacctgaaagctactcaatgagctcattagtcccttaaccacatttgtcattaatcaccaaaacccactaggaggattaatgcactttcaatctccccctttttggtgattgatgacaacatggttaaaggttacaaaagattgataagaattttgatttgaatggttagaggtgaatgaaactcccccttaatgtatgcatatgaaagatatgagtggagctcatatgcatatatatatgggagcaaccgaggagagtttccttcctccctactcattcatgggatgcgaaaagcagtaagaatagatattatatacaaaagatacgacacggtgagcactcaaaaagataaaatcaacatcacatcacaaacaacaaataagacactcatagcataaatgaagagcagaataaataaaggg

SEQ ID NO: 69071 - DNA, 1170 bp, Oryza sativa
tttctactttattttatcatccagcgggacttggcacctgacgcggggctgcatcggtcttcgatctccggagaagggataagtccaatgtttcgtcggcccaggcaattgtctcatctacgtcggcattgttcaaggctgcatcagtacattcgacctcttggattgctctggtttggatgatatatttgcctacctatttatcatatgtctctattaatctagtcttagcatatcaatttagctctatcggctgcttctcgttttagggtttctgccggtatcggctaaatcgcgttgctagattagattaacttagacatctaccactctgaagactcagtcaacggcttgattgtctagatattatgtttcttttcatacttagttctgcatcagttaagtttgatctactaagtcgtgcttagaaccataatctctagcctgcttcttgattgccaataagggtttcatcggggtttcagccggtgagttatctggacgttgcatcggctcataaggattgcatatataagttggatttagcttatgacaacaaaggcttcactgtttaatctaatcttgtggatttcatgacatcggacctccagccgatgtgtgctttaaccttcggatcgatgcttatttgtcatatcattgctagccgattggtttatacaggattatattgttattgtattacatcatcatcagccgattgcctttatatcattatctacattggacatatagccgattgcttaaaccctatcgctatcggctggtatcagcatcggctattatcggctatcggctggaaatactccatcggcttgtcagccgatcggttgttttgtctactatttgcatatcttgtcagttgcaggatcaaactgactggcacgcccacatctcattaagatttggacctgcacaggagctaagcagatctcccaagccggtgtgttcgattttttcgtcaacaccagccaatcatgcattaacccaaacacttgaataatatttcttaaagtacttgccattgagcgcccgtccataaaattctccatcaagtccttgcaacatataggctcctttagacacaaccttatggatgtgaaactgtccttcccaatttggtgaccacttgccgaatttattatcacgagt

SEQ ID NO: 69072 - DNA, 751 bp, Oryza sativa
atacaatatgtttttacgggaatccagatactatacagaatggccatttgtgcttgggcccaggagtaatctgaaccaaacgggccaactccaacgatacgagtgggccctttccttctttcaacccacggaaaccggaaccccaccatctggccatctccaactccaatcaggcgtccaaatgcaaaaatccgttaccaaaattatggaaagcctccttccccacgccggctcattctaacaggctgcgttacccactcaccagtcggtatgccgtatgccaatcgggctgcgccctgactgcttacgacgatactatgacaaaataaaagcgaaaatgattatccagtcggttgcgttgcattccattccgtgtcggacacgatgagtttgccctgcgttcgcagcgatcgccctggactccgatcaggtctcgaggcgcatacgcattcgcgcctataaatccagggcatatgcgccatccaaacccccttccatattgagttcccgagggagaattcgatcgaagaatacgagcaaattaaaatcgatcgcgatacttcggtgttgacgaaacagcgtgatctctctgccccgcaatatgccgccggctgctgcgggctactccgccggcatgaagcggcctctcgccgcggtggcgccgtcgtgcgacgtcgacgggcgcaatgccgctgccgctgccgctgcgaaacggcgggaacgacgacgggaggccaagcgggcgcgcgcg

SEQ ID NO: 69073 - DNA, 972 bp, Oryza sativa
atatgtaattatcatttattttgttatacttttccattaaatttcctacaaacgctctcacgtcaccatgtgtcactctacaaacgcttctacgttgctaagtagcgctataataaattaaataaaataatataaattcttagttaaaataaaacatttaattctcgattttcacttaaagctaagagaccattattttagacaattaaattattatatctataaaaaataatctctccctcctaatatcccgttcaaattattaaatctataaaaaataatctctcgctcccaatatcctattcacatagcctagtggttacaagagcttcagtagcacctgaggtcctgggttcgactccccgtgggagcgaattttccaggatttaacggcgttgtgcttttagtggtaggcgacgtacccgtcgacagcgagacgcctacggtgacttcatcaatctctccaggatttgccggcccagtcttcgaagatgctcataggagtagggtttgcgtgcgtgcgttcataggggtgagtgcgcgtgcgttgtgagtgtctgtgttgtactgtgtaattctcaaaaaaaaaaaatcctattcacatacaagagaaaatcgttgcgtacaattcatctggttaaaaaaaaatcctattcacatacaagagaaaatcgttgcgtacaattcatccgggaaaaaaaaaatcctattcacatacaagagaaaatcgttgcgtacaattcatccgggaaaaaaaggcaaaagctatacgtatgtacgaacgaaataaaaaccaaagatattgataactatgattgaaaaaaaatcactgccaagattaattataaaagcaccagcccaaacgatcagccaagataatcaccatcagctcacggcacaagcacgtatatgcattatctgctcttcttatttttaggttgttgagatatctacagcataataaaatctaaa

SEQ ID NO: 69074 - DNA, 1173 bp, Oryza sativa
attgacttaggagtgtcatccacgaggtacacagtgaaatcatcaccaaaagacttagccgtcctttgtctcttactccttcgaggagcttcactgacatcctcctcagagacaagttcatgtgtatgttcagtttgttctggtggtgtgattgaactgggaattatttcagagggttggttcgaaccactatgtgtatccttcattggaaaaaagctctcaaagaaggtagcatcacgagactccataattgtaccaacatgcatgtccggtacctcggatttaactattaaaaatctataggcaatgctatgatgagcatatcccagaaaaacacagtccacagtcttaggtccaagtttgcgcttcttcgttattggtacattgactttcgccaagcacccccatgtgcgcaaataagaaagtgatggttttctaccaatccatatctcatatggtgttttgtccttatttctgttaggaactctgtttaacacatgatttgaggtcaacaatgcctccctccaccatgccttaggcagtcccgcggtgtccaacatggcattcaccaagtcagtcagtgtgcggttcttcctttcagcaatcccattagactcgggagaatagggaggcgtcctctcatgtatgatgccatgttcctcacagaataagtcaaactcgttcgagaaaaactctccaccacgatcagacctaagcctttttatctttctgtcaagttgattttcaacttctgccttataaattttaaaatagtctagagcctcgtctttcgttttcaacaagtacacatagcaaaatctagtagcatcatcaatcaatgtcatgaaatatcgttttccacccttcgtcaacaccccattcatttcacaaagatctgaatgtaggagttctagtggtgccaagtttctctcctcggcagccttgtgaggcttgcgaggttgcttcgattgcacacaactatggcacttagaacctttgacaatggaaaacttaggaattaaacacatgctggaaagccgagacatcaagccaaaattaatatgacataaacgtgaatgccaaacattagcctcatcatccacactgccacaaatatggttcacagacttattgcagaaatcagaaagggaaaagcggaacaggcctccgcac

SEQ ID NO: 69075 - DNA, 1837 bp, Oryza sativa
aactatgagaagttgattaattaactaaaggaaaatagggtgtttgcacgtgtaatgctaacaatagcataactgttttgctttcataaaacaacgcatgtttttattacctgctaattgcatgagctgtagtgaattggtcaatctaccggtgtcagtgaactttcatcgatggtgtcattggctaaaaacaaatagcatcgtgtaggatttgcaaaagggcgtcggtgtcagctgacactggtaggaacaccgtagatccgcccctggtctcgactctccagcaatcagatgtgtctcgatcttgcatcctgcaaataccatgaagaaagggatgggtgagacaggctagatagatggccagttctggggagagccagcgtgtgcggctgagcactttactccttctcccccttcctccgttgccgccggcgtctatagtccctcgacatcgctcacggttcacctgacgagatcgatgtcgctccaccgatgaaaactcccctttctcccctgccacctgccaccatgggggctgcgacgagccgtcccctttctcatcaccgagatctgagtagttgagaataccagattgcagtagatgggaagcataaacctcggttgctcgggtgatgactgatgaattgtgggttcctcctggagttaaggaggtgatggggtagttggtgttggggcttattattaggggtgaaaacggagcggatattatccgatccgatccgctccgaatccgtccgatgtgaggatatggtaaggatttttagatattcggccggatgcagatgcggatgtggatatggtatcaacgatatccgacggatgcggattatccgatattttaatcggattatccgatgtactgtttggcggataatccgcaactttcaggccacacaacaactctatttagcccattttacatcggacggcccatctagcccatctagtgtaacctaatccaatcctcccctaaatctctctctctgtgactcatctcttagtcccttctcctgctcccacacgcgctgccgcatggcaccattaccataggtgcgccgcgccgccgttgcagcatgttggcgccaccgccgccgctcctccttctagtccgccgacagtgtgttgtgtgttgtgtgctgtaagcagtgtgctgtatggaactagtgtattgtgtgctgtatgcagtgtgctactgtgttgtgtggctgtgtgctgtatgcctagatagctgtatgcctcattgcctcatgcgtgtcgtattgatgagtgaactactgatctactgaactgaacactatatttttaaattttaagcaacacagtgaactgctgaactgaacacttatattatgtttttgatggatgtgttatattaagcaaaattatattattgatgtgttttggttggtttttcctagagagctgaaatcatgttcatatgttgttttgccatcgtattgcggctaattgtattgccgccctcttgttgtacggattgaatacaaacttaacatccgacaactttttgtccgtttccgaaccgagtccgcaccgactccgcaccgaatccgacgtccgaaataatccgctccgcatccgcatccgcacgtcatccgcacccgctccgcatccgcttaaaaaaaggtttaggatatggtatagctattatctgtccgaatccgctccgttttcacccctacttattatatcgtgagctgaaaatgtggagataaattagccggttcgttagatgtgaaattttggcggcagtatgggggatccactagttggtagagcgaaaaccaccgcggtggag

SEQ ID NO: 69076 - DNA, 2701 bp, Oryza sativa
aatgaagcttgtttgtggttcgcatattttggcttaaatttcattatcaaagtgccctctaaattctttagaaaattaataaaatgctgctgatacgaagttaattgtccatcccatatacaagcttgtttatttttctggttatttatgtacaagtagcctctatatgtttgtgcctagatagcgtcgtcagccgctgccattgctgtaaggaataactagatattctcactatgtgcctacttccattctccttcgtcatattacataaaaaaacgatatgtatactttttcgtaaaatttcattttccacacattataaatagcactgtatatgaaaatgtaataggctattatttgatatagaggggaagattttgtttcattaacatggattaaactaatttactgataaggtgcgtacaaaattgttaaaactttatagcattccaaataaaactactagtaataaaaaaagttatttctaattattctattccattatctaaaaaaaaataaaactactactaatttatttctttataggtccaccctgtcagatttccatcaatctagctctcttgtgcctgaaaaacagaaacgaactgattttgccgcgggtttgctccaaaattttgtgttcgtacgcttcctccctcaatttgccgggttttcttctccactctcggaagcagttatggtcctaacagagaacaaaacccatctcatctccttgactccttccctgtacataccgacccaatctctccagccttcgcagcttctccacagcggatggcggggcccgccgcggccgacggcacaatcccttgcagcccaggcgacgtcgccggtgcggcagtgcctcagccctggtcgctcgtccccagggcaagatcacccgcctcaacgcgcttctccacgccgtcatcgaggtcaactccgacgcgctccagcagccggcgcgcgccgacaccgcgagcgcgcctctagccaccgctactgcgggccgctccatggcgtccccatcctcaaggacaacatcgtgacgcgggaccggctgaaaacgacggccgggtcgttcgcgctgctcggcttcgtcgtctgtcgtgacgccagcgtgacggccggcctccgcgccgccgctgccaccatcctcggcaaggcaaactcctccaagtggtccaacttccgccccgtcccgaacggctggagccaagacgctggtaacacctatcaccaccctaagctgtcgtttttttctccagcatctcgtcttgtatgcaatgtgtttgtgaaattgtccataaagagccccatgttgtcaactgacgtgatccggtccagccgcgcggcgctggcatgagtgcatcatccgtgttgaacgggtggtccctggcggctttgcccgcgcgcatcccctatgttttcagtttcagcaccagcagcaaccacctcaccgtgatggattcactggctgaatttgttcctgccaatcaacgaccgcttatcatagtaagaacttgctgaatttgtttctgccaatcgatggcaggttacaatagttagcactctatttctttatgcacaccacgagttcgatactttgggccagtgcaaaatcgttggtcttattgtttcatattcttgtgaactgactcaccgctgtatacttttgtggatttaggcagctccagttagctactcacacgaaggtcatttgcatctactagaagctgcagcatggacgtgatatatatatttgcaagatctggtgagaacactatttaataatcccaaacaccatattagtgctggcagtgattgtcatactatgtgcacacgatctattagaatttgttgaacccaagctttggctatcttgctcatgccataattgtttggaatgtcagattacattaggaggtgatgaagtaagtgttccaaacgtgcaaatccatgtcatcatccaccagcactgccccctcactattaccattctctaccatatgtactagtaattattatagttatacagatgaagtaagatttcatgctggaactttcttaggaataatatgcaacttgtgacctgtttttgctagcattattgttgttttgaatgaagaattgatggttgcaattggccgatttctgctaaccagtgaatcagtaaggtatgaatggatgcaaattctgctaaacacatagctatttttattcaggatagagctgcgaactacgacatgaataatactcatatgtacatgaatgtacatgttaatacatacattaggataaatataataaataactagatgaatgggtagtgtgaactaacctagcaagttctgttttttaaatcgtttggtggaaaatctggcagtttttttatcaaaagatatgtgaaatgatgtagacactcccagtcttatatacagtcctcatcaaggttgttcatgttgcttaggattctattcattcgtccttatcttttttttttgttagtaacaacatctttgtaccatgatctaagctttcaggctggtataagtataatcagccatctgtggcctttcaattattctaattatgcatgtgtacaagattgtccttttttattcaattcagtgatctccaaggttgcatgtaagctttgtccactagatcatggatccaacacaagcctccaggtgctgtt

SEQ ID NO: 69077 - DNA, 3708 bp, Oryza sativa
ctaagatctgatcctaatggccatttaacaattgtgtgaattagtgattattacagcagaagtgtgtgatcattgagtatgtttattaaaattctttgaagtggtggaatttttttacactgccaccacatgtttgtcactgttgttggtatagaaagtacaaattttcattctatgtgatatcaactgtttattttcaagcccattctttggtttgtcaaggtgggaaattcaagtaaaggcttgttttgataacctcttgtgcaggatttattttcaatttgttcaaggctgttggtattgcacggaggaaattcattacctactttttttttaaccttgcaatgtcatattgataacccatgtatccccgcaaaaaaaatattgataacccatgtaatcatgtcatcaactcatgtgatatttggagtgccttggagtgtattggctttgaaagctttgctatcctgtatttcccatggttattcatcaacagacgattgcacattgttgctttctactctgctagtggagggtatgttaattaagtccattgttggtggatgattatttgatttttgaccatgttaatggattaaactaagatcaacatgctatctgtagatatatatatctgacttcatatggaaattcgattgtatattaaacaatgttatgaactccaaaataatttgcatattgagaactgcacaagctcaagggaactttagtctggtctattatagaaaaatggcaaaaactgaggtgattaaaatgagaggtatgagagaaaatagaagagtaatacaatttttaagtaaacaatgcaacggaaagtaaacggttgatgtaaatctccgaacaaacgaatacagtagacatgtgagttcgaatagtttgctctatggttagcagtttccttttttttatatatatatttggagacatgtcgcaaatcagagtaaaaaaacagatttgctaaaaatatgtcgccagtttttgtcaaaaaatagtcgattttgtgacagtacgatttacatcgagattcgtgctagtgcaaagtgtcgtgacggagggttgaacccagaacttcgaagtcggcagacagagctcctaacaaccgagcacggtattggcattcactttattgccaaaacaaattaatattgaattttgaagtacttatacactaattaccccccacattcacttacacggcacttacgctataattacatatgtatttattcacttacacagcacttgcatatcacttacactataattacatatgtaatttagggacttacaatgtaaatacatgctgactattttttaatgaaaaatatggttccataaatatagctactcccgttaaaaaacacacaaagtaaaattatcacaacataatccaaacacagccatgcgctttccaggtgccactggatcgcaatgcttgcgatatacatgtttgagcctagatattattattattctttctaaaaaaaacttggacaacagttgatagtgtgatggcgcaaaaaagaaagtaaaatcatttacatgcacctagcaacaccaaggtatacttgcccacttggttggttgagaattgcgtatgccaaaggtctagagtttaactccctccataataagcaacacttttttaccatatatttgttcactgtttcagcattcataacattgtgttacttttgttcactgtttcagcattcataacattgtgttactacaggcgacagcaacatatatgtaggtgttactatacagttcaagtataacataactcgtatgttttataacacacagcttgtgttgctattgaactatcttgtaacatatgtcttaaagtgttacaaatttatattgaactatcttgtaacatatgtcttaaagtgttacaaattatgttacaatatgtaagttctgtaaaatgggtgcacgatgtcattccagaaacaccttatgccataactgaaaatttcatgaacaaattattcaatgagtataataaagattacattacccatggtgagtttgaattattcaatgagtataataaagattacattacccatggtaagtttaatatagattacattatcatggtgatgatccttgtctgctctcagatggtactgatacatatgcccttgttaactaatatatagtcatatttcctccaaaagtatatatagtccgatcataaatggtatggacattatcatgccgaaaaccaccctttaacaacaaaaatgacaaaagataacaattttaagacatattattgatttggttataaataattaactctgataattaaatctaccagtagaaacttacgccgtacttaggacgtctgcatgcaatccatattccaaatataaaggatgaaataaactgaggtattgcagcatacactcatttcatgagaaaaataaaaaatatgaagaaaaagttaaacaattgatcacaatatatcttgttttcaaaaagaaaacagtgacaaaaaaataactgattataattaaaaagatcaatgaattaattaattacactcatttagtttttaaacttcataacacttgcaaatttcactcgtaaactagtagcagttaattgtgtgtacttgtatgatggctactcggaggacatcaccacggatggcaacgacggcggatcctatggccatggcagcgggcccgattatgaacttcagaaaaaggcccagaagtgtaagtcttggtccacactacataatcctttcttgctggcccatgaataatccttaggaaaaatgaaagaaaagaataagctggtttagtacttttaatgtaaacgtgcattttttttcttgacatactgtggacagagatatattatagcccttacatacatatagactaaatgacatactgctatatgtttagaagtgcatgtgtgcaaacctacccatactgaacatagccagccccagccctgatcttgacattatttgcaccgacccctccaaagctggtggcaaagtgaggtgcgacctgctataatattaggcacagatgtatatattagtacatatagattaattatatttatgagcatgtacgtacggggatacttattactcgtttacctattggagatgcaagcccaggagatgccgattacactggcgtgtagattgggattacaggctaacttgcgtgccaccgacttgaagagcggtaacctagcaccattcacccctgccactgtcactgcctcctcccccttgagatcttggttcgtggcatctgaaaccccctcttcgaggctttgcatatcttcgctggtacccgagccaccgacaaccgtatcatcatctatgaaggacccttcttcatgtctgttagactcgtcatgagcgtcggagacgaaagctttccttacttccaggaccaccacgagtgaggtgagccacactattgcctggaagattgatagttgtaccacaatttgccctgcccagttgccatacatggccctcgccatgggcatgcccacaaccaaagaattggtgagtgacgcaagagaaaagccgcttatacaccagtcggtgacagcggcgcataatccctctttccggaatttcaacataacaccaatgctgattgcggcgactataattaactttgctatgctatcagc

SEQ ID NO: 69078 - DNA, 2221 bp, Oryza sativa
tcctgcactttttttaaatcccggcaaaccatccgtagctttgttattgtactcctctatgacccatccgttgccttctctcttaattattagtgagattttaaaaatcgaacatgattatcattttggtttaatttttactttccaaaagtcttgccaaacaccgtgattgtgctgcttaacagcttgcctgtcatcccttctcttaatcatcactgggattctatttgattttttttaaatttaaccactataattttgacatgctatcatctaacaattattttttagtaatatttaaattcaataatatgataaatagatactacttgaacactttggaagtcatatcaaaatccaatttggggatgtattttatttttaattttatttttaataaatatttttaataagtagatggactctgcttctaatattctttatttttaattctgaattttagtaatttctaaattgcattcctacctgaactctttcgaattcgtagaattcatattgaaatcaaaatttgggatttattttattcataattctaaaatttaattaatcctatgttgtgttctaaatgcactctcttccaatattttttaatttagaattttagtaaattctaaattgttttcctacttgaactctttgaaaatcgtattgaaatctaaatttgggatttattttttaaattttaaattttaattattttgtctttgtttctagatgaactcttttttcaatactacttatttttaattctgaattttattaatatttaaattgtattcttactttaacttttatttttatttttctcaaacttattttttaatttcgtttgataatatactcagtaaggggcaggtgtggactgcatggatgtcatgtgcggttgattgcgcattagacatactccaatcaaacagttgatatttttttttatttttctctaattaacgtggtaatttcttaaaggtttagacatcatagcaaaactgataagctcctatgcggtatacaggagccgggtttgatattttttaggtgcatgtatgttagttttttttacgatctagattatatttccaatttgccgtgctagtcatcaatctatcaaaaaaatgtatgacatttaattttctccaggagtgctaggctagctatttacgaatgcatatggcagtgtatagacatggaggcatgcactatttatttttcttagtactctacttttcctttttttttcttcgatggttaatcggatctactctacagttcaatcactcattctttcattgctcagggaacggaaattgtgtcgtgtattcgtatttctcgtcaagtgagtcgagactgcggctgcatcctggagactgggacggaaatcagcaacagctagcagcacgagccacgctcacgtgtggaggcagcagtagcttagttgggagcttttctcgatgaaagaaagaaatgaaacaagaaatagaggaataagatcccaattttctagcatccatccaggaacaagaccccaattttctagcatccatctatcactgttaaataaaacataggtagtttgctaaatttcatgtatttgatggactatgagatattaaagttggatgcagaatcatatagcgtgcaactctttttcgatatcatattattactttgtagttttttcgctatatattccatgtttgtaacatgaacattgatctattatatataactttgatctattataagtgcaatctcgaatgacaaggattttagccctcgcagcctcgcaatgcctcattttttgtccgtcctctgccactgtccttgcccaaatcggcgccaccgcccctgccaccggaagccttttcatctctaggtcgctgccgacgccttccacgccgagctgctcctcgccgccaccgatccctgccgccgacaccttccacgccgagctgctcctcgccgccatcgatccctgccgccgacaccttccacgccgagctgctcctcgccgccaccgatcccgccaccggaatcccttttgttgctaggtcaccaccgccgccttccgcgccgatctgctccccgccgccaccgatccccattgccgccatcacgctctcaccatgcctctactttacgctccacatctcatagcacaggtaatgtggctcttcttgaagcagtggcattgttctgttct

SEQ ID NO: 69079 - DNA, 2573 bp, Oryza sativa
tcatggactgcaagttatcttctaccctatagttcaacaaatggttttactcattcatcgtgtgacacatccaacggtctaaaattatctaatgaatctggatccaacgtcccagatccgcgtgtgtcccgcgcctccctgtcgaccgcaatcgccacaccacctcccccgcatctgcgcctctcccgcatcatccttctctcacgcaccttcctttctcccgcaaccgccgcacccccaccacacatcgcctccaccaccctcatcagctccacaaatcatgccgccgtcgccgtcccgctcatcgcgccgaaccgcgctggagtcaccgtcggcgtccccgttcccgcccctccgcccatctcatcgatccacgccgccagagtcgctgtctccgcccccgatccacgcctgtgcgcccctcagatcaccgtcggccggagtcgccgggctcgtcgtcgcaagctgatcccctccgccattgataggaggtccagaaaacctccttccttaccagattgaatttaatctctttttgagttaagcaagagcattggttttttcctccatcagtttgattcttgcaagttctggagactgatacaattatgtaaaaattgaggtggcatggaattcaaagccatgtgtagaagttagaaataatacttctgctcatacacaccaatcctttgctctactggagactcaagtgcaatattgaatccatcaagagcataacaaaatcaaataatagagaggattgtaacagattaccccatcaagttggtgaaataaaggagcaattaggataaccaatagatcagctaatggaacacataatgaacagaaattccttagacctttgttgtcgaagtgacaactgcatacgtcgaaggatgtggttgctcaagggttcttggaaacaacgaagtgtactaatttaaggatttttcttttgaatgcccctttacatggccctaggggtctatttatagttctattacagatccccctattagggtttaggttttacaggggaatttacatggttgccctcatgagagggacacttgtatgggcatacaatgtaattgaaatatatgggcctccaatgggccggttggcgaatgttggcccactggccaatgggatagagcggctgggatggccccttgggcctccttggagctgggcttgataccgcgaagtcatcctccttcggcaagcacccttcaccatttagccttcgcctaggacgcatttggacttgcagggtcccaacgcgactcttcacccttcgccgcctttgcccccatagtcttcgccatggggcttcgccccgacgaaccttgacgccttgagtctgaatcctcgctggttgcatggtttcggcaggtctggtcgaagggtctcatgacataccgccaacaagcccctcacaggcaagggtgagataggagcttcggccgagaccatgcaaaccatgtggtatggtatgaggcgccccctttcgaccgacgctcctgccgaaacctattttgggttcctgcaaagaatgtgtgcattgcgtgtacatgtattcttgcggttagtaatgttttgcagcttttgccttctgcgaacggcgaagctgtccttattctttcactggaccgaaatgaacagtgatgggctttccttcgtgggcttgtccctatgcggctcggttaatgggaatttaccgtttcgcctacccttatgacgcgtggcggctcatgattgggtgggaaggcgaaccgttgcctgggtgggctatatattcccccttcccctttttcaccgccgcaccctcgtcattttcaccgcgagcgctctctctttctctgtacttccctttcacggcgccttttgagtcattaggtctttcgcccgttctcccttttcaccaccgcgcacacttttcgccatggctcctcgcaagccgaacccaacctccgcgacgggccccgatcccggccggatcgacgatgacaccaccgcctttttaggagcttagctcgtggacgatgacgagctggtgaagttggtcagctccggcgcagtggtggaggggcaggccttcgctccgggaaaggccgtggtgccgaaacccggcgaaaaccggacggtggtattcgtcatcttctttgaggaggggcttcgatttccgttcaacatgttgtttccggagatccttcgccttttccaggtggagctcccccagctaagcccatcggcactcgtccgtatcgccatcttcgactgggcgtgccggatcgccgggtttgatccgagcgccgatcttttcggcaccatgttctacgccacagtgaactcgaagacggtggtcactccggccgggacgaagaaaacgacgttcgggagtgtgaactttaatgttcgccccgagcgctccgatatctggccggtgaatgccgccatgtcaaagtaggatcgcaattgggtggcgaagtggttctacctctccatccccttcgaggctgggtccgatgcggcgaaagccctccggaggcggcgtagggtgattgcaccga

SEQ ID NO: 69080 - DNA, 3339 bp, Oryza sativa
gcgacgtgtcggtcgctgagttcagccagctgctatcgcggcaggcggcaagacgggcaaaccggtgtaggatcgagatgtcaactagaaggggggtgaataggcgatataaaactaaatgacacctaatcaaaactaacctaagttgctaggcacgtgaggatcaactctaagcaactaagttatgttttgcaaacgtagggtgatagtggctcaaatatatctctaggaaagtaaatcacactcctatgtcaatgtttagcaatcatagggtgatatgatctcaagtatctctctagaaatgtaaattgtacaaatgtaaatgcgacaatcaaatgagacaaggagacaagagatttttcaccgaggttcggaaactcgccggtttcctactccccgttgaggcgagcccaactccaccgctcaaccacaaagccaccgcacgcccccttcgtcaaggggtgggcaaggcgggagccggcccacggagaggactacccaagcctcgatcactcggggtagttcttccttcactccgaaggtggtgaactccaaaccactcacaaaacggcgccgggcctcctccacaatcttctcggagaggtcaccgggcaacccctccacaagccgtctaggaggcggcaacctccaagagtaacaagcaatgacccggcgtggagataatcaatcaagtgccgcactagctctacaaatggaagcaatgcacttgactcttggctaatcaaccctctaacacactagatggatgaacacaaagctcaagtgagtgtgagagaggtgcaaggggtgtatgcaattgaattgggtgccaagagagcccccttgctgctggtgggggagtatttatactcccaccctccaaaactagccgttgggggcgaaatcccccaactctgtgctctgtcggtctgaccggaggtatgtggccggtcagactgtgctactctgcaacggctagaaaactagccgttgtagtgctgtcagagggccccatcgtcccggccggtaagaccggcgttgagtgggcggtcagaccggcctcggctcggtctgaccgaatgcggctccgtcggctctgtatcggccaccctgagcagcaccatcccggcctctagggggccggtctgaccgcgcatgtgccgccgatcagaccggccatatgggccggtcagaccgcccgcttggagccggtcagaccgccactatgtggccggtctgaccgcccctggtcaggccgaacccagtgaaaggcaaagtgtgtgtgtgaagaaaatgtgagcacaagtctaaatgcataatgacctaatgtggcaattaaaatcatctctttgctaggtcactacccctcttaataatacggcgaaactaaaaataaacttgcaaatttgatcgccctacacctcgatcaattctaaattaaagcgctagttttaccgtcttctttccctttgctttgcgccgtcaattttaatccatcgataatcatccatgcacacatatgacgtggacctaacttaaaatatatagctcaaagacaatggttagtccacaattagcgcttgtcattaattaccaaaattaacaccgggggcctagatgcttcaatctccctctttttggtaattgatgacaaacaccacaaatatatatataatcaaacatagagcacatggacatatattgcattgacaagcaaaagctccccctaaacatatgcataacaatcacaaatagcaaatatggagccaatgcacatttcaatttcacatttcaacatatcacaaacacaagagcaatatctcaatgtgaacttcaagaaatattcattcatgagcataagatggtcacaaatatatcaatatcacatacaccatctatcatcgcacaagttcacatctcttaaccattcaaatcacataagtcacaaatcattctaaaagggctcacaaataaatataggctattacaagactacgaagggtccaaatgacatagagatcaacaaaatgaaaaggaacatacaatatagagtaatagcccatacccatacataatatagcccaaacctccttaacctattagatatgaggtgactaacctcactaccactagtcccaacccacaagacaaaaagcacacctaatgacatttttctcccccttttggcatcaactaccaaaaaggtcttcattcttgtggaggagaaggaggacgcgccgaagtggaaggatgatgagcatcacgacgacgatgatacacaaatgcttgggagctctccaacatttggactcgagaatccaatgtacccactcgagtgtgcaatctccccatggaagcattcaagtctccaacatcggtgcgcaagccacgaacatcctcatgcaaagcttcatgcccggtagacaagtgttgaatgcttttacttagggtattaatagccccaagtaccgggttgaagtattcgatgggttgcattccaaaataagcatactgtggatggaagaaagcatttggatcgtacccatggggaggaggaggtgctgagcttgagctagctccaggatgagaggagggcgccgccctaggagcacggggagctccaagctgaaggcggggcttgtactgcttgtgcttcttcaaatttggctcggcagccccaagcttatcttgaatcaacctcatgatgtaaggggcataatagattccctgagagaaagtccccttggagatggcaatctcttgcatcataagagacacaatgtcgaactgacgaccctgaatgattgcatccatgacgtgccaagccactcccctaatgtcatcattgtttccaaggcgagggaggatagtggctctcataatcctgttgaccacactggggatagtcctcaagccgacaaccttcccatgagtgtaccgtgctccatcttcataaaactgagagagatagtctatggagagcgaattatgggtgtgctcctcatgcaagtcatctccaaagtccaagcgaatattgaggagccgccggaattgcctcctagagatagaacactggagggtgtcggacatccacttcatctcactatagtctccagccacccacactgtagcataaaactgccggatcaaatcttcattgtagtcttgctttagggtcacaatccggtcaatgccaatagtcttgaagagatcctgtaagctctcaaactctggagtctcattgatgtctctccaaggaatccacttatgctatgcaaaagccttcccagcataaacctgctcatacacactttttaggaaagcggtgtgaaaacgggg

SEQ ID NO: 69081 - DNA, 2138 bp, Oryza sativa
gtactatcgctatggtgggggtgagggacttattttgtgcttgtatgttgacgacatactgatatttgggacaaaccttgaggtgataaatgaggttaaatcattcttgtctcaaaattttgatatgaaagatttgggagtagctgatgttatcttaaacattaagctaattagaggtgagaatgggattactctcttgcagtcccattatgtggagaagatcttgaatcgctttggctacattgatagtaagccttctccaacaccttatgatcctagcttgttgcttcgcaagaacaagagaattgctaggaatcaactggaatactcccaaatcattggctcgttgatgtacctggctagtgcaactaggcctgatatctcctttgctgtgagcaagttgagccgatttacttctaatccgggagatgatcactggcgtgcgcttgagcgagtaatgcgctatctgaaaggtactgtggaattgggacttcactatactgggtatcctgcggtactggagggttatagtgattctaactggatctctgatgtggatgagatcaaagccactagtggatatgttttcacactgggtggtggtgctgtttcatggaggtcttgcaaacagacaattttgacgaggtcaaccatggaagcagaactaacggcactggatactgctactgttgaggcagaatggctgcgtgatctattaatggatctgcctgttgttgaaaaaccggtgccggctatccttatgaactgtgacaatcaaacggtaattgtcaaagtgaatagttctaaggataatatgaaatcgtctagacatgtgaaaagacgattgaagtctgtcaggaaattaagaaactccggagttataacgttggattacatccaaacagcgagaaacctggcagatcccttcacgaagggactatcacgaaatgtgatagacaatgcatcgaaggagatgggtttgagacccatgtgagttatactatggtggtaacccagtctatgtgatcggagatcccgtgaattagatcctgggaagaacaaaccattaataaactagaggagagtacaaatatatataccctatccaagtgaagatgcatatactcttgtgagctgcaaggcaggttggctatgccttaatgagttctgttggctttaattagcaaagatgttgtcctgcagagcattcttgaaggaactcacctttgtgagcttgactgttggtcgcagtctatgaagattttgggtgaatcttctaggaagcttactaaagacctaggagtatgacttatacgctccacccgaggggtagtctacagacggtctagtaccagataagactttgagtgaaacttgcttgcacaagacttgcaattcaaggcgtagtccattgttcaagttgtgagtaagtgtagcttggagttctaggtggatgttcaaccttaattggtctccatcgaaccgctggtatataaacagtacattggaaaaggcaaatctcagtgggattttgagatttggtgggggattgttggaattaatgaatgggccttagcccactcgaagattaattctttggaaaatcacaaaagcccacctcatgggatggcatgcatgtggagtttagtaccaccttgcttattctaggagagggggacctccttaaaagggaggatgccctcctagccacttgaagcatgtgtggtggagagaagaggggaaacacacgcgcgcgctcgctcgcctcgcctggcctggcctggcctggcctggcagggcagggcaggcggcgcgcgtgcacgatgtacgcgtcgaatggtccgaaaaattggctcctcacccttgcgcagatgcagcctccttttgcagttttgttttgctgcaaattcggattcgttttgttttggaaacgttccgaaaaatccggtgcgtgcaaacggcgtggagtccggataagttacgcgcgacttatccggttcggttacgcgcagtagagatcgtgcgggcgccctgatcaagcgacccttctctatataaaccgacccgccgtcttcacgcaatatatgcgaaaatcaatctagggtttgcctcctactctgtactgcgccgtcgttcgt

SEQ ID NO: 69082 - DNA, 1883 bp, Oryza sativa
atatagatgtgttgtcctgtgtggacaaagaaccttttggtcttgtgtggacacagtatccttttgggttggttggttggttaaaaatgttgtgattgcaaatgttgcttaaattaaatttatatctatttattatatttaaatttgcaaatgcctttatgcaaatgaaccctaaccgtcctttgaagccttgtatcatatattgcatattcccgtacacttgcgagtactttatgtgctcacccttgttgtctcaccaaatttcagagaaggtcagttgtttctagaagttctgttgctaagaacgtcgaataggttgcgtgccccagtcgattgcctgtggtgtgtcgttggtgcctctcgcctctttttcctctgtttatctctgtttgaccctgcgtggcaaagaaattataaaatctggtcataagaccaatgtaaaaattatatttgtttcctatttattaatataatcgtgatgtgattgtgatattatcttttgttactgtgtgtgctagcgttgatctgggactagcacattacacacagagggatcgtaattggggtcccgacaagggccaaaagatagctgatctaggttggctttctcctcattgacagattgccgattgacttggatggttgcctctatatcttttctttctcgcctattggctatcctttgtcttgctttctccaacttgaattgatgttgttcaagataaaaagctggagttagcgtagtggctaagtcttctgggatcatattttgaatttcgtggaaccaggccctgattgatccacaatcgactaccaagacatccaaggaattctctagccgatttgatatttccataagagttctcttaacatcatcggctagaggagctaaggctttgcttgaggtgtcttcttcttcttcatcccagaattgtcttatgtcaaaagagaacatatcggctaaaacctgcaagaaagaaaaatgcagattcggttaaagtgttcgaatgtttaaacagccgatataagatcaagataagtacttacagggacagcaggagttggagctgctgcatcttctacatgatgacttcctacagccgatggggtgtgttcacttgattcaggctgaacaggagttggagaatgaggaggctaaaaagaaaagtgttattaggaatcggcttatatgaataaaaaggaaatgagaagatatgagttaccgatggaggcagtattggtttctttctggcagccgatttcttcttctgcagagacaagtgttatgatgaaattgggatatgaaattcttgcaagcatcaagttttgattagaatacttaccctgggatgccgagctagttgaggtggtgccggaggaattctttgtggagctggggtatcggcaggaggtgtttgttctctagtgtcactgacttcggcagcagctgcatcaatgtcttcttccatggcttcatcatccagaaatttgtcgacatctggatcaacagttggtagatcatcggttgctaaagttttttgcttatttgttttcttcttcttggtagccgatggatctacaaccgatggcttggttcttttcttctttccggtatccattgggataggctctctcatctgtccttgaagcaaacttgttgtcttggggggcatggaagccgatgacaggaggagccagtccaccaccattaggaagaaggcctgcagcataattgatctccaaaccactttcactatgatgaggaggtgaagattctgtggtctgcaatcaaagaaataaattggataaatttttatatcagcagatagttaaggaaattgataaaagtagaaattcttacttgagggataacatcagggaat

SEQ ID NO: 69083 - DNA, 1381 bp, Oryza sativa
gttgatatgcctcatgaggatagccatgcatggattgagtccaaagaaggcaattgtatctattaattagattattttatgtaaattccttatgtttcaagtcggtaagagtccaccttagggacttgtttgcattttgagttgtaatagagataggtgtcgtgtccgacagggacatattatgtactttgggtataaaagtagcccaaacccatgtaattaattaacaatcagtttaataacaatctcggcgcatcgccaccctttcgttttagtttactttcgacgagttcttgctttcaagttaggctgcatcggttcgatctccgacgacaaggtaaaacttgttatgatggcttgtgttctcgggattagtgcttccatctctatgatactctagtcttgtttatataagttgttgatttatcatatattctatataatctagactaatattgttatctagcctcaaatcagctaacatctctttctagaaggtagccgatagggttagataccaacgttgaattagattatatagtttatctaccatcttgaaaggctttcatcgacttgtatagatcttatacatctccttatgcttaatgctgcatcggttgggtccgacctattaagtaatatttagaattataatatctaacttgttttatgattgctattagagatagcatcggagtttcagcctatcttacctgatttagttatcttattcattattttatgtatttgatatgctaaatctgctctttatattaagatctcactatagtaaaatatattgagcttgttgttaatctgttaagttatcttagcaatcgattgatatctgtttaatatatttcacttgcattgatatcgtagtataaagttgtatcggagtattagccgatacatgttagatctacaacatcggctatgctataaacatatataatctttatattgaagtacttttagacataagtgatttatactgtctcggcaagctgtccgatctatcccaatcacttagtttaaacatatttcgatatacatattatatattgttaatatctacagccgatcggatagatctaactttcttttgctttatatttcattgccgatctaccttacgtaccatcggctaggttataaacgagacgtcatcggccattagccgatcggctatcgtttgaggatttaacttcgttttcttgtttcttgttgattgcaggatcaaactaactggcacgcccttaaacccaaaagcaagatttaggtccagtactagagttaagcaaatctctcatgccagtgtgtgttttttgcaaatacacacttgaacaaaactaaaactctacttctactaccaacaaag

SEQ ID NO: 69084 - DNA, 760 bp, Oryza sativa
ttgaagaatctactcaagtgtggaaatgacagaatggttagtcctgatactctgccagctgactttcaggatgacagattcaggacctttgtgcaggttgattggtataactctgtgatcatgggaagatctcatccagtggtagagatgaagtggctagactggcagtacatgtcctcaaagaacaacatagtcttcaatgaggtacgcaaggtgtgtgagcgcaagcacatggcagatttgttggccttgcagtattcctggaatgagtaagtgattggacagttctactccactgctttctttggcaccaccaagaaggggcttgattttgtgaagtggaccattcaggggtagcagtatagggtctctatggcacagtttgctgcagctttggggttagatgatgatgacctgagtcgtccacatatctttgtagaggatgctctgtcaccgaccagcactacctttatgtatgagaaggatgctcccaaggattgtttggggactactcgagggttgcgtccatattatagagtgttgtactctatcttcaggtggtctttgctccctaaagtgggagatgctacagctcttccaggtaggcatgcgctcctcctcagtcgcatgcgctacaacaagcccgatttcagcatcatgaagcttatctggagtgagatctatgagacagtgtgtgagccaaagaggggctgcatctatgcttcttatatcatgaagatgattgaggccatgactggga

SEQ ID NO: 69085 - DNA, 1486 bp, Oryza sativa
ctggtgatgcctatgtaatatatcttctcctatgaacttgtgccgattaatataattttttgcttctaaagtccatatttttgatttgaagtccatattttttatatgcatatgcccccttaatttgtacagatgttgaagcaaacattgagaaaattaaaaattttaactaagggcgatataacaaatatcggccatcacacatcggcacaatccaaccgattatgataagaaaaaaaaaacttagagcgatacaacacatattggcatatcacacatcgggcatacacaataacagacttatgataaaaataaaaagtctaagggcgatattaatcatatcggccatctaaaggcgatgtcacaacatcggctgtcatgcatcggcacaacttaaccgaatcatgaattgatccaaacacttggataatatttcttcaaatacttcccattgagagctcgactgaaaacttctccatcaagtccttgcaacatgtaagctcctttacaaacagacttatagatttgaaacggtccttcccaattcggcaaccacttgctgaatttgttgtcacgggtcctaatcggcaagatcaacttccaaactaactcgccttctaaaaaaagatttggcacaaccttcttgttataatgatgagcaatcctttcctatatctcttgtaaccctttccaaagcacgcaatcttgattgtactaattcttccgactcatccaccataagattatgataatcatcggctgacagctcatcttgtaattcaatccttcttgagccgattttaatttcccatggcatgtccataaaccagcttataaggaggaacttgaatcgaaccatgacaagccatctgataagcccataatgcctcagccaatcggttatgccattgctttggataatcggcaatctttctttttatcaacttaatcaaacttttattagatgcttctgcttgcccattagcttgcgcataatatggggaagaatttaacaacttaattcccatgctttctgcaaattggacaaactcatctgacacaaagatagatccttgattggttgtgatagtctgaggaacgccaaatcgatatatgatatgcactttgacaaactgaattgcatccctagaatcaactttcttcaaaggaattgcctgaacccactttgtgaaataatcggttgctaccaatatatatttatgtcatttgctagatggtggattaatctagccgatcatatcaattccccaacctctgaaagggccatggcttgatgataggattcatagccgatgctggtgttgtatgaattgttccaaacttctaacgatcttgacaacccttgtaatatctaaaacaatcctccagcattgtcggccaaaaatacccaactcgccgaagtaaccacttcatcttgtgagccgattgatgagtaccacagatgccctcatgcatttctcccatg

SEQ ID NO: 69086 - DNA, 1493 bp, Oryza sativa
ggattgttgagattatgggcatataaggatttaatttattccataaataaatcatgacattacagatgaaaactagcatgaacgcatcattagatctacacatgtaaactacgcagaataacatgaacagatcaaatatgcgcaacatattaacacgtaccgaggtgacgaaaagaccggctgcttggtcgaaacttttcgcaggtgtctacgaaggcacgaaacacgcgagcaaagaggaaggcgagccgtcgcgaacgaacagggagcagtcgcgcgaagcgcttcccaaaaaccttattgccgccttctcccggtgcaggacgtcaaaggcagaggttccggagacctgctctcccgatcgctggtgcacgccggcgagcgggatggagtagtctacgagcgacggcgcagtacagagtaggaggcaaaccctagattgattttcgcatatattgcgtgaagacggcgggtcggtttatatagagaagggtcgcttgatcagggcgcccgcacgatctctactgcgcgtaaccgaaccggataagtcgcgcgtaacttatccggactccacgccgtttgcacgcaccggatttttcggaacgtttccaaaacaaaacgaatccgaatttgcagcaaaacaaaactgcaaaaggaggctgcatctgcgcaagggtgaggagccaatttttcggaccattcgacgcgtacgtcgtgcacgcgcgccgcctgccctgccaggccaggcgaggcgagcgagcgcgcgcgtgtgtttcccctcttctctccaccacacatgcttcaagtggctaggagggcatcctcccttttaaggaggtccccctctcctagaataagcaaggtggtactaaactccacatgcatgccatcccatgaggtgggcttttgtgattttccaaagaattaatcttcgagtgggctaaggcccattcattaattccaacacatccatcagtgggatgatcaacggagaatttgttatagggagtagagtggtggactgattacgtagatggccgagatttatttgtagggagggatgacttggattgatttgggtattaggaggtttggtctaaccatgaggtgtgcaacatggtgccgtggagcgagcacataataggcgtggtgatgataaagcactggatggtggacggatagctagaggggcttcaggagtcgggttggagtcagggacatcgaggtggagctcaccgggatgctcgatggtcgctcgtggtaggttggcgcggggggaggaaacaacagatttttgtcacagcggtgcagctgctcaccaaccacgatggtgacatggctgtgcacgagaaggaaagagaggtggcaacaatggctcaaactcctagggacagtggcagcgaagcgagggatcgatagtgcttgggcatcagcgtctcagcatacgtgaataaaaagaaaaagggccagcactagtaggaataagaagagag

SEQ ID NO: 69087 - DNA, 895 bp, Oryza sativa
caggcacggcccggtggttgggccgggccagcacgggcccaacccctgacgggccgtgccgtgcttgggccgggccaaaacaccgtgccgtgggccgggccgtcgggcctcgggccttttggccatctatagcatcacaacagcaagatgaagagtcccagtgtgcacgaataaaataaaataaaaattggaggggcagcgctgctgtatagggaagccagagcagagagcatctcagcatgcgcgagcaaaagaaaaggattgcagaggtgttgttaaatatatatagaggagaaaaggggaaaagtacgagcagccataagatggagagatggtgaaaacagagctaaccgatcgacggtgatagtgatttagtttttgataaataaaggaggaaatgattataaaaagtggaggcagtgcaggtccttaccaaccacgatagtggagacatggcagcaacaatatgtgctagacgacgaggcagtggcgtctttatgtgcacacgacagcaacccgacatggaagaacagaagagcagcagagtgatggcctctcaacctgtgcaaacaccggatgatgaataggaaggaggaaacgaccaatggacttggatgcggtgcaagtgcttaccatgacagagaagtggcagcatgatgctcgtatgatgacggcacaaactctagagatggtggtgtgatggaatgggaacgacaatgatgaggtgaagacgacagcgcagaggagcatagcagcggcgcatcggcggttgaggaagctcccgacgaggtggtcatgtcctcgatcatgctttcacatggatagcacatggtgtggctgtttgcaagcgctaccgtggctgaactcaaccgggctgcgatgacagagcctgcaa

SEQ ID NO: 69088 - DNA, 721 bp, Oryza sativa
ggatcccccacttgtcaccagccgatagatataatctgaacggcacccctttctgtggaggaatcagaaccggtggggaactaagatattccttgatattacccaaagccttctgctgctctgccccccaagtgaacttttgatcggctttcaatcttaacaaatgtgtaaagggttctaactttcctgataaattagaaataaaccttctgacaaaatttatcttgctgatcaactcctgcaacttcttcttgtcctctagaggttgaatcttctgaattgcattaacactcctttgagtcacctcaatccccctctcatgaacaagaaatcccagaaactggccagccgacacaccaaaggcacattttgttgggttcatctttaagccatatttcctggttctctcaaaaacttacctcaaatcggctatgtgattttctagttcttttgacttgactaccacatcatcaatataaacttcaaccaaccagccgatcagatcatggaatatgtaattcatagcccactaatatgtagctccagcactcttcaaactgaaagtcatcacgacccattcaaacaagccgattgcacaaggacatctagaggctgtcttatgaatatcttcttctgccataaagatttgattatatcctgcattgtcatccataaaacttaatatcttgtgtcctgaagcagcatcgaccaactgatcggc

SEQ ID NO: 69089 - DNA, 1060 bp, Oryza sativa
cctcaaaatgtggggcaaacacagatacatgaaaatagatgcaggaatagaaaaaatagagttgaggacccttttgttaggcctcactaacttggctttgagttgcagaggtgtttatatagaactaccttacttgaatactgggcctcaacataaggccatatcgtttccatggtaaggcttatgcaactccagatgaaatagaatggtcactgtcaagccattgaaacatagggggtgaaccactgcatgtttgatcttccaaagcaaagtaacaggaaataataatgtgaggtaaaataattaggaacagatcctggacttactcttgtttctccagtacattttccatgatcttgaagcaatccataaataatgaggaaaacccgcatgctgctatccctttgtcagcaacatatacatctgggaactgcacatccatgaaagattgaaacaaatagccaagttaggaacatgcgatgtggcattagctcaccgtcgttgtcgccgtgccgtggccgaaatccatcgcgccgacctccgcaatgcccctgccgtccctctcgaccctggctccaacatctcctctgcttgcgatgtgcgccactgttgcttggatccaaggccaccgccaccggtccgtgaccgcgtctccctcctcagctcctccaagctggaccttcctctcactgccgccccaacaccttgtacgccaccggtgcacaggagctcatccccgccggccatggccgcactacggattgggacgagacaggccgctaccccagcgccttctcggcacctggcacaagggggctcgaccccgccgccatgacagcgctagggtttggggcgagaccacagggctgatacaacactgatggggaggaagaaatggaagcggtgagagctaaaggagagggggaaaagagcagtggtttgctggcggaggagacgatgcgcggtccacctcaggcgagcgaggcgacgccgcagccggcggctgtcatcctgtcgagggagaaagcaaagggggtgaggcgaagggggatagagttgg

SEQ ID NO: 69090 - DNA, 1310 bp, Oryza sativa
aactaggatcaagcggaataaaacctactactccctccgtcccataatataacaacctaggaccggacgagacatttcatagtacaacgaatctggacatgcacatccggtcctagattgctatattataggacggagggagcatttagctatttcctctgttacaaattactagctttatccaaagtcaaatatttatatccttgaccatcaatttctataaattcgtgtgttttaacaacatgcaaattatatattatgaaagtatttctcatggtgaatataaaaacataaatcttaatgtgttaaactatatgaccagaaatagacggtcagatacagatagctcacttaggacaaaactacaatgactagaaaaggagggagtaatggaattttgaactgctgacttcttgcctctaaatttgaaataagaaaatgcctcagcacatgtgaaaatttttaaaagatgacaaacaggaacacattttgttgtcatgctgaaaagatgatactttggaaagagcgttaagtgaaacaaaccatctcaggtagacacagcagatgaatgagcttgtagatataatcctcatgatactgcacaggagatagattgtcctccagatatttatgcaagcaagtatttccaactgcaacatggagcgggagtagtccgggaatgccagcatcattgactgtgtgtaaattggctgaagcaccatggcagaacagcaacttgatcatgtcaacagagaaccgttcagcagctccatggagtggaaaaattccatatgggttaatgcagtttggattggcatgcatacaactgagctgaggtgccttgccctccaatacagttttcgcacatcgcaaggcattatgcctgacaatgcaggataaggtttctgaggtgatgttacacttaaatgccatggccgcagtacattccgcgaacaaacggaagaagcaccggacactgtcctttctcaagacggagtccaagcggggagatatatcaaagaaggcatcccgcaccacctaaattggtccgttcacaatcagaagagatgaaaagaaatcagctttcaatgtaataaagcaaaacataaagtctcattgacgtgcaccttcatgacaaaacatttcatttcagcaaagggcaccctttttttttgagaaaatggaagagacaacttacgtaaactaaaatgctgcaggattaaaaaaggacaaacgtaacaggatgatctagcaactgaattctgtacatgaagactagagagcaacctgaggggtagggtctgggatga

SEQ ID NO: 69091 - DNA, 10134 bp, Oryza sativa
attcctgcacccccctctttaatcgtagttgtaaccacagcgcaggcatatacagagtaactgtgtacactttttgatatattttagtgatgttggccattgcaacttttgcatgtttcatgaatacttgtgtgctattatctccttgtgaattttcttgatgcacagcacataacggcaaaaaacgaaatactttgcgtattaattattggttcatggcggcaagtggcaaccaataggttttgttattgtcttaagctgactacatttccctgaggatattttgatattgttgacacaaacaagttggaaaagttaaaaaaatatattggtattagtggtgattttccctagtgcaggctcatattttgcatattttggtagtatatatgtcgcatgattaggtccacaacaatgaaactgacctgatgaagttcatgttagcgagaaccactatcatgttgtccaccatgaaatatgatttagtgtgttatttgtccagtttataaatttggggtaaaaaacaactagtttcttagttcagggcatatgcttcaagaaagcactatgagcctaggcccaaacacattacattaaaaaatattgaaaaaaattacactaaaacagcaacagaacaccacccaaggtagttcatctgcctaatgcaccatgtataatgcccagttcaaagttcagggtgaaaaatggactagaaggaaatttcaaatgccaaaaaatagacttttacctttttataatttatagtcaattacagttaccaagttgaaatttgaatgactaatgttcatgccttgtaccttttgaaccatctagtcgtattatttggttcctaatcctgaatatagttaaggcaaacgaagagaaatagttacgtaattttgaatatgtttgtatatgtactttattttaccaagtaaacttgtattcgatgtgattgcaaactgttctaccttctttcagttcatctgttataattaatttttctctaaaccattcttttttgtcatttctttgccaccaatgatatcattgtactacatgatcatattatcaatatatgcactttattttaccaagtaagcttgtattcgatgtgattgcaaactgttctaccttctttcagttcatctgttataattaaattttatctaaaccattcttttttgtcatttctttgccaccaatgatatcattgtactacatgaccatattatcaatatatgctatttttatgtttcattttctgacatttttcactatctgatataatggttctaatgtcattcaggtgcccaatgtggaggtccttgcgcgtgtttcatatattcttaaggaattcgggttttgccctaacgaagaatacattgacaccatgatcctgtactgctctttttgtattcaatataatattttttttctatgcaaatgtttgttgtttattaattatttcttaaacttgttattgaagctgtccatataacaagatttcttacagcgacatagttcacaaaggtgtgtgtttattatttaagtaactgtttctgaatttctcagaaagagcctttattaaattttttatggtcatatagatgtaaccaaggctgttgcacaaatgtctacttctctgcctgctgcagaaaaaaaggtaattgtattccgatgttaccaatgatgatttcttatattcaccttgttaattattgtgcaacaatgcgtggggagtatgatgtaccaaagcatgcagggagcagcagcagctaatgatcagttacttaggttccaagttaggtttgctattagttgccatcttactggctggtgcatataagccagagtgcctgccagatcattatcttgtagttggattctagaaaagtagaaactctatgtctggtctcttctctatcctggtaaaaggttgctcggcagtttttacagcagtgcgtcattctagattatagtactgtcaacaatctgaaaataattgattttctccaatgagatagaatgttttgctttaagtattgtgtttagatttgatctgcctccctttctgtgtgtgtgtggtcttgcgatagatttttggtgtgcaatggtttgttttgatatttgatcatgacctagttaagatgttagaatgaacgaactcagtatgattagtccttttgtagttggatggtaataaatcaagctgatagatgtctgttatgcttctggttgttatgtttctgccgtgcagctgcttactggttcagctgcttttgcttaagcaattcagtttgttgacatcacttgaatataaccagaaaacaatttattctgttgctcaagtaaaacacctctcccaggatatatgaaaatattgtgaatcaagtgctctttggttgatcaagctggaatttaacaatttttttttgggtttcacaaagcttaatcttcatttaattatgggacaggctgcgagaaaaaaggcacttaaaggatgggatccaacattcataaagagaaattttttcccctactggagatcagtattaggggcccagctgtctgtatccaatggagcagcagatgagaagtcaatgcttcatcgtccacagttccgtaattcagtagtgagtaacgagtcttcgagtctgaaccataatattagtttcttgggaagaattcagcaactgagtggtactcatgaatcgagaaggtacagtactgctgcattcagaatgctcacgaaggtgctaaagacatgagcaaaaaggtatgtcgtgagttttgtttcagtctacagttactgaacatgtggaaatcattgctgtgacgcctatattattaattgagcaatatatcgtaatgtcaagttgttagggtacctcaatagaatttcacttgtttaaatttacagtaatattttcttgtttttcttcgtgcaggtgcctagtggcatgttgctgttgataaccataggtctgcaaagtattatgctgcgcacgtcttttgcggacaccttaagaaggttgcgaatatacatgtgaccaccaaaaccttgttcaaagtgatgctaagtactttaaattatgatgaaatgcaacatgccgtgtgttgtattcggcttgaaccctcgacccgcgagatgtggacatgcgtgccagcatgttgtacttgtaccaggttcaacgttagcttgaacactgaacaagttaaatgtgttgcaaaatgccatttttctttatcagcaatctcttctacctatatcagggtcatgattctagaatgttattgggccacgtggcagcctgaaaaattagctaaacatcaccaaaatttttgccacgtgtcaatcagatataagctcttgtgatgtcccttgcacatcagaatctctagaaaacccattactttacctatctctttgcactaatgcagttgataagtatcgaccaataaaataataaagagagttaataagtgcttcacttttgccaaccgatagccggaatcagcttttttgtgatgttttgatggatgcaaaagatatagttatatttaacatgtaaaatctataactaatataaatattcgtgtttttccggtcgtcacatctaattttcgtccatacacaatccgattcggttagcaatagccatggaataaaattgcaaaaaaaaaaaaaggcggccggcgccgacgcctgtctccacgtcgtccaggccgccgcctctcccgctccgccgcacatcccctccccccgatctagcggaggggagggcgtcgccggccctcccgccgccacacaaagagaaaggggaagaagtggagagagtggccgccgccgccgctcgcggggaggagggcgccgccgccgccgctcgccttgggggaaggcggcggcgccgccacacaccgccgcaccccaccatcgccgcgccgtgccggcgagaagggagggacggcgccggtggcgggggagtcggccggctggggggagggggagagacgccggtggggagagggagggggagaggcggcgtcggggcgggggaggaagaggcggccggctcggctcggctggggggagggttagggttagggtttcatcaattttaatctgatctgagccgtccatcaaaactaacggctgagatcgattgagggtttgggccgcacgtgggcccgcggtccactaaatgaaaggagtatgggggtattaagtagactttggtctcttgcgggctgaagaagaaaatgggttgaaaaaggcccatagagaaaaaaggatttttatttagatttttatttcaataaatgctgaaatgatatttgtattatcaaaattagcaattaagctaggtaaattccaataaaatttcaatgagtgtaattaatatagaaaatttaataaaagttaaatccaaccacaacattttatttcttacacttactttacttataaattaatttaattgtatacctacctacttaaaaaatacctaaatatttcagaaaatttatatttcatttaattagaatttaatatgttttaattcaactttatctgttttttctattcgttgcaacgcaatatcacttttgctataatttaaaagagtgtaattaatattgcagaaaattttatatttcattaaattacaattcattttcttcatataaatagttcaaatcaaatttcagtcaccatatcattacccggtgcaacgcacgggtattttgctagtattatacaatatttatagaacttttgcaaaataaagagcgattaaaatttaataggctgtgtcaagtaaaaaaaacaatcaaatactaaaagatatgttacgtactcccttataagaacatctgttagccaatcaaatcaaggtatatatacatatttaattaaaatttaaaaattgataaggacgcaaaggatatttcttgccactacaaatttgcatgagaattgctagaaataaagttttcagggttggagtagaattttttttttgttagttctactttcgtgagaaatgccccgtcattgtaaggtctaaaacattatttgaaattgggtataggtattaataaactaggtgagtttttagataatggataaaatccagtgtttacttcaatagaagctatagccattattacatagttcttagttgaaaaccaaatataaactaggtgagtaagtggaaaaattaaataagaaatattaaccaaatataaactaggtgggtaagtggaaaaattaaataagaaatattatgattggttgagacaagggactggatactcaattgctatattctgatataaactttgaatgcttatattttgaacgaggaaaagatgttcttttatcataaattcgatttggtcttttttatatatataaaaaacgagtacggtcgttatttaaaaatgtccattttgtaaagcttatttttaaagaccatggcttatttagctgaatataaagctcgataattaatatttttaaaataagtacattttaaataatgtagacttacataaaaaaacagtccattttataaagcttatttttaaagaccatggcttatttagctgaagataaagcttgataattaatatttttaaaataagtacattttaaataatgtagacttactaaaaaaacactttttaatagctatgccataaatagattaaaatatgatgatctttaattgaataaatctacatgttaaatgaacaatttaatgaagttggcctaatcctaccaaatcttttgaaatttctacgttcatgcataagaacatgctaaatggggcgcgccatttggcgcgagattttctagtatagtactaatatttatctgttcgacgcctccaaataattcgttctcgtgtagtcgtcagctacgtaccgaaagctttgcgctttgcatgcagcaccatcaccatctagttctactaataaccagtaagtccatacttctcgatacaactatggattaaaatataaacatgtaaatttaaatgcaaactacaaaataaatataaacacggatgtttaaattcaaactataaggtataagaaagaatacattcttaatttgtagattgagagattgagttttaaattgaacgttatggaaggatggaatataggtttacttaaaagccgtgcgatcggtggaagactaccagcacatcagcaatttttgcaaaaaaaaccctacacttttggttaattacgcaccggtccccgctaatatccgccgtccgatctcgaggtagggtcgatctggccgtccacgttcctcactgtgctggcccttccgcacccgtgggatcgtcggatctctaacggacggtgtggatttcgcaagcctgaacaaaccctagccgcctcgccctcctcctccaatcgcgccgcagcctcgccctcctccttcactcccgtgcgtcgtcactgccgcaactccctcctcttccactccctcaaggcctcaacctactccagctatctcgccgtaccgccgtcgccgcttcctctcgcacgcgcgccgccatgccctcttctcttcattcctcgcgcgcgccgtcgctgtcgtagcttcgtcgtccttcgcctccctcgtgccctcatccagccattgttactgtgcccgcgctcccgcgccggcaagcgagtccgtcatgtccaccagtgaggaggcggggcttccagatccggcaacagcggcctcctcgctggtggattgtcggttgcccggacgagagggatgcgagccactgcactcctcttctcctctttcatctcatctccacgttagcctctctctccctcaccctatcctctatgcctgatgcgatcccaagtccgattccctcgactttccaggtggatccggtcgtggccctcttcggcagtacaacgctactctccactgtcttcctcacccgttctccatgccgctcacctcccctcggtgccaggatggggagagcaagagcagcagcttgggcaccaaagccacgacggcggaaggcatgggctatggcaaagtacggcgacgacggcagcaaggcacaaactatggcaaggtatggtgacgacggctgcaagtaaattgggacattgtgcttcggtttttctcctagatgttcttcattctttcaacatgactactgctaaaacattgattctccctattatatgcatatatacatatctgttctagcgcctgctctctattcttgatttgctgctcattgtgagtttcacatgattggtaggaaggaaagaaaaaagggagtgaaggctagattattcagtactaatgtttaaacatcaccacccaggtacagatcaaattaatcatctccttctgtcatgcatatgttgtatatgaattgagtgtattgatattatgattcggtttgtctcctagatgcccttcttcattctttgagcatgagttttaacagatcatttgtctatacaaattagttttacctgtttgcacattagtgttgcagtattaatacgaactgttgccatggtctagctctctatgtactttttggttgggaacacaagagtgacatatatgcctgtcattaatctataataataactgcaatgctgtattttatctttagaattacccattgtctaaggatacaaaatatccatatgtaatttgaattggttagttcttacattttgcatatcaggtttattagtaccatgaattccgtttccataggctttctcaatatttgatacaaccaaaatttgctatattgactacaatgtgctttgaaccaaacaaatatgttgtaggtctgttatctactgtgcaatttggttattggaagtaatttatattaccaacttctaagccttttacatttcaccgttttagtttgttggcacctactgaacaatatttttcccatccaaagtattcatgaggttattttctgtttggaggtctagacagtcttctctggggtgtacattattatagttccatgatacatgccggttatttttgttgttatagtgagtgtaaaggtgaagccaattttattttccaaatggaacatgcaagccatgttaaactaagttcttcagctttcatccttggtaataagttcccttttgtgcttcttatcaggtgtgcaaatgggaaatgagcagcgctgtcagaaagaaatagaagacactaaacatggacttgaatctggaagtattacatatgacccggcaaagcttaaattttctgatgacatcaaagattctcggtgaacctgacaatcttgacatattattgcatccagtgttccaatttggcaagtccaaaagtaccatttgtttatatctccatttttactagctcactttcctgatatatgtatgatagatcattaggtgggcagttcttcctgccttcttcacattgtagttctcagtgtattttctctatattcttgatctatacatggacttggaataaggtgttcaccctgaataaggagggaggtcagtacatttttcctaccttaaaaatctgaagtatggttgaatattgtattagatgatattcagataatattgttagtttataacaggccagttggtttatacctaagccacttggtcaatgcaaagctatatattctataattcctttatttcttaccaaggaatgagaatgtgccagtatgttccttcccatgcatttgcctctgtttgattttttattgatttgttgctcctctatttttgcccctatatttatttggatactggagttcattcaaagagacgaacctcatggtcttcaggcttcagtttagacagataattgtagtgtctttaaagtaacgatgttatattgcggtacaagtcttttagccatcatatctggagtaggatccattatcccgggaattatattgaaacaactgcgatggttaaaaaattatatttaggaaaatcagttgaagattttgatattggccagaatttaatagaccacgaatacacatttttgcgatctcttcattatctcagttcaagctctgtgtataacaagataattggcaatatgttgagacatgccctgaatatagatggcagtatcaataccagatataaatggctaaaattgtttatatgaatgcgcaagtgtgcacacgacctaacgtggcattagttaccgggttacttggcagatttcaaagtaatccaggcctagagcattggaatttgtaaagaaagtcttgcgctatttgcaaggaacaaaaggcctcatgctgtctcacagaaaatcagaatcgctccagatagtggggtattcagattctgactttgcaaaagataatacaaagtcaacatcgggatatgtgttcaccctggtagtaggagccatttcatggaaaagctcaaaacagactatcactgcagggtctactatgtatgccgagtttatagcatgctatgaagcaacggggcaggtgaactggctaaagaagttcatacccggtttaaaggtggttgacagtattgtgaaaccaataaagttatactgcaataacgaacccgcagtaatgtactctcacaacaatcagtcaagtggtactgccaaacacattgacataaagtactatgttgtgagagacaaagtccgggatcaaacaatcagtctcgagcatattataacagaaaggatgctcgcggatccgctcacgaaaggcctacctcccaacatgttcaaggaacatgtagcatgcatgtgtttaagggaagccttatgaatcctggactatagggcccaaaagttaaagtatctgtttctgaatagagatgtgtatagtggctgtcgaatccagcggtaattaaccgtgacgatgaaacatgctctatatgtaaacctgtgatggaatagaaaaagctaaaagaaatagtgagatcaagggggagaatgttagatggatctccctctccttgagcccaacggctcaagggggccttgacccgcgccctgatcgggggcgcccagcccaatggctggtgggcctccgtcaccctgcgccatataaagaggggtggagg

SEQ ID NO: 69092 - DNA, 6656 bp, Oryza sativa
cactccaccccacaaaccctaaccgatcaagggggcacagccagtgacgggaagactccatcgtcgcgccatgacctcgccggaatcgcctacgaccgccactgccgcgcagcatcgtcgccgccgcccacgtcaagcgcacaacgacaacgacgatggccggcctcacttcctcctcctcaacatcgaccggtcacatccctaaaccctctcacttcctctttgttagttcatctattgttgttcatccatccaaagtgttctaccgactagatctaaacctaggtaatccaatagacaaacctaacagttagtactcaagtgaggcatacatagctttgcagagttctttctgcaactagtcaagtgcgcctcccctgcccttcttcccgctcgccggcgtccgccgctcaatgccgctctcggagtcctccaccctcgcgacgtcggagctcatgccgccgaaccagaacgtgctccacttgaagaacccgccaccgccaccgtgccacctcctctccatgcttagcctgtccacctgagcctgcagcgcgctgcactggacctgcacgtcgcgacgaagacaatgacgaacacctcaaagctttgaattgatgaacggtggcggcggagatggccgtgatgaaaccgtacctggaggcgggcgaagtcctcgcggaggcggcggagctcgtggtgctgggcgagcacctcgcgcttggagggcagcgggcgccggggaggtcgaataccaggctgggcgcgccgaaggaggcaccgccgctgagctcggcgaggcggttgagcttgccgtgctcggaaaagagcatctgcagcacggagcgcacggggaggcggtcattctgaacggcgtgcgccaccgcctccgcctccgcctccgcctaccctcacaagagaagagaagaaaataaaagagaaaagagaagaaaagggaagaaagaagagataacgtggcatgctgacatgtgggtccacgtgggtcccacgctgactcagccgccatgtaggataaaactgggatcaaaaccaatacacggctatatgatattcttattattctatttctatatttactcatattctagtttcataaagctatactttagagaaggaaagagagattctaggaccacttgcccataagaataagaccgaacttaactacctgtaactgtcccaactgcccatgtgtactaaccccccgaaatcactttccctactgctacgttgaaatgaaaatgcccgcctccaatccacttaaagctcaatccaaaacatgaaagcggaatcacaactctcacgaaagaagggtctcaagcagtgttcatggtcactccaaacataggattttcggcatatactctttgcgaggcttctatctagatggttaggtcacaggagctttgtgggagaaatggatttctagtaaaagctactgcaagagatttccaattgggtagattaagcctaacctgttaaaatccgcgagccccttcttatattcggaactggtacagtaaaagctcttgtgggctcactccaggtgtagccgcaatagcaccagtttttatatctcttggctttacctttttttaaagaaatgtatgtgcgtagttcaagttttcgaccgattcaccaaggaatattttggttgcttttggcggattgcttactactaggttggatcagatgtcaacctgtggaggcaccatttgttactattggacaagttccttctttctttttcttcttgttctttgccataacgcccattccgggacgagttggaagaggaattccaaaatattacacggatgagactcatcgcaccggatcagtctcttagacggatgagactgatcacacctgatcagtgatcaattctggcacaatgaatttacgagttattttacacaatgaatttacaagcagatgagtttgcaacggtagacctatctcctgaaaagagatcagtaaacaagggaacgaagcgaccgataacgtcccctcggggaggagtgttttaagggattgacttcggctcctattatctttgtttacaaatcttaaaattggtgaattggttaataggaagtgcgcgctagcacgcttcatatttctagtaacaagggcagttgtttgtttggacgttagatcagagggcgctcatcccttgctcggtccctgaaaatgagataacataggcttttgatatctgctgtgtcaacaagccctggttcaatccctgcttcttccgggccttatcccgaaagaggtcaacaattctttttgtgtaaagccttttgttcactggtcttcacttcaagcaattccattagtccaagtctgctgcaattggtaataggagactagaggttgggacgcgccgcctgcacatagatggattaattagattattttgctgtttttaggctgaactactggtcttgtaagattaaagctgaataaagttgaaggcacatataatatatatgaatcaaacggcttatatgttagccattggtgagtaatttcgtacgagtggtgttacagaatctggagagaacaaaactattacatagccgttatactctaagaatgaagcactgatgcatatggaaaatgaaatcacatatttgcacgatgatatgagatcatgacgagatcttcactctaccctttgcaaggtcgatgtaacaacttggtcagaagagtcaggcccctgctttccttggctttcctttgatgagcacaaaaacatagttaaattgtctaagagacccagttttggaaatagatgacaaacagtttgatgcaagatggtttttcacactgaacaaatatagatgtaccaaatataaactctcggagtgttagagatgtgtttgactcactaatctcatgttacctttggctaatggtctttgctctacttttgtcctgtcttcgccactgcctacctgtaccgaacagagtgtgaccttcgactatctcctgcctattttttcttgtcgaagtcatcgttgtccatccatccatgaattggttgaacatggcaaagttaattcagactaagaattcaatcctattggccagtatgagccaaacacattttggcgttgttctcaccttcctatataagccgggagtagtagcgcttctgctcgtggccgttaggctctgcaagaagcaacaacaggtcagatgtcacaggttgagtcgagcttgagaatggcgtcttcagctgcttccatgctcgacatggcgttgctacttgcagtttttgcctccatcctagcaggtacagaactctctcactgattttgttcccctgcttttcttctagcatactctgcttctgtttagttcttgtgttttttgtattagcttgcaatgcgaaaagtttattgtcctatgtgaagagttgtgccgtgaaaaagttgaaattggtgtgcaagccattgccgaacgtacgagtgagtttgttgatttcaagtagtggagttactatcttgcacattagtactacatgacaagcgttacgcgagatactcatttagtgaaacggtaacacggtaagaaaacaaaacatgtaagcaatcgagcgtagattcaaggacgcatctctttcttcagcatgaacgctatgcatggaaatatacaatgcaaacgtttggtttgatgaaacacgggaaaattctcaccgttcctgtgaaattcgtgcacgattacgcatactactgtattaagaaactagtatggtaccacaaagctagattctgttagaaaattaattggttttaggggcgtcattaagatgcatgatgtgtgatagtttaccagcactactgcacgctagattacgattccttcaggagaggtgaaagtacgcacgtaccagcttgtcagtaactcatttgcccaaaatctatggactaggctgtgttcgttccacgcacgtaaaatggagcagtctagtacatgattaattaaatattagcatttttttgaaaaatcgattaatatgatttttttaaagcaactttcatatagaaaatttttataaaaaacataccgtttagcaatttaaaaaacgtgcgcgtgaaaaatgagggagatgagttaggaaaattggagaaagaactcagcccgatccctttgatggatgatagcacaaactgagttcgtaacagttatttgagagtaattaaatattagaaaatttaaaagttgatttaaaaattgtttctaacgagggcggccacccgtttttttttccgttcgtcattcgcatctgcgtcgtcgtcatgagatgatcgatctcgatcttcttggacggcatgtcttcgtcattacgtcgtcttcgtcaagtcgcgccgccgagtagatcgatctcctcggcggggctcgtttttcgtcgagtcaacagcagctacgtcgatctggtgatcttggaagccacggcgtccgtctctgctccagccccgtcgcccgagttccgccggcgcggccccgacggccggatcccgagccgctcggtccatgccgaccgccggatcccgagccgtcgccagcctccaccacctccagatccactcagccggttcgccggctcatcctccgtctcttcaccgcgccgaggtccacagccggcgtcgccgggctccctctgccgtgccgtcttcaccgtcgacacacggacgccatcggcgcgccagggccctgcagccggccggactcatcccggccgcatccctgcaccgccacgccctccgactccgccgcctttcgtctccaccacctgcgccctctcctgacgtcggctgtcagcaccgccgggcctgacacgtgacaccctgtcctgttttttttctcttctgtgaacttgcttgactgcaagggaggagagagagaagtgtagacatggagtttcatggatggctggctctggctgtggaggtctggagaggacagatgtgcatgcgtcattggtgctggtaccgttgaggcagagagattgctggacttggtctatggaccgacaccattgaggaagagatgtggtgttaccgtgttgctgctgctgtacatgtgtgtgtctgtttttttttcctgatcatagatcgggtttgcgtcgcccaccgcctcgtcgacttctacacatctccgacatcggcatcgactctgctttgacttcatcgttcagccccacgcatcttcggcttgatcacccgttcaggctcccggctacaacgacttctgcaaccgatcgtcatcgagcatgcgtctacgccattaagcttcgggttgccgctgcgtcgcccccttgggccgcagtgccaccgcccgtggtccacctccacttgttgttggaacgctgagaggcgccctcctcagcatggcctccctactagtggagttctcgccgctgcatcgacatcaagctgcacctgtgtcgcccctatgggtcacgatgttgcccctcgtcgtcttcatcgccgttcgcgcttcgacaccctcgtcatccgcactggtcatcgtcagccgctcagggtcttcttcgtctacttcgagcatcgtcgccgcatctccaagctgccaccgtcgccgctctaggccggtggtccagctacctctacatggttactgacgtcgccatccaggccgttggtcccactacttcgccttcgtcttcgtccagcatgattcatcgccagtgtcaccgtatcttcctcgactacacttcgctcttctccggcaactacgtgctactccggcaattctccctctacgtcgttctcgcgccgcgaccgtcccggaggccttctctgctagtctcctccgacattggcgtatgattcatggtggtcccctactaactttcattgttgtagacatcaataagtggcatctacatcagcaaaataggaagatcacttccatttcgaacaataaaataagagataatccaacaaatatcattgacaagcggctaaatctaagaaataccattaacaagttcgccagcgtcgcctccccatgattatatatatgttccaagaatatcgaattctcgcttcgaatcccctctttggcttccccatgttttgccgagttcaaatattcgatttgaattcaaatcccgcaccaattgcccccaaatcccttaaagcgatttcctggtaaaagtctactttacctccctcatattcgcttgggccgaatccggccatggcctggcctgcatctcctctcccacgtgcgtcgcgcgtgaccactctctctctctctctcgccgcttcctgccgacgccacccaaaatccggccgcgtcgttcgattttcacgcgcgcgcgcgatgaccgaccgtccgcccggtcgccgctgccgtcagcactgggctgcctgctgttgttgacggtcgttatcgatcagtttcgaccgtcaatattaccaaaatagaggagaactagtgatgcttgcaatttatatatactacctccattattttaatagatgatgccgttgactttttctcacatgtttgactattcgtcttattcaaaaaatttatgcaaatatataagatataaatcacacttaaagtactatgagtgataaaacacctcataacaa

SEQ ID NO: 69093 - DNA, 7829 bp, Oryza sativa
gtcaacggcgtcatctattaaaaaagaagagagtatgttagaataataatattccactagtattaggttcactaaccttgtgcggagaataatcataaagtggaggagaatcgacatcaacacagacgataaatcaatcggatgatgtcgagaaccagacttatatatgaatggaccaagactcggaattgacacgacaaactgggccaaaattcacaagtctgtggagaagaacaacggaggaggccgccagccgaaattgggctagattgggcaggccccaggttcggctgaaccctcctcagtgccatccgatccagggcttcgcctggaaggtgtggattagcccccaatgacggttagagggtatttccgaccattccaacattcacaacgtcattggaaggctataaaaggagttgccattcccacttcactcacacacctcaagtaaagttctctcatattctctcaagtttagtttagtagtatcaagctagtggaataggaatagagtagaaattaggagtccggaagtcttcgaaagagttcgggtatggctttagtagctttcctatcttcttttgtaagctttgtagtattattaaatattcttctttatacatttatggtattggaatactttccgagagtatgaatgccaattttacattatgttcatgttatactgaatatgctgctagcttatctgggagatgctttggtgcgggtataatgtttacttatgcatttactctatgtcatgatgatgatattagagtagtatctggaagtttagacgtggtgtctagattacgtgatatcattatttggggttatatgctgcggatgagaggtgggccgctgatggtgacagctcagtacgggtattcctccgcgcgtgtatatgatcctaagttaattccctggggaggatattcctccgtatttagccccgattgtatggtcatgacgggctgtcataaggaactcgacagttaggggtggcttctcgaagtaccaggagggcatcggatagagagtattagctagtatatcagataactagaatgtatgtatactagaagtataggaatatattttctttctcatttctttccacttagcttagataatatattatgagaatgagtagctattgcttgtgtgtcactctacccttggattatcttaacccctgctcaggatatgattatcacaagtaatatataaattattagtcaagttctctctacatgatattctcatgggataaaataaatacgatacccttgggtgaaatactacaatggtatatgcgtgagcttacggataaactctgtaaccataatataccatgaatatttctgcgtcattgttagaaattatatttctagtaatatcgttaaaaaataccaacacctgcatcgcgtgctgccaccttgtcgccgctccacgccgcaccatccacgctatcaccgccggcgtcatccttccgcccctactcctgtgcgcatgcgtccaaaggatggaggcagagccctcagccacgtccccactttcaccacgccgtgcagctgctcctgccctagtgattcgacttccaccgctcgatccaccgcctccaccaccgagcgcatccccgtcgttcgtcgttttcatgtcgcccgtggttggcagccaagcgccagctcgcatgctccccctctaaaccgactatgccgctcgcaagctcccgccctccccgcctataaattccactccgggaccccctttttccctccccttgctccgtgcctcaaacggtgaagccatgccgcttcctccctcaactccggtcgccgtcgcacggccaaccccggagcaccgccgcctccttagtcgcggcggccaagaacgccaccgccgtgaccaaggacgccaccgcatgccccggtcgttcacctttcttatcctctctttgtcgtgcctactcgatgccatgccgccggtgagcacctcgctcctcccttccattttcgccatggccgcgctcctctcatcccttacccaatgccgcactcgctgccgccgttgaatccttccccggccgcgccatctcagcgccacgcctcctcggcgtgcgttcgcgcccatgcctccgttcgtcggtgagttcctcgcacctcttctgttttgccaccgcgggcgccaagaaccgccgtcggcttcttcttcctccccccggtcgccgcgtcaccctttccctcctgctctgctcccgccgccgcgcgtagtcgcgcgtcaccgccggttggtcgtccctgcctctttctcctccagcttgctccccttctttcctcctcttctcaccgcggccgctcgccacgcctgcgccgcgctcggccatgcgccgccatcggtctcctcataccgaacccctcgtatcgtcgcgcccccttgagccctagagaatctccccgggacgccgccacggctggccgcctcgccggccgcgtccgcgccgtgccgcccatcccgccgccgcatggccgccatcgcgccgcctctccctcatccgagccggtggatggaaccgccttgagcccctctcgcttccggtgcctgccggcccctccggcttgccgccgctcgccggcggcgttgcgccgctgtgagccgtccgatccaggcgcctcctcctcccctctcgccttgccaccgtggctgcccatgtggcgtttgacccagtccatggtgcccagtcagccgccccctcctctctctccctgctcgtgggcttggcccattggccaaccttcttcctcggcctaaaaaacaaggaaagtctatctttactcccttccccaaacacagtggccaaaagtccataattgctccctccctattcactcctctctcaccatatgttggccccacacgtcaatgagtgactaaaaagaatattcttttccacaaattcaataaatcatttctttaatccagaaaattcaataaatcctttttccgttgttccacaaatattttccttcctcccagaaaattcaaacaaccttcgtaaataatttctcttattcccatcggataagtacatatcctcccttgtccacaaaatttccacaaattgttttccccgctccaaagaatcaaataaatcatttccttgtccagacattcatttaaagcctccaaaaattcatatctcccgatccgtgactccgattgacctcgttccacttccagtaattccgtaaaattgtgatctatctaatggcactattattttagtctaaataggatccttttctatttggtccttgtttagatttttgattgtatgcgcctagttgcggttaccggatatttttcgtcaagcggatttctcgaagattcgtgaagaccctgagcaaggcaagccacctttgaacatcttgagcctatatttgaacttaattatattgattgtaaaatattattcattgataggattgcacttaatatgtttgccccgcctgcgaggcagattggtgggcctacctaacttgttgcatttgatccttccattgttaattgctatatcatgctcccttgtaaccacctggttgcgcctcggtattcatacactctgtgcgagtatcgacggtcgcctttaaaacttaaaatctgagaaacatcttgggtaaaacttggtttacgaaaggattggaaaacccgacgcctgggtcggtgccttgtgaaagaaaatgagttttaaaaataaaactcgcgacacaaggccattcctgggcggaatgcttgtgcggtcacatttaaggaccgattcctttggaattacatccgagcatataacaagtgcgaccacatgggtggaatgggacacccctggctgagtaacaagctaggccagggaagccttgatgccaagagacaagtggattcgccggggtggtgtcggggaggacccctgggcttcatggcacagtatggtctgggacctaacctgttgttggtccgggacccctctcgttggcatatggcaaccctgtgttggctttggaaatgccttgtcgtgaaagccccaagtcaccagacgtgtttgatccgcacgggctaggtgaccaaggctagtaacgtcatgtaggtaaagtgtaccccctctgcagaggttaacaaactgttcgaacagccatgcccacggtcatgggcggatgtgaggtgattccttagcgtagtttttgttttacccagctttgtgaaaagatgttgaggtttgggaaacctgatgtttggataaagcaagcggatgtcagggagacagcgggacagggagtccctgagaatgactggttgtttggagacaaccaaaactctgaaagattggaaaattggtttggtttgggaaaccaactttgaggccaactctgggagttgtgtaaatcttgcaaatcaaatttggttacgtctcgcccccaaccaagctgagacttgtctcgctctgtttgtggaaagcacacacttagattgttgaaaacttgaaaacaaatttgattgctaaaataacagcctttccttgaagcttgaattaaccacctaagtccccctggcttgctgagtacataagtactcacccttgctctatatatatatagttctgccagctctgaaggtgaagttgaagtgaagtgaagattaaggtttcgtcctagttccctagtattgcctgtggtgttgggtgttagaccgttggttccactgctgctgctgttgttggtgtttgcctcgtccgtgtcgtcggttgtattctcgggttgtcccgagctgcaacctaagtcaaggtaaataaatcctctatttattttaaggattgcaatgattcatatttgtcaccgtgggtaccagcgctatgtcctgggactggtactgtgatcgcggtttcgtaggaagcggttcgcgccgtttttcctacgacacgctcctgtcaggtgccgttgtacggcggtgccggatcagggtgtgacacgttcccgtccaacccagccccgaccctccccgttgccacccctagttgtaatgatggtttgtgggttggttaagctcagaaaccacacataaccgcaattaggactccagtatcttgctccacgtgttggcagatggcgaggggatgcaaaggcagttcgaccgaacttctggctcacctaccggccactcattcggttgggaggctgcctggtgggcccccaacatgttgtactttggctggactcaattttaggtggttttgattgacacgtggggcctccaaaccgtgtaatcgtgtccgattgtccggaggtgtatttggtcacatggcggatgatttttgtccatatatttacctatatataaatattcaccaagactactacctctaagtttggtattctattttatattctttcaattgttattatgcatgaattgataaatcgaatttggtacttaaggaccatcaacaccatccaagcaacaaatggagacaccgacaatagcatccatccaagcaaaaagaagttgtgataacaactaccttaattcaatctttgaatttttttttttgcttaacccgactactaccacccatccaagaacgaacaatcaagggagacatctccgacgaccaccaaaccagccaatcacccgtcactatcggttggtagcgcgccggagaagaagttctggagcatgatgaggttcacaagaatgggggcaatggtcctgttcttttctccaataaaagttggatgaagattaagattttcgtggcacgcttttcaaattgctaacggtacgtttcatgcgaaaaatttatatatgaaagttgctctaaaatatcatattaatctatttttcaagtttgtaataattaaaactcaatcaatcatacgttaataccaccttgttttatgtaaaaaacgtattcttcatcttcatctttattttcagaagaaaagaacatcaccaatgtaattacagacagtgctccagagtcctcagccatcggcgtattctggatctaagtgaaggatagcgtaatcaacatgacaacgagaagcgaggaaaatggtgacgccgtctcttcttgccacttgcgacggcgatggctgagggtgctctccgaccagatcggtgtctccattgcccgctgacccacatgtgcacggtggagagagatggggagacagaggaatgaggaagaagaaaaggagaaaggatgggaggtagattcaacgaaattctttcaattttcatggtacgatttaccattgtcacgtgggacaaaaccacctaactaaaccgctgggagactcgatttgcactagtatatctatatatctatctatcgattatattattaaaacagttttgaaaggaggcaccacgttcgctgtgggggctagaaattcccacattaatcggagaaaaagaaaaaaaaataaaaggagagtccaagtagaaatacaatctaaaaatagctggaattcggaattaaaaataagtaatattgaaataagttttcatataagaacccagtacgagattaatcaaaattcaaaataaaaataaaataaaatccaaaattagaaaaaaaaagcagagtccaagtagaaatacaatttaaaaatagctgaaattcggaattaaaaataagcaatatagaaagaagtttacatataagaacccaatacgagattaatcaaaatttgaaaaaaataaaataaaataaaatccaaaattagaaaagaaaagatactccaagtaggaataaaattttaaaatagatgaaattaggaattaaaaatatggaatattaaaagaagagtccatataagaactcaatacgagataaattaaaattaagaataaaaataaaaataaaatccgaaattagcaaaaaaaaaagagttcaagtaggaatacaatttaaaattagctaaaattcgaaattaaaaataagcaatattgaaagaagaatccacataagaactcaatacgagaataattaaaattcagaataaaaaataaaataatatccaaaaatagaaaaaataaaagagagttcaagtaggaatacaaatttgaaacaactgaaattgaaaataaaaaataaaaatattaaaagaacacaatacgatattaattaaaatttgaaaaaaaaaattccaaaattagaaaaagaaaaataagatttcaattaggaatacaattgtatcgctgtgggggcaagaaattcccacattaatcggagaaaaagaaaaaagagtccaagtagaaatacaatttaaaatagctgaaattcgaaattaaaaataagcaatattgaaagaagagtccatataagaacacaatacgagattaataaaattttaaataaaaataaaataaaattagaaactagaaaaaaaaagagcccaagtagaaatacaatttaaaaataactgaaattcagaattaaaaataaggaatattgaaagaagagtccatataagaacccaatacgagattaattaaaattcagaataaaaataaaataaaatcctaaattagaattaaaataaaagaatatttcgtatagaaatacaatttaaaaataactaaagtttgaaatttaaaataagcaatattgaaagaagagtccatacaagaaaccagtacgatattaattaaaattcaaaataaaaaacaaataaaatccagaattagaaaaaaaataaaaagagatttcaagtaggaatagaatattgaaacaatccaaatatctactattataaaaattgaagatgtttcca

SEQ ID NO: 69094 - DNA, 933 bp, Oryza sativa
aagaaaccctaggtgctcattccaccgccatcgcctccggcgaactctccaccgccccctttcctacatcccaccactattttataagccagcccttcatctcatctggagatctggttctactcatccaggaaagccccaatctttatcatagcaaggaggtcatgtcggaatcggccctcggtaatagttacatcaaccaatttttgttatttcagtacttctttcccattcttcttcttcttcttcaactcggagtcttctacggtgtatatctcttccatctccaaaattatttgcgaatcgccctcagatctggagctgttcctcatgtcgaaatgtcaaatctataattctgatctcttctgaaacattcagagcctaattaccgatttgatttcttttcggcgtatctagtacagcaggaggtattgttttgttgaacagaaacatcaatcttattttttgatttgttcgatttccataagttttacacatcactcgttcaactagtatgtgaaaaacttctttttaccgttcatttcacatatactagataaatatctgtgatttgcgatggattaaaataaattaaacgcgtgctaatattgcttggaacaaattaattgcgaggttttggggacagtttcgtgcttgtagattatgtagaaggactattttgtaatattaaaacacgaaggagtagttggtaaaagaaataatctatacaacagagttggtgtggtggccgattcacgccaccaccactgccttctttaagaatgaagtataggtttctatactattacacacaatattattatatccagctgtgggggtggaaattcaatgaattcatcaatttcagtgatgcatgtgccgtttgattcaaaatatatgttgttgcagggtatggttcctaccagtcaaact

SEQ ID NO: 69095 - DNA, 26778 bp, Oryza sativa
  unsure (1)..(26778): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccggaaaggaatgggctcccctagcttcctgggtcactggctggtgtgctcttcgctaacatgttaatttatctctcatggtttaatcgttatcatgttttaaattttggaatttaataatatttccttattatgttttacaggttcaatattatgggacaggtatgaatatgtttctcacgggttcacaccaagtctaaatcatatatctctactattttaaaagcgaaattgttctacttacatgctctcatccgaatatgcataacgttttacaggttcaatattgtgggacaagtatgaatatgtttctcactggtccacactaagtctaaatcgtatatctctactattttaaaagcgaaattattctactttcatgctctcatccgaatatgcataacgcgtctgttcacgaaaagtaaccaccatccctccctaattatatggtgctggcccattaacgtataggcggctcatatccctaattatatgggtctaattcattataacatacatgcatataactagtaaaaagaagagttaattttacactctcgaactgttttcagaaagtgcagaaatcttttgagggaaaaaagtgcagaaatctgacactccaattgctcgttaactgatcctccagtgggcttgcacgacgagcgtggatttctcgctggcgcagcttctccaggtgatcatcttgcttgccacgggaggcgccaacggcggcggctacatggcgtccaagtacgtcgtgttggccatctactctgccatcctcatcctgcacggcctcatcaacagccttcccatacgatggctctcctggtttggccaacttggagctttctggaacgttgcaggtgctgttcgtcccggccatttttcagatattcagtgttgaatcccatatatacatcatctcattcttcggtttgtctgtttgaacaaacaattccaggtgccttttcgctgacgatcttgattccagcggttgccaaggagagggtgagccctgagttcatctttacccatttcaacgcagaaaacggcgcgggcatccacgacaaggcatacattctcgcagcggggttgctgatgagccagtactcccttatcggctacgatacatctgcacacatcgtaattctgaactttctgatagctgaacaatccttagtttctcgttgcatacatacaattcatccactaatcttctcctcgcatataaatattcagatagaagagaccaagaacgcggattggagtgggccaattgggatcatcacgtccgttgcactgtcaaccatgttcggatggatctacctgattgccctgacatcgatcatgaccgacataccttacctcctgaaccccagcaacgacgccggcgggtacgccatcgcgcaggccctgtacaccagcttccaccggaggtacggcaccggcgccggagcgctcgcctgcctgggtgtcatcgccgtcgccatcttcctctgcggatccgcgtgcatcaccagcaactcgaggatggggtacgcgttctcgagggacggcgcgatgccgctgtcgcgcgtgtggcaccgcgtggacagccgcgaggtgcccctcaacgtcgtctggctctccgtcgccgtggccttcgtcatggctctcacggtgagttgcacacgcgttgctgctgctgctgctgcaaatttctcgtgcgcgcgtacgtacgtgctggtctcatatagtgtacgtttttttggcacagtcgctggggagtcaggtggctttccaggcgatggtgtcgatcgcgacgctgggtttgttgatcgcgtgcgcgctgccggtgtttttccgcgtgacgacggcgcggagatcgttcgtgcgcgggccgttccacctcggcaagtacggggtcatcgtcggctgggtgggtgtggtgtgggtggccaccgtcacggtgctcttctcgctgccggtggcgtacccggtggccaaggagacgttcaactacacgccggtggccgtcggtggcgtgctgctgctcagcctcgtcgcgtgggtgcttcacgctcgcttctggttccaagggcctgtcaccaacgttgacacgtacaacgtaccctgaatttgtatccctggattagctagcgagcacaggtggatcagtaacttaaattttgtgcaattttctcttgagagggaaaaaagatgtgcatcttgttggttgtaatggggacaaagaccaaaataagcccaacgaagggtgctgcacatgtggctcctccatcgaacccaccaaaaagagcaattttatattctttgagaagatacatgaggtaccactttttttaattgtaaatttggtacattttagtacctaggtactacgaggtactaaattttacactaaaattttagtacctcatgatacctagtcaaatactgtaaaattgctccaccaaaaaaagttggccgtctatttggcccatcaccaaattgggtctctaccaatagtaggcaggatagcagatatggtttttgagaagagtagcttactgtgtcatcgattgtcatcttttatagatgtggtattgatagttaggaaaactagcgagaacatcacgcattgcagcgaaacctatctatgataaaacagaaaacaatggataaaaatatgtatttgatcggttgtatatatatatatatatatatatatatatatatatatatatatatatatgtatgtatgtatgtatgtatgtatgtgtgtgtgtacataacttcaactttaggtgtttgctccattagagccaagtcgttagaaagaaaggtagttgccattcgtaagccataacacccatccgttagtaagtaagatagttgacatttatcactcttatgctaataaatttatacccactatgaaaaatataaaaattaaattatagttagtactcaacaattaactgaacaatcatagatgagtgaagaattatcatgatgaaaaaacccgttatgtaaacacttcccgaactgctaaacaatgtatttatgaaaatataaaaaaagttactttcaaaattcatattagtcatttttttttaaatttaagtagttaataatcaattaattatacgctaatggtttagcttgttttgtgtatctttccaatcctctctttttctctcctagaatcaaacacaccccagataacttcttgatcccataaggccataactactatcttcatactaattcaatctaatgataaaatattgttgatgatgtggctctatgtatatgttactttgtaggaattaatattttaataggtataaactatataggaaaaagatagatgcgtgcttgatgaattgaatagacttgtcgccgacataactcggtagttttttttttttgggaaaattcactgcggggcaagttttttgagttacatattaagagagcggaggaagagaagagggtctttcaggctgaaattacaaaacgatcatcaagtttaatttgctcagcctaaagggacgcatcttctatacattgcacatgactcggtagttattggagagatcaacgaaccaagagaacatgggcatcacaggttggcaaaagccagtgcttaatcagacaatcagtggcaattactaaggcatcatgtagtacagtagtagtatagaaattatgttgaacttttctcaatgatcaacaatttgcgcgtgctctaaggtacgtaggaatatgcatatccatgtatatattatatattccaagatagtatggtaaactgattattaaagtatgcgcgtatccacatggattattcctaaccgatcgtatggtcaactgatcattatatagtatgcacgtccacctggactatttccaacggaccatgtattcatatcaactgataattacggccctatgcatatccacatgggtcctgtttggatccggaatcttactatttatgagtattaaacgtagattaatgataaaatccattccataatccctaggctattttgcgagacgaatctaacgaggtatattaatccacgatttgctacagtgatgctacaataatcatccactaatcatagattaatatacctcgttactcgttagattcgtctcgcaaaatagactaggggttatggaatgggttctgtcagtaatatatgtttaatattcctaaatagcaagatttcggagggctatttaatagcccggaggatccaaacaaggccatggattattattgttcccagctgatcgacatatatatcggtttccataatctataaggtagtagtgtttaaattaggtagtgtctgttatgtatattgtctcttaattaacttgaggatgccccacacgttgctgcgggacttggttaatatcaatttgttagataggaggtacaatctcaagaagaaaggaagaaacaaatgactttcttagagaaattctttttagcaaccctgtccaaaatttgtagataatttaagtagcgcattcaaagcataagctacaaagaagcaaaatggtctgacgtaagttaacaaattgtaatgttaactgaatgggcattcggccatgaagctcttttatacggattgatgggtcggatacatgtagatgagtgtggagatgggttaatgtgttcatgtgggctacatttggcactaaggaggcgaagagactcacccggtgcttgatgggttgggctctatgttgcgttccatccaacgtctaagaagcaatctaatgcattcatccaatggttcataattgatgatgacgtggaagcatgaggtttgagcttttggcattaactttatgaaagaagggacgagtagcttaatctataaggatgactcatattccttgtgagcgatattcgcgatatgtctttaaatttggacggtagtgttacttagatccgtgatcttgtaaattacatatttagattcataatcatggtttaatataccagagcagataaaaacgcgtttcaagtgcccacttggttgaccaaggtagttgaaacattacattcaagacctctaaaaaccattgtggaaaaacaattacatatagccactgcaccctatagtacacacctaaaatgtccattcacctcccctcctccctacgcatagtcgatagggacggtggcgattagggcaacactgatgagtgatgattgtcaatgagccgaggcgctttgggcggagcagcaccattgttgacatgaaggcgagcgatggaccttaactttcagggcagcggcacacgatatgcaatccttttgccaaggtggctttcagagatgggcgaatgcaaactttcagctagcatggacaactacgttggcgccaagaccagtcacacatgcttaatttgggtgcaccgtgcacctactctctatgaccatcaagggtactattactatccgagatctatatgacccgatcgtttgtttgtttaatgcagtgcagagaaatgcaaggccaacaagaaatttcttcatgtggatggcatcatcttcattattcttaagagtaaattgtactttgcactatgtaaattgcatcgtgtttcacttgtttttacatggactcaattgctatgtggcaccgctcctgcggtaggaatcactgacatgtaggcccttgagcaagtggcaccatcgacatgtcaaaagtaatattgcagggggttgcttatactttcactttacaccaagttattttaaaataaatttcacttaacatcgggatgcatcatcaagcctataaaatttcataaaatcaaagaaaaacatgttgtgaaatatggtctaaatttaagaagctcagtatgttttactcatattttacaatcctcgtgttcaataataatgtaatatgatgcaaacctagtaaaatgaaaccagctatattactgccgtctcccggttcaaagggcaaagggcaatttactctgttttaatgcacggagaaatgcaagaccaaagaaagggatggctacgataaacgtcgatagcaatcaatcatgcaagtaataaaaaatggcgaagcatgcgaaagcgaagacgccggagtgctgcatccgagcatgatttccagtccctcccttgactcgctgtacaccaaagactttcttcatctaggaagcttatatatattcaattactgagcagcgcaaccgcggagatatcatagagaaaagtagtgagcagacaccgacggcgatgtctcgctccggcgtggtggccatggacgccgccggcgccgatgcagaccaagcccggctgcaccagctgggctacaggcaagagctcaagcgtggcctctcgtatgtgcttcttcttcccttcttttaccacacttcattgcgatcatttttcaccaaattaagcttgtgagtgttaatttggcatatattgcaatcctttgttagccttgtttccaacttcgccttctccttctccatcatctccgtgctgacgggcgtcacgacgacgtacggcacggggctgcgctacggcgggccagtgtccatgacgctgggttggctggtggtgtccgccttcaacggctgcgtcgccctgtccatggccgagatctgctccgcctacccgacctccggtggcctctactactggagcgccaagctggccggcaaggaatgggctcccttggcttcttgggtcactggctggtgtgttcttcgcgtcctagcttaatttatctctcatgctttaatttaatcgttaacatgttttaaatatggaatccgcttaatccttttgtcttctgttttacaggttcaatattgtcggacaggtacgtgcattcaaactccatgagttatgtagaagtttataaaaaaatatagtagtattttcagtacaaaacaaatctattataaaatatattaaatggtacatttagtgagattaatttgatttgtagacgttgctaaaattcttataaatttaaaagtttaacttagaaaatagacaaaacgattaataatatgaaatggaggaagtaattaatgagccatgatttttgaaagtgctttcaaatatgaatataattttattcctttttttttctcaatatacctttggactaattgttgttcaaacttcacgatttcttaaaaataaataaaaaaagtacattttgcactctcgaattgtttccagaaagcgcagaaatctctgacgctccaatcgctcgttaactgctcctccactcatcccagtgggcttgcacgacgagcgtggatttctcgctggcgcagcttctccaggtgatcatcttgcttgccacaggaggcgccaacggcggcggctacatggcgtccaagtacgtcgtgttggccatctactctgtcatcctcatcctgcacggtctcatcaacagccttcccatacactggctctcctggtttggtcaacttggagctttctggaatgttgcaggtacagtcgactcaacgtcccgaccgtttcttcagatattcagtctgaacatttacatcatcagatcatctgatcgtgatttgatctttgttctgtttgtctgtatcaacacacgatccaggtgtgtttgcgctgacgatcttgatcccatcggttgccaaggaaagggcgagcccagagttcatctttacccatttcaacacagaaaacggcatgggcatccaccagaaggcctacattctagctgtggggttgctgatgagccagtactctgtaatcggctacgatacatctgcacacatggtaataaatctgattgttgaatgtcctgaacaatcctactttctcttcgtatgcattcaactgatcgacgaatcactgaatctttttgtctgcacattcagatagaggagacgaagaacgcggattggagtgggccgatggggatcatcacgtccgtaggcctatcaaccatgttcgggtggatctacctgattgccctgacatcgatcatgaccgacataccttacctcctgaaccccagcaacgacgccggcgggtacgccatcgcgcaggccctgtacaccagcttccaccggaggtacggcaccggcgccggagcgctcgcctgcctgggtgtcatcgccgtcgccatcttcctctgcggatccgcgtgcatcaccagcaactcgaggatggggtacgcgttctcgagggacggcgcgatgccgctgtcgcgcgtgtggcaccgcgtggacagccgcgaggtgcccctcaacgtcgtctggctctccgtcgccgtggccttcgtcatggctctcacggtgaattctaagtccattgctgctgctgctgctgtaaatttctcgagctgctctgatttggttgttttctcatggcagtcgctggggagccaggtggcgttccaggcgatggtgtcggtcaccacgctggggctgtacatcgcgtacgcgctgccggtgtttttccgcgtgacgacggctcggaagtcgtttgttccggggcagtttcacctcgggcgatatgggctcatggtcggctggatggccgtggtctgggtggccaccgtcacggtgctcttctcgctgccggtggcgtacccggtggccaaggagacgttcaactacacgccggtggccgtcggtggcgtgctgctgctcagcctcgtcgcgtgggtgttccatgcccgcttctggttccaagggcctgtcaccaacgttgacgcgtaaaacgtaccctgaatttttgtaaatttgaacgcgcgtaccctgatttgataaatttcaatttgaagcgtatttgggtttgaccacgaattggatccgtaccgatccgttaaactcaaaatttgtgttccttttggaccgatataagcccaacgaaaggggctgtgtaggtggctttcctaccaagcccaggtaaaaagtgggcttgcatttggcccgttacggaatatgagcggtcaacatgggccggattggtttaacagcttgactttgggccaccgtgaaatgagtcgctaatcctaggataaagtacactgaaggtccctcaacttgtcgtcgagttacagaaacgtcctctgacaagatatatcacatccctcaacttaacaaaaccgtttacttcggtggttggttttatgtgacgtgacggttgagtcagcagacccacgtgtcagatgccacctcatcacttctctcttatttcgcctcttctttctctcgctgtgctcatctggccaggcggcagggtggccgacgggtggggactggggaggaggcccccgcgggggcggggaggcagaggtccggcggccggcgtccttcttcttcgcttctttccgctaggcggagtcgccagcggcggctttctccaccgcgcgcagccgggagggaggtgagaggaggaggtccggcggccggcgtcgcgccctccgcccgcatcctcgttgccgccgctgtggcggccttcttcttctcctctttccgctgagcagagtcgccggcgacggcttcctccatcgcgcgccgctcgacggggggatgccgatggcggcggggccgcgtctcgccatgtagcagccgtcgatgatcctcgcgccgttgaggagcatggcgaccaggagccggcggcgaacggagtcgaccaggctgcggcggcgaacggaggcaaccaggctgtggcggcaaacggccagccgccgaggtcgcccgctgcagcgctggtgaagttaggatgatgccttccagttttgctctgatatgagggaacaatgatgcctggaaaataccagctactgacaagcacaagggaaagaagaatatgaagcatgtaaaatgaacatatctgcagccaaaccatttcaagttttcaaccaggctattttgttaatgctttgcaccattgctctgcccgtcaggatatccaattatccattattcacaggcccaaaggagtagggtcagtttctaaacctcgcctaaatagagcagagaaaaactacttattgttacaaggcataccttcaaaacaacagctcccccagtggagtgaccaagaagaaaacagaggacccctggattctcaagcacaattttaccaagaagtacatcttgtttgaagataataatatatttcataagtaactgaatgaaggaataattgcaagactgcttgcttatattcagacttactgtatcttctacaacataatctagtgaaggcacatcaccatgtagaccatcgctgccaccatggcctgacattgtatatgagttagagttagcctgttaatgttcaaaataaaagcagaaccaaacagatgttgttgataaaaaaacaatgcaaactgcatggataaaatcaatgaaattgcctactgtattttgttagtaagtgtgcactgcagagtcaatttgtgctatgagtgaacagaatgtggtaacattacaatcatgagctattctgaataaaatttcatgcttttgtccataacaaacggtaatactttgttattttgattgcaagcaggccgccgaggtggcctgctgcagcggcgtctgcacgacctcatcgccacggacgccttccaccgcgaccaccaggcaccagcgccattgctcccgccaccccatgccgctcttcttctaccgtctcgaccactgggcctaccccgaccgcgtcgcgtccacctccgcggcgtcgacatcgccgcccgcgagtcccacccggtcattcgcttcgcccacgccgacgccaacctccgccgtctgccgcacgcccggtcatctgctgcacgcccgcgccccgtctgctccgccggccggccgctccccgcaccgtcgcctggtcctccggcaggcccgtgctgcgggtgcatctgccgcagccgctccgcccgccgcccgcccactccgcccgccgcgcgctgctcctccccccgccgcccgcccgcagctcctcccgtcgcccgccgccgcccgctccgcccgcagctcctcccgtcgcccgccgccgccatcactgcagccgcgtcgcccgcgtcgccatcaaattggagagaagtgagagatgaggaagggagagaagagggggagagagatgacctggcattatgacatgtgggactcacgtgggttccacgctgactcaacagccacgtcagataaaatcggggtcaaaaccaccggaggatctatagtgaacggttattagttgagggacgtccgatatctggttttgtggttgggggacgattttataactcgatgacaagttgagggaccttcggtgtactttttccctaatcctatcatgggattcgcttgagccgtcggatgtaaactgcgtggtccagatcgatgcggatgcacctgtcttacgatgtttgcgacggggacccacgataggaaaaggtacacccaaggtccctcaacttgtcatcgagttacaaaatcatcccccaacggtaaaaccagatatccagtgtccctcaacttataaaatcgtttaatttaagtcattcggtgattttaaccccggttttatccgacgtggcggctaagtcagcgtgagccccacatatcagtatgccatgtcatcccctcctctatctaacttcctcctctctctctctctctcacacacatttctcctctgtgctggctgccgacgggtcggaggaggtcgctgggcgaagacgggcggcggcagggggagaccggtggcacacggccggccgagggtcgcctgccgctgtcatcgccgcggccgttggacgccgacgccgacgtggaagcggtccctgagctcactgtcgtggaccccgacggtggtgaggtgagcaaggatgtgcggggtggtgggggcagccgtgtatgcagaggcaacagagacggcgggcggcggacgacgtcgaccatctggaggcggaggcgcgccggtgccgctcttggatctcggccactacgcgggagtagatgaggttgggagcggaggaggcccgcgggcaccgagcggtgtgtcgtcggcgcgtcgccgccctcaccgacgacgtggagagcgccattccagagagagacagatgtgggtgatggccaacgacgcggcgctccaaaaagttgctcgtaaggtcgaagcagccggggcggctgccctggatcgaggcgctgcagatccatcgtcggcggaacgaacgagcagcagtagagggagcagtcaatcagtcatcacttccctcccttgagtattaagagtggttctcactcgattcacttgcacactctttcactccactgctccagtccagtgtgttcacatgctctgccccaacgcaattcaagcaagcagatgagatcgatgatgcgtctcatgatttgctgcctcctagtctctgcgggggccgggggaattgcaggcgagggcaacttggacgtggcgctcctcctgcagtgcgtgaagccagcgctgcggagggaaggcgggaacacgcagctggccacctggaccgcctccaccccgctctgcctgtggcgcggcctccgttggtccaccgccgccacgctatctccaccgaatcctaggaggccgctgcacaacccttgtcgccgtccttgctgccgcatcctaggcgcctcggcttgaggatgcccttccccttcatcatgctacagagccggtggccggcagaggagaagagcgacggtggcgctcggtggcgtagacaccagagtccgccgctgccgccgccctccccttctcccacgtcaccggcgacctcctcccgaccctgcgagagcagaaaagtgagggggaggggggggggggggagatactgaattatataccacttttagatgtggaaactaactggatccatatgttatagacatatgtggacccatatgtcattgagatagacgtgacaaatagttaattgacaaatctaaaagtggcaaatagttaaatacccgggggggaggggaggaagggaaaggagaggaaagagatgatgacgtggcaccctgatatgtgggtcctacgctgactcagccgtcacgttggataaaaccagggttaaaaaccactgaagaacccaaaacgaacggttttgtaagttgagagacgttgtatatctggttttgtggtttggggatgtttttgtaacccgatgacaagttgagggaccttgggtgtactttttccccaagatattcttgtggtgtttattgggcctaataggccgaggactcatcaatttcatgggcttttcctcggagtttttcctccgcgcccgccacacaggtgtgaacaaacagatcgatcagagacagcgagggatccggtatacatcgaagagctgaagaccaattaatgcacaagctgaaacaatccaaaaatatcaaagcaatttgcattattgtccggaaatgaaaggcgacggttaaattttgctactatcctacccaatcaaataatatccccatccacatcttgattcttccatcgtagagaagctactgcctaaaccagacactagtaccatgcactgagcctgtaaagtttttgcaaatctactgcaaaggaagcacgatacagatggcgctctctcgctccgtcgaggtggccgtgcccgccgatccggccggcgatggcgatcgagataaaattcggctgcggcagctcggctacaagcaagagctgaagcgcggcctctcgtaaggagcagcttatcttatgaatttaccatgcgaagcctcgcaaactactactgttcattggcatctttggttaattgtttttggccttcgtgagctagtgttctctccaacttcgccttctccttctccatcatctccgtgatggccggtgtgacgacgacgtacagcacggggctccgctacggcgggccggtgtccatgacgctcgggtggctcgtcgtgtccgccttcaacggctgcatggccctgtccatggccgagatctgctccgcctacccgacctccggtggcctctactactggagtgccaagctcgccggcaacgactgggctccctttgcttcttggatcactggctggtgagtacgtgtatgtattgtgaattgtccgtctctcatgaacttctcgttccaagaaatgaggaaagccttgcaaaaatttcatactccagcatcttttaggcttcgtttaaaataggatatttttataggattttcgcggaaattgatcgatcgtatataaaaatcttgtaaaactcgcacattccaaaagagacctttattttctcaaaaagaaaaaaagagagaaagacctttatctcttgttctgtttttcattccttgtgttctgctttgcaggtttaacatcacgggacaggtaggtacattcggatttctgggcccgggcttctcgctaattgatgggcctttttattgggccatgagtacagaaaggaataagttcactttgggtccctttatttgttgcccagtccgattttcgtcccttaatcacaaaaccgggtacgacggatcccctaacttacgaaaccgtttaaattccctcggcagtatttgactctggttttggctgaggtggcaccgacgtggcttcttttgactagatttttgtccaacgtgttattgacgtggcgctgatggggcaattagatcccaaaaaaataataaaacttatggggcccacatgtcagttgcacacacaaattaataaaaaaggtgggcccatgtggacccacacgtcatcctcacaacctcttctctctgtcccctctctctccctcttgtctctctcccgctcatgggcggcggagcgacgaggaggccggctggaacggcgcacggcggccgagcgacgaggaggctggctggagcgggcgacggcgtggcggcgctgggggggcgggggtggacggagcgggtgccccggcgcatggcgtagaacacctcctgctcgaacgccgggtcgccgtcggcgaggaggcggtggacgagcaccagcatcttgagcgtgacgcccaggcagcgtgacagcgacgcgacgcaggcgcgggagtggagcgtgagcgcaatcacctcccggacgtggtgctcatcggcggggaagccatggacggtgtgggagaggtcacgcttgacctcttgacacatggatactctcgtttaattatctcgttattacaaacatggttaattacaacttccaaataaagatcaaagcagacatattatgttaaacttgtgcctgcaaaagctgttttattcagttaggatagtactttccttttatgcacgttatgtgttttagccttttaggctagctaatattattacttgtagtactagaacacatgcaggaaatcttagccgattgcatgctactgagctactcgatcgctcatggattgactgagacgccagagctacaccttggtgtccgccttgccgctggtcgtcgagtcatcggcgctgccgccgtcggcgaccttgttgttcctcccctcggccatctccacgtcgtcgtcgccggcctgcttgccgcgattgccgcggcggcggcgaggaggaagacgaagatgctggcggcagcagcggcggcgaggaggaagacgaagatgccggcggtggcggcgcgctgggggtggtgtcggtgtgggggatgcgtcgccccgcctcgcctccttccccctgcgcacatgaagaagagaggacgatgaatatgagagagaagggagggggaagaagggaggagtagctgacatgtgggccaccattttaaaattattatttttagctgacatgcgggtcccatgttttttattattttttcgagatataattgccacgtaagcgccacgtcaatgccacgtgggacgaatatctagtcaaacaagccacgtagtcgccacatcagccaaaatcaccttcaaaaccgctgagggacctcgtctacacggtttttgtaagttgggggatgggtcatacccggttttgcggtcaagaacgaaaatcggactgagtgacaaatagagggactcaatgtgaacttattccgtacagaaaagcctaacagtgggctgacgctatatggatctcttgatgacatagtgggccgctaccacgagcgtggacttcgcgttggcgcagttggtccaggtgatcgtcttgctcagcaccggtggagccaacggcggtggctacatggcctccaactacgtcgtgctcgccatctacggcgccatgctcgtcatccacggcgctatcaacagcctcccgatccagtgcctctcttggttcggccagcttggagctttttggaatgcggcaggtaatgaaattatttttttttcctcctcttgcaatcgatctccttattaagtcaccatcgattccatcatcactctattgttcttcgtttgctaggtgtctttgtgctggtggccttgatcccggctgtcgccacggaaagggcgagcgttgagttcattttcactcacttcaacacagaaaacggcatggggatacgcgacaaggcttacattttactcatcgggttgttgatgagccagtacgcgatggccggctacgacacatctgctcatatggtacgttgcgatttcgcccctagacacagtagtccatatctaaactgcaaatactactgacactctgacagtatatcattctatgcatcagacagaggaaacgaagaatgcagattggagtggcccgatcgggatcgtaacctcggttgctctctcgaccgtgttcgggtggatctacatagtgtcactcacgtcggcggtgacggacattccctacctgttgagccccgacaacgacgccggcggcaacgcggttgctcaagctttctacaccactttccaccggagatacggcagcggcctgggagggatcctctgcttgggagtcgtcgctgtcgccgtcttcctctgcggcctcgcctgcatcactagcaactcgaggtcagatcgatcgatcagctgacgtgttcaggaatttagcttagcttaattagctacgtacatgttgataatttcctaggttaattagccactgcatgcaggatggcgtatgcgttctccagggacggagcaatgccgttctcgaaagtctggcaccgagtgaacaagcaagaggtgcctataaacgccgtatggctctctgtggtggtggcgttcatcatggctctgacagtgagttaattcgtaccactgctgattaattttcatgcttgattctcagttcagaataaccagaattatgctttatttttatgacagtcgctgggaagccaggtggcattccaagcaatggtgtccatcgcgacgatagggctctgcatctcctacgcgctgccgatcttcttccgggtgacgacggcgaggggatccttcgttccggggccgtttcaccttggcaagtacgggatcgtcgtcggctgggccgccgtgctctgggtggccgccgtcaccgtgctcttctcgctgccggtggcgtacccggtggcggaggagacgttcaactacacgccggtggccgtcggcggcgtgctgctgctcaccgtcggcgcgtgggctctccgtgcccgcttctggttccaagggcccattactaacactaatgacggcccgctgtgacggcccataactgtatgggccgatgcatgtgtgctacggcccatggagttctacggctgacaaggaagcccacgtacatgtagccttgttgggcggcccagtaagaggccgttctttattttgattcgtattcccatgtccttggatggaaattcaacggtctacgattcggctgattatgttagaaaaagacaggcatgaggtacagaactatactaaaaaagcagcatgcgtgcaataattcaagcatagtttaaacatgaaccaaaagtcctaaggtatacagttttttttttggaacgcataaggtatacagcgatatattgcatcttatccttcagttagtcaacggtagttggcaatactacaggaaaatcgtgacataagcgtatcaatcaatcatcagtggtatacaaaatttccaaccatttcgttgattatgaattatatataagagagaggtacgtacttggacatttcttttttgggaagttgactagtacagcgagcatgtaaactatactctgcaggattagtgagctatggaggtgatagcgtcaaaaatagctagcctcccaggaaacagcctacaggagatagagaactgatccacggccatgtctcgctccgtccaattagcgatggccgccggcgatcaggccgccgacgacccggacagcctccggcttctccagctcggctacaagcaggagctcaagcgtggcctctcgtatgcacacaacaagtttcagtttattcagacttagcatgcattcaccgtgctaattagttcattcttttcaaaactaagaccatcttgatcgattcatctggatatatatacacacaggaccctgtcgaatttcgccttctcgttcgccaacatctcggtgctgacgggcgtcacggcgacctacaacacggggctgcgctacggcgggccggtgtcgatgacgctggggtggctggtggtggcgctgttcaacggctgcgtcgccctgtccatggccgagatttgctcggcgtacccgacctccggtggcctctactactggagcgccaagctggccggcaaggaatgggcgtccctggcttcttgggtcactggctggtacgtgagacatgtatgagctagtctgcatcaatttcccctgtctttatgcactggaactaatccaaaatggttaggtgcaattgttttcttgatatccttgaaaaaaaattgttgtcttgagatggtgccttcttgaagattatgtttgatcattactattttgaatatttgttgctgtggattatgcatgtatgctgttgttcaacttaatttgcgagcctgaatttgttattgtgttgtgtgttcgacaggttcaatatcgttggacaggtatactaccattgtctggtggatctagatactgtttttagctccagcttataacttcatttttcgagaaaaaaatttgcattgttgccctgtccttgtcttcaactgttgtggcagtgggcagctattgcgagcgtagacttctcgctggcgcagctgctacaggtgatcatcttgcttagcacgggaggagccaatggcggcggctacatggcttcaaagtatgtcgtgttggtgatttgcgccgtcatcctaatccttcatggcgtcatcaacagcctccctatccagtggctatctctgtttggccaaatcggggccatctggaatgctgcaggtgcatggtacacatggaggcaataatcaccagtccttatgaattgtggttcttggcatctgaagtctgaatattgaaccctgaacgaaatttatctgtctgaacaatcaacaatgataggtgtctttgttctggtgatcctgatcccggcagtagcaaaggacaggccaagtgttgagttcgtgtttacccatctcaacacggacaacggcatggggatccatagcaaggcttacatcctagccgtgggattgctgatgagccagtactccgtgctcggctacgatacatccgctcacatggtaaacgagtcctctactcctgtcaggctgcagatatctgaatgagcataactgaatatggatagaacacagtgtcacagtgacgagctgatgatgcgtgtatgcaggttgaggagacaaagaatgcagatcggagcgggccaattgggatcatcacgtcggttgtttgcgcgacggtgttcgggtggatctacctgttggctctgacgactgccgtgacggacatcccgtacctgctcagccccggcaacgacgccggcggctacgccatcgcgcaagctctgtacaccgccttccaccggaggttcggcagcggcgctggcgggatcgcctgcctgggagctgtcgccgtcgccatcttcctctgcggcatcgcgtgcgtcaccagcaactcaaggtgacgggctcacatcgcgtcgatcgatctgatgattccacagctagctgttcatcgaatcatcgtgtcgagttggtgatttacatgtcgggtttctgtaggatggcgtatgctttctccagggatggcgcgatgccgttgtcgcgcgtgtggtacagggtgaacaagcacgaggtgcctctcaacgtcgtctggctcgccgtcgccgtggccttcttcatggctctcacggtgaattattatattccgagttgcacgcgttgctgcttctgttcctcctgcgtgcgctgctctgacacggtgcgctaattttgttgtttttttggcagtcgctggggagccaggtggcgttccaggcgttgggctcgatcgcgacgctggggatgtacatcgcgtacgcgctgcctgtgtttttccgcgtgacgacggcgcggagatcgttcgtgccagggccgttcaacctcggaaagtacggggttctcgtcggctgggtgggtgtggtgtgggtggccaccgtcacggtgctcttctcgctgccggtggcgtacccggtcgccaataaggagacgttcaactacactccggtggccgtcggcggcgtgttgctgctcagcgtcggcgcgtgggtgctccatgctcggttctggttccaagggcccattaccaacactagtgacggcccgatttgacggcctagaaaagtatgggcccgctgatgtgtagccttgcttggaggcccataagtgggcccaataagaggtcgttctttagggcttagtatttgttagagtctcaactcttaaatttaccattctgggtctaaagtatatctctaattcattttgtgagaatgttccaccagcttcactcacattttagatgaaattaaaacgttttggctgactctagctcttgccaaacataaccttcattggattcacatttttattggatgcaaatttgaaaacttcaacggtctaagatccggctgattttattagaaaaggacaggcgtggggacaaaaactgtactgaaaaaaaagcatgcatgcacccattcaagcatagtttaacatgaaccgtgattagaagtagtactaacgtgacgtatatatatcctatattttctgagtcaacattggcgtgtaatacgaaaggaaatcgtgacatgggcagatcagtgaatcagtggtacaaaatttccaaccattttgttgactcgcgaatcatacatgacagatacttggactattctctttcggaaacttgactagttacactgagctgtctgagcatgtaaactgcagcatagcgcgactagtgagcaacagaggtgaaagcttcttcccaaggtagaggatctagagatccaggccatgtctcgctccgtccaattggcggtggccgccggcgatcaagtcgatccggacagtctccggcttcaccagctcggctacaagcaggagctcaagcgtggcctctcgtatagacgcatatgcttgcttgtgtttaatttgttcagactagttcttgattagcaattaagcatgcattttggatcttccagtcacaagactcttttcacaactaatctgcgtacagggcactgtccaactttgccttctccttcgccaacatctccgtgatgatgggggtgacgacgacgtacaacaccgggctgcggtacggcgggccggtgtccatgacgttgggatggttggtggtggcggtgttcaactgctgcgtcgccctgtccatggccgagatctgctcggcgtacccgacttccggcgggctatactactggagcgccaagctggccggcaaacaatgggcttccttggcttcctgggtcactggctggtacgtgctaatgcaaaattgtcagatgcaattcttgccttgagatggtgcctacttgaattctgtcttttttttgtgttcgacaggttcaacgttgtgggacaggtacacttgccattgtcaacttggataatcttggggattgttttttttcagttgcagactataattgcatcgtcgttggccttgtacttgtcttcaattgttgtggcagtgggcagctattgcaagcgtagatttctcgttggcgcagctgctacaagtgatcatcttgcttagcacaggaggaggcaatggcggcggttacatggcttccaagtacaccgtgctggcgatttatgccttcatcctaatcttgcatggcatcatcaacagcctccctatcgagtggctatctctgtttggccatgtcggagccatctggaatgctgcaggtacacaatgaagtgagttctatcggttctaggcatctgaattctgaaccctgaatttatctgtctgaaacaatcaacaggtatctttgtgctgacgatcttgattccagcagtagcaaaggacaggccaaatattgagttcgtgtttacccatctcaacacggaaaacggcatggggatccatgacaaggcttacatcctagccgtgggcttgctgatgagccagtactctgttatcggctacgatacatctgctcacatggtaagttaatcctgctgtccctcaggttgcagatatctgaatgagcattgacagacggtagtgtggcagtgattaactgacgatgcatgcaggttgaggagacaaagaatgcagaccggagcggcccaattgggatcatcacctcggttcttttcgcgacggtgtttggttggatttacctgttggctctgacatctgtcgtgacggacatcccgtacctgctcagccccagcaacgacgccggcggctacgccatcgcgcaggctctgtacaccgccttccaccggagatacggcagcggagttggagggatcgtctgcttgggagccgtcgccgtcgccgtcttcctctgcggcatcgcgtgcgtcaccagcaattcgaggtgcgtgacagagctagcatcacgtcgccctgaatccctgatgatcgattgaattgctcaaagtgctatatacatactcgttgtttgtgcaggatggcgtacgccttctccagagacggggcgatgccgttgtcgcgcgtgtggtaccgggtgaacaagcacgaggtgcccctcaacgtcgtctggctcggcgtcgccgtggcgttcgtcatggctctcacggtgagttgcatttgcattcgcattgctgctccggtgattcacggtgagtgcgcgtgatgacgacgccttctctgccttttgccggtgcagtcgctggggagccaggtggcgttccaggcgatgggttcgatcgcgacgctggggatgtacatcgcgtacgcgctgcccgtgttcttccgcgtgacgacggctcggagatcgttcgtgccagggccgttccacctcgggcgatacggggtcgtcgtcggctgggcgggtgtggtgtgggtggccaccgtcacggtgctcttctcgctgccggtggcgtacccggtggccaacaaggagacattcaactacactccggtggccgtcggcggcgtgttattgctcagtgttggtgcgtgggtgctacgtgcccgcttctggttccaagggcccatcacgaatgttgacacgcattgttgacaagtatggtatcgtgttgttagtcagcgagtcagtggaaatatggaaccacacttttatattgtgtaatctatacgtgcaattgtagtcgttcagcagttatccaccattccggttttctttttttatcctttttattttgaaaaaaatgttttttttaaaaaaaacttttttgaacggttgaagagcgcagcaacgtgcgatgcgaggggcctgtctagggaaatttcagtagctgtagcttctgctataatcttcagctgccagaaactccatcaaacaatttagattttcacatatattttgaaaagttgtagttgtagaatctagaaaataaactcgaaatcagaaactgggtttgccagcttctctagattatcactaactgcttataagaagcttaggactctatcgtttctcttattgacggaataagcgaaatgacatatttgcaaacagaaaataatttgtaaataaaacttttatataagtgttcttagcaatataaacaaagtctgaaaaataaactttgatgaaaaaccccaaaatctatctattatattattaagatagctcgaaaagaaggcactacgttcgctgtggaggctagaaattcccatattaatcgaagaaaaagaaaaggagagtccaagtaaaaatacaatctaaaaaataactgaaattcggaattaaaaataagcaatattaaaagaggtgtccatataagaacccaatacgagattaataaaaccattgattacaattctaaattttaacggtctagatttgtaggagaaaagataagtccatagatctgtattgtgtacgttacatactaggagtctttgtcctttctgtttctttagcggtgtacacagtacacgtataatctaattcaattacaaacctacacgggcaagatttgtgctgccaaatatacaaaagcttgcactgctgcacatatatattctgtagatttcaagcagcaaagattgggcttgaacccaatggtagcgggagccaatcatagtaaaaagacatgatatttagatagacattagaataaatagatcaatacttgtagccggcaatgcatcaaacaccaaaagtttctttgatgtttatgaaagtacaaatgatatcgacatattgtaattagtgtatatttttcacaggagatggattaatgacagtcagattaaacggttagattatagtggattcacaatttaacgttcataatttaacgattgagatataacacgtatataggaatataggaattagagttgtagtgctaatacaggagtacaaagcggccctgctctgctcgacggataaattgagatccaatttcaaaactgttataggtttgattctaggtgggaaaaaaaagcaacaggaactaggtaggcagaaagccatatatatacgtgtgctcatgtaagtattattttttcagtctataatcacttcaaaactacttagaacatactttgaaatatttgttgccaataaaaaatgaagcgactgtctctttatctatttgatcctttttaatcaccaaatatacacccaacaattcagatgatttataaataactaaattcgaaagaaaataataaagactatgaaaagaaaaaagcatctataacacaacatgtgattaattaaaattaaaaaaaataaattacgaaattataaaaataaaaacaaaagtttaagaaagaatacaatttatgaataacaaaagttcaaaataaaaataaagaaatattaaaagaacaaccgtaccacaacaatggtaaatgacaacaaagaggaagggataacgggtgagccataaatgaataaggtgtagcggttgatgggatatttaaaaaacaataaaacaaaatcaaatgacgattaggttctattttaaaaatctcaacgacgattaaaagaaacaacagcgggcaagccgtcaaggagcgcaatcgtgacgtttgacggaacttctaaaaagtaaaaaaaaaaacaccaacgataatcataacatcatatttgactttttaaattccaatgacaattaagacgagacatcgggtggattgtagagcagtacaatggtgacatttcatgtaacttctaaaaatataaatatgcaactgacaagaaaatgaactacaaaaactataagatctaaatatgaaagttccaaataggatgaataaaagttgtgacatgtcggacaatcaaataaatgagcggcaaaaaagtaaggggtggcgacttattgactttcgaaaactaacccgatgataataagattcaatcttttaagatcggctagatggctatttaacaaaattaaataaaaccatgtttaaaaatagataattttggatgggtgttagccgtgcaacaaataaaggggtgacaaaggagtaaggatagcaacggatgtgaattttaaaaactatgaaattagaaacacatggatgataatgttcgatccttgaaagttctaagacagcgagatgaatattttaataaattttaagtagaatcgtgtgtaaaaatagataattttgtgggtactagccgcgcaattgcgcgggccacctagctagttagctctaaatctaagttcgaaaatttaaagttttacttactgaggacatatccggtgaaaatgagttaaatgttgaaaactcgtgaaaatcatacctaaaagtttcgtaaatttatgaaaaaaataatagagataagtgtagatataaaatacattctcaccaaatttcaactccaaacccaagttcgtttatgagaaaaaaaaagacaaatttcaggtgaacagtgtcctgt

SEQ ID NO: 69096 - DNA, 20746 bp, Oryza sativa
  unsure (1)..(20746): unsure at all n locations
aatttgtgggaatttgaaactcaggggattaaaaagagcgagggtattagcgtttcacttaggcggctccaggtttttgcccgtaagtaccgatgtgagtcagtgagtgggttgtgagtgtgtgaggagaaaatgagctctgcgcagtgtagtatggttctggcttttgtgttctgtcaagtgttccaacaaacgttggatttcattttttttcttccattctgacaataatacggaacacagatatgttcagctcaagttgttaatgaaaaaacacttataatgtatgtgatgtttggttcacagcttgccgctcttaaaacattaagatctggaacgctttatttttcttgaatttatgatatatgtgtcaaatatttgaactacgaagtaatgcagtccatctttacttccctgtgatttgctagaattggataaacgacagattttgttggttcttatcaaaaagttgttcgatgtcaacctcaggtatgctcaatgtttgtccacttattatcaatactcacagtttctgccgtacaaacatttcatttcttttttccttctaatgatatgattcttttcagttgatgtgcaattagactatgagactgatcccccactcgatggtgtaaaagttctcgagaaagagtcgacactaagtgtcgctgtctctcaactcgcaagtgattttgatagagaatctaatttatgtttggagcggttctcccgcacaggcgcacacctgtgatctccactggttctcttaagcttgatattgctcttggcattggtggattaccaaaggtcatgatgtgctttcatattgtccagatctagaattctagatatttagtattccaatgatatcattactctttatcactatatcattccatatgatattaccttggtcctaaatcatatatttctgatataacacataaggatcaaagttcaaataagtcttctgcatggtgttattgttcagttagggtgtgtttagttcctgaaaaaagttggaagtttgaagaaagttgggagtttggaaaaaaagttggaagtttatgtgtgtaggaaagtttttgatgtggtatgatgtgatggaaagttgggaataggggggaaactaaacacggccttagttcactattttgttgcaatgggaactctaaaagtcaaatgtgtcatgtggggcttttcatcttttgatgtctaatttcccttttgtgttaatccaatgaaatctccatgatgtgttgaactagttaaattagtgccaaaagccctcttctttagttgtgaaaatactatttgttgatggcagtattttccttcttgctggacaacaaaaaattgcattttgtctatggtatttctgattaggaaatatatttataggtagaactgatgcccatatcttgcttagctttacttctgtcaaatgtgtccatatcatccatccttttttttttcttgatagcatatatgtttagagttaaaactgcaggcttaccttgattgatatgatcagtgagtgtagtggcatactgttttgaacactgcttttagttgtgctgtttgaaaattattgtagatatttaacagggtagaatggttgaattatttggaaaagaggcctctgggaagacaacactcgcccttcatgttgtcaaggaagcgcaaaagaaaggaggtctgtatttgtttatggtccttgctgttctttttggagtatacccttcttctaaattttacattatatgattggagttgtgactgggactatttgcaggctgctgtgcttatattgatgcagaaaatgcttttaacccttctgttgccgaagccattggtgtaaacgttgaaaagctcctgatagcccaacctgactctgctgaaaattctttgagcatagtgaacactcttgttggtggatcaattgatgttgttgttgtcgatagtgtatgtttcttccgcaatgtcagtttggattagttttttctcttctatttgattccttattggcttattaaaattttatgcattccctactatgacaggcctaatacttggataagtagttactaaatttgaaaattggactgctattcacttctgatgctctttagcactgtcatactgtcaggacatccatttttctaatatgtatttgatatcttgtgctttgctacatatttgtttaccttgcttttactggacttctgacaggttgcagcacttattcccagatgtgaacttgaaggtgaaatatatatgaattctgaagatgtgcagtcccgcttgatgactcgggcacttcgaaaaattcagcacacactaagtcgctctgaaacgctgattatttttgttaatcaggtttgggatgattgctttttttgcactaaccaggatggcatacttcaatatcgtttagtgttgatgctgcctaacttatttagagcttctgattgctaatgtttgcaggttagaacaaagttgagctcaaatcagactcctggaatcttcaaggaggtagcttgtggcggcaatgcattaggattctatgctgcagtcagaatgaggacttcaagaagggaattacgctacaatgaggcccaggtattgtacataacttttcatgcttctcatttcccttctccggttccctccttagaatactagcactagacaagagcgcgcattattctaggtaaagtgtacagcatttgtaaatatgcaattaagaaaattctgccatttcaggctactggcatcggtatatcagtgcagataatcaagaacaaattagctccagcaactctgaaggaagctggcattgacatcagatttgggaaggggatctgctacgaatcagagatcctggagctggcttcttcccttggggttattatgaaggatgattctgggtattggatcaatggtgagttccttccaaacaaggcagaagctgagaaattcctacgtgaaaatgctgctgtggcggatgaaatctgcggtaccatgaggagacaattctttgaaaggtgacaaactgaaggacttattctggttatcttgtatactagcaagcaggtgcgaaactcagaaggaaattacagtgtacagttggggcatcattgaagagtctaaaaatatcatttattacttgaagtgcagttaagggatcgacaaccaattagagaggctaatcttttgttagccttgtaatctcatcccaccatcaggcaaatagctcactactgttatgacatgaggtatggatgactgcccctatgagctttgtttgttcagtaagatcacagctgttgtatcatatatttacaggatatttttctgcaatgcaatttgttttcctcagcctgttgtaatttgacaaattttaagcacatcgagggccattccctcaaacaacgatacttcagtacaacatcgagggtcattccctcaactttaaactttcatgagcctcactgtactgagtactctatgccgtgatgtgccgggtagtcttggagttccaaattagcgtgtgtacgtgtgtggtcaagaaggattcagaggttggcattggtagattttttttttgaacaaagcattggaagattttagccagaaccgtccaacaagtagcggcttattttgacttgagctcttaagtctgcagaggtgtatctactctgcactcacccgtgtgcgacggggttggctaacccaggaggaaaggaaaaaaaaacacggagcttgtttatgtggtgacgaatgaacagtaaatgaacgtatgtcaatcccatttgtattgatcttgtccagtcttcgcctggaaattccgagcagcgtgactataaaagcaagcttgcagcgttgcattttcttacatccagatcgagttcaagtgcaacagatcaaactagtagcagcagaagatgtctatgcaaggcgttgttcctgtgcttgcagcggctttggccattgcagccttcgcctcctttccttcaggtacacatattgctaagcttcgttatatgtaggtcgtaagtactaagtttttttttaaagataatgtaaatgtattcctgcttgtgttttataaagttatagcttcccttaaaaaagaagttatagccacttattatataactggcttaaaagagagctcataaaacctaagacatgaagatgaaaaactaataatagcaacactaaagaagaaacttttattcaagtctatttgtaaatctccaactgtagttaacaaaattattcatagccgttgactctagattttggcgtgcagtatgcattagctcgtttttctcgtcacacctttgtaaatcgtaagtacttgtcctaaaattagtggacatcagtatgataatgtcaaatttacgatttaatttggatctggatgaattgagtgcttacccgaaaactagtcatctggccacatatgtcaagcctaccgtgcgatactgtgctcgttgtcactgaacccgtacgcttgtgcgtgcgtatgctgagatttggtgcagcatgcgatccatcggcgtgtgctacggcatgaacggcgacggcctcccgtcgcggagcaacgtcgtgcagctctacaagtccaacggcatcggcgccatgcgcatctactccgccgaccgcgaggccctcgacgccctgcgcggctcgggcatcgacctcgccctcgacgtcggcgaacggaacgacgtcggccagctcgcggccaacgcggactcctgggtccaggacaacgtgaaggcttactacccggacgtcaagatcaagtacatcgtcgtcggcaacgagctcaccggcaccggcgacgcggcgagcatcctcccggccatgcagaacgtccaggccgccctcgcgtccgcaggcctcgcggacagcatcaaggtgaccaccgccatcaagatggacacgctcgccgcctcatcgccgccgtccgccggcgtgttcaccaacccatccgtcatggagcccatcgtgaggttcctcaccggcaacggcgcgccgctcctggccaacgtgtacccctacttcgcgtacagggacagccaggacatcgacctcagctacgcgctcttccagccgagctcgaccacggtgagcgaccccaacggcggcgggctgagctacacgaacctcttcgacgccatggtcgacgccgtccgcgccgcggtggagaaggtgagcggcggcggaagcagcgtcgtcgacgtcgtggtgtcggagagcgggtggccgtcggacggcgggaagggggccaccgtggagaacgcgcgggcgtacaaccagaatctgatcgaccacgtcgcccaaggcacgccgaagaagcccgggcagatggaggtgtacgtgttcgccttgttcaacgagaaccggaaggaaggcgacgccacggagaagaagtttgggctgttcaatccaagacaagacaccggtttacccaatcactttctgaaaaattactccaatacggaatatgtactacgtcgtacagtatatatcatgtgcttaatctggtgcttacgaatcaaaatctgttagaatttgtatgtgccagatgttgaacatgaacagtcgttgaacactcacccaccacatgtgcacatatgtacttttaaacaagctcatgtttcaattgtaacatttggttaacgaatattttggttggatttggaaaggtaggaatgcacggtaacttttggaacagactaatttgcacatggtcgatctatataatatttgtacgttacatctagataacacataaacaagttgtcgtatttagctgtctcaaataaattcgtgtaatgaataatttgattctatatactacatgtactctctccgtccctaaatataagggattttgaatgaatgtgacacttcctagtactatgaatctgaatagggagcatgtccagattcataggactatgtgtcccatccgtctaaaaatcacttatattttgggatggagggagtacgatggtataaacggtatatattaatgaccggaggaggtatttccttttcctccacatcattaaaccattgttgtactatagtatttttggataaaatgataaatggaagtaatattatctgacaaaggcaaaaagggaatgaaaaaacttaaaacaatttgattgtgtcacgctgcctttgtgacaacctgcttcttcttcttctttgaagttgggggctttcattaaacaatttgaaccatgacatgaggtccgattgaaggtgctctctcgtacaacactttttataaaaaaatatgttctttgtcgtacatttaatatgaatttagacaagtttttgtctatgttcatagctaaaaatagctctattttgagatgaaaaaaagtatgtcgaatgacgattgtgactagaaaggtctatacaagatattcgtcccaaagacttagctcaagaagcaacatctttaacagggagccgatgaagaaatttcaacgttgtcggaatactagattagggttttcacccccaaagaacatcaccacaatctgttgttcacccccaaagaacatcaccacaatctgttgttcgaacgtcgatccaattttccgaccaaaatgaggatgacccacaaactctatttcaaagtggcaactttcctggagccacatataacaagattagttcgccagccaccacataagcaaggagataaaggaaaaaatgaaaataaaataattacaccagtcaaataaagcaatagaggatttgctaatcaaattcatcatgaacattggttggattccttgagaggtcagattcatcatcccgtatttatgtcttgacatttggaattttgattttctggcactatggtttgcagcttatcgggaacctattcagtctcatctgcatgctgagtgtttatagtttatccggaacaattcacacattcatctgcttgctgagtaccagtataaatcaagctgctctgctttgaactctgtaaattacatccagaaaccaagtgaactataggtggtctaggtacagaatacgccacatttgttacatctctctaggtttgagaccacaagagatggtgaatatacgaggtttctccctggtttttgcagctgcattgctgcttcttggagtttttatctcaatccctgtaggtacgtgattcgcctgtactattgaatattgatatatgtattgttgatattaatctatctgattgaattttttaaattttttataactatttagatgacatgtagacaatgagggtatgtctcgtcaaaagtttaaaatagtttcccattgtttgaaacataagaattttgaaaaaaaaattataaggactgaactatttccgacgaaatttctgcaaaaactttgtacttgtccaaagagatcttaggtccatttgggtaggtagaaacaaattaaagatcagagcttgtactgatgctttctgtctgaatgaaatacatgtggtgcaggcgtgcaatccgttggtgtgtgctacggcatgatcggcaacgatctcccgtcgaagagcgacgtcgtgcagctctacaaatccaatggcatcacagacatgcgcatctacttgcccgacgtcgaggccatgaacgccctgcgcggcacaggcatcggcctcatcgtcggcgtcgccaacgacatcctcatcgacctcgccgccaacccggcgtccgccgcgtcctgggtcgacgcgaacgtcaagccgttcgtcccggcggtgaacatcaagtacatcgcagtcggcaacgagatctccggcgagcccacgcagaacatcctcccggtcatgcagaacatcaacgccgccctggccgcggcgagcatcaccggcgtcaaggcgtccacggcggtgaagctagacgtcgtcaccaacacgttcccgccctcggccggcgtgttcgcggcgccctacatgacggccgtggccaagctcctggcgagcaccggcgcgccgctgctcgccaacatctacccctacttcgcctacatcggcaacaagaaggacatcagcctcaactacgccacgttccaggccggcacgacggtgcccgaccccaacaccggcctggtctacaccaacctgttcgacgccatggtcgactccgtctacgccgcgctggacaaggccggcgcggcgggcgtcagcatcgtcgtgtcggagagcgggtggccgtcggccggcggggactcggccacgatcgacatcgcgcggacctacgtgcagaacctgattaagcatgcgaagaaggggacgccgaagcggcccggggtgatcgagacgtacgtgttcgccatgttcaacgagaaccagaagcccggggaagccacggagcaaaactttggagccttctaccctaacaagacagcagtctaccctatcaatttccagtgaaatcgttcatcatcagcgccagttgtcaaattcacgcgattgcttgcgctgtaatagcgtattgtattcggatgggaaactgtatttatatctcgagaggatgctctctcctttgtttaaaaaatatataaatagttataaagaaattctaaaaaaatgggatatattcatataacatacatgtatcagtacacaaaattttagacccaaactcaatttatacattaagatataaaaaatacaacttcaacatataaatagtagtgtggtggtgtgttattattcgggatattaactatttgtcattctcagttgtggcaactaacaatttaccacctggacctatatgtcatatacacatgaggtctcatatgtcattggcacatgtgtgacaaatagttaaacaacaaatctaagagtggcaaatagttaaatactctgtactattcatagctgaatttatctctttttttctcatcgtgtaggtcgaatttgaacttgctttttggtgcagtgatagatgtactgtacctacaattgttagtttttttaagatttttttatgactatttatattaaattcggaagaaaaaggtatacgagataatattctgtggagggattagaacccgtttctatattaggatacaaatgatttaatgatttcctatatataataatatttttttcttttcaggtatttcccatatctgatctcaaaaacttaattagtgccaggtcatacagattccagataattccataggtttaattcgtggtacgtccatgctgaagaaattctatgagatgcgtgtgtatagtaactgatgtggatcaggtattcaggtgagttctcaaccgatggaaaggtagtgttgtgctgctaacctgacaaaagaacaatgaacacacgtcaggaagtcactccggtacaagccaccattccattcagttagcaccccaaacctgaaattccacgtactggtcaagaatatacgtaagaattcaatgcaaaatcggatatacggttggaaaaacaaactagtgtggtattagtagtgatcttccgcgactctgtgtactgctgatgagggaagaattccatgaagcggaagaatacatgctgtgtctaagtacgccaagaaaacagaggcgagtttccacgtttcgtggaattttttagctccaacaagccgctgtttctgtggaaaaaatgggaggaagatggctagttaggctgcaaatgcaacgtagcagctagctgtaagcacgcacttgggccgtggatgtgaggaaattaatgtgcctaactggctagacactgaaacttgtatataaaggggtgtgcattggcacatagcatgcataacattcaggttcaggagcagcagttgggagtagctagctgggacaacaatggccaggagacagggagttgcttctatgcttacaattgctctgatcattggagcatttgcttctgctccaacaagtactgatcagattctctctatgtttctagcaaatagcaattctctgttttgcttgcaatgccctgagcacgtactgtaagtgtttagtggctagtcagagatttgaggggaacaaaattctgaagagcaccacaatgttctttatagaataaaccacattttatctatatgcatcttgttgtcttttcataactatggaatttccccacgtaattttacacgggtcagttgaattgaatttgatatagaactcttagttcctatttccatatatgcaatattttctacacaatacattacaattgcaatagtactttgtatacaaatattgctatatactccctccgtttcaaaatgtttgacaccgttgactttttaagtacatgtttgaccgttcgtcttattcaaaaaaaattgtgaaatatgtaaaattatatgtgtacatgaaagtttatttaacaatgaatcaaatgatatgaaaagaataaataattacttaaattttttgaataagacaaatggtcaaacacgtantananagtcnncggtgtcaaacattttgaaacggaaggagtattaatctacaccgttaatttggtcctagatgatgtaattagcttagatcttattattttattaatatgataatgtataggtatacatagcgaatatggtgacttcgtttcaagttatcattatgttactatacaatatatatataatagatcatgtctggtctagataatataatagataatatatagatagatatatggaagatagataaatagatagatgaaactaaataaaatgtccggaccagatagacactatagctttgggttaattctttttgggcaaacaaagtttcacttgaaattcaactaggcatgctctgataattcgaaggtgcacgttcattgtgtactctgctatggtttattggaaaacctaactttatgctgtcggtgtccattatcctgtcgtgcatatgcagctgtgcaatccatcggcgtgtgctatggcgttctcggcaacaacctcccgtcgcggagcgaggtggtgcagctgtacaagtccaagggcatcaacggcatgcgcatctactaccccgacaaggaggcgctcaacgccctgcgcaactccggcatcgccctcatcctcgacgtcggcgaccagttgtccaacctcgccgccagctcctccaacgcggccgcgtgggtccgcgacaacgtcaggccctactacccggccgtcaacatcaagtacatcgccgtcggcaacgaggtggaaggcggcgccacgagtagcatcctcccggccatccgcaacgtcaactccgccctggcctcgtcgggcctcggcgccatcaaggcgtccaccgcggtgaagttcgacgtcatctccaactcctacccaccctccgccggcgtcttcagggacgcctacatgaaggacatcgcgcgctacctggcgagcaccggcgcgccgctgctcgccaacgtgtacccgtacttcgcctacagggggaacccgcgcgacatcagcctcaactacgccacgttccggccgggcaccacggtgagggacccaaacaacgggctcacctacaccaacctgttcgacgccatgatggacgccgtgtacgccgcgctggagaaggccggcgccgggaacgtgagggtggtggtgtcggagagcgggtggccgtcggcgggagggttcggggcgagcgtggacaatgcgagggcgtacaaccaggggctgatcgaccatgtcgggcgtggcacgcccaagaggccgggggcactggaggcgtacatattcgccatgttcaatgagaaccagaagaacggggatcccaccgagagaaactttgggctcttctaccctaacaagtcgcccgtgtatcccatccggttctaagtcagatgctgcatcggatcgacatagcagctactgaaagctcttgctcgtatgcatccttaaaattaactgtaaactaaaaataagctagcttcaagcagagcagtagaaataatcaatcagtaataaagtgtgcagcacgtatggtgtgcctgcgattctcaaattccagaattaatagtgtattatgccatgagtaaagtgaagaaaatgtttttttccctaatcgacaatgaatcagtgcatgaacaattgagcgcgacttatatgttcatgaggagactattttgatcctcgagaggatgtcacatccttatttgcattctactcaaatgattataaaaaaaataagaagatgtattaacatgtgatatatcactacacaaacatgcaagttcaaattcaacttctatatctcgcaacgaaaaaaagaagtcctctattttgcttgaaggttcatttacggcgcggtgtgataactgcaaggaccatggtatctttgaggtttatttttaaacatggtacaaacgcatacgttcacaaacagtgaagagaaggaatgcaattaaattcgagggtacaaaaatttcaaggtgtaatcatgaagaacaaaatatgagccaccaatgcaatttacagtaccactggtattctagcgaagcaagtttatgcgattgtagatatgcaattttctcaagttgggtgtactgttaaatactactaatggataagaatttccatgcagcggcagaacacaaatggatgtcccgttcttttctccaacaagagttggatgaagattaagattctcgttgcaattttcgtgcgaaaactttctatatgaaagtttctctaaaatatcatattaatctatgtttcaagtttgtaataattaaaattcaatcaatcatacgttaataccatatcgttttgcgtaaaaaaacttaatcttcatcttcaagagaaaagaacaccacaccaggaaaacataggtgagtttccatgtttcgtggaatattttagctccagcaaggcgttgtttgtgtagaaaaaatgggaggaagacgacgagttagggcaactacaagtagtaagcttgcgttggatttttatacctaggtggtagaaagagaagtatgagagagaaacgtcgtcgattaatttgtcgacggtcatgcacgggcaccaatgctcctatcgctggcttggcgccttcctatcgacgatatcgtcgactgataaagaaattagcatgaacgggcttccctgattggcttggatgaaagagaaaaggggaataggtgagagacaaaataattaagcgatgatgatataaatgctgtaggcctgtagtggataactattgtatttagagtaaatttcacaaaactatagatactatgaccaaactatcacagaactacagatttaaggagttgtattataaaactacacatttagcaccaaatttatcacaaaactacacatttaagatgaagtgtcacaaaactacacgtttagtaactaaattataataaaactacaggtttagaaccaatttaattacaaagtaataatgtttatagctccaccataacaatagtgctagggatttaaactctaaaagttgtagttttgtgataagttcaatattaaatatgcatttttgtgatacttaacctaaaatttgtagttttgtgataaatttggtgctaaatgtgtagttttgtgatacaactccttaaatctgtagttttgtgataatttggtcaaaatacctgtagttttgtgaaatttactcaatggattaatataatttttaaagcaattttcgtatagaaaatttttacaaagaacacaccgtttaatagttcaggaagtgtgcgtggggaaatcgaaacaaactcactcacaatctctgctgccgaaggctaaggttgcgggatataggaattggactgaggcaattgagtgagttcaattagacttttaccacggcatagcgatggctactatccaaattctaatgggcccaattatgatggcccaatgttagtttacgatttgtgggcctaatcggatcgttgcgtttgtccgggaatcggtttatctggaccgtaaacttcaaatccaacggttcacagaaacccgacgggatagggtcgttacaatgtccgcaagttggcgcgcagctcacctcctctcgctccttgcgcttttcgggccgccggcggcggccggagctagctacaccacgtgtgaaggttatttttactctgagaaggtagagagattctacctattgcattaatgatgggtcaaaatgatacaaacattcctaagtaggctgccaaacggtgaaaaggtagacaaatactgaaaaatagaagtgtaacgaaaaggtaagaaaagatagaaaaaaaaggaaaaggaataagtgaataacagagaaaacggagagaaatcttagagaaatcaataaaaaactggttctcttgtctcagtttagcttgttaatccagtggcggattcgcacacgatggcttgctttggacacgaaaacccccatcctaccgaaaaccacctccaaactatcaacttaactacggcgacgagagggagacggccgggcttccgccatcagacggagctggtattatttccttctcgatcgatctcgcatgtcgagctgacgaaagaaccggaagcgactaccgtcgggtgcctcgtggagaggaggtaaaatcgggtgctgacgtcagcatacgtgtaaaaacaatttaaactattttttctcttaaattatttatcatgatttaatcaaaatcatgatctgattgcacaattaaattcgttgcaattaaatcttcaaaacaaaaccacacatggatatattccaacggatttttttatcttattattgaattattttcaaattgtcgacagtgggtacccgtagaccggatatagagggtattggggtacgctggtacgaggatctacgtagtacgacatcaagcaaacagaaaacaagaattatactggtttagaccccttagcaggtaatagccctaatccaattggtatgggattatataatggaaaccacagattacagaaggaatagcggaactcgataataccgacgagatcgtagtcgagttggttcgactagatcacacggcgacttggctcctgtaggctccggcttcgtaggctgtggtggatgtgttggcggtgtgattcgatgccttacgtcctgccgaggggtcccttttatatcgcgggtcagttgatctccaagtaggactcggagatatcagacccctcacgatatggcaaatacccaatcttgtctgagtaggactccttccatctgtggattccgcttctatctcgtgatagatttctttaacgcatacaaggactatccgtatacgcgcgggtatgccatatcaatatacaacgcatatctaaggatagagggtataccttatccgtaaccctgacagtagcccccaacttctgcttaaatgaactcatgtaaccaatcgtgacttctgatgtcggaatcgttgtcgttctcatctgatcgatctcggtgtgagaaccgtagagacgaagagttatcgacaatgccgtatgaagttcaatggtcatgaatgaatttaaattgaagtctaaaaactaccacacgtaacggacccagaattttccggcggcaatctctctcctttccttggaatacgcaccgtcggtagtgcggttatttaaagggattttggggatccattttgaagtccgtttgccaaagaactctcaagtcttcaagcgcccttcgtcatctccgctcctgcagagaaaaccctagcctgcttctttcgctttactctccggcgatcctccggcagcgatggatctcgacaagtccacctccaccaccgcgtccctgaagaagttgcaagatgacggcgccttcctggtcgcgggaccatgcagagggagttaggaggtattgaacccgaacccatcttgggccgtatggttgcggtcgaagattacatttcttgcggttttcttcctccgccttccaaatttcttcttcttgtcttgaacttttatggcctttctttgcttcacctgaaccccaactccatcgcattccttagtattttctcctatctttgcgaggcctatattggggtagagcccttccttgatcttttccgtttttactatgagttgcgctggatggaatccaatagggtatccggatgtgttggattccgactttgggatcgcctgaagtcgcgttacatccccttccagtgcccctcttctcgtagcaaatggcgggcgagatggttctatcttcagatagaaaactcggatcccgtccttgttgtcccggaagaacaaccagacaaaatcccagagtggaccgccaaacctgccctgactccctcccttcagtctttcatcaacatcatcgataacctccgaactcgagggttgtcggggtatgaagtcgctgccgacttcataagtagacggatccaaccgctccaggcccccgcccatccggcctttgattactcggggccagaggacacgacccgggtctctcctcggggtattttttttcttgtatttcggattttgtcctggatatgtctgtttctcccgacttatcgagtttctgttctcgatctacaggtctggacagtgacaccatgaaccgccgcgtcggccaggtgatgatcagcgctgcctcgacggcgagcgacatcccgatccccctttgcgagaagggtccggctgaacacgaggctgcgatcaacgtgagtgtactcgatgtatcctttacatcttcctccccaggatcgcgtcgtgacttcatgttatgcaggctctccctctgacggacgtcatcgggccacttatggaccactaagcggcagcgtccttgaaggagggcgtcaccaaggaggcgtccgacattgctgctgctaccatgagtggcagcaatgttccgaagaaggggaggaaattctcctctgtactcgggacctatcggaaggcgccaagcccggtggtaagcctctcttgttctttagcatgtagtcggaatgatttagcctcacatcatcctatctcacttaggcctcggacgcgtctcctccacctcagcgaaggcagaggcttgtgacgatcggcaagaagtaagtggatattttttgaagttttttcattcacaaagtcctgattaactagcttcatgaaagagaggaaactcttcgcagggcggcacgggcgaagccggcgcaaggcgggactggttcgacttccagcacgtcccctgcagcgacttcgacagatgtcgtggtcgctactaaggaccgggaggtgacgccgagtagcctcgccgtcggccttgtgcctgctcggggcccgcctgccgatgccctcacctggggggagctccaagcagagatggagtgcatcctccaggccggtgctcgcagcgtaggctgcgagatcgaggaggccaaggcagcggcgtcgtcggcgaaccaacgcgccgacaagctagcgcgtgaactggcggaggcccgcgaggacctcctgaagatgagggggctggtggccggcaacgaaaggtagcgacaagggctcgagcaccggatgtcggagctcgagaacaacttgtcagagatccgcggctcgctacgggtatcttacaccggcctacaccagctcgccgggtagtgcggcgtcacgaccaccatcccggcgaaccctgacgagttctcgctgatgtcctcgctcgcggagctagctacggcaatggaggagatcccctccaagcatgcggctaggatcggtgaggagacgtccaacgggatctacaccagggcgtgccacgtcctcgcgtgcgtaaggccggcgcatcccgacttggacctgaggagggctctggaccaggaggccgccgatgacgcgtgcaagggcgtgatggaggaagtcggagatttgggggagtctgtcctcccccttttgaatagtaggattttattttccttgtactccttaattaacatgctgtaaaaactctcaatgggcttgaactgcttctatccatacagtcatctttccttgtcttcttagcatgtaattccgagtattttattgtcgttatagggatgttcatgttgagaatgtccagcagcgcgggcaccttgactaaacaagcttaccacatcatgcttaaattaaatgacagatagcctatccaaaacatgcaagtgttacgtatatatacgtaacagtttattcgatcaaatccaaacatgcaactggaacttacgtactccctccgtcccacaatataagggattttaagtttttccttacaacatttgaccactcgtcttatttaaatttttttggcaaatataaaaaacgaaaagttctgcttaaagtactatagataataaagtaagtcacaaataaaataaataataatttcaaaaaattttgaataagacgagtgatcaaacgttacaaacaaaaactcaaaatcccttatattataggacagagggagtactatatagtcgttgctttcctcatcgatgtccttaattgtatggagcctgtaagtgctgttctctttagaaattaatggtgtaggccggcgactgatccgggttgaagaggccgaagtgcttctcggtgtcggcgcctttcttgtcgtactcgttgaacattggcgggaactgttttaacagctcaatcgagtggacgtccacccgtttattgtatgtcatgtaaatggttatgaaaaaattaaaaaaatatgaacaagatagataaatatgtaatatatcactccacaaacatgcaagttaaaaatcaacttctacaaattctaacaaatataacaaacaagactcaaattaatatatgtatatttacagttaaatttttttatttttggtacaacttgtagaagttgaatttgaatttgcatgtttgtgaagtgatatattacatactgatctatcttgtcaatttttttaaaaatatttcgtaaccatttagttgacatgcagtaaacgggtggacgtccactcaagctattagaatccatctccgaaaatgtagatctcgattctcccggccctcttgggcgtcccctgcccgacgtgtttgatcaggttctggttgtacgtctgcgcgttgctggcgctcgccgccgtgccgccggccgacggccacccgctctccgacaccacgatcgggacgctcccggcgccggcgctctccagcgcggagtagaacgtgtcgacgatggcgtcgaactggttctggtaagccttgctgccgtccggcaccaccgtgcccggcgacgtgaagagcgcgtagttgatgtcgtcgatctgggcccgcaggttgcccacgtaggcgaagtaggggtagacgttggccatcagcggcgcgccggtgctcgccaggtacttcgcgatgggcgtcatgtacgaggtcgcttcgggggagaacatgccattggacggcgggtacccggcgagcacgcccttctgggacaccgacacggacaccttgatgttgctgaggccggcagcggagagcgcgctgttcatgttctgcatggccgggaggacgttctgcgtgttgccgctctcaacctcgttgccgacggcgatgtagcggaagttgacgcccgggtagacctggacgttctgcttgacccaattggccacggcggaggggtcggaggcgaacgcggagaggttctcgttggcgacgcccatggtgagggcgatgtttgagccggttatatgtatgaaagattttcctagacactagaccagattgttttcaaacggaccataagtgcaaccgcacagaaaaataaaggacgagcatcagggcgtcgcccgcacagaaaaatctattttcgtgtgcgggtcatttaacaggcccgcatgcgaaaataagcctatttttttatgtgggcctgttaagtgacccgcacacgaaaataacccaccccacacgctggcaaccttatcctctcctgtcacgggcgagcgctgccattaatttcctccccacatcctccaatcctccctctcccgctccctctcctcctccccatccccttctcggcgacgccggcgccctcggttagggcgggggaggcggcggcatcgatggcggcggcagcattggcgggcgtcgtggctgcatcggcggcggcatcagcgagtgcggcgacgacatcggcgggcgccgcagcgacatcagcggtggcatcagagggcgttgcggcggcatcagcgagtgcggcggtggcgaccgtggggacggcggtggcgggcctcgggcaaggcagcgatgacgacggtggtggcggtgacatcgacgacgggcctcgggcaaggcagcgacgacggcggcggcggtgttaacggcggctaggttagggtttgcgggttgattttgttttttttttttggtttcggtttttaattttcccgtgcgtgcggcgcccgcacgcgaaaatcgattttcacgtgcgggtgtgtcacccgcacgaaaaaatcgggattttcacagacgcacacttccagacgggtagaagctccgcacgtaaaaatcaggtcaacggcgtcatttattaaaaaacggaggtagtatatacttacctttaggagtgaccgcaagtactccaaggaccagtgccagtgttaaaatggaagcaacaccatgctttgccatctttgtttgcaggcacaggtaggctttggatgcgccgcctctctcgatctag

SEQ ID NO: 69097 - DNA, 6291 bp, Oryza sativa
  unsure (1)..(6291): unsure at all n locations
tttagagttagccagttagtgatttagggacttgggttgggctgggaacttggggaggaattatggactatttggatgggcctttttaacttcagaaattccgacaaactttccggaatttttccgaccgattctgagttccgacggaaactgctattatcatattcaattccgtttccgaaaaattatttccgtttccgattccgtttctgagaaattccgaaaaaattccgaccggctgattccgtttccgaaaataggtccggaatctggaaaaattccaaaccattttcacccctacaggtagctatagctagttgttaaggagcctgctgaccactttgcatgccgatgcaatgtaacaaaagcattcacccctatttatacaagttcctagcacgtctatatttagcatgtattttttttcaaaaaatatatattttaataaatgacgttgacttttgaaataacgttggactgttcgcattatttaaataattagtgtgaatatgctaaagtataagtcatgcttaaatattctttaatgataaaatatgtcacaaacaaaataaacaatatttctataatttattttgaacagaacgaatgattaaacatcagatcaaagtcaatagtattatctattagaaaacagatgaagtttgtagcatgcagtttgcgaggtaatggtatataggtgattgctccggtccacattaccaggctgtcacgaaactttctttttattttgtatctatttcacaccaagtttgtttattgataaacttatagttccattctggtttggaactgataattttatactctatctgtttcatattataagtcgtttgactttttccttatcaaatttctttaagtttgattaagtttatagaaaaatatactagcattttcaatacaaaacaaatatattaccaaatatatttattgttaaatttaatgaaactaatttggtgttgtagatgttgctatttttttctataaagttggtcaaacctaaagaagtttgactaacaaaaaaaaaagtcaaatgacttataatacgaaatagggagagtatttcaaaggagtcttaaagggctctttgaaacgcaagattgaaaaaaaaagagaaatagaaataacttagtattttgttaagtgtaaaatatagattgcaaaatagattaaaaaataggaatgattgtttgagtagaccacacaaaaacccacgagtcggatgatagatattcaaatgaaatttctatgaggttgaagtttttttgctaacttttcttcaatatctttatagtatttttatttcataggaatttcaaataaaatggtgggagttaatgctttgttcaaaggcctttcttggaaattttcatgtaggatcaagatcctccaatatttcaatgtttgtcgtacaaatcaaagaggggataaatttcttatgtttttcctcttgaattgcaaggaaaagttcctatgtttctcgtttgctcattcatacgagtcaaagacatcaacactcaacagtgttatttcctataagattaaaattccttttttttccctttgcttttccttcattttaaagaggccctatagtatgtctggtaattggtgaagttataaaggaataagggataaaaatggctatgctccctttcaaacgcaggaatagtaaaatataggaatataaaaaaatggaatctccgtagggatgtatatgaaaacagaactacaaaacacagaaacaaagatatgtttggaacgctgaaaaacaaaacacaaaaatacaaaaaaaaaaaggaatgcggatgtacgtacaacaaatgagtagaaaagcacatgaagaagaatagatagttgggtgtttggaatacatgatttttctctctcccgctcctctcacttttcagcataggaagagaaaacattggttttccccgttttgggtgcaaactgcaaaggtacagattacaggaaacttctcctatattctgccttcctctgttccttagttccaaacgagcgattgacgtgaaccgttatcacgtgattatcacgtgcagtacctttttagtttttaaaactatagtatacgtcgcgataatcgtcaaatctggttgtgttcttaggtcctccgacacgaaaaacggagcaatggattaatacgtgattaattaattattagcttaaaatacttttaaaaatggaataatatgatttttaaaagcaacttttctatagaaattttttacaaaacacacaccgtttaacagtttgaaaagccttgggaacttggacttaagaacacaatataaaatggtttggtaaaccctgttaaccgctggattttttttttcttttgtttttcgaggatattggaacttcaacaggctgtgttcgtaatcaagggatgggaacaaatccctcacgtacggaaaacggaacggtccattaacgcgtgattaattaagtattagttatttttttcaaaaatggattaatttgatttttttaagcaactttcgtatacaatttttttaaaaaaatcacaccgtttagtagtttgaaaagcgtgcgcgcgaaaaaagagagtgattgggaacatgggattgcaaatccagcctggcgtgtatacgaagtctacgaagtacatctgcacgtgctgtttgtgctaattagctcagacaattacctcgtggctagtatcatatgggttttcataatgttaaccttgaggtttgcgtacgccacttgaacgaattcaccggtatctgggaaggatattattattcttgttagtcgcgacactcaccagcttcgattctcagcacctctccctagctagtcacgtttgtcacgaactcgcaatttagtattatccacggaccatgggccgttggatgaagcttctactgtccagatcgtctgaacgggtggcggtgtgctggtgttgggctgattaagggcatatttggtaaagctcaaactcttaaatctagctataggagttggagcaagcaaaacccagcttcaccttctttttttttcatttcatgacttggatctaaaataaagttatgaagcaggctaaacacgggcgtggctaattggcgcgcgcggctggcagcccctttttccctttttttttgcgattttttctctttttttcgctttcttatttttttccaaatattttcagtttcctttgtgccttttttctaattttttttaatctttagcagacttgttttcaaatgtttgagttgaaagtatttaaattttaagttgaaaattttcaaattgaaatttttcaatctcgagtcgagagttttcaaaactcgagttgaaagttttttaaatcttaaacttaaaaattttcaaatctcgagttgaaagttttcaaatctgagttgtaagtttttaaaatttgtcttataaatttaaatctcgagttgaaattttaaaagtttaagttgaaagtttctaaaatttgacttcaaagtttaaatcttaagtcaagagtttttaaatccaactcgaaagttttcaatcagttagtaaaaaaatctccagaaaaaatctactcttaatttcgtaattatccttagctaacttacttagtacgtcttaactcccccggaacgcacgctggcggcgcgtgcgcgagctagcttttccgggctacacctagctccaccttttttaaaattttgtgagagcgctccactcagttctgctatcattttacgtaaaactcttaggctgcactaaacaggtcctaacttcatgggtgattgctaattcgttttcaaatcttaacttataaattttcaaatctgaattcgaaaatttcaaatctcgagttaaaagtttttaaatccgaatagaaagttttcaaatcttggttgaaaaatttcaaacctgtgttgaaagttttcaaatctgagttgaaagttttcaagtttgagatgaaaacttgaaagttttcaaattttgacttaaaaaatttaaattttgagttaaaagttttcaaatctgggtttaaaattttcaaaatttgactttagatatatattttttcttttcaatttgttagtaaaaaaatctcgcggaaaaaagaaaaatcttatctactaccgtcattatctcaaactgttgttatctaagactaatactagtctaaccgccttatcccaacaaagcgctgcgtatgcgccaactagcgatccccaacttcgtgagcctgggctttaattcggtgtatgatgtgagccctgtctaatataatttgggcatgttcaggccgttcgatcaaatttcagcggtccagattgcttcgcgcggaggaaaacgtacatcctgatggaacgagagattgggaaaaaaaattaacgaagagagatggaaaaatgaaaaggacaaaaagaaaatataccgccaaaactccgaccccatttttttggcggggaaaacggcgatcctcattcggtgctcgtctgatctcaatgcagtatgtgtgtcatatggcaatcacaagcttggtgctcaagtttatatagattttgcattgttcttcatagagatatatgtttgtagttagctaagctacattgtcagataagattacttgagcatcacgtacggttgtgacatgaacatcatgattcattcaggtacaaaaaactgtctcaacgatgcatcaagtatcaaacatgtaaaagactgaaggaatctgccgtcgcaaggaatcatgcaaaagactgaagttcagtgagttgtccacctttatcttcatatgttttagttagctaagctacattgtcagataagattacttgagcatcacgtacggttgtgacatgaacatcatgattcaggtacaaaaaaaactgtctcaacgatgcatcaaagtatcaaacatgtaaaagaccgaaggaatctgccgtcgcaaggaatcatgcaaaagactgaagttcagtgagttgtccaccttatcttcacacctgcccttcccctcaccnnatnnncnacnggncttccccccccccccccccccccccttctctagatcctcatcctcccgaggtttctttggcacaactggttttgctttgactgcaaagaaataattttcattaaatttacatagcaagtcacaaaaaaactacgagaaaagctgaaaaaaagataaacaaacttactgttgcgaaaactcagaagtgtcttagcacttatttcttcgattccagcatctcttagcagcttaatctcagatgtcttcaccaaaacaactgtacagagatttttttggtggatatattcatccagtgccattgtcccaccaaacataaccaccaatcttttggtctctttctcttcagtgttaggagagtcatactccacaattgtgacactgccttctttactcatccaacacgtgtaaaacttttgagagagatccttaattaacttttgataatgaggagatttgtcttcaaagttgtcaaccacaataagcaagcgatgggctgaaaaagttttcataatttcaagaaaggaagcaatttcagcttcttcatcatcagccttaacccaacagattgaatcctcggattcatctgattccttaatttcatttgttgtgttagaaatttgttttccaccatcacgtttgtctggaaaaaaaagaagcaagagtacaaattaaatctgaaacaagcacaatctgaaacaacaatgttataacagaggaaaaaaagaaaacatgacaaattaaatacataaggagagacagagtaagcagcaaatgtgactataacccaaacaatgtaggatgtaaaaaactgaagtactgaaccactgatctgataattatcttatgaatgttctaactaccgaacattgaggcaatgcatttatacaaatcgcgctttacttgccagactaaaaatcaatctggaacgtgtcaaagggccaagacacttctggtgaatatgtgcatgtgagctgtaagtgttgactactacaatactcatctcatctgaaaccgagtattcttatgactccccagttaagatgcctatatatggagcattcatatctgtaggggctggagtgctggacggactaagagtctacagagcggcgtgtacaaaatagaaaaatataactgccaaaagagtaaaaaacacgagtttttggaactggcgcacccacaaaaacaaggcctttttgctagttagtcgcccgcattagtgtcgagcagagcaa

SEQ ID NO: 69098 - DNA, 8482 bp, Oryza sativa
ccattcagcacattataacagaccttgttgtcggtccaaacagtccctcttaacaagttaaggtcaataagcttgaagaggagagctatgactgccaaagcctctgcctccacaacactcttgcaaggtacctcatggaaaacctcagcccagacaagtttaccctctttaaagatgacaaaggcaagttttgcctttccagtttgctcacagaatgaagcatcacactcccccttgaaagaatcactgcatgattcagcatcactcgagtggaggaaggtctgaacggtcccgtagcactttgtccaatcatctacaacaatgaccctatgtttaaagatgtgctcaaggaacaaagtccattcatcttccagcaggatttccttttctgtggtcacatctagggcactgaggtagcgtggagacttcttcaacaggttatttgttctttggttgaaagttttcatggatttatcaagaggctggtgaatgagtaaacactttgaaacaagtagtggacgaatgctgtcctcaaacacttgcttcaacgcagggatagcaaaggtcttacttgcatcacgaatgcctggaagtactttccgcagtaagtccgcagtgtccccagggccaacactcaactgttccaaagaaagattgggccttgtgctgaatccacgctcgccgggatctcgaaaaacacctgcatgcatacaaaagaacacataaaaacaccatcaccaaacagccaaaacgagcatgaaaataacagcacaaatcagcagcaggggataatctacgagttctaacaatagatcagcagcagaggataattcacgagatcaaacaataaaagatcagtagcagggataatctacaagatcaaacaacagatcagcagcagggtagataatccacaagaacaaatctaccaggggataatctacaagttctaacaatagatcagcagcagaggataattcacaagatcaaacaataatagatcagtagcaggggataatctctacaagatcaaacaacagctcagcagcaggggaataatccacaagaacaaatctaccggggggtaatctccaagatcgaacaatagagtaaaaaaaaaggactgctttgacattgcccccacctcccccagtctccacgccaagcaaatctaccagatctcaaacagactagagaaacaaatccccagtttccacgcccagtacaaatcagaggatttttttaatatatataaacgagagaaacaaattcgccaaattaatggaccatcacacaaattaatagggtttaatctgcaagatcaactaggaaacaaatccgagccaacccaacttaatagaccatcacatagatcaataaggttttaatctacaagatcagctagggaaacaaaacttagaccatccctagagacgagtggattgacctgagttatcctcggcttgcttgctgccgccggcggtcagcgcacggcacagcgtccatctccggcggccgaaccgaaaaagactcgacatctccgcagatctccctcccaattcctcgtcgccccttcctggccgcctcgtccaccagaagggagacggggaaaaggggtttccagagagtagaagggaaggggaaagtgaagcgagtgtacgacgaccaatagagatttttttttgccccttgttgagaaagtgcgaatagagactactgggccttcatgttcgactttgggagtttggggatccgcaaggcaggcaggaagttgaaggcttggtttgacatagctgaaacttttggcccggtttgagatagctgatttttttttggctcgacatactgtataatctatttttttcactgattgctagtatttgactgtacaaatgaaggaattaactaattcttattatggataatccaatttttatgataaatctagaaactcgggtaaagtgcatcaacaaataatcgcacagtcgtaaaaatgtttgaacaaaaccgtaggtattatatcaaagttatactactgtttcataaaaccacataattaaccaatttaatccaaatctaacatgtagggggggaggggagggggtggtttacgagttatttcatccaccatacttcactgagcatgtaaaagtttcatcccacatgtcagatcatataaaactatcatctcacgtcatatttaagtagaatttgtcaattgtgcgattttatgaaacactaccgtaatactcgtaatactcgtggttatgtgtcacatgccaaaacccatatggttttgtattacttagaccataatacctatggttacgtgcaatttactttacaaaagtgacagtacgcaatccgaactctagattgggatcatggatttatattactaacatgtactccatcgatcatggagtaagtattttggttccatcgatccaatttaatggagccatcaaagaaaagcaaacaaaacaaaatcgccctcgacatcacagccagcaaggaggggcaaaaatgacttgttaaggagtggcactactacaaaaacgatttttctgtacgggacccatgatttttgcaaacggaccgtaagttgtcgcgtctggaaaaatcgagcggcattttcgcatacggctctttaaggcgcccatatggaaaaatcgttttttttccatgtgggctcttaagaggtctgtatgtaaaaataagctcgtttttgcatgcgaatcacttaagagcccgcatggaaaaatgagttagcatttttacatgcggaccacttaagatacccgcaaacaaaaaaaatcacccctttttttcatctccctccactctcttttccctcccaccacttcaaattatttctatctcctctctctctctctattttagtctcccctctctctctctcttcctatcctcttctatctctcgttttcttatgtcctccccgctctctctccaagagcgggcagcgacgaccgggagcaggacgggtggcaatggcgtcggcgggcggcggatttggcggcgccaccctcaggaaggttggatccaccgccctagggagcggctgctgcgacggcgggcgcgcagcgggggcggcggatcaggcgagtaggcggcggcaccaccaccatcccctcctcactgtcgccgttggcggcggccggctccgtccccccccctccccgccgccgacaaggcggtggcggcaacggcgacagctcagcctcctccagcctagatctgttggcaggagcggttggcggcgacgcgtgggcgacttccacgacgacgctggtggtcgatgggagcaacggcggcgggcctcctcccgcctggatccgacggcgggaacgggcagcggtgggagcaaacggtgggagcagcgggatcccacgacgccgacgcgtggccggcatgattttttttgcgatttttagatttttatttttgcatgcggcccatgtaagcaaccgcatgctgttgccctagccgcatgcaaagatcgcgattttcgcagacctttctgtgcatgcggctggcccaaccgcatgcaaaaatgcttttcgcccttttgcagaaaaaccctttcgtagtagtgtgggtaaggcattttaagtaagttggtggtaaaaatcaccttttacaagtagtaggttctttttttaacaaaatattataacttcaagagtttttatattttaataaaacaaagggagtaatagtaaactataaaaaatataaatcactcatatatggccagctagacggcatgtagactgcatctataggtgcacctcatagggagtgctattactactgcctccatctcaaaataagtttattttagactacaatactcctactttataaaatcccaatgcaactattactcgctttatctactttcaatacaattattcactactttcgcatattccaatgcaatgattactttaaagatgaacttattttcagacaatttgaaggagcattgggaacttattttaggacaaattgaagatgttagtattatttattatggtccaagttacacaaaaccacataagttttagcactactgtttcataacaccaaataattgaccaatttaacccagatctgacacgtgggggattcatgagttctttcatccaccatatgaccatacttatgtgagcatatcagagtttcgtcccacatgtcagatcatataaaacatgtcatattttagtagaaattgtatattgtggcactagagctagagctcaacaaaacagtttcaactccacctaaaattggagacctaaaattggagtggagctgggtggagctctcacaaaatgatctagagaggtggagctgggtttaggtagctccacaactcccctctagacccaactcctaaagttaaatttaggagttagagctctactaagcaggctctatatataggtgcacctcatcgggagtactcccttcgtcccaaaaaaactcaacctaggttgattctttttgggacggacggagtattaatctacctagaaactggacgtttgcaggcgtacgggttccccatgggacgcaagatgtaaaaatcatcagcagaaacaatcaaacagtggagaaaagaacacagcaaaaacagagcaaatttatttaagagaagtagggatatattactgcctctgtaccatggtgtagtgctcatcaatacgagttgtaataccaatcataggcttcctccgtacacatttgcagggggagatcagtcgtcttttttgcacacaatgaactgaatctcctccatctcctatctgcaaaattttggcatcatgggtttcctttcctccgcaaataagtgacgccttgcccaccggcccctgcggcatgatagaagattcaaagtggtgtcacgtaatgggggatcaattaattttgatgcatgacagtacaatttaaacttagtttaactcttcacgtgaatggaagtggtcgttggttacccatccacagatataacatctctatttacatatttatgcggtggaactcagatagataaaattgttcagcatcgtaaaaacaacaaatcaaattgatacccgtctatgagcgagcgcaccgtaccatagtatggaattgtctgctgtaggacagcccacgaaaaatacaaggtttgatttgcaattatcacagcaaggaatgtgatactaagcccttatcacttttacatgttactagttgtataaaaaagcacccaacccgtgtggcatagatgcatagtagtacgtgcacacaatgcatcgcaatgctaatgcccttaaacagcaaaaacaagacgttccacctaatgaattttaaagccttagattgcgagctaaatgaaagaaatagtgataaaaatacactacaattagggccttaggcctgaaacattttggtctcacacaaaacattcaaattcaatttggtgaaatatcaacacatctgcagtgaatcaaaaatatctacacatctgcaatgaatcgaagacaaaataatgaaacaacattaaaatacttggtacaacatttcaatccaacaaaagaaacatcaaaaatgcattgactgaaacactggaaatttcacaaaatcaatgctggctaggtctggcttcttcctcctctccgttagttggatcaggcttccttcgacaacctcaagtgctgcaacgcgatgacccggtgatacgtacttcaacttccttagccacgatgggctgccccacgcctcctctttgccgctgctgcgggcgtcctctccatcgccatcttcggtggcggtgctacgcactactagaaaaaacatttttactgacggcctaaaaacatttgcacaggcgcgccagcaggtaaaggccagtgaaaatccttactttccacaagcggtcagaatactgtttgcgaaaattgaaaccaatgcgcggtgggtagttaggagcggtgggctgtgggtggtggggcaatgggatttatttttttttacgagcggtgctctaccgccacacttaagaggtccgcctaaaaaatagtgttattttttatgacgtacctcctaagtttccgctagcgaaaatcggttttcgctggcggctcatgagcgagaatcctcccatatgtttttactagcgtttgtttcattaatccgccggcaaaaataaaagggtgtcgtcatgaaaaatcgtttttttaagtagtgacggggacgctgcgccctcgtcctcacatcaaagccttggtgagagagagaaagagtaaagtagaggagagaaaacgagcaggaagataagttagagagatgagtgagatacgggagagagaaatgagtgaatgaatagctatgtggggcgcctgtttttgtcccccagattggacgccccatatggagcgtattcacaatccaattactgggtcaatacagtgcaatacagtgcaacacatgtactacaggagtagtagacatagcacaagagaagtaattcgtttaattaccttcatcttgttgaatctcgcgtacaaactaaggtacgtcacatcaaacggtaacatcatcacgcggtctgcaaaaaaaaaaaaattacgattaatgtaaagtaaagcatgtaaaacatactgctaaaagcgcactggctgtgtatgtaaaccaggggaaatataggttacaagtaaaaataggataatgataataataatccacagaccacagctcaatcaatccagccgaccaaccaatcagactgattgttgccatgcttggagtagtacttataataatgttgaatatgaatcggcaaatccatcggtccaactgagcaaccaaatgaaagcaaaaaaataaaaccgccgggcgagaagaaatagtagtagtattaaacactaacgatctgatactagggctgtgtttagtttcaaaatttttctttaaaatctcaactttttcgatcacatcaaaactttcctacacacatagacttacaactttcccgtcacatcgttccaatttcaaccaaactttcaattttgacgtgaactaaacacagcctagcagctagggtttgcaactagactgcatctgtaggtgcaccacatctggatcttgaaacgatgagaaatcatcaacacacccaatcaatcaaacaccagagaagaaatgaaagcagagcaaataggctactagtagtacttcactaatcatatgttggacttcatccgtactctgttgcaggaagggagaccccgtcctttttttcctcaaacagatatcctcctctctgcgaaattttggcttcgtaaggattccattcctatctctgcgaaattttggctccataaagattcctttcctccgcgcacacgcagcctgcagcaggagagaaaagattcatcagagatgacaacgaagtgggatggagtagggttgagaacgcgttggggaaagcagagctgactgctagggttgtagtacaacgtgtgcagtcttccacacccaccccgccggcccctttctcaagatctgatctgatctgacgatgtgaaatgtcaatcctacccatacctctatgcgaaattcctattgtagacataccccgggcgggttatccactaatctctaataattaaaacaatcgttgttgtttagggattaccaaattaagacgcatgcattgtttaggtactacagcagcgcaactactatactcatttgcatccaatataagatccttggtgttggtgatgggggtcgaaaaaactttaacagatgttaagaaaagaagaaggcacaggctgtgtttggaacggctggttcccatctctccacctcgtttttcacgcgcacgcttttcaaactgttaaacggtttgtttttttacaaatttaccactactccgaattgttattaaaaaactgccactagaaaattgcaaaaatgccattagtactatcattccagtgatatccttgcaatattaaaaaaaccagtggaaaatttacaaatgccctaaaaagtttctatatgaaagttatttaaaaaacatattgatctatattttttaaaaaattagctaatacttaattaatcacgcgctaatagattgttccgttttcgcgcgcgtacatgctgggaaccgattgttgcgacacatagacacagattaattgatatcaaaccagagacgtgtacgtacctcgatatcaaatgtagagttaaaccagttgtgagaactgggaatctcgctcggcgacagcccactaaaaaaccccaccaaccattgacggattgggcagcagctgctgattaagtatggcctcgtttagttcccaaatatttttcccaaaaataccggggctgcttggttggcggcttaggtggtgtttagatccagggacttaactttagtccctatctttagacactaatttag

SEQ ID NO: 69099 - DNA, 12572 bp, Oryza sativa
cgaatctttggacatatgcatggagtattaaatatagatttagaaaaaactaattgcacggttaggagaaaatcgcgagacaaatctttttagcctaatttgtccacgattagccatgagtgctacagtaacccacatgcgctaatgacagattaattagactcaaaagattcatctcgcagtttccaggcaagttatgaaattagtttttcattcgtgtctgaaaacaccttccgacatccggtcaaacatccgatgtaatagccaaaaattttcttttcgcgaactaaaaaggccctatgttgctgtcttcttcgtctccatcccacgcctcgcccatctactcgtactactccctatgtttcaggttacaagacgttttaactttggtcaaagtcaaactacattaaatttgatttaagtctatagaaaaaagtagtaatattttcaatttaagacaaatttattatcaatatatattcaactattgatttgatgaaaataatttagtattataaatattattatatttatctataaactcagttaaactttaaacagtttgaatttgactaaagtcaaaacgtcttataacctgaaacggagggagtatcaaatagtggatgatgatttgtctcactatttgttgtatgtacaaatgtgttccttcaagagtactactccctatgtcccatattaagcgtacttgtgggttttagtgtccaacgtttgaccgtctttcttatttaattttttttataatttgtatttttattgttattagatgataagatataaatagtaatttatgtgtgacttaatttttaaaacttttttataaattttttaaataagatggacggttagatattggataaaaaagttatggttgtatttaaaatagggagtacgctgctgcgtgaaagaagtaggaggtgtgaatctttatcttcggcctgactacaagtatttatatatggatgcatggatattgatgatgcatatccattccgtcaatattcacgcgaactaatggaaataaatttatcataatatatagtaaattatcccaagattgagccagtagtaaaaaaactaatacaacactctacttaggtggtgttcttttcttctgaagatgaagatggagatgaagattaagtttttttacgtaaaatgaggtggtattgatatatgagtgattgagttttaattattataaacttaaaaaatagattaatatgatattttagagcaactttcatatagaaagttctcgcatgaaacgtaccgtttagcagtttaaaaagcgtgtgccataaaaatcttaattttcatccaactccctggccggctcttggttcttgagcaaactcctccactgggatgctcatagatgaagaaaagagactttaggcaagtggttctggtagctcagttggttacagcaaaggttaatctttagaataaaatccagttagaaaagaaaatccaataagagttaagctgccatgagcatcatggcatagataggtcaaagggaaggaggcaagcccgacgggaccttggcctggtttagatggcaaaaatttttgttttggatgtcacattggatatatggacatatatttgaaggattaaacgttgtctaataataaaataaattacagattccgtcaggaaactgtgagacaaatttattatgcctaattaatttgtcattaacaaatatttactgtagcaccatattgtcaaatcatggtgcacttaggcttaaaagatttgtctcacaatttacacgtaaactatgtaattgatttttttatccacatttaatactccatgcatatttaatactttatgtatgtgtctaaacattcgatagaataggtgaaaagcttttgttttgaaaactaagcccaaaattagaagtttgaagaaattggaacgatgtgatggaaaagttgaaagtttatgggtgcaggaaagttcaatgtgatggaaaagttagaagtttgaagaaaaaaattggaatataaggagggcatatttggatgctatactaagtttgccactattcatcatactttttacgccacacttgtctaagttgtggcttaaaaaaaatgagccacgccttagctagcaagattggattgtgccatactttaatgagttgatgacatgtgggaccctaatagatgagaaagaatcttgctacaagcgtggctatgaaccaaataatatgctaatttagtcaaacttgtctaatataaagtgtggtaatctttgacaaattttgatagcaaaccaaataaccctttagtgcatgcatcatggaaacggtgcaaattaacgcagccccgcgcatacgatcggttggccgcgctgcatgcgggattgattaatttttttcttgaaattccatttgatttgatgttgattgatcgagaatgaaacgtggattatttaaataggagtactactagtagtgcgatcaaaatctgaaacccatcacagcatcacatcacatcgatcgatggaggggctgaaacccatgcacgcacgataatttataatttaatcgattccggccaggtgacccgcccagtatatattccccaccacaaaggttcggttgttggtttggtagcttgtactcccaccgttttctgtattactcgaaacttttaactttaactaatttatagttaaacctttttaagctttattaagttcattagaaaaattagcaacaactataacactaaattaatttcatcaaatataatatcaaatttatttatatagtatgttttttatttgaaaatgttgctacatttttttataaatttggtgaaacttatgtaatataaaacggatgggtggtattgtgctttgtcatcgatccatacatacatgcaaacgagggacttggtccaattcatttctaaaagaaaaatctcagcaaattttggtagtgttaattttgtggggtatcatacttaagagcaggtacaatagcaggctataagccagctgcaaacatattttaagcagataaatgaggagagagaaggtcaacaggctacagatttgtagccagctatagcacggactccaatacacaatgtgtgtatgacatgtgggaccagatattaatagtgtagtatgtaactattgtataaatgagctattagattggctataatgaattaaagctagtaattgacaatactatacttgctcaaagaaagatactgtgtactttttccccatagaaatttcttccggcccattagggataggctcgtgcagtgatgtcggccgccaagcgattgccggctgctgcgggcataggtgtatgctttacagatcgatgccaattgagctcacgtccaaggttctgcaccgttcaacaagcgtcgaactggtacttggcatggctaagttgcatggtcaaataacgttagtgttctcttccaatttgcttccatcgtctcgcatttgaaacctaaataaatggtaaactttatatttctgccactttgcctcatggctaaatgtcagtacaaagtaagatcgtcaaataaaaataattctaaaacaatggttggtcaccctcacgcaaaaggacaattattgtaactagtaatatgcccgtgctaaacgctacggtgcaattatattaatctttaataaaactctaaaatgaatttggatgtcgcaaatagaaaaaatatatagagtacaagaaaatatattttccacatgtcacgaattcggatgttcccataggccaattccattcatttttctaaattggcttatgtacttaaaaatattgatttttctattcatcacacatggcacacgctggtcgcagcccattaaggatagcatgagggcatgaatttataaacccaaataccagtttgatatgacacaaatgtcaaagtaatagtttgacaatgtttcacaatataagaattgttggttatctcgttaacgtcttctttcaatatttatatgaaacgactactaaaattagtcgatgacggaaatgcatatttagagagacacaagtgcatatttaatcatcttattaatcacacaatattccacctgaatggtgatggcgtgttgtacaaaacaagaggacattggtgagtaacattccagttagcaatttactattttctaaaataagtttctgaattaattttgatcacgcgaacctacatttgctcaccaatcatgaacgttttgatacatgatattctgttcttccctgtaggttcgacttctttctttggctttgccaaaatccttgttgtttgtcaagttgccttgacagacccctcgacaatgtgacaatgtgccaaaatcaatacgttatttacagagtaatttgacggatgaacaataagtaatgttaatgtaaaaacttcataatttacagtcccactccaaaaagccggtagccacttcccatcgtttctaaatgatcaaatacctatcaaacgtttcgtctcggttgatgtgattccttcaaaataagaaattatgcttgtttccagcaagaagtaattgagctctatagctattggacattcccctgtgtcatctatagttgcttccataaagtcatttttatacaatgaatcataaaatatttttatctatctcctaaagaatcataacttcctaaagactgacaatcaaagtgcatcatgtatatttttgttttctcaaccatttgtgttttacataaaaaattaagctcagtagtcttttagttagaactgtcactccaagcacggctcgatgatgggcggctccagaaacggctcaaagcgcgacgtgaaggggttcgccgccgatctggatacaagaaacaaattttctcaaatgaaattgtaataaacctaaaagaattcgaaatcggatgagcacacttaaggctaggggtaggcgttcggtcataaccgagacttcggtccggttagttcggtctttaaaaatttcggttatctagaattgacacccgaagttgctctcacaagaatcaagaccgacagttcggttagccgaaacttcggtctcggtcttcggttagaccgtacagaccgaacaggcatacagcatgtggcaattggcagccaacacaacaatcagaacatgattgcaaaacaaatcaagcgttgaaggattcaggctcatacgtacagtacattacaagattgtatggactccattgtgctgctctgttcgtcaccttcacttcaatggccccctcctcctccggctcggcgattggccccctcgctatctcagcagtcgggtagacagcagcacggctgcacggcagcaggcggtgcgcgccgcgacgggcgcacggaggggcagcacgccggcagcagcgcgcgggcagtgccgcggcggcgcggcaacgccgacgagccgacgagattggggtagtgggtaggccgagcggcggcgcttgaggcgaagcgacgagattctggttcgggacttaggtttgttgacttgtttgtctcgtggagaaatacactaatcactaatgggcttgccagccacccaacccatgagcccaacaccaacacatgcctatgtttgcctatgtttaactctgtttttatacagatcggttacatcgagtacccgagaagaatgaccgaactacccaaaaaaacttcggtcttctcgagtgcatgaccgaactaccgaccgatgaccgaaacttcgggtagttcgggttcggttttggtttgtttgggttcggtcttcggtctcggttttttctgcccacccctacttaagatcctggtctatcatttttacaaaaagtgtagaacacgatgggtcaaaattatgctcagaatagaaggattaaacactacatttccaatcgtatgcataattattgaaattatctcgaaaataatccttgtaccaatattgactcaattgttcgccatctgtacgtaaatagagcaggaaagcacatggttaccaattgctttcgagcatgagcaaattaatttcagcaactaatctctatgtactattctttaagatcctcagaaaataagggaataaaatcgatcagctttggctcactgcttgagtctgatacagttgatctttaaaaaaactaaagtacctgggcggcattgactgggattcacggcgagtcaaggacgtcggtcaccggcagaggggacaatggaggcgacgtccaacaggttagccttacttccaaagtattttttttgcaacgtggatataattggatttattttaaaattataccgctgaatgtgattttttttctgtgaagcttatatttattttttgttatttttagacattccaaacatgctcatagttggtgaaaaagggaagcaaacagttgaagattattaccagttgaagatgtaatccagaggtcaaacctgagaattaaaaaaatgaaaattaatatagcagtacaccactctaaagattattagtcaggttatattttacacaaatttccggtcaattgatgtgtataatgcatgaaattcaaaatatagccaaaggcgctttccagtttccaacagtaatgacaaattttgatgagtaaatgaaaataaggcagcagtgtacatataagcccatagaactttattttaatggcttgtgcattacatatcgtaatttgaatttgaactgtaatggttgaaggaaagtgatcgtgcaatgattaccgtgttcgcggagaggttgagactggagagggttccagtggtggcgtcgtcgatctggaggacatggagaaaaaatcataaacccttgacatcagttgttatgcatatggatatataattggcatcatggtttttcggtaattaagctcaactaaagggtagtaatatataaatcaacatgcagagcatgaatcaaacagtcttgatttatgaacatttccattgaatcgcacaaatagatagataatgcaattatctgaacctgaaatcgaaatcccatttacaactacaaattagttaaaaaattgatgcaaatatagaaataatatcccttaacaacaataatggactaaaatcatgtctatcaagagcatcagttatagccccacaccagtacaaattgagttatatttttcttgagctttatggtgtgcacaaggtacatcccccatgtttgtcaagtgcattagctgtgttccaatttctccaaacaacccttaaaaagattactacttccccattcctattcacgtcttacccaataggccaataccaaaacattccatgacagcagaaacttattcgcattcattcacaaatcacaaattggcaacctaagcttgagctacaagcctatgagcaatgaggcatgagctatcaaccactgaccttcaattgccaatcggagtcgccgagtaggagcctcggatgtagggatgtggaggcgtgtagtgacagagcaagagtaatcaggaattttagttgggtagtcctacttcagaggttcaaatcacatatcaaaattttggaacactgcaaatctcatacaagtacaagttagttaagatgtgattaaaatatatcaataatatcttataacatcaataatgaaaaaagcttcggtctccctgcagcaagggggaacttctgaaaaggaattaattgtacggagaagagatcacaacagatataatttatatgaaagttgaaaccatcctggagcaacaaattgtactgcttgttattccttgacaggtttgtgcagaacaatacacagcaagaggcgattccaaacagcctcaagaacagaacgggcttgcaactgtaaccatggtttgcgcatacacatgcttaaaaaacatttcatatttttagagaatggatcatatttaaatatgtttattaaaatctgtagaaatttcactgggagtaatatctcactgttgtacacaaaataaaccacccccatacagaaaatggagatgctgcataaatgtttggcaaacttgtgttagagcaacatagcagcataaaatccatgtgcttctacgctgttaccatcaaatttacaacacttaagatcactcatatttactttgatttttctttaataaagcaattcttagttgttaaagaccataagcttagcaaatggcaaagaaatgaattttgtttgcagagagccttttttaatacctttttcatgcaagcattactgaagctgtgagggagagtatgcagtacctgattatgcagtccctcctcttttctgaattttgtgggggagattccttgccaagcaagcctatcaaggagcaaaagaaggaaaaaaaattagcaagattaagagttggaaatgaccaacatctccgtaacgatcagcagactaattagatcagcataaaaggcaaaacatttgatatagtcactccatatagaagtcctctagggtgagaagatataatttgcagtgtatcccctgattcggtttgatcattccgtaaaaaagaaaaatacctgtagcctttaaatgcgatgaaacaatgtaattttctggtgtaatagaattaataactgatatacttgaccaaataagttccaattccgttatttcatctacatggttcagaaacgaacttaataaaactctctaaaaaatgtactgataccaccaagctagtagctgaactacttaataaaactctctacaatcgctaacatccagatgacaaccacctactggacaatatttgcaaaaactgaattatgctagtccagatcaaatcatccagtcatatatggaatatggatattatttatttaactaaaagttgctgtcacagggaacataattgagagctgcacgttgagccaagaacacgataaaaaaaacacaccatttttatgcaaacaggcagatagatagaggtcaaaacatcaaattattagttaaggaattaaattaagctaaggcaaatcctgctccaattcggcatgtctacctgatcgataatcgatcgttttgttctcgagcatttcccatcgagagctcacaaatccgtctccagtttacggtgcggcgattgcgccgacgatcgatggatcccaggctgctcagtgccgcgcgccgcggtgaccgcgagtggctggaggccgttcttggcggcgccgcaccggcgccggaccaaggcgccgttgacgtcgcggggccgccggacccgggacaacaagcgcccgctcagccgccaccgccatcaccctccgcggcggcgctgctcctggacgtggcgacgacgccgcggggggactccgcactgcacgtcgtggcgggctccggcgacagcgacgacttcctgcgctgcgcgcgcatgatctaccacggcgccgagggtctcctgggtcacaccaacgcgacaggcggtcgcgcggatgaggaggaggcgcggcgattgcggaagagaaggaggtgcgggagaggatgcgttgcggcagagaggtagatgcgggagaggatgcggagggaggtgggggacacgcgcgctgatataggacgttggatccaaattcttcagatgggtttcgaccgttggacgtgtgacatgatgaatgagtaaaaccatttgtttaagaaaaaagtctaaatacccccctaaactttagataaaagtccgtctagcaccctgaactttaaaaccagatatccaacccctaaactttgtaaaaccgttcatattacccactatggtggttttgtatagtggtttttatctaattcgtatataaattggatgagtttgatcacgtgacatacacatcagacatatatattaaaatctccacttaaatctttctttttaccactttttagctctcttacaaacaagtaccaacataataatagcacggtatcgctgtataagtataaattgatgacttacaactgatgatatgtaaatatgttatatatgttatttaaagttattcgtttaagcttttaaaatatgcaaaaccaccatccaaaaccaccttagggggtaatataaacggttttgcaaagtttagggggttgaatgtccggttttaatgtttagggtgctagatggacttccatccaaagtttaggggggtatttggactttttcctttgtttaactatagggtagaagatgaaagggctataataacgtatcacataggttcgtttatagtttatgagttacgctacacaatgcatacatttgattgcagaaagtatagtgcatacagaactcatttccaaagaatataactgtttcaacgttcaccaatgaccagacgatcatagcatgagacttcatgcatgaccatcaagtttgagcactgtcaaggtatatatcctttagttttgccacgttggacacagtctcgcatctcctacaagtttcaaccacaggatgtcagtcatacaccgccattgatatattgttgaactagcaagtacataactgtcgggtcccgaaactaatgattcgaaaaccgatatatttaactgtatcaagccctgaatcagtagattgatacaggttcaacaatctgaattttcattacatacatttgaatgtctctaaaggagattttattataacataatagggtatttacaagtttgtggctaactattattacaacagaagctatagaatgactcaactctaatgttttgctatagacttaaaccatctaactacgctagacttggaagttaagttggaatgaaactaacttatatgattaaactcccggctttggcaaaatctccaaaatgactctaaaaaggtggggttgaagcaagggtgagtacaatgtactcagcaagctattatattcaatattgaatgcatgaaatgataatatcttagtagagctagatttacttgcagaaagctgagaataaagagggacaaagcctatgatgtttgaaatgcatcaatatttaataaaatcttcaattaggtttctaaccaaataccatatgagtcccgatactcaagtccatgagcacggctattcgaatagttttaagaatattcatactgcagtagatgtacgctttacccgcagtccataacttgccaataatcattagcttagtcatggcccagtattaggttactaacaatagtggtacctgttccgtgaactctagtcctcatgcgctctgaacgtaacgttatcagcagcgagagtagttctggcgttctcgaggtttttcgagagaactagttgagagaccccccgtcatctcaatcaggttttcacaattcacacatacagctcgcgagataatcaagatatttacctgcgcctcggtaaatattacaatcgccctgctcggcgtaagtttgcctcctgcgcgagaacttaaataagaaccactacacagagataccacattattaattgacataataactaggtatatccccattctagaagctgcggtcatacctgttcgtttgacataagtatttggtgaacaattatatcgactgagacagcactagccacccggaaatcaaccaattcctacgtactgtcccaatctaagtttattatatttttatgcaatctaactaggcaaggctaagcaaaagctagcatatttggtttactatgttcaggttatgcatttgaaatcatgtatgactaatgcatagaataatagaggcatggaatatgggacaattatgctcaaaggagagggataataacttgccttgctccaacgtaaataaatccaatatagcagcctgattatcgattcttgaaataccataggttgccatccaaaagataatagactctacttgaaggaagagccaaattcaataaaagccataaaatagaaagagaacgataaatggttaaaagggctatggtttagggtatattctatttcctttatagggtatagggattattgggctagtatttgctggcggtaggtttaggtagtataaggtttagttgtttgctagtcgttgctagagttgggtagcataacgacttgatttggtatcttctttagccggtgtcaacagacagcatgacggttagaggaataggaagtttagcggtgtggaagtgttactccgacaaccgtgagtggcggcggagtggttaggatcacacagagctcaagaactaactgtgcggcgtgctgtaaaggtcgagggaatagtgagctccgaccgttgtacgcatcgaggcgtggagtgtcgagagcagcacttcgaccttgggtttgggttttgccgggctttacaaccaacggttcaacgtcggggatagtaaaccgcgaacgtccccatggaaggcgtaaagtttcaaccggcggctttttagtggcttaaggggtagtttgggataaaagaaaatatttgaaagacaaatataaattcagacggtatttgaataaattcaaataaaatagcgaattgggtttcaaaagggagcatttgaatttagatgcattta

SEQ ID NO: 69100 - DNA, 1847 bp, Oryza sativa
aatttagatgaatttatgtccaagttttactggaatcggatctactgtttaggagatatgggcttctaaagaatatgatttgaattaaatctagaaatgtgaaaatgcactgtgtataggcccacctgtcagcctttctttttccttttcttcttcttcttttcgttctcttctttctgtctcacagtgagccgagagaagagagaggagaggccgagtggggcggcggtgctccagtggctgggaggctgcgacgtcggcggaggtttgtgttcccgagcgacgcgcacccggggagggtggtggatggaagagaggaagagggatgtggccggaacggcgagtagaagagcttatctccggtggtaaagagaggggtggtggtggcttgattcaaggggaaaaggaaggggagatgggcaaaatggattcgccggagtggagccagcatagtggcgcaagggaagaggaaggggaactacgaaggaggagatcggccgacggcggcgacggccggacatggatggagggagagagagagaaaagagcttcaagctcgatgtgaggaaatgatggggtattgccggctatttataggcgacgaagggcggtggtcaatggcggtttgcagaggggaagagggagttggccttggtggcggcgacgtgagaaggaaggcgacggcgccggctgtggcctgtgattggtcggcgacggcggcgcatacacgcggcggtcgcgggagggttggctggcggcagtggagtgcacggcacagcgacggcttgccgtggttggcaaggcagcggcggcggcaagcgtacgcgcgccacgcgcgcccatggcgccggcggcagcgcccacagaaaggaaaaaatacaccgaaggtccctcaacttgtcaccgagttacaaaatcatcgccttttgttttctccccttcagcggcctcgagcctcctttgcgccccctttctcatagaagccgctgggttgaccccgagagccgctgggttgacccagagggccgaattcaatggtagagaaggctttaataagaatttagccatgagtgacctttttaagtattgcaaaagaagaggcctgctgatagagctgggcgggaagcgatactagttatcaggttagagaaaggcctggcccgtaagctggcccccctttaaaagccattccttattaataaggatttgttacgcgcgatatgccgacgacttactactggaaatcgtgggtgccgtatttcttctcatagaaatacaaaaacgtatcacccacttcctacaatccggcccgaacctttgggtgagctccgcagaatcaacaaccatagctacacggagtacggtagaattcctcggtacggtcattcgggaagttcccccgaggacgactcccatacaattcctgcgagagctggagaagcgtctacgggtaaagcaccgtatctagaggtgagtgagcctacgaccaccaattgcttatcggcaaatattatgcggcgcatgaggggcgagcgagggggcatgccaagtcagcaaaaagctacagtcctacagtgcccggggtggttgttttgcgagaaagccctccggtttgttcgtaattccgagtaggtcccttccgaacagtgcccctgaggcgatattgtgcgtaaggacccttctaaaatcctgatattacatgcgcaggaggggagaaacgcgaaataggagctctatgtaaaaatataaagtctaggggctttttcgcaaaagtgccgcgcactgacccccttgccgcctctcctcgactcctcctccctctcgtcctgcgccatcatgacgccgcc

SEQ ID NO: 69101 - DNA, 1250 bp, Oryza sativa
atcatgatgccattggattttcccattcatgtgttcagatatgttgcacagacgttctccatgatatgttcagttcagcagctggaggcagagttgccactcgtggagaataactcttgtgatctttgcatacagactacctgtatgttgcttctaacaggggtatgtgcagcaccacataacacaaactcctctaaaagaaacatctttcacgtctacctgtttctgctaacaaaagcattttgtatttctctcattcacatggagagttgattggtttgtttgcaggaatttgttggcatttgaattcgaggttagacagtggggttgtgacaaaaggtgacacactcacacactttgtttcattatggactccatcaagcagtgtcatgggcctccaaaattgttcatacgtgacaagtatgatagcttaacctcttctattcatgtgtgagttaagcttgcatctactgaaaactaaagagaatgctggccttcatggatgtgatcatgcattttttcaggtatgacattaggggtgagggagcttgcttgaagagatacacagactcgtccttcaatactggttttgcatgttctaggatgctagagccaataactcaaagagtaagaagacctcttagagctatcgtaacgaaactgaaaataatagatttctttagctgattatttttgtggttgtggatgattcaatccactcagacatagaatcatacctgacctaaccttaaagatcgagtgcttggcatttcttttccatttcttctaggagattaggccgcccctgtagaatcctcagattttcagaccacctaatgcagccaacaatgtctccaagtacccccccctctctatatataatcatctcatactatccagtatcctttcgcttctattttcttcccagaaaaacaatatcttttttgtaggttggagatagatttgtctaggcaccgatgactggagtaccgacaactaagtggatctgtgtttcaaagcttcaaaccacatacgtagaatctgtacatgagaatcttcaccagatgagaacccctgctccatgaaccattcagaagtgtagatatctttcattgcctcacctgacacaaacactgtagaggacatcatgtagacactttcagtaccatgtacaacggcaagtaaaacaagtatgtgtcaatgatttttgctcatctcagcttagtgttatgagttttacatgtggaatt

SEQ ID NO: 69102 - DNA, 1273 bp, Oryza sativa
ggataaaaatgcatttaacaatatggtgtatatgcaagcttaggcaaaattttcagctacgaacttactcctttagccttcacctaaaaattgcttactattattttcctggagttgtcctcaattttctcaacatcactcatattctagacgcgttagttacaacaaataatgtgattactgagcaggaagttcaagaatatcggcatatttgtaggaaaatgatgtcttcagtccaaactgagaaaatattatgggagtcttctcttaattgctgccccaggcagcaaggcatatggatatgccattaaccaactcaagaattgcactgtaaaatgtcaaaaactaaatggaaagtatttgtgttcttatcaaggtctttctgttgagttttaaggttcagagttatgatcccttgatggtccatttgtgttggtttggatcaacaacatgccatgggctgctgatagtatcatggcggctcttggggccaaggtaattgaattcttcgctgtaacaattgtttctccagtaatgttttgtccatatagtatactttgtatttcaaacctatcttctgaaatggggaaaaagatccatatttccacctagggaatatagtaggcatgttcatttctgatgacaaacctgtgattaggactagccattagccataagtatttactgaccagaatgtggacagaaatcctttttctatagttcttgaatttatacagatcaagaataaggatatttctatttcatcttgtagcaaggcaaactttatgatttgttcgttgtaaccactctatgaggtaagcatgatttcgttgaccgatgaagggggtaaaccctgttgtgatttgaagaaataaattggtatattgataatgctaaaagaacacttagttgtgcttgtactttgttatagggaactagattgaactaggtttatgttttgttttctggttcgttcatcactttttacaaccaaaataataactaaggttcttgctcaaattttttttttgttattctaataccagtcaatataacatctccattgttcgatatttcagttatatctattaaactacttctccgaagctaaattcaaactcagcatgtcaccctatcctatttaactggttttcttttttacagcgtgaaatatatgctattttgcccatgtaacgaagagtagttaatttggggatcactgatcagtgatcacataagcatctattttttctgctgaaagggctgcaggaat

SEQ ID NO: 69103 - DNA, 708 bp, Oryza sativa
ctatcagcttattttgctttagttcacatgtgtactctaagtagcttatcacgtctttctcgttaacctgcaggtttttaaggtcatgtctgaagaaatcaagttacacattgatctcctcagtccatctcaaataacttagcttcagtttcagtgatgagtgtgtcctttagaacagttgctagctggtctctaatattggaaaggtgggactagagtcatatttttacagttgaggtacatctatatttgttcagtgtgaaaaaccatcttgcatcaaactgtttgtcatctatttccaaaactgggtctcttagacaatttaactatgtttttgtgctcatcaaaggaaagccaaggaaagcaggggcctgactcttctgaccaagttgttacatcgaccttgcaaagggtagagtgaagatctcgtcatgatctcatatcatcgtgcaaatatgtgatttcattttccatatgcatcagtgcttcattcttagagtataacggctatgtaatagttttgttctctccagattctgtaacaccactcgtacgaaattactcaccaatggctaacatataagccgtttgattcatatatattatatgtgccttcaactttattcagctttaatcttacaagaccagtagttcagcctaaaaacagcaaaataatctaattaatccatctatgtgcaggcggcgcgt

SEQ ID NO: 69104 - DNA, 7634 bp, Oryza sativa
ggattttattcccaaggtgagtttgaagtttgatctactgcttctggattgagatgcaatattctcattatgatgagcgaagtttcattatggcaagtgaagttttgcagcggggtatttacctaggaggagaagtatgctaaaaaaaaaagagaagcacattcaagtcatcgagagggagtctcgctcctgtctagatcacaaggtgatcaaattgtccggcgaattttgctaccattgtacccaacatacaaggaggttatcaggggatctaagtacttcattttgtgcacaagaatttttcgcgtttctgtttggattccagaaattaatgccagcagattcaggattttattcccatggcgagtttgaagtttgtgcatcagtttcgcgtctctgctaggttcagacaagttaatactagcagattcaggatttgttcccaatggcgagtttgaagtatggtctacctcttctggatcaagggtgttatggattatagtccaagtgactatttggcgcatattgatcttatcatcacgaggttttttttagagattgaagttttttatgctacaagggaaattcgtctcaaggtggagattgttaaatatgttatccgaattttaggcccacagtatatccggattagttatctaataggactctactttataggattagtttcctattaggactcctagatttctcctatatatatccttgtaagccttacggggagggtgcgatagcccaatgtatcccctgcgtttgtatctaattcctctatagtgatcattgccggccggcgtccgtagttttttttcgcaagggttttccacgtaaaaatttgtgtctccgttgtgcatctatttcataacatggattgcttcacaagcccgccatcctcttcaagctcctccagaactatgtgtcacctctcctagctctagcttcaccttccttgacaagttttgcctcttacgcctcaatatcgatcccacgccgtctgccacagtggatgaacttggtcacctttccataccttagttcttggcctctagtgtaattgcccactatgacgaagttaaaatcgatggtgatttcttaaacttctcttcatttttaagttgacggtgatttttagaaaaatgtggtagttgaaggtggtgataaaacggctcttatcccaattttagatacacggactgtaccatgacctgtaaaagaaaacggaggtaacattataaataggtaaacatgttgtgtgcaaattaaaaagctaggcattccatgcaatttgtcaagattcgagattgcccgtgcaacggtgcaagccagcaatcgcgatgagacatggcatgtgagacaaaaatatttggacacgagtttttgtggctatatatgcgcgactaattataatcaggtcgtcttccctgtagatcagggctcggtctagtgagcaaatcgatcactgtaaacaaatgtcactaatatgttagtgaagtggagtatatgatgcagtccccgttgatgctagtagagcaacagactataaaccagctataaatatattttaagaagataaaaaaaaagataaaagtagcgggctacatacttatagccagctgcagcacggactttaaaacgtatgtgtgtatgatatgtgggaccagatattgattgtgtagtatatttatatataactattgtgtaaattgattattaagttaactatagatgacatctataaagttagaaattggctattctattaaacttgctcgtactagtagctatgcctaaaactttgggttatgtagtgatcgatttaattgatagagttgcactacctcgagccagccgtatcttgtcccctcttccaacaaccacatgaactcagatcaaatactagagccctagttgtagttaactagtggagtatactgtactagtactactattagcaggttttttcgttgatgaacactacacgatctgatcattgatttagtataggcttaattagtgtttagacactcaagtactacaatactcctacattggaagctgatcgaacaaacaaatcttgtacacatgtccactggaatattgttactatgatcataattaagcaggttcatgatattaaagactcgagatttaattagaagactaattaagtacacaacgacactgtctgctaacagtttggtttaatttgcaataattcgtgaccggcctattacgatgaccatgatgtctcaacgccagtcgcagcagcagtacagtacactactggtggcgacataatatgtcagcatctgtgatcttgttcatctcatctcatcacttgcagggatcagtgccccctacaccattcatcatgtactcccataattaattaattgagacctatttaagctaatggtattattaattatatatttgattagtacattggagtacgtagaattctactgttgcaaaccacgccgatgcgtgctatcgataggagtaaaatactgtccgcgaagtctgaaacttgcacagtctttgacgcatgcttgcaggtcttcagaaaccacaagttcagaagaacccatcatccggccggccattattttaatctgccaatattccgtacgctgtcaaaagaagaagaaagaacagtcgaacaatgttgtacagctcgatccgcagaatcgatcagagtttagtacttactactataattgtttagcatgtagaattgattagaagtaagcactaaaagttcagaggaagtcaaggaagttcagaggaatcaattaacttgcagattaattcaacaaagctaccagctgatatatgctcctaatgatgatgattgccatgatcataaactttagattcttccatgctccatggtgaagtcttaagctagtttggctgtttatattagggcctacacataggtcctgattggatccggagggctatttaatagttcggaggatccaaacaaggccatagttaaagttcagaaaaatgattgtccttttatctgaagaagtatgtactactactgttgcatgcaatgaacacgtacatgagagagtagatggatctgatcgatactgctactgatcatccagccttgcaaattatccaaggacaggacagggagacagaaaccaatcaatcagacgagaagatttgcgactcgacgaacggccggccgccatataggcaggattccaaacaaggccgcggtgataccgttgggttctcaaaaccgcgcttttaatttgattcatctgctcgccaattaatcttccaatctttgatctgtactgctccaatccactgttcgtatagtattaatttttagtaatttttagctcgccttggctacccatcttagtagagaagtaaagagagagaagaatggtactcttctcctatcataaatactaattgatttagcataaatttagatcatttttactggtactttgatacgtcatccctgtttcagtcgatttctaagtccgttctcttttagaaataagaagaagtcgtataaaaaatctctttaaaaaactcgtatgctaacttgagacgattggacttttaattgcagcttacaattttataaaaaaaatccaagcgaacaacagtaataatattaaaatagcccttcacccactgcaacacacgggcattttttctagttatgataaatataaaaggttttgttactatggcaatgccttcttaaggtgaatctctgtagtgtaacattttgattttatcacaagtcaaacctctctgactttaatcttgtttatagaaaaaaacatcaacatcaacacatactaaattagattttatcaaaaccatcatgaaatatgtcttgacattgtatttatctgttagtgcatttttctataattcagtcaaagttagagaatctcactaaagacaaaaagaataattttcaatatgaaacagatgtggtgtatatttgataaactattgatcaaatgccaaaatatttataaccacagtaacagaatagcagtaaggcaaagccatacgatacgacgacagtcagcatctatcgtttgacccgtatataaatgcatggtacgaacgctaaaaaaccagcgttactacttgatgaaattattgatcagattggcagtagctaggcatgctttcatttgatgggtttttttttttactggcataggattcgccggagttgaggtgaaacttgtgttctttgtacggcgtgtccggccaacaaaagatgggcagcgttgagagccaatgcaaggcaaaagggttgagtttttatcggcagatatggaggccggaatggcgcagggcggtcggtcggccggccggattcgcgcgtcggagcatgggtcactactcactactgtagtcccttttttccctctgcaaaatccagccctgcaacctgcatcattcctgctctcatgttctatggcttcttgctgattcgttcaaaaaaaaatgcattgtactacatttgtagcatgagtctagctctgttttgaaaacgcgggattgaaaaaacagatgaatagaatttttttttaagattttgctaggaatacaagtgcaaaatataaagttccgaaaacggaatgatcgtttggttaggagaaaacgtaggaatcggatagtaaaagatatagactcaaagggaattttccaagaggttagagctcttgctaaccttttctccaaaatctctctctctctctctctctctctctctctatatatatatatatatatatatatatatatatatatatatatatatagtaaatttgtttggtgctccatggtgcccgggcaccattgttgaaattgagtatatacccaattcaaatgagtatgaaactttttcaattacttaggtattaacattaactactttactaactagtttaaagcaagtttgaactgaatttgaacttgtttttgttagattttgattctaggtatatagcatccatacatataattagttaggtatgtaatcatggattgtgaaataaagttaaatttgagttgttttgttgataagtataggtatgaatcaaattattataactaggtatatactcacaatttaaaaattttgaaaaatttgagtgattttgtgcattagataccatggtgtccgggcaccatggtgccccatatgagtgtcctatatatatatatatatatatatatatatatatatatatatatatatatatgtcattccataggaacttcaaaggaaaggaaatgattcaacccttataaaggatttcataggaatttttcatataagattgaaatcctccaaatttactatgtttttttttttacaagtcaaaggggtctagtagttagaataccttatagctagaaaaaaacagaagaggatattaagttacatgcaccagatagttcacatgaaagtttaaactgaagcataagctgaggagaaaagatagacaatttacttgtatttcaatagaggacgatacattgagatggatagcttaacatattacatatctgacaataaaaaatggccttccagaactgttgttgatacaaaccagaagataacaaatcaaatttcaaatactgagatggctgaatatggcggcccttgttctacaagttgggtcatctcagatgttgaggtaaaagatatcagtgattccattagacaaaatggggtattgcatcagcttcacagagcaaactacaagcctatacatctgctaaaaaaatatggttacatcattttgttttggcgtcacaggattgtgtacatactatcttctaccaccatctttcttcgaaaatatgcgcaagtttgcagtctgccggcgccattcatttatagggacctaaattcagtgggcacagcaaacatttgtgagtgaaggaaaaagttaaacatgtaatgtcatagctataaaatgaaaggcttactgctggaaacccgccatagtcaccgggtttctgaatatcctttgtcaccgaactatttgctgcaagccgaacctgtaaatggattgaggaaaaaaaaattgaatggttaaagggcctttagagttggtcaaggcttaaaagaatagattgagcaatgtagttaaatttgtaatacagataaacacaaaactgaatagagactgaagtagtattaaatcatgttagcaggaagctatgaaaaaagaacagagatgggaaaacagcacctttgaagcaatggagacgtgatcccgaattgccaccctaccacccaaggttacatagtcccccaatctgttgatacatgccaatgacacaagttactaaatctcaaaaagcaggcaaaataaacatttagtcaatgagatgaaggaatgcatacgttgcagaaccagcaattcctgcttgtccacaaatcatgcaacactttccaattactacattgtgaccaatctgcaagaggaactgtcaatttggacaacaagggcggcggaagtccaatcacattaagcagaatatccaatacctgaacaagattgtcaattttggtttcatctccaattactgtatctctccaactgcacttagtaaataatgatgaaaatttccgctcgcgggttaggttcaaccaaacatatattcacaaagaaagagctgatattacaaaatgtttggtatatttaaatcaaccatggagtggccaaaggaacatttgccatttcaaggctgacaaattacctccctctgtcaatacatgtatttgcacctatctccacatgatttccaatttttacatgcaacatctggagaagcataaagcttttcaacatatagccatatgatgtttcaattgaatccaaaacaaaacatctaaatacagtctatgagagtgatagtcatcaaacatttgtatcagaagtacttctcccatgtcactggcattttctcagtttcttttttctgtatctctgataccaggtaagcacattgggtgaacgtgacaaatgaaggactgagcatttccttatccttttaatacaaaatgaaccctctttgcgatcctagaatatttcagctaaccatttcactgcccttccatttggaaactactaactcatcatcttcacagaacgtttactaagaaaagggttgttagagagtactagcctgcagtttcttcttaacctgtccatcatcccccacaaagaaaccaaaacctgaaacagatgcatcaaactaaatagcatcaggatgcaagttttaatgcttgatcggagtacataaatcaatatctactggagcatcaaacaagaatagcataaaaacaaaggaaacccaaaaggttgacatttaaatagatggactggacttcaatccacaacaataaatgtaattgggcaaaagtagtgaaattctgaagacagttcacaagttgagaattttttttcctagtttgacatgtgtgcaggtagcagaaagaatccaagattgcagcaatcttgctagttactagtaccctcactggcagaaagagtccaagattgcaacagtcttacttatccctcactgcatcg

SEQ ID NO: 69105 - DNA, 2471 bp, Oryza sativa
agatcaagacgggaagcatatataggagaatataagttgattgctaccggaggaagcagcggaggcgccgccgaggaaccgcgcgaggcgagcggcgtggcgcggtggtccggaaagccggaacaccgcctccgccgccatgggagccgcggttctgcgcagagcggccgccatgtctaacaacggcggcgattcaaggtttgagcgcggcgttcgccggcggcgcgggtaggtgggtctggggactcggctttcaggcccatgggtgggcaaggagatgggccagcgtgctgggctaagaggagagaaaattgggctggccttcagcctgtagaataaagaagacaaaattggttatatagcatcaatgttcacgtttttttattttatagtatcgaaagataccggttcactttaatagcatctaaagtccacattgttttccgtccgtcttgattgctattgactcagccacgcacacggtatgatgtctctacccctcattgccatgtattctactcgggtactattaaagtgaaccggtatctttcggtgctataaaaccaaaaacgtgaactttagatgctactatataaccaattttcccaatatagaaatgaaggaatgccataagcctataataacttattgagtggaggaattaaaaaaaaagaaaaaaggggaggatgaaaaaggaaagggggagaaaaaactattccctttcttaaaatgtgccttcttcgtgtttgaaatttggtatgaaattattgacgaagaatttgatctaaaatataaaaacttctagtgtgctacttctcataaatcacttgtttatttttacctaatgttatccgcaatgcacccttccaggcttccactccccatcccctcatttagtgacattatatcacttttcttttaaccttaattcctccgaaaagaccccaaaagtctttttatggagtatattggaaggagtgagtaataattatttcgtttattattatgattattagttaaatttgaattatagaacttatttttgaatttgaatttttggttctttcatcgtagtgtattttatagcatttattttttagtcgctaaggacacatatgtataagttttactcataaataattttttatttaataataagctatttggataagcatatgaataagcgaaacaatgtggctggaggagtggaaagagtttagataaatttctaaaattcctttattttcaaatatagaaactgttagaaattgaaactaaaaccgaaagaaaagaaactagaagtgtgacaaacacacaaaaaaaaaccagtgacgaggcccacagattcatgaaaatggagaaagcagcatgaaactttagtccgcactcgccccaccgagcgaaaagttattcaagcccacagattcacaggtctttcatgtggttgaaggaatctcacggaaattaaacttagggcttgcttagttggcaaaacatttacccatacatgttacatcggatatacggatacacatttgaattattacacgtagtctaataacaaaataaattacagatttcgccaggaaactgtgaaacaaatttattaagcctaattaatccatcattagtaaatatttacttagcaccacattgttaaatcatgacgcaattaggcttaaataatttatctcgcaatttctcggcgaactgtgtaattggtttttttctacttttaatacttcatgtatgtgttaaatattcgatgtgacagtatgaaaaattttgtttgggaagtaaacatgcccttaagaaaatctgtagtacgatccaaatgagcccatccacaaaggaatactttaggagttaggacggctgacaaaagtgatcaggcatagaaaaatggacgaatcaactaaaatataaataaccctttgcatttatattattagtgatttaaaaactagtgatgtaaaatagactaaagaaaattccaaaattaattttaaaattacatttcggttggctacggctgataagccaatataacaaaatacagacattaacgttgatactccctcaatcttaaaatagagtaacatagtactagcatacgcacactttaggacaaaatataggaattcatggcaatagtaggttataggctgtatatgttactatattttactcttcccgttgtaaaacatagggattatgatgtgtcttcgttaattttggttaataacttaatatattttaggatggaggggtagaagttgtagaacggtgaaagtggttaagggtaagtactatgagcatccaagcacaatcttttagatgtcacataagctaaaatagtgaggtggaggagagaagagatgagagagataagcagccacctctcatgcaagaggcaaccactgtataaaattcaagacaaaaggagagaggggaagagtagactggacaaa

SEQ ID NO: 69106 - DNA, 3258 bp, Oryza sativa
acagccgacacgaacagagccgtactcagtgtgcgcagctgcaaccgcagccgcagccatggtagccgacctaccgaacgctcccgttgatggtcttaaggctgtgtttgggaggagccgacacgtaaaacgaagtacgtattattacatgattaactaaatattaattattttttaatttaaaaggattaatatgattttttaaaacaactttcgtgtagaaattttttataaaaacacacagtttagcagtttgaaaaatatgtgtgtgaaaaatgagggaggtgagttagaaaatctgggggaagaacacggcctaggcggtcagcagcgaattttggtgagcagtgttggtcggcagcgtgctctggattatggatgaaactggttcggatagtttccgtctgtccggaccatttttcggattcggatagtttcggtcggaattatccggaaattatcggattcggaaacgaattcggatatttttttctcggaaacgaaaacgaatacaataagggtactatccgtcggaatcagaaaacggtcggaaactatccagaatttttttcggatatccacaaacattgaacaaattttagaaaaaacacgtatatatacataactttttcatacgaaatcggatgaagataaactttatatcaatattgtagagctcgatgagatctacaactttattattgactattttattatttgaggtcatttaagggtctaaatattcattataatataccatattaattttacaaaatcttagatctacaattcaaacgacatctgatggagatgtgttccatatcaaaattgtagagcttaatgggatctaccactttgtagtttataacatttgtatttgaaggcatttaaagtataatacaaacattacaagttttgaagatgtgaagtaaaataaataacatctctaatttatacaatggtaagtaagttatatatctagtaaaaggtcttgggaatagaaaataataatcatatttgcatatggtcttagaggaaatcgattatcacatacggttgtgggaccgtctacaaaattgacgatataaatgttggagatgttgaactaaaataataagtgatatctcttccttgatcaagaaactcaatttgaggggttttttatataccggtaaatattcgctaccgtattcgttccgtctcgtattcgctccgtatctgtattcgataatattcgatttcatttctaattaaaaaaaataataaaactagttttcgtccgttttcgatccgttttcatccctctgatgccgccggcacgagcggaaaggtccctgcacagcacagcactacacctccgctggtagggtagccacacgtccgtcttgccatcttggtgtgccttggtgcttctgacacgtaggccaccgagtgagcattttatattttctacttacctttcggcaacgatttctttttagtttatttattattatcactcctcacatgcacatgtcactcctgttgtttatgttactcctatataacatcatccattgtacagtactagtaccatgtggatttttttatttttttagacttttttattttaaattttattaatagacgtttctaaaaagtatttccaaatcagaatcccgtggccaaataactttgtcaagacagtgttgttagctagcgtgacattcaattttcagaaatactttttaaaaagatctattaataaaattaaaaaaataaaaaaattataccacatgtcaatgtgtgttcttccgataatgcttgctagtacagcaagcagcaaccttagcacggaagaaatgatgaattccacaggatggattatggtttcttcggtactagtagtaattcctgtttgaggatttttcacaaaattatgagtttctccggctctaatttaaagagcagaaaagttcaacaaaagcatatgatataccaacttgactacgcaatcagcaggcagcatctattccttgcaacaaaagaatgtaccagtactgttccatccagatccgggcatctcacattgtcattgtcagctcctccacaattaagcaacctagccttaatcatctgcgcttcccaacgcccaatttgttcggtagtgataaaaataaaaatacaggaaactattaaaacactactaattgagttttaatttttttttaaaaaataaatttatctaaatattttaaaataatttctatatataaagtttttgtacaaaatatatcagctgtttaagaaacatgttaagagacacccaaataaaataaatctgacgtgtgtctctctttcttcttgttgcttcttgcaagttaaaccaaaccaacccaaaccaaagcagcagcagccagcaggaacagcaaattaaatttgtccaattaatgccatgtttagtttcaagatttttctttaaactctaacttttccatccaaactttactacgtataaacttttaactttttactacacacaaacttccaatttttctatcacatcgtttcactttcaaccaaactatcaattttgggtgaactaaacacagctttttttttcctggtttctttctgcttctgtgttcttacccacctttttttttcctttccaatttccatttcgtagtttactttacttgtttgttcctcctcttcttccctgacacgacacgaacccgaccacacgagccttctccgctcgcgccgccgccgtccacgcccatcgctcgccgtcgccccccccgcaattctcgtcgccttcgaggcgcgcgctggtccgccgccacgccggctgtgtgggggtctcgcttgcccagatcgcttcggctcgcctcttcttccccgacatcgcgtctccgcctttcctccccgccgccgcccacaggtgagctcctcgtatgaattctgagccacagcaattattttgcaaatgtgccaaggtagaaagcatcctgtagtacagagcaacaagctttttttttttttgcatgtgtgttcttcccccatgaagagacaagtgaacaattgctgccagaacttttgtttttcgtatgtgtgttcctccttcctgaaggaagagataattgaacaattgtaggagtcttggtaccagaactttttttttttatgtgtgttctcttcccctgaagagttaagggaacaattgtaggaagacctagtactagaaccactgcagtaaaataggggctttactat

SEQ ID NO: 69107 - DNA, 38089 bp, Oryza sativa
  unsure (1)..(38089): unsure at all n locations
cacgcattttttttaggatccttccttttaagttgaattcagggcaatgcattgaataaattcgtttgatctgttaatttatgagcagcaaggcacattctagtttcgtgtgaaaaaagatggatttttcttgcgtccacttcatgtttctgtttatcttagtatgtttcatttttgtcttatgcctctgaatatcttttagaaatgatttctgatgttgacgtttgagttcactactcgcttgaatgagtttatacatcagcatttttttttatttatgcagctctgaccacaagtctggaacatttctccagtgaccaagtgctcacactttctgcttcggtttcaattatgaattctcagtgactcagggagccatatttctatgggaagagaaaagctgcgcaagcaacgttctggtcgtctgattgaaaccctcaaaatggagagggtcaggactatcctgactcatagatacccatacccacatgagcactcaagacatctcatgattgctgtatttgccatctggcttttcttcgtttcatcggataacttgcaaactcttataatgaagttggacaagaatttcaaatggtggtcgatgtatgcttgtttaattggtttcttctatttcttctcatcaccttttattcgaaagactatcaaaccgagctattcaaattttagtcgttggtaagcaacctcttgagtctgtgagaaggtaaattaagcaaaacatggtgtatttgttctctaaagccgttccctgctgcaggtatattgcttggatattcttggcagcattataccatctccccagttttcagtcaatggggttggatttacggatgaacctttctcttttcctcaccatttatatctcctctctaattttcttgatcgtatttcatgtcatctttcttggcctgtggtatttgggcctcgtttctcgtatggccgagaaaaaaccagagatgcttactataatccaaaattgtgcagtaagtttctttggatacagtaattatagaagtgttttttttattttcacctaatcttgtttagttaccacttatcagctgttccttatctatgtttttgcattttgtgctgtgttgcaggttataagtatagcttgctgcgtactttacagccactgtggtaacaaaactattacgagagataaatccattgaccgtagaactgctagctgggttgcgttctctctgtggaaaaaacatgatgacaattcactgatttcaaagctattgcgcatgcataagtttaaagagcagatttgctcatcctggtttgctccggttggctctgctagcgattaccctctcctatctaaatgggcaatttatgaagaagttagtattgcttcaccttctgtgtttctcttgatttttttttagtttattcttattttttttatgtttgctccagttagcttctaatggatccgggcattccaatgacatttcacctgtctactctttatgggctacattcattggtctttacatagccaattatgtcgtggagcggtcaaccgggtatgtcaactatcttaacgtatccacctgataactcacttgtgtactatggaaatttagaagacaaatatatggattctttcatcttgaaaaagcaacagttgatattggaaagggaactaacttcaccatttgttcatataacagagctgtatataatatgttaatgttcggttttttaactttcagctacatgaatatttagacatgttcacaatttcacatgcttatgaaatctaggagataactaaaaagggaaaaaccatgttcacactgtgtaatggccgtgttttgggttttctaccacaaaccagatcatttgaaatataatgatctgagttctaattcttttttgtataatggccaaataataaagaaactaattgtttccttggttatttagtttttctcaactcactttcttatctttgtttcattcgagttgcttatagatgggctctaactcatcctttgacaatgtcggagtacgaaaaattgaagaaacaactgaaaccagattttgaggacatggttccttggtactctgggtatgctgatgacactctacctcttgctacctcgcttggtgtacacagtgactaaatattcgtcgatttgcttgctctgcaggacatcaactgatttatttaaaaccgtttttgacctcatggtatctgtgactcttttcgttggtcggtttgacatgcggatgatgcaggtatgtgacctgttgaagttgaaacttgttcctcacttcctctttttattttggttgttagttttcagcttttccttatctcgtgaagtcatgatcccctcttcactatttttttcccactatgtttcctgttaaatggatagcactagaatgatatatatatacttccttttacattgtggtttatgttttcacttcctatcgaggtcatttgtcctgttaacttaaccattgatattttctttttaattcttgaccaggctgctatgaacaaaactccagatgaatctaagagtagtgacctgttttatgatcatcttgatggaaaagacgaactctggtttgatttcattgcagatactggtgatggtggcaactcgacttatgctgtagcacggttacttgctcaaccttctttagccataaaatcggatggctctaggcagacatttccccgtggacagctactccttattggtggagacctagcgtatgtttctatctttggtcatacaatttgcgttgtaaaaaattctcgattaatatggcctaagtcaaggcgagcaaaataattcatcgcagaatgtttttgttctgcaagctgaaattttagctatggatgatatcatatattgtttttgtgtcatctcattagtaccctttccattgttattagttaacttatacagttttggagtttccatattgatattagtgtactattccacaaagatgataattttgttccttttcccacagatatccaaatccgtcttcattttcatatgaacggcgttttttctgccctttcgagtatgccctccagcctcctgcttggtataaacctgaacatatagcattggagaaacctgaacttccccttggagtttctgagctcaggaaatatcgtggaccacagtgttttatgattcctggaaaccatggtaactgtcacacatctgtaattttatgcagtagcatcatggtttacaaagttttcttaccatgtattccttgtcattcgctgatgtgttctatttgttatgctaatgatgttttggtatggaatacccaattatatttccatgacgctactgtgggttgatctattgaaaaacaggactgacaaaatccacattgttttgagcagattggtttgatggactgcacacattcatgaggtatatctgtcataaaagttggctgggtgggtggttcctacctcagaagaggagttattttgccttaaagcttcctaatgggtggtgggtttttggccttgaccaagctcttcatggtgacattgatgtctatcagttcaagttttttgcagagctatgtcaacaaaaggtaagtacattgcgtcatctttaggctattagcaaattatttttgtggtgaatgctatggtctacatttgtgaatttgttgtttcggttcttctagtgaaaacacaatttgattgtagtacaccagtgacattattctacaggttagtaatatgtactagacgttgttatcatgaccagaaaattatgcataatttcacgtgaagtttaccgcgtgtgggttttcttattgactaatactacttgtaactatgcaggttggagaaagtgattctgtaattcttataactcatgagccaaattggcttcttgattggtactggggtgataaaactggaacaaacgttgagtatttaatacgtgaatacctcaagggaagatgcaaactgcggatggctggggatctgcaccattatatgcgccattctttcattgaatctaaagaaccagttcatgtgcaacacttacttgtaaatggttgtggtggggcctttctgcatccaacacatgtctttgagaatttcagagaattttatgggaacaaatatgaaacaaagattgcatatccttcttatgacgattctagcaaggtaaggttgattcctgcttgtgtgccttcagcccttcatttggttcattacatagcagagcttgccctttcatgttcatgagccgattctatttattgccaatttgacttctctccattgtttgcccttccagattgcacttggtaatattttgaagttccgaaggaagaattggcagtttgatgtgattggtggttttgtgtactttgttttggttttctcgatgtttccgcaggtgagagactaaattatttatgaattatttaattcatagtaaatcattttgcttatgcactatgtggttaatgtgaatacttatagcctagaaagaccatccaattttcatatgcacgaatgctatattgtaaagtccatgaaggattgttctccaacagcatattatatgcttgtctgattaaagtagtatcgtatatgtttggcacggaaaaataaccttggtggtatgagttcattgatgattatgccctgctacttacaattgatattggacatgacctatactctccagagtattttaggacttaagaataatgcctgatatcctctatatagttttgttttttgttgcgttgaattggatttaggaaaattattagggctttgctcatagaatcatttcaggcctattcccaagggcgcattaacatatctgagacttcatgaacatttctcataggttcatagttgtactttgtaggtttagttgcctgtagtctgctccatgaactctatggaccaacagttggtgataaataatgttcatctagacaattaatgtgcatgcaccatataatagaagctaaagcaacaagaaccacatttcaactttgggcactagagtatcaaatttatattagagcagtgctagaagtttctcaattactgttcttttgtggcctgacataagtatatattattttcagtgtgattcctttcgtatcttacgtgaagactcttgggctgaccgtgtcaatagtttcttcactgcaatgtggaatgttgtttttgagattctggagcattcctatgtatccctggctggtgttgttactctattgatggtatcttttttctttgtacccacaaaactatcgcgtagaagacgtgccttgcttggttttcttcatgctgtggcccatctaacttcagcagtgatactgatgctgcttatggaattggctattgagatatgcatccgcaacaatctattggcaacatcaggtcggtgtgttatctttctttttttttcatgcatcgttgcttgatatatcatgtaatgtttgtgcaagctttaatcctgtgttctctcttggtttaagatggcagcattccatttttaccacggcttaccacagctgtcagaaacttaatgcggttctataatagtctatattatttaatgtcaatttctttggttataactccatttttttttcataagaacttgtgtctaactttattgttacaatatgggtaatggtagtcatcctaaggttatcagaaatgtttggagaagagactaggacagtgtactaacttgcaaccattgtgtattcttgaattggtttcttatacccttttatgagttggcaatgtggcacgtgtttatttgtacctctattttatgtctcaactatttaatgcctgaaatgttcattttctattcctgtccttatccaggctaccataccctctacgagtggtatcgcaaggtcgaaagtgagcattttcctgatcccacaggacttcgcactcgtctggaacaatggactttaggtctttaccctgcatgcattaagtacctgatgtctgcatttgacatccctgaggttattcttcataaatataccagaatcgctatttctgagttcctgtaccattttcaaccctgtaatgtatatttgctatttcaggttatggcagttacgaggagcacaatctgcagaaaaggaatagagtcccttcctcgaggaggagcgatcatctactatgtttgcgtcttcctgtacttttgggtcttgtcaacaccagttgtatcactggtgtttgggagctacttatacatatgcataaactggtttcatattcatttcgatgaggccttctcctcactgcgcatagccaattacaaggcatttacacggttccatatcaagaagaatggagaccttgaagttttcacctttgctgtcgacaaggtaagaagcctgccgatttaatttatgtttgtcagcttagcaatgcatcgatcaaacatgctcgctctcctacatctttcatgtatctggaaccccaagactaagatatttatttaactcctggaaggcatctgtaaaacatccaaaaaagttctcaagaagcaaatagcatttcctattgatttttctccagaactagactagacctaggttatgtagactcggaattatatgtcgcacactgttcccaaggattagcaaaatcgaaatagtgaaattcttgggtcatttcaatgggttaagttatggattttttcagtgagacctacataaatgtttctctttagaaagaaccaaacaagctgttgtgctttgtgaatcaatcaggtgccaaaagactggatgctggatccagactgggacatggagccaaaggagccattccagatgagctacaccaggaagttccccagcaaatggagggccgcctccggctcggacccaaccaatgcggtgcggatcgtcgaccatttcgtcatccctcggacacccccagattccccaacctcaggatctgctagttgatcaattgtagcctagcttaagatcatagtgttgtaatgtacagtgtagtagctatcttgttctatctccctgtataaattgtacagcaacacaagaagccttctgacatactctagcatagaagaaatagggaaagaaaaagaaaatgagaaaagggtaggatggggcactgcttgtaatgctacagatgtttttgttaaacgaaacattattggttcagtaatgatggttcattgttgtatgatcattgtgcaaattgcctctgatgcctgggcaagtgacttgatgggaattttgtgctgtcagtttgtcaactctactgtttatggtcactcctagttttggtgccatacccgtttatgattgagtacttactactactaaatgactgtgtatcaatgcaggtaataacattgtttcgatcagatgtttatcttgacgataacattaacagatgatgttgcctgccaagttttctcgatatctctaattcaacagtaagtaattcgttcctggcaaatattcactcgatatctttgcttgttggcttattagacatagtcaattttaaattttaaatttcatttttagagttgattttatgatttattttatcctttttttctgctcttatctttaaaactactaataatacaaatataaattttaatcatatactacttccttttttaatagatgacgatgttcaccttttgtcacacgtttgaccgtttgcttattaaaaaaatttacgtaattataatttattttttatgagttgtttttatcactcaaaagtattttatgtatgacttatatcttatacatttatataaaatttttaaataaaacgcattgttaaaaaatgtgttcaaaattaacggcttcatcgcttaaaaaaacgagggagtattacttttagtcgcttgatttattcctctacgactcatcggtcgtagctcaaaaacccaagacaaggaaacaatcaaacaatggtttgcgtacagaatacaaacagaagacatgaggaaaaatcaaaaagcaaagagcggccgacatgtgaacagtagaacaagtcggtgggcgagacggagaccggaggtggagaagacggtggagcagcgagacgcaccgacctcgccggcggcgtgcgtggcggcgcatgccggtgagccagtggcggcgccgtacattgctcctccccccgatgggccatggccgacgcaggccgcgccggcgatcccgactgtagccgtccagcccattaaggcccaataagagtctttccaatggtggtgagtggtgactaacgaaatttggacatattgactctttcgaaaaaacttatttcaagaatagaccgtgtcaaaatttgttgtaaaaatgaaataattttctcagcactgccaaacctagatgtctctgagctataacacctgtgccacaagcattgatgctaaggtcctatccaatgtatgtgatgctgagctttgatagcactaagcaaattgttagtttttagtaaatttttggcacaatctacttttaaaataagctttctaaaagggttaatttgtcaaaattttgggactaaccgtgacaaacatgccactgtatgacctcaaccatttgtactgatgaagtgctattaggtgtacataaagctcgcgattgtgtgaatttgtagtatggtcatcgattataaagtgtttgtgtgagtttgtgtgtgctattgccgtaagtataataaagttgtgtgtgctatctttaaaagtggattagataataataaggtgaagaaaagaactgaagagacaagatgcgatgagtcatcccttacttaaaagacaatatctacataacctctaagaaaaaagtaggaagaaagcgatatagtatgattaaaaaaaataaaaaaaggtttgtatataagaggttatgttatacgtatgctaccttttaaccgataagtagacgatataactaaagtttaaaggtagtaatactacaaactacagtaaagatcaaagaaccgattatcacattgatggtttcaaagttgaaaccttttggtgatttgaaagttgcacctctcatgctcctaatggctgaagtactccgagtccatttaatgtaattatagtactaatatattctctaatcccaaggactctgacattgcaacgtcaacttaacaatttgtatgcatacgtgtagcagctaacagccacaacaggggcgtttgcatgcaaccatgtaggagtactctactagtgtacgccattcatcccctctcttattttaaacatttctttattgaaacaacactgtttaaatttaaacaaacctacaaacagtttcaatcgaagtagacaagctacaccggttggttggttgccggcgtgaacgcgtcaaatttggcaaaattcataccaacaaaatttacagctcagtactatactactactcctaccagtaaaagccaactagaaactgtataaaagggcacaaactgcgccgtccccgtccatccaaacgaaacggtaaaacctgtccgccgtcagccacacaccccactgacaaccgggccccactcgcacccccgccggcgccgtcccctccctcccggtcaccgccatgtgggacccaccccaaccctcgccggccacctccccaccagtcagagagacacgggcgcattgaatccgtggcaaaggcagcgcgaagcccgtgggccggcccggctggcacgtgggccccaccaaaccgctttttttttttttttggtgtggtttagtcgctcgcacacatgccggtttcttgtctcgtcttctctcctcgcctcgcctcgtcgccacctccacccccacgcgccgcagtcaactcctccccccaccccacctacgcatttcggcgaacacctcgcctccatggcggcgccgcggtgagtagacgaagcaggcatctcatctcccatcccatggcgctgcgggcgcggttgaggcggttgctggtggtggtgatcctcgtcgtggtggaggtggtggtggcgcagcagcagcagcaggagaggttggcgtcggggtcggatttggcggggctgttcagcctgcgggcgtcgctggggatacgggcgagggagtggccggcgagggtggacccgtcggtggcgggtgggccggggtcacctgccgcggggggcgcgtcgtcggggtcaccgtcgccgggttccgccgcacgcgggtgggcgcacgggcgccgaggttcgccgtcgacggggtgaggaacctcacggcgctggaggtgttcaatgcctccgggttcccgctcccgggggagatgccggcgtggttcgggcgcggcctcccgccgccgctcgccgtgctcgacctccgctccgccgcggtcaatggcacgctcccgcccgatctcggcgtgtcagggaacctcacgagcttgctcctctcgggaaacagcctctccggcgccgtgccggggtcgctgctgtctgtcgccgggcttcggtttcttgacctctccggcaacaatttcaccggcgggctgccgaatgtcacccccgtcgccggtggtggagccgcctcgctgttcaacgtttctgggaattcgctgtatggtgtggtcagcgatgccattggggccctcaaggggaggttccaggtggtggacctgtcaagcaactacttcgatggggtttggaatgtgtctgatggaaatgtagatgttaggatgaattgcttctccggtgcgccaggtcagcgcaaccgtgttgattgtgaagagttctataggagggcaggggtgaggcttggtgatgctctagctcccgcaccttcgccggagacatcaccggggacgacgacgaagaataataacagtaggatatccaagggtgtactgattggagttattgctgccgcggcaacgctgatggttgtgttttttggtgcattggtattctgcttggcaaggcagaaggcgggaagaagaggcgcacgcgggagaggggtggatacaaatgaggaaagcacacgtggcgtgcgcaggagggatagtagtgtaaacccggtgacatcaccaccagtagcagtgtccccaagtgccaattctggacataaggatccggttgttgtttccggtgaatttacctttgagcagttggtccatgccacaggcgggtttggagatgacaacctcctcaagcatgggcactctggggatatttaccatggtgtctttgagagtggatcccaggttgttgtcaagaaggtcaacgcacagagcgtcaacaagcatgcaggtgaattggacttctataaaatgtattcccatgagaggattgttccgttgctcggacatttggcaaaggatgaagaggaatttatggcttacaagtatatgcctaagggggacttgaccaatgcattgcacaagaaacctgtggacacagaagatggcttgccatcattggattggataacaagactgaagattgcaacaggtgtggctgaggccatgtgcttccttcacgatgagtgccgcccgccattagtccacaggtaattccgtattctatatgatccacaggcatctaagaaattcatttgctacaccatgtaatatcctattggttagtgcaccctaatattggccgttctgtcctaatttaatttggttcatagttgagagaattattgatggctcacatgccttattttttattaagttgtagccgtactaatggtgtaagttatgtcaaaggcgggaacgatataagaccagtgaagtagaagaagtgtctaattgaaattgaattgtttgatttgtgatttctgtggctcctcagtgtggttgctgtgcctttcttggacttatttactcagcggtttacttcatatttcattgaggcacttttttactcaagagcgaatcttgcatatgaaaattcttttggtgataaattattcataggcctggacaaaaatatcatgcttggagacttgaatatgatttatctgtgcatgttgtgtcgttgcctagaagcattgacccactgtaattaaaagtatacattttgatatgacttgtcattttcggtaaccttattggtactataaaatgtttgttagtttgtttctctttccacattcgatatatttgtttgtgtctctttcttcattcagttatgcgttctaacgatttgaaaccacatatggtttctttttactagtgatcaactataacaagttcccaagtctctatcaaagctttagatgcgcattcaatattctacttgtatagtgttctgtgtatgtcatcaacaattccaggaaaatttaggtttggtgcttttgacataactggtagtggtcataatttttttcccacttgcctgtcttaatttcttcgtttttgctgtcttatgttacttttttatctaggaaattttttatcagtaggtcagctcaacttttctgattcaataagccttacctccaagttgatacatgttttgcatacctcaatcttctctgacattatgttcacattgttatttattatgttgtgatttcttcaattgtaatcacagagatatccaagcaactagcgttcttcttgatgataaatttgaagtgcgacttgggagtatgagtgatgtatgtgcccagcaaagtgggggaagccagagtgtcttctctcggttgttgagatcatcaaggtatgattatgacctgtcatgggcgggaatgagaaaaactacacttattgatggctgaatgtggtggttttacaattttttgaattctcgtaatcactggtgacagaatttgatggttttgcccctctttttttttctgaatttgtattttaaatttggaaacaacataaacataaaattgaaggtaagagaaacagcaacagtagtattgatagatcatggatgatcctatgtagagaatgcagttccctactttccttactattgcatttttttaaaaaataaaaataaaaagggtaaataacagaagagaccaacctggttcgaaccagtgacctcagtcaaaatactctaccattgagctatggaaatggaactgttgatccttattaacgtaattttccttttgggttcacttgggtttacactagtactgatgtaattgctgtttgttttctcattcctcgctgtttacaactggcaaaaaaattcttccctccggttaaaattttttcaaaaaatcctttggcaaataaggcaaaaaatttacaggggctcaagggagggganaccctccctggcacgcctatctgaaagtttctatcttgttggatggtacaccaagaatatgtgcctgctcaaaaaaaaaaaaagtaataatatgtgcaccaaggggttggtgattatagataacctaaaatgttattttattttctatgctgattgcatgctagttggtatttggtagttcaatgttccgagcacacacacctacttccttctaatcctgttgtcttttagttgagcaaacttccatctttatctgccttaaacgagtcacatctttctgaaaacttttgtttactgctaactaaagctcctaactgacaatgatatttggttctttcttgtggcaggtcgcttgataagaacatatcaggtacataaatcttatacatggctatttattaccactctaattctgtggttcatgtacatgcgcacaaggaagtttcatggttaacattcccttctgcattttttacatgacaggcccaccagcaacttgttcttatgatgtttactgctttggaaaggtgatgcttgaactagtaacaggcaactttggtgtaagtggatcaaacgatgctgcctccgaagagtggatgacaaacacactaaaccgcatcgacatgaacgacaaggagagcatttctaggatcatcgatcctttgcttattgtcgacgaggatcatctcgaagaggtgtgggccatggcaatcgtcgcgaagacatgcctgaattcaaagccatcaaggcggccttctgctcggtacgttctgagagccctggagaacccgctaaagattctgcgaatggcgtcccgctccaattcagcaagactcaggagctcatcatcccggagctcctggcagtctgctttccttcaaggaaaccggtaccagagccttgaaaccgcgtcgtcgtcagggcaaatgcttgacaggaaacattcaactagatcacatggaagcggaggagagacttccttctccttcaagagggcttccagggagattgctccggagccagaagggttcgaggagaatgttgtcgtgtagaactgaaattacaccgattctttcgaagaatttgtgattcattcatacctgtgtataatctgatcttctgatgagcatgattcggggtctcgaagtgagaattgtgcatatagagaagttttcggggtttttatttctcttttttttttccttcatatgttggagaattgttttggtttactgaacgcatggtacttgatgttctcattgtgcacataacatttacccttttttttcccttatcatatcaagcagcaagctcttttaccgtagatgttgctactttttctataaacttagttaaattttaagacatttcacttagagcaattccaaaatgtctcataatatgaagtggaggaagtagtaactacgatttgtcgcaatcttagtagaacaaaatcaatacgaaaaaatctggcatatattatgccaagtgcagtaatccgcatttttcttctggtttgtgtgatgtgatgcagggactattttgaaacactcctacaagaaacggggaccaagttgtaaattgtaggatgtaaatagttggacctctaccaacgaagcgatacaaaatactaaaatagggacttaaatgcaaaacatcctaatcctctacgggtgtacaagcagccgtcagatccacaatcaacggcccagattgatccccttaactaccgaaatgccagagtgcgacatttctaaaagagtccctcgaaaaatatattttacgatccaatcccctctactcgaagcaatcaagcaaggagaggatagaggagagctcaagctccacctcccgctccaatggcggcagccactctcccaccctcccaccaccgcctccacctccacctccacctccacacccccaaaccctccccacctcgccgcctccgcctcgccgccgccgccgccgcgtcgcgcctccagaacccgacaaccacccactacccgaacctcccgccgcccgcgccgccgccctccacctccctcgtcgccgccgaggaggcctccctcgcgccgcgccgcacctaccgcttccccggctccgtcccctcctcccccacgctcccggacactgcggacggcggtctcgccgcggcggccgcggtggcggacgacgccgtcctgcggcgcgcgctcgaggtgcggcgcgcggtggccggggaggtgcttgtggcggcgctccgaggcgggaaggtgggcgggctgacctacatcaggaacctcacctcccggatggcgccgttcgtggaccgcgtcgtcgtcgaggccgccgccatgcggcgcgaccgccccgagctcgcgcaccagtcgttcaacgcgcgggcgcgcgtgtacatcgaggagtccggcctcgtcgccctagtcaagtgaggatgcagctttgatgtttttcgtttatatactttgtaatatatcgcctcagttcatttctgtttcggaatgcacaaagaaatttgaattcgaagtaacaccaactatcagaaattcagaagaattgcggatcatacaaatgcaattttggtatattgtgtatgggaaaggaaagaattagagggaagtgatgattccgtgttcgaagtaggcataagcatgacgtagcgtaattcattagagcttaggagttaggagtagtttagtttgttactatgcacataatactgattgatcatggcacccaccatcttggctatgaattgtgagctccctcatgcctcatttcaagtcttcaaagctcatctttatgtctaattagcaacctgggctacaaatacttaatttggaggcatgatcgtggttggtgttgaaaatggccaggctagaactgtaccgaaacaatctgagttgaaccttggcttggcttgaatttatttgatttcttgtcagaactgtatttatttatgcactgtaaaattattagtacctgtttaaaaatatgatttgaactggtatgatttatgactctgttaattcccaaataggctcacatccctggcatcttgtcaaactcctaagcaattgcacaaattcgtaatatattacataatgtttatagtgttttataaatacaatttaaatcctgatcctcaggtggttcaagcacaactccatgacttatccccaaatcgccaaagtagtttgctcatcctctggcaatctggagaaagtgagaaggatgataaagtggttaaggtccattcatgtgaaaggagaatatctaggacgcgtgcttgcaaaaggtgatacttttttgagccgcagttttgaagaactggaagagattatttactacatggaaagctgcggtgttagaaaagattggattggtcatgtggttggtaggtgtccacagttactgaatctgtccatggatgaactggagactcgtgtgagattttatacagatatgggcatgaatgataatgattttggcaccatggtttatgattatccaaaagctcttggatttttcagcctagaagagatgaacagtaaggtgttttatgtgcactaaaacttgttttgtgcttttttggctccttgttcattcagaatttttttagcgattattttagcaatatcatttcattctcttaatatgaacaaagagtgttcattgatatctgtggacaagtaaggatcaaattaatatttcagacagttaaaaatcgatttctgattaaaagtgaactattaaatcggacaaaactgaggtcacgatctggttatttccccttttagatatgaatgaatgtaactgatgatgagctggttaaagttacttttcttgtaattctgaaagatgtttagataaagttaccgagtattctcaacgttctctttctgctatgagcttcattttctagttgtagtcaaatagcatttgtttatgtattctctctttgtcagatagaaacttcattgaagataatggcattatggatcacaggtacaatatctgaaagaatttggactgagcactgatgaacttggaaagttgatggctttcaagccacagctcatggcctgcagcattgaagaaaggtggaagcctcttgtgaagtacctgtatcatctaaacatttcacgggatggcatgaagcgtatgttggtggttcagcctacgatcttctgtcttgatttggaaacagtaattgcaccaaaggtactcttttgattgctttgcatgcattgtatttccaaattttcacaacaattggatacattttatttattacttcacagcaacatattaggaacttgttagtgtgttcactaaatatagtcttgatcgttaaagagtaacagcatattgttttaagcaaatgcacaaagtggatttatagctcttaatatgctgagatctgaacaatgtgattcttcttacctctatcctatcatttgttttaggtacaatttctacaggatattggtgtgaggagtgatgccgttggaggtgtgctggtgaagtttccgcctgtactaacttatagcctatacaagaaaatacgcccagtggtacaagctctcaattttccaattcttaattagtattgacctgccttgttgattcttttgtttttaaggtcagtaggatcagtttggagcagctaagcatggcatagaaggcagtttgtcaaatctcatgaaaccaccatctgaaatgctaaaacttgctttaaacctaagttgccacagtaactgaacatggacagaaatttcaattgttttcaatattggtttggtttgccatgatgaatgaacacaccggcaactgttgaataaccagttaaagcataaaggcgagcgcggcattgcgtaatgcaccttgcagcaaatatgtgtaaggccaggagtgatgaagttgaaaaatgttaaatggccagttgctctatttgtatgaccagcagtggtgatgttgatgagaacacccaaaatagtaaaagcagttcatccacatatagtgcttctatgtttttcttcttccttttttaatacataattgcataccttgatgatctactccatttggcttatgctgattccacatgtaggtaatattcctgatgacgaaagccgcagtaaaacaggaggacatcggcaaggtcattgccctggatccacagctcctgggctgtagcattgtgcgcaagctggaagtcagcgtcaagtacttgagatcgctgggcatctaccacttcgtgcttggtcagatggtcaccgatttcccaacgcttctcaggtacaacgtggatgttctaaggccaaaataccagtacctgcggcgcgtcatggtgcgaccgctgattgatctcgtcgagttcccccggtgagtctgtctagggttcatgttttgattgcacatcgaaagatgagatcattgtgaaacaactgcgaaatgcttatcaactctacactgcatttttgtcaggtttttcagctactctttggaggacaggatagtgccaaggcaccaaacattggtggagaacaggatcaacatgaagctgagatacatgctaactggatctgacgaagatttttcacaaagggtacgagaagctgttgagaggagagccagatttgaagctggaaatgttgaggcatcagattcgcaggcgactaccgacggagcagaagccacagcaccagcatctcaagacggctgggaggcagatacatagatagagcaggcagggcaaaattgtaatctcacattgtgatgtaaagaaaaatagaaagaaaaaacgctttgcttccatgccattgataagcacagcacaggggaccgtgagtccatgaccacattgtacttgcatgaggcgaagatcattggcaagcagtacaaaatttcatttatacaagttgcccagaagggaccagttaggcactagcattagcatgagtttgtcctttatttttctagcaaattacacaaaataccgagggaaaaaggaggatggaattcaggtcgcactttcagctaggaatgcccagcccctgaattattaacaccacacagaattacggcgctgcgtgaatcccgaactaataaacacgcgccttgggtgggaacgactcaacttcactgtccaatgtgttcatgtggactggcctgtatgccaagcgaaccttctcattctcccagtacctgtataacaagaaacatcgagaattcaggatcaaattacatataaaaaaattataccatcagagagaaaacatgttgatttcacattctacagtgttttaacacctaatgtgcatgcatgtcatgttacagccaatgataagtaaggttgacattcttttaagtgctacaataatttgtctcaatatttaacttaggtgtcgtggtgacaacgtctaaagctgcaacccacatcaaaactactatactgcttgatgaacagagtatgcttaccccagcgagtgcttcatccattgctcatcatctcttttctgtaagcagtaaggaagaatcaattgtcactacaacatagaagcatgtgggtgcgaggcaccaaaaagaagggaaacaagagaagtacaaaccgtgaaatcttcacgagcatgagctcctctgctttccttccgagcctctgctgagtgcatggttatgcatgcatttatcaagagattttccaactcaatggtctctatcaaatctgaattcctgtgaaacaaatagtgaattatagatagccagtgtaagatagtaacaagcaagcaaaataagtcggtgcaatccttgcaagaaatggcataccatatgagactccggtcactgatcttcacatcatgataactttcccatgccttggtaatcaatttgcaacctaataaagcaaggtcgaggtcagtgggaaatatttatgaatcatgtctcttgttatcttaactatttatgccatgcttgattactagctaattatgaagcttcaatcactaattcttggtattatggtacctttactatactttgctaatcagctaacaacctaataaaggtctgtgagaacacattgatacaacagtcaagaatcatgactttctactggggtctatctttactgttaaatcctgccttccttgcttcctattgttaatgactaggatgatctatggtgacaacagacatttctatatcaccagcgtcattgccttaagctacaaaggatatgtgcaaaactgcattaccttcctcgagtgtttcttgcgtacggaagacagcagcattattttgcataacacgttgcatgtttagacggatcttggaagttggcaatgatccatttgcatttctcagcttgtctaaccaggctatggtcttttctccagcacttttttgaagaggtttctgcttctcacctataatgttgcatcacagacattaggtgcatcaggatgagcaaatcagccaacaagttatgtagcacaggagggaaacctacctggcttagcggtttcagctaccctgtttgcacaagctctgccaaaaacaactatgtcaagaagtgaatttgcacccagacgatttgcaccatgaacagatgcacatgctgcttctcccgcagccatcaaaccaggaacaacagaatcaggattgtcacccttcatagtcactacctgatatgcagaatagaaaacttctattaaaaatcagcaagaaaaaagtgatctacagtaatgtttattggttactcaacacaaacctctccatggtaatttgttgggatcccacccatattatagtgcacagtaggcaagacaggaatgggctccttggtgacatcaacaccagcaaaaatagcagcagtttcagaaataccaggaagcctctccttaagaacttctggaggcagatggttaagatgcagatagatgtggtccttcaatggccctgaagtaaccagaacaaaagataagtttcatcccaacagccaacacagttctgtacctcaggtgttaaatgaatggacttgggcataccaacaccacggccttctctgatttccattgtcatagatcttgaaacaacatctcgagaagcaagatcttttgcagtaggagcatatcgttccatgaaacgctcgccttcactgttcctaaggataccaccttcaccacgggaacctgatgatcaaatgagaatgaagacacgaagattgtcagtaaaattacatatgtgcaacatcaacagtataaatgtcctgcccataaactaggataaacaagagaagtccttagaagctaagcacatgaagaaaagaggagtatagaaccttcagtgataaggcatccagcaccataaatgcctgtaggatggaactgcacaaactcaaggtcctgcaaacatatatcatgcaaatgtaatcaggatagaagcatggaacagtaactaacaattcagcactaaataattggactaacctgaagtggtaaaccagcacgtgcaaccatagcgttgccatctccagtgcatgtgtgagctgaggttgctgagaagtaggctctgccataaccctgtttccacaagacaacacaaaaatgaatcgccatagtcaagaaagctagcacatttgtcatccaaaattcaaatctgtgagatatcttactcctgtggccagaattgtatttgtagcacggaaacggtgaagagtgccatcctccatgttcaaagcaataaccccctgacaggtgcctgaatattattacaaagtaatcaatagagcttctatggcatggagtaatcgactgcttgaataaaattcacaagtcctaatacaagaagcaggagggtaaatacaaggatatgaatgagatatttgcaactactgaagaggaagctacagtgccaagtgtacttgtgttatgcttgaaatagccacacacacacacacgcacacaaggaacaaaataattagagtaaactgcacttagcaccggataaaacatttgtttcgctttgcaccagatttagcacatactttcctttacactaaggttgtattgaaataagtttcacttagcactaggatacataatcttacctatcaagattgaataagttttataagatatcctcatattttacaatattttgttcaattataagacataaccaagtgcaaagtgaaatcgaattgagataccctggtataaagtgaaagtatgtgttaaacccagtgtaaagtgaaacaagttacgctctacccggtgcaaagtgcaatttactcaaataattatcaaaagaaaccaatttagcaatgatggattacaactaggagtttatgacacagatagtaattagaaaagtcttctatcatacacttgagtcttgcatagactacgtagacacagggttgacggatatgattatctaaaaaactagccgtcttaccttcactgtccatgataaggtctagcgcaaaatattctacaaagaactgagtattatgcttcattgcttgaccatacagagtgtgtaacatagcatgtcctgttctgtcagcagcacatgcacatcgataggcctgcccacctgaagaaagcacacacagttatagggactggaataatatatgtcaagattgtcttttcaaaataaatttagaaagctacgacctttcccaaaatctaagctctggcctccaaaggcccgttggtatatctttccatcttcagttcttgaaaatggcaacccatagttttcaagttctataactgcttttggtgcttctctgcacatatactgaatagaatcctggtcacctggaaatggataagaacaaaatgttagaaagagagtgaaactgtagaacagtagggtagttgatataagatgccattccatgttagtaactctttattataacctctaggtgttttgcagcctaaaagaagtaaaaaagggaaccaggaattaaggcagcttaccaagccaatcactacccttgacagtgtcatacatatgccatctccagtcatcttccgtcatgtttccaagagcagcatttatgccaccctacatacactcttgtaaattagtacgtgaatgaagctcataaacataccagaacaataaaagaagtaagagaaggctctaatgatgaacatcaatggagcaaaatacatcaaccaacaaaattgaaaagtttagatgttaacctaggcatttagacataccaaaaacaactgttgctgaatgactcatatcaacaaaaagtataaaaaataaagaggcacaaaaaagattcaaacatgcaaaacacacaaaataactaggtaggacagtaatataggcattaatcaattaaaaatttatatgtatagcttcgatatcggtaacagtaatatcgcaagtcaaggaatacatcagatctgcataacaatccactgtgaaatgcatatctgacttaaaggccagagaaacagaacaactgctcttcaaaattatcttaaatacatagaaagtttagaacagacaaccaagaatggcaggactaaaagtccaggacactgtatttattcctttaaaatgattgttgattataaaacacaccgtcttagtgacacgtccattcactgagtgctaatatcaagagcagatgcaataaaataactggccttttctgttgacaaagcatttttttctgttgaccattggtgtgcagtgaattccctgatgaaagggagctatgctcaaactggccctagtactttagctactacctaaccatatttatctcatttgtactgatttggttagcgtactgcgcagtacacaaaaagcataccataggacaaatgaacctaaacagatggaaattacttagcacataaatcacaaatggacataaagcatcacatcaaactaattctaaaactaaccatccaacataaatcatcgtaaacacaatgaaagcacatcacaaccagcatctcagttcccacaatacccaaccaatgtttgcatgatgcacaacaaatctattgtcactaaatgcaagcctaagtaaaggtgttgcagcaagtttttcacagtacctgcgccgcgacggtgtgcgaccgcgtggggaagagcttggtgatgcaagccgtgttgaacccgtgctcggagagcccgatcgccgcacggagccccgcgccgccggctcccaccacgaccgcgtcatacgagtgatccaccaccgtgtacgacgactgcacatcaacaaataaaaaaccaataccatcaatcgccgcccatttctcgaaccaaaccctctcatcgcatcacaaatcaaactcccacaccaccaccaccacaagcagccaaaaaaaatataaataaataaataaatcccatcccaaaatagagctcatcgaatcccacccaaaacaatccgaacacacagtcgcgcggatcaactgaggtcgggggatcgaggggactaccgaggcggtggagaagagcctagcggcggcggagacgggggcggaggaggaggagcccttgcccttggagaggctcctgaggccacgcgagacgcagccgcgccacatctcgggtggatctcggtgcaccgcacgccggcgatggagatcggcggcacgagagaaggcggaggcggaggcggtggaggagggagagggcggcgcggaagacgacgaggtgggagggtggtcgaggggaaggtcgtttattctcgagaggggagggttttgatgggacgattatgccctcggtattgacgggttatttacgataatgccattttctccttttctttttcacttttttttcatttaggaattttttaaaatgtcgtgttagtacgtactccatccgtcccaaaatatagcaatttgtgcttggatgagacgtatcctactacgtactctctcttgttcttgttcagattcgtagtcctaagatacgtcccatcccactaaaaattgctatattttgggatgtagggagtattttttttacaaatgatttttttgtttggtatataaagttttctttttaggtaccataaaggaaatggcttctcccaaattatctataaataaaactcagaatttctttggagtggtggtctaggttagaaacgtatggaaagaaattggaaattattttcacacaagttcagtccttttaaatccaacgacgtataaacactttctcttctttcgctacaacacaacattaataattttgggttggatggggttatcttataataagaaaagaaataaagtaatattacgtctcttttgaatcatgggaatttactcctgattaccaagaaaatgaaaaccattccagcgtttcagagagcctttactagtaaaatatacacttaatgaattgagatcaagatatatagctctgcggttttttgcgtggaagtttatgatctaggtgaagcaaaaccaaccaaggagaaacaaaatttgagaaaatttggccataaattaagttcccagctagatcagccaagggtaaaaacgtaatgcaaaaccaaagtaagatgaattgttggattacttgcagaagaagaggagagcactagttgttgagaagttgagatggctccagcttcagtggagggcggcatgtacacgagtgtggctgcgcaaagcgaaacgcggcgcgtccatctcccaaccaaacaaagcacagtgtgactcgcatgactcccatcgccatcgcttgatcggctacttgctagtacttcacccacgtatacgtactcctcgtatgaattgttcttcttcgttatcctttttcactttgggttgcgttaagtgattcgatgttaatgaaaccacaagggtacacgtaacacggctgtataaaaattggtctgaaagatagcacagttgatcaatcgtttcgtcatgagccgatgccaaattttaaattttaaaagttactatcctatatagaagctcttgctaaatacaattttggcaaattttattatggtacactaaacaatgtaaatttggttttatagacaatgcaagaagtcacatttgcctatgtgaattttagtggacaacgcacctattatttatcatttttggctatttcaaggagatttttttgaagcaagtataataatacccctaggactaaacccatcactcaaccaataatttttatgttagaataagttcaatgatattatgatattttttaggccaatatatatgtatacaattttaaaactaagcatagatgattaaaattttataacagaacactaccatgaatttaatgcctaataaattaacagtattaaagatgactcatcagggtgttaattcatcgcgggtaccaatacggcctccaaaaggttagataataaacaactttataactaatgatcgcatcgcttcgcttattcgggaaataagccaaacatcatatttgcaaacaaaaaataatttgtgaatacacttttatattttgtgttcttagcgatctaaaatcaaatgttgcaaaataaactttgatgaaaaaaacccccaaatcaactctatttttaaggttaaaaattcaaattttgtctgataagtataaacttaagcgaaaagacgaggttgtaaggttaacctataaacaacccatatgtttgtacaatagtagtatttcttagttgatgagatatagtgtggtaccatatcattgtgtacgccacccgtagtattacaatagtatcgttcacacaactcctatgtataatattttgaaatagcccaatttaaacatcaaatgatccatcatttgtaactcgtgtaatggtaagcgtgggtaagaaatagatacgctagtatctgtagtatctagaatatacccatattagtgcatttggactaattaagggttcatttggtacaactcttactatgaggacggagctaattaaggagcggttgggttgaaatgccacttcattgctagttcttttttctgaggtgttattggttggcccttatacttataagccaaaatttaaattttagaagttgatttgaatttgattttttttgtcttttcatcactgtttatgtttattttataatatttgtttttgacttgctaagaacaagttttatactcataaatattttttctatttgttactacctccgtcccataaaaattgaatttctagctttaaacctttgtcccataaaaattgtatttctactaatgtgggacccagtaaactgtaatcttctttccttccatctcatctctaacccattgtcgtgacattccttttaatcaagtttatatatggaatgtgtgcatgtactgtgttcattaaatagggttattgtagtcattagtctatcctattaatatgtccttaattctctagaaatttaatttttatgggacggaggcagtaataagtaattcgaataagccaatcaatgtcttccactagcctggagtacgcggcaatgtcttaccgtttcctaatatgaaccctatactttatggtaattaaagtaggtcattcactcacccaataagtagggcccgcatgtcattgggaagagacgtggctagcgctcaactcatggctaccggcgccggtgagcggtgcggcgtcggcgcgtcgctacggcggttgttggctcaacagaaccttggcatgtcatcaaccgaggtcaagagcacttgccccaacttggatgaggcaaagacaactgaggtggcgcggtctcgatccaacgatagttatagtcgctaatgatgtaatatataaacattactgtaacttgattgacactgtgacataatgggcctattctgtagtaggtcaaagtgaagtgtttttggctgtacagcacagccctatatatggccatatggcccgaggctcgatggcccgctcaaggcccgataaatttggcccagggcccgtccaaggcctagtaattttggcccggccaggcccgtgctggcccggcccaacagccgtgacgtgcctgagcttctacctcgacacgctaggctggcactaggggtgaaaaaaagctcgggctcgcctcgagcttggttggctcggctcgtaagccaaacgagccaagcccaagcctccttttcagctcgttgctgaaatgagccgagctggctcgcgagccgtttgttttggctagcaagcctaggccatcatgtgtttatatcgattatttcactttttttggcgttattatttgtcaacttgaaatttatcattaagatttttttttaaaaaatgaatatataaacttatttaaattttacatgttgatgatttgtttttgttttttttaataattataaaatatatatgaagaggattttcaataggaaggcttgcaagccaactcgagctggctcgagccacgaaatgagccgagccgagctcaagttttagcttgttgccttaactgagccgagccaagccaagcctagtttgttgcgatccactgcaagccgagccgagctaggcttcgcttggctcgtttccacccctagctggcctggcccggcccaaagtttagtgatgcgaaacagacttattctcaaccatggccctttttagattccaactttttttttcaaactttcaacttttccgtcacatcgaactttcttacacacacaaacttccaacttttccgtcacattgttccaatttctttaaactttcaattttggtgtgaaactaaacacagcccatatgtaaggcacgtcacaaaaatatagggagacaaatagacttattatatggtacgacccaaagagtagagatgtaaaatagacttattttagctctctctctctctctctatatatatatatatatatatatatatatatatatatatatatatatatatatatatatgccatagcccaaagaggagggggaaaataaacttattttaaaaaaggcatgatgggccgcacgtgccttcgggctggcacggcacggcccgactactggtaggccgtgcctgggcctgaggtgcagtacgtgggccggcacaacacgtcctgaagtgccgatcgtgccgtgccggcttgattgacttgggccgtgcctcgcccgtgcctaggtcgggccgtgccagacaggccttatagccatctatatacacatccctaaccgaacggtaggggcaccgcagcgaatggtcatctaactaataagaatggtaagtggctaacccgtgaagctcacttataagtcggaacaatgtaagaatccactttattttgatctataggtgagctcgcggattaattagccacttacatctctatgggtgtgttcggcaccccttttcccaacccctctctcgttttccgcacgcacgcttttcaaactgttaaatagtgtgttttttttaaaaaaagtttatatacgaaagttgcttaaaaattaaattaatttatttttcttaaaaatagctaatacttaattaatcacacgctaatgaaccgctccgatttccgcgcgtaccggttgggaagctgtactagcgaacataccctatatatgaaatatcgttgtaatcttgtcccgttgtagctgttgtggtagtgacaagtgtagctacattcatgtttcagcagctagttctaccaaacaagtctattgttttttaggctccactccaatagttatgattgatattttccccaacgtttggacggtctacacaatggtcgcggaaatgatttaagcattttgtttggactgttttctttcctgcacgaatcaatgggcttgttcactttgatgtcatttctaaccataccattttttagcaagttactaaaattgtgcatatgtttggtttcttaccaaattttggtaaaaacgccaaaattttggctacattgccaaaatttggcaacaaagtgaacacatccaaaatggctatattgcctaaatttagcaacattgacaaccttacaaaaattttgacaataacaaagtgaacaagctcaatatgatacgtcctgggtcgatttcccgctcgaacgcgtgctatgcgattatatttcttccatccactgatccatacaggcacaatccttaatgtgaatctaatactccattaaggtttgtgcctgtacgtgtatattagaaatccatcggcagttctttgttgtaacatacggttctctacataatactatgcgtgcatatgatgcagtacgtacgtacagtaccaccggccggcaaatatggaatggagtagaaacattcgtggatcagtacacgcgagatatgtttcacgaaaaaaaaagagagggaatgtttcaaaacaaaacatactgtcctatacaaaaccaacccaaattcattatactaagggcctgtatacttcgcgaaaaaaaaaatttggattgcacatcggatgtttgaccggatgtcggaagggtttttccgatatgaatgaaaaaactaatttcatctcgcctggaaaccgcgagacgaattttttgagcataattaattcgtcattagcacatgtgggttattgtagcacttatagctaatcatggactaattagactcaaaagattcgtctcgcgatttcccccataactatgcaattagttttttcatttatctatatttaatgctctatgcatgtgtccaaatattcaatgtgatgtttttagaaaaaaatttgggaactaaacggggcctttaaagctatataaaaaacgtttaatcctgtattagattgaatttttttttaaccgagagtatgttcctggtgtatcaacgaaagcaccgctgtacgttctcaaaaaaagaaaacacgcatcactcctcgctggatcatcaggtcgtttttgttcacatggcatggcgcagcgcgtgactagctgcagcagcagtgcaaaagcagcagcattagccttgggtcgttgcgtaccgtgaagcacagtgatcccgtgcagagacactgcagcacgcatgcactcctactcctatagtataactgacgagctgtcacatgcaatcatggtcaatttcagatttcaactgggatggatgttcaggtctggttacatctcacttcaaaattttttaacatgttaaatagaatatttgagcacctacataaaatattaaatataaaatattaaatatagactaaaaaataactaattgtacagattgcgactaatttacgagacgaaatttttaaatctaattgctccataatttagtaatgtggtgctacagtaaacatttgctaatgacggatttgctatactggaaggggaagcccgtgcaccgccgcctatttcccgtcggtgcatcgttgccgtcggctgcttccccctccgccgtgcgtcgtttgtgttagattaatgagctaggcccaattaaatcataataaattccattgtcccacattaagagctatgggtaataaaccaccttgaaaatctaagtgaagaggtctcaacttaaatacagagctagtggagagtctctgttgaacggttaagatggtgtacgggacaagcaagtgcctctggaactccgtccgcgcttgagaacctgcacgggtaggcgggcgatcaagtttcatatatatatatatatatatatatatatatatatatatatatatatatatatatatactctgtagtaccaaaggaagaacttcccgactcttgcacttgattcatatatatactcaagtttcatatatatactccgcattgcacttgtttcatatatatactcaagtttcatatatatactctgcagtaccaaggaagaacttcccgactcttgcacttcgagttcctcctcctttgttcctagtgtacgggacgagcaagtgcctctggaacctgcacggataaacggacgatcaagtttttgggtagctttttcaagcgcggctgctcctattcttcgacgacaacgttgcatcttcctctgcttctgcttcaccatggcttatactggagagaacggaggagacaacatcaacggaggcaatacaaatgcctcaacatcttctgcatcgttctctgggtataacattctaactttatttgattttcttcttggtatttacacgttcataatgttattcataggattgaaatcctacgtgaatatcaattgatgtttatgcttattttagcttaagcatgctcatgtttatgtttagccttatcactagatcgcttcttattgtgtatgtcatgtttattgtcttaatattttggattaaaatatgccaaaatatgaccaaatttccaatgttttgctgcttcgcctcctcgctctcgcgagatggaggtcgggggagacggcgtgaagtggtacaagagagagggatgggggtagggtggtgccatttgcgggtaatttcatcaaaaatatgtgggtaatcctttaacgcggttggagttggagttgaggagcgataaaaatgccaccgtctgccggtacattttcccggagcgattctatgcgctccgctccagttttgatcaaatctgaaccgtttggttgcactccagctctagataagatgaatctgagagctggagccctgccaaacgagctcttacactaaatcaaccaccctatctaaattctatcacaataccctcgcaaaataatgagattctattataataaatttttggtaatatttgcacatattgcaatgtcaatgtaatcatgcatgtttacacaaatttgtctgaagactgaagtatcattttcaattccaccctagctaaatttaaattgttcgccctactacaagtatggccttgtttaattcccaagatttttttccctaaaaatatcacatcgaatctttcgacatatgcatagagcattaaatataaataaaataaaaaaataattacacagtttgcatggaaatcgcaagacgaatcttttgagcctaattagtttatgattagctataagtgctacagtaacccacatgtgctaatgacggattaattaggcttaataaattcgtctcgcatttcacgtacctattttgtttcattcatgccgtggctggcttaagtaggtgcgtgtaacagaggcccttaatttgttgtttcaacctaaaatttggggtgaaaaagtttcagcaattatttcatcagagtttcttctttcccctacttatttactcaatggcatggctgatgttaagttggtgcaaaagaagcaaactgattttcccttcttttgttgttctaacccaaaatttgcttgaaaatcacctaatcctttcagttctagctgaattattctctgcgtgcatagtattgtctcttagttgtccgcttgtacatactagtagtatggaacaactatctatggctaggcaaatgcaagatgtaacacttgagggtatgtgcaacctgactaaatgagcgactagttatgatattaattgctagcccttcctctgctgtttggtcttacttgaagcaacagctgctttgtggtttgcacttggcaattcctagcaatcaatctgattatgtttcttccttcatgtgcgaaccatagggcacgacatctcccaagactacaactcctactaccaagagctgggaagagaacaaccctgagcttcttgctgaattggttaaacacaagcaaactgcgttcccctggattagttgtttgaacctatttttttttttttttaaaaaaatccatcaacgtctcttctttcacgtacctatctgcttcatgccgtggctgatttagctaggtgtaatggaggcaaactgatttccccccttaattttttgtttgaacctaaaatttgcgtcaaatctttttcatcaaagtttcttcttcctcctaaaatttgcgtcaacagaaacaaactgatttttcccttagtttgttgttttcacctaaatttttcttcgaaattacttatccttctattctaatggattttgtttgaaaccctgcctctctatgcgtagtattgtctctagcttagttgttcgcttgctaagccgtatatactacactagtagcatgtaacaactatctctagttttaagagagagaaggcaaagcgagaggagatgaggagacatacaggtatagaagagaaccagccgtaagtcggcatggggagcgccgccatcgcgctccctccaccttgatgttgtttctcttctcttctattccttccccgtgtcggcttgctcattttcgagatcccggatcataggtttaatccaccgtcctcgcgcaattatgccagctcgctccccgggctcaggatctgtttgttcttgatttcgcgattcaacctgccctccccggaccgtgattagagcccaatttggggggaaaaatttcagtttttcccatcaaagtttcttcttttctgtattcatttgcttcaggcctggctgatgtgcaacacaagaaaactggttttccctgaactgcaagttgtttcaacctaatatttatgcttcgagattacatcttttagttgtaccgtcaccctgcctctgcatgcataatagtattgtctcttaattgttggcttgctaagagtagcagtatctatggctaggaaagtgtaagaggtaacagttcataggatatgtgcaactgactagttatgatattcctccgctgcttggttttacatgaagcgacagctatttagtagtttgcaccttgcaatgcctagtaatctgattatgtttcttccttcatgtggaattgtaggataagctgcgtggcacggcatctcccgggactacagctcctactggcgctacatttgaagagaggaaccctgagctgtatgctgaattggtaaaacgtctttcagatcaaaagagaaattccaggaggatgaggctggctggtgcttctgcctattgtgttgtgttcgtcaccctgttgtaccttggcgatcgtgagaagcgtttgtttgagaagtctttcggtgttggcaaatagctttatcatctatatattattcaccagggttatgtattttctggtgctaagtctaatggtttcttagatcgccgtctttacgttctgagactattgactttgttatctatgactctcctgtagcatgcgtgtgacatgcatttgtgtacgattaattaattatctatgtattactaccttaagtaccttctatatatctgatatgtgcaagtagatgctatggcgatctcctatagcagctttggctttaattgctctatcgaaaatacatatccatccatcttcatccatccgttaaatacctcgaacaaaaccatttttttccgaggtacattgatacactaagacaacgacgttacagtgtataacagctgaacatcgcgtatagacgacagtagttgagtttgtaggaagaaacatgaatttggaaaccgggataatatacttagcgtgcaggcgacgtggctacagttaaaaccgcaccggcaccgcacgtactacgtactatactaggccggagccagtttagctgcggcgcggggcggggctgaagggaaccgttcgattcatccacgtgtcgtccatccggcgcggtgacaaactgacaccagcacttacgcacccactcactccttcttcctcctctctactactctctttccccctctcctctattgaaggtgaaagaaaccaaaaagaagagagagagagagagtgtgtgtgagtttgaaaaacccaacccaaaaccctagccttcgggaaagcctcatcgccggcaaccaatccgatggcgcttcttctgagggtggtgaagaaagggagggggatggccgtcgtcgcccagagcggcggccgcggcctttccatggtggccacgagcgccggagccgcgggaggaggagaccttgtcccgaagctgctccgcctcggatgcccacagcatgtgttgagattataggcatataatgatttaatttattccataaataaatcatggcattgcagatgtatactagcattaacgcatcattagatctacacatgtaaactaagcagtaaaacatgaacagatcaaatatgcgcaacatattgaacacgtaccgaggtggtagaaagacctgctgctcggcaggaacttttcgcgattgcaggcgtttacgaaggcgcgcagcatgcgagcgaagaggaagacgagccatcgcggacgaacagggagcagtcgcgctaagcgcttcccaaaaaccttattgccgccttctcccggtgcaggacgtcgaaggcagaggttccggagacctgctctcctgatcgccggtgcacgccggcgagcgggatggagtaatctacgagcgacggcgcagcacagagtaggaggcaaacactagattgatttttcgtgtgttgcgtgaagacggcaggtcggtttatatagagaagggtcgcttgatcagggcgcccgcacgatctccactgcgcgtaaccgaaccggataagtcgcgcgtaacttatccggactccacgccgttttcacgcaccggatttttcggaacatttccaaaacaaaaacgaatccgaatttgcagcaaaacaaaactgcaaaaggaggctgcatctgcgcaaggtgaggaactaatttttggcagaccattcgacgcgtgcgtcgtgcacgcgcgccgcctgccctgccaggcgaggcgagcgagcgcgcgcgtgttccccctcttctctccaccacacatgcttcaagtgactaggagggcattctcccttttaaggaggtctccctctcctagaataagtaaggtggtactaaactccacatgcatgccatcctatgaggtgggcttttgtgattttctaaagaattaatcttcgagtgggctaaggcccatccattaattccaacagcctagagcagcggcggcaccactcgtcgccggagccggcgtcaccacaaccactgccaccgccatggctggggccgcgaaaggcgcaacctttccgccgcgttccggggccatggccaagcaggatctggtgggggtggagaaggagctccgcttcggatcaccagccatggccacgcccacacccaccaaaggcgccaaaggagctgcctttccgtgccctggaccaggagccttggtcactctggacctggttccaaagaagctctcgtttgatccactgcccggcgctgctgcagtcggtggcggcgaggctcccaagaaggtggtcacctcgtcgccgtcgtcaccctcgaagaacgctcgtctttacactggtggagaaatgctctttactcctggtttagaaccctttgtagtcccggttttccaaccgggactacaaatccgggactaaagatcgctatctttagtcccggttcaaataaccgggactaaagatcgatctttagtcccggttggtaacaccaaccgggagtaaagagggggaatctttagtcccggttggtgttaccaaccaggactaaagaggggaagcgacagttcctcgagatttattattattattattttgttgttgatttgctaatggctagtgttaatctatgtattttctcccgaatccaatgagatgcacatccccaaatcaacatcacaaatcaaatacatcacaaatactacacacagatcaactacatcacaaat

SEQ ID NO: 69108 - DNA, 17218 bp, Oryza sativa
agaggggaggggaggaggaagaggattggatctgagaagagcaagagaggggatgttccaatcttatctaaatatctgtctgggatttaaccgatgggatgtgggagataaatatttactcccggttgataactccaactgggactaaagatcaatctttagtcccggttggtaataccaaccgggagtaaagatcactcgatctttagtcccggttggtgataccaatcgggactaaagtggtaatctttagtcccggttggtagtatcaaccgggactaaagatcctcgaccccctgacatacatctgacaggggatgaaccgggactacaaatcatctttagtcccggttggtgtagatcaaaattttttaaaccgggactacaaatcgtttttagtcccggtttttaatggaaccgggactattgtgaaatttggtcgaccgaccaaagatggtttctccaccagtgttacggcaccgggagcagcagagggggttggccatgctaggctccgccggaggctttggacaacctggagcggaggatcctcgacgacatgaagcaggctcatgaaaaatatcctcggtgtggagcctgccattgcagagagcaaacctcggtcgttttggaggtctctatttctcttcatctgtcgctgtgcagtgggattggcaatgtttggagtctttggagatttcgcgctcgcagcactcaagagatgggccttcgatttccttcagagtccggaggtgactcagatcctcaaaaccttcatcaacaacagatattacggatatgtgactaaattggttataaacatgtagttttgttagaccaaatcttaaatatgtatttttttttataaaattaatattaaatccgtagttttgtgatacatccagttaaatttttagttttacgataatttaatcacaatatccgtgaaatttactcttagattatagactaaccatgcatacggtaacaagtactccctccgtctcaaaaaaaagacaaaccctggtttccgtgcccaatgtttgaccgttcgtcttatttgaaaaaattatcaaaaaaattaaaaagacaagtcacgcttaaaatattaatcatgttttatcatctaacaacaataaaaatacgaattataaaaaaatttcatataagacggaccgtcaaagttggacacggaaacccagggtttgcctttttttggggacggagggagtatactcctatattagtgcctgatcgatgatcaaagtatatatcacgatcctattggtctgtttagttggtgaaatgaaaatttttaaatgtcacatcggacgtttgattggatgtcggaagaggttttcggacacgaatgaaaaaactaatttcataactcacttggaaaccgcgagacaaatcttttgagcctaattaattcgtcattagcatatgtgggttacagtagcacttatggtaatcatggactaattagattcaaaagattcatctcgcgatttacatacaaactgtgcaattaatttttctttttatctatatttaatgttttatacatgtgtccaaagatttgatgtgatgtttttgggaaaagtttttgaagaactaaacagcccctataatatactccactttggaatactccttgtgatcatgcgagttttcttttgtgcgctctgaagacaaaaaggagggcaacgtagcgaccgtgtggatgctgcctacaaaggctgccagcttactcgtatccggtctactcgtagctctactgctggggcggaggatttgtccaaacatgaattcggcaataataaaagggggtagcgcacgaaacctaaaagtggatggatgcggagacaaaagatttagacaggttcaggccctctcaatgagaggtaataccctactcctgtttggggatttgaatccgcagggtgtagtatagatcttatgtgctcataccccctagagggcctcctgcccaccttatataggatggagggcaggattacaagatagaaaccttaaccattacggtatcggtttcctaaatctactttacaatattatcaaactaggactttaggccattccgtaatataaaagaaacgtaatacccaagtcatgatctgttacatattccatagatataagttatcacatataactagtcggataaccacgccgtgtgggtatggggtacccataatctccacagtagcccctgagaccttcgcagtcgaaaagataatcttctctcgaactaaattactccaaagccgagtgcttcaatcatctttgccatggtctcccgagtacttttaccaaatctgaagactgtgaagggctgaaaaataaactcaggtgcatcgactagatgcacctaataggtgtagccctcaactatatggttaattgaacaaaccaagcatatagtcaaggaataaataatccaaccaaccgagtggcttcgataattatagtcaaccaagcgacttgatattaatatgtagcatatgcggtgtgaatccctaaataacatgatccgagtgatataccgactgttttgtacaatatgatgagtgtaacctaaagttggctacatcattgaaaattcacatagcaaaacagctataaagaagcttatatgttgtgaataaagaaatttctaaagtattgggcatacgccatgcgcacactgctttaacagatgtgcttaagtccctagaagacacatggttccaccacacctggaaatatatggcatatgtggtataaaatccgagtaaataaactcataaaggattcaccaaccgcctggaaaatgaccaaaatatataatcagcctaagccataatattggtcaataaaagtgcacacttacgtggcaaaaagcaatgatattgtatccaatcaattgctttatgaacccaaacaacgccttgacttatataaaaaagtcagcggggagctatataaagcattactgtttggcaccttttaaaatgcattgtaccaactcctaaaaagttgagtaactgcggtataaaaggattttaaggtatagggcacataatcacgcgcgcttttgcctaagcaaaaagatgcctaagtccctaaaagaacgtgacatgccacacctgaaaatatgggctgcagacatattaggcctaggccaaaaaatatgccttcgacaccctttaaaggatgacgcatgtaacatgctcccgagtaataaatctttcgggtgatatagacaaagtgtaactcatatgaatagcttctgatctgagtgattatcctttatgggatactccaaaatagatataacaattgaattccgactggcgcaagtattcggttgataacccttacggggaataataaatagtccagtctttgagcatagaaaatagacccatgatcatcaaattcatgttgcatgtatccggaacaagtccaaattgaaggtatgatacttgtgtttgaggtagtgagcccctgagtatatagcttgtccttctgtcgtagtcacaattgtccattgatggtagctgacgcggttggcatagagacaagaagaccaatatagagataatattgcccaccagaggtggcaaaaatattggtagtagtgaagatagtgataccaatcaaaagtgatgaagttgcccagcgataaagttgtgtagccatggcagtgaaataatcattcggtgacagacgatgcagctggtgaagaagatgaagatgcccattagtggtgacataagctatccatgaaggcgaggataccggtcggtggtgacgaaagataacgatgtcggtgatccagtcgatagcaaccgtgaaagtgaaataataagtcggcgaagacatagtcatccattagcaacagagttgatgtcagggccgatgaagcagaggtgctggtgatgatgtcagtgacagtaatccatcaaattggtgttatagctgttgcagatgcttcacttggaggaaagtagatgatgttgtccaactcgtcgaaactgagctgattggttgataactctgctataaagcaaagacgaagataatgactcctagaattgactcgttggctgattaattgattgcttcagcttgtcgaattttgaaagtcttgtatttgtgtagcccccgactctttggttagttgggaaacaactgaacatagagtcgagaactgtaacttcttgtcgtcgagtagtcattgcttgagtgaagataaatattgaagattggaacaccacttgttgtaataaaataacacggcatcatatttggtgacgtatgccgaggtgtcgaaactcttgtagtcgtcatggttggtgaagtagcaaagcttgcgaagtagaggcaatagagtttgccgatgccgaagataataaaaatgaagttgctccaccatggtgacaaagttgcatatccgtgatgaagtgaacacgagtcggcggcaacagaagcaaaccggtagtgaagacgcgcaattgtgaagataaaagcaccagtcggcggcggcataaccagtcggcgacggaagacgatgatgtccatcagtagtggtagctgtataaaccagacgtagaggcgagggcactagtcagcagcagacgagatgaccagcgatgaagacgataaggccaatcaacactagcagaatcatgcagccatggaagtgaagaaactagtcggcagcagacgtaggcagcttgtgttgaagatgctgacgcctattagcggtgacggcgatgtagccagccgtgaagaagatagcatcagttggcgtcataacaggccagccgtgcaggcggtgacaccagtcagcggcggatgaggcggccggtcggtgaagcggccggtcggtgaagacgtagacgccaaacaacggcggcataataggccagccgtgcaggcggaaacaccagtcggtggcggacgaggcggccggtcggtgaagacgtaaacgtccaacaacggcggcataataggccaaccgtgcaggcagaaacaccagtcggcggcggacgaggcggccggtcggtgaagatgtagacgcccaacaacggtgacataataggccagccgtgcaggcagaaacaccagttggcggcggatgaggcggccggttggtgaagacgtagacgcccagcaacggtgacataataggcagccgtgcaggcggaaacaccaatcggcggtggacgaggcaagtcggtggtgatgttctaactgatccattcatggagcgtaagagataagcttaaagccataaatcccttttatgcatatctggatctggatcctgcagaacaaacatataggatgactagtatctgatataaatataatacttgagaaaaattcaagtattttaaaatatttataaatatgtatttcatctcttgtcaattttgatttccccgagcagatgactcattacgtttaaacactctgcccgactagtcataaccaccaagcaccgggagtcggcctaagcacttcccaaacatgcatatgagtgacatgagttcgtcattaatggaacaaagtttcacgggtcggagtttactactcgggtacttttgcaattattaagagcagaaaataaattatcttatctctatgcttttgatttattccaaataatacttagcaccttgcgttattcagtccatccaacaagcccccaggtgctaggaatcggcccaaaggcaactatccattggcaaaccaaacggaaagcataggaagatggaactccataactcgataggcacttttgtactcagaatatgtcgcaagcaatcaagataaatattatgaaaattgtttaaaaaatatgatataacatctgtagcccccgactcactagtcaacgacgaaccagttgatgtagtgaggcaaaggaaaaggcaaaatatcatataaagaataaaataaatgatgacttagctttgtcgtattccctcggtgacagcaaaagtagccgatgtgggaacgaagcaatccatcaatggtgacaaaaacaccagtcgacgccagtggaaccaagccagtggtgtagatgatgaagtccattaacggcggcgaagtccgccaaccgtataggcgaaaacactagtcagtagcggcagaggcaggtcggcggtgaagtcgtagacgcccaacagcggcggcataataggccagccgtgcaggcggaaacaccagtcggcggcggcgaaggacagcctgtcggtgaagacgtagacgcccatgtacggtggtgtgaccaaccaaccgtataggcgaggacaccagtcgacggacgcccaacaatggcagcatataataggctagccgtgaaggcggaaacaccagtcggcggcgacgaaggcaagccggtcggtgaagatgtggatgcccaacaacggcggcataataggctagccgtgtaggcggagacaccagtcggcggcggcgaaggcaggccggcggtgaagtcgtagatgcccaacagcggtggcataataggccagccgtgcaggcggagacaccagtcggcggcgacgaaggcaagccggcggtgaagtcgtagatgcccaacagcggcggcataataggctagccgtgcaggcggagacaccagtcggcggcgacgaaggcaagccggttggtgaagacgtggatgcccaacaacggcggcataataggccagccgtgtaggcggagacaccagtcggcggcggcgaaggcaggccggcggtgaagtcgtagatgcccaacagcggtggcataataggccagccgtgcaggcggtgacaccagtcggcggcaacgaaggcaagccggtcggtgaagacgtagacgcccaacaatggcggcgtgaccaaccaaccgtataggcgaggctgatttgcatgtagattcgtctctctgattttgttgacatgatgggcttggtgcagctaaacggccttagaggttgcgtgtggcatgagcaaacgctacattggtagtcgagccacgcactatgtcctggtgtacccctcttggcaacatggtagcagtgggaagcattgcaccgacggccgtacatgcaataaaaaatcgtgagaagattagtgtacgttagtaattaatctaaatatataaattacaaggaggttaggaaccggcagcacagccaaatcccatcactcattaaggaacgattttttgatctcgattgccatcctgtgcatgtgaccaaccatcgctccagtatacatgcaaaacaaacagatatagtttgattagccttaaaatattacacgcttaattgtgtaatgcatatatcaagctagggtttgatattaagccgtgcatatcagttgatcaacacatgcacgtgaagcactcagtcgctgttgatcccatggacatgaattgtccccgtgtcgtatgaaggttacgccggcacctgtacagatcgtaccaggcgacgagcagacacaccgggacttcgtctcgatctcagccggtgcgtgaaaacaagaaaaagaaaagtaataggagattagtctgcagttagagaataatctaactagtgaaaacgacaaagccaatgatattaattggagatcgaatcgatgaaattgccaagattgatcccttcgactggattgaatccgagacgaaaaagacatgcttgatgaatccggcgatgtcagagattggttccatcacacttgtgataggaaactcgacgaacccctacctggcgcgccaactgtcgaaacatgaattcggcaataataaaagggggtagcgcacgagacctaaaagtggatggatgcggagacaaaagatttagacaggttcagaccctctcaatgagaggtaataccctactcctgtttggggatttgaatccgccgggtgtagtatagatctgacgatcatatgtgctcataccccctagagggcctcctgtccaccttatataggatagagggcaggattacaagatagaaaccttaaccaatacggtatcggtttcctaaatctactttacaatattatcaaactaggactttaggccgttccataatataaaggaaacgtaatacccaagtcatgatctgttacatattccatagatataagttatcccctataactagtcggataaccacgccgtgtgggtatgaggtatccataatctccacaggattatataaagagtaggacttaattattaaagtatgaacttctggaacgaattttaataaaaaattagtaaatttcttggtattttttctgccaggtgtcacctggctcctccccaccaacagctagcggtgcagcaagctcgagcaagcagaggcgaatcatccatagcattaactagttctcacatcacattaatttaatattaatgattggtcctgtatagatttcagaacttgaaaaacaccaaatcaattcaaacaaatattttcctttttttttcaaacacgttaaaggatcgaatgttaatactatatcgtatgaaagcaacaatcagcagcgcatatcgcccatcagctgaaaagaacattattgcagagacaagcgacgggaagctgagatagcatcggtcgtcagtcttaacaaaaactagtgactaccccgcgcgttgccgcgacacttttatatgataaaagaaaacttttagatgcaacatatatctagcctgatgtattcctacgttggcactattctaaatttatacattacttcaagcgtagggtacacttgattgttgtgattaaaatacaccttgcaactattaaaaaacttacaaaaattcaacaattaatagcaagatagagttatgcattttctgatgcttgcttcaactgagtcaaggtcgttggaaaggaagattgttcattcatccatgctaacgaacttaggctgacatgcatcattccgatactaacagagatataggcctcctatgaaatagcaagtgaactttaattagtacccgagaataaacttaaagaaccattgccgtatgaatgaatatcatagaaaaaatagtggtctgatagggagcttagttgatcattgccatgaagcaacatcatcaggatcaatgtccatagaagcagtagaaaaactgaagaacttcagatcgcggtgagcaaaaacagataaacaaagaacacatgagaaagaaaatagtaacatacgagtaaaataaaaataataatttaaattgtaggccgaggaaagaaacacaccacaaaccatgaaggaatgactgtagcatggcaatgacagcatgacatcaaaaaaaccatcaataatttaaagagatcacagccattgcatccactggtttcacaaagaatctgttttgatcctatacgatggctaagacatgccattgtggagaggcatataaatagtgaggtgagaggataggtgaaaggaaaggtcgagtcaagaaaaatgcaatcgatgaatatatgcatgtaactgtttagtttattgatggtagtaattaagatagaaaattaagcgatatgcatgcaacacaattatcatgggagttgggccggtctcctcgatcgatcccgcataggtttaatccaccatcagctgcgcgcaattagccccgctcgctcgcttcctggcctcaggatctgtttcgattcatctcgcgctctccccacccgacccagattagagagcacaatttggggaaaaagtttcaatcgaagtttctcttttctctactcaattgcttcatggcctgcctgatgttaacttaccttgtctctgcatgcatgcatataatattgtctattatactcccttcgtttcataacgtaagtcattctaacatttccccacgttcatatggatgttagtgaatctagacatatatacatccatatgaatgtgggaaatgctagaattacttacattatgaaacggagggagtaaattgctggcttggtaagctaaatatttaggcccggtttagtttccaactttttcttcaaacttccaacttttccaccacatcaaaactttcctacacacacaagcttccaacttttccgtcacatcgttccaatttcaatcaaacttccaattttgacgtgaactaaacacacccttagggcatgtacaatggtgtctaataacgggctctcttcattgtcatgtaagtaaatttagtgacgtggaagaaagagatggaaggaatgggttgctacgcgagtcgactcttagcatttattaatggaaaatttgttgcatgagggctctcttcattgtcatgcaagtaaatttagtgacgtggaagaaagagaaggaaggaatgggttgctacgcgagtcgatccttagcatttattaatggaaaatttgttgcatgaggatggagaaaaggaaataagtatgataaaaaattgcaaaatttgttgcatgaggatggagaataggaaataagtataataaaaaattgtttggtgcattaatggtttagaaatcttattgtctctactattgtaggaggatagtctttagtgatattaattagtatatagagctcatattagactctatcattgtacatgcccatatattattaagtgtgcatggatagaatcgtgcaaagaattagtgtccctctatatatctacatactggtagtatgtaacagctaggcaagtgcaagatgcaccagttcagggtatgtgcaactgactaaatgaaatgagcgactagttatgctagcccttcatctgctggctgggggcatttttcttgaatcaacagctgtttgtttgcacttggcaatgcctagcaatctgattctgtttcttccttcatgtggaaccatagggcacagcatctcccaagactacaactcctactggcaagggccgtgcctctactcttgaagaggacaacatcaggtttcttgctgaattggctaaacgacatgcggatgaagcaagatattacaggatcgtggcgctgtctgctgtttctgcctctggtgttgtgttcttcaccctgttaacccttcgcaatcatttgaatcacctgtctgaatgttagctttaccatatctgcgttagcccttcgaatcatgtgattcacctgtctgaatgttagctttaccatatccttgatggttatgtattttgtggtaccaagtctaagcaccttttatctatgagacgatgcaaacctgtggctttgtattgatatggcatgcatttggataatgtgtaacgtatgcactcttatgtatttcaaccttatatatatcgttctgtgtgcaattagatgctaaggtgaggttcattcttggatgaatttggagcgttcactgtttatatgtagagactaatacggatagctgttatggtggaatcatgagtcatgacgagggttgcaaaggaaggaattagttggggtcgcttctttgccatgccatatgcttctgttctgttttggatcattattcatcttttctccttgcacttcttgttcgttagtgtatatgaatcagtcgatgtggattacaatgaaaatatatagagagaagcatccaaatcaattataagtagtggtggtcttgcaagttgctactactagctagtgaagaacacaagatatgtaattcaaaataattgattgcccgtcggccagggccagtgcgagttgttcaaaatataagcagttgaaaatcatctcatggtgtagtgtggcaccgatcgattatcgaaacctcttggttgttgttgggaggaatattgatcgataattcgatatggtgcatctagggtttcgatcgttcggtttctttcttaaattttttttttgggagctggctggccaaaatctatacctattcctacttacaaaatacgagggacgtcgggtccagggccccaatcgccgtctccccaaacccaagtgccacctccgcaaacaccctcaccgtctacctctccaaatggctctccttcgccatattcagggtgtgtttagttcacgctaaaattgaaagtttggttgaaattgaaacgatgtgacggaaaaattaaaaatttatgtgtgtaggaaagttttgatgtgatggaaaaaattaaaagtttgaagaaaaagtttggaactaaacaaggcatcagagaagtagaaatttgggcagggtaagttctttcaaacattttttttttttgcttttccacctttcctgtttctgagtagtatttcttgaaagtagtacagggcatgcttactatttttgacagaaaaataaattaaatcaaacataaaaagtttgatctttcacaatttttgttcattagttatactaagcctgatcaaacagagattccaaaccaaacaatgcaaagttcttacaaaataaatgttggcagaattcctttcaagcaaaacatagtattctactgcaacctccaatgactttcggtctcatcttttcgcttatgcttattagccaaaatttaaattttcaatcttaaattttcccaggaatcaatccggaaaactctgcagatcaaacttcaaattcaaatttatcctcaaaatttgggctttccaactctgcaggtatttaattaactaaacattaaattaaagacacagtaaatgcaattaagtaactggatttcaccctgaagatgcaatgcaggctccagcaagtcgaatccttcccacatctcactgcttaattaactaaacattaaattaaagactaaataaatgcatttcagtaactggatttcaccaccctgaagatgcaatgcaggctccacgctccagcaagtcgaatccttcccacatctcactgcttcttgtttccttgagctccagctgggacgatagcaacggggctcttcttgtcacgggcaccggcacccttgctgctccagaacaggctcttgatcatctgacggaggcttctggccgtgaagatatccttaacagctgcatcccaaacctccgcggcgacaaccctcctcagctcacaagcttccggctcgcgtgagaactccagcagctggttctgggcctcatcctgatggcgcctcaacacagcaaacagctcagggcagtcaaggaagtccaaaaacctcatcctgaaaagcttcatgagagcagcagcaagcaaggctagacgccaatgtgagcgccttgtctgctcaatcaacaacttttggttgccaacccaacacttggtgatgcgctctcctagtgcttcttccatcttgttcaaatgggcggcgataaccttggcgatagccttctcctgatcatcccaggcctccggcggagcctggcatggccagcaccgtcgggtgacgtaggaccgaaccccctcggtgatggcggcggccttcttcttcaccagagatggcgccgccttgccctccaacgccagcttcttggcagcagggccggccatggaggtaggcgcgaagagcagggccttgggcttgggcaccaggtgtagtgacgatccccccgcggctccggcgtacggaaagcccgaggctttggccggagatcccgactgtggtggcgccttgggcaccggcgggtcgacggtgaccagagcgcgttcccgggctccggcggtgcacggagcacccggtggcgcgaacagcagcgccttgggcaccaggtcgagcgtgaccaaagcgcgttcccgggctccggcggtgcacggaaagcccgatgatttctccgtggcgaggccacgggcggtttgggcgaccagtgccctcgcggcggccgtcgtccggccttgcttcgcggcgttgaggaggaggagggccatcggctggttggtggcggcgccggcggcggggaggaggaggtgagggggcttagggttttgagacgaggaggacgagactaggctaggctactagctttctctctctacttcttggttcttgcttgccttgcccctctctcctctttttactccggtagaggaaggaggaggaggagtgggtgccagcctttcaatcccacccggatggccgacacgtccacagccctatcaatccaacggctcccggctcctgacgcacgctgacatctgagagccgagccatatactactatctaggagtaaataataataactttcacataataattctttcttgaaaaggataaacgaacacaaagtatacgttttcctcgatccattgatagcttttcaattcctaaccctccctataattaaataatgagagtattttaagtgctttattttgtgtagcgagatccttcaattctccagtggcggctcgtctcacacatatctggccatatatatactcattgaaatgagaaattcaaacaaattaacgccgttgataaggcctcatttcaacaagtgacattgaacacgctaatttatctacaaaatgacattataatccagtatttctttccctaaacgcccaacaataatactacccgttagcgttgtagagtagtactccatccgttaagtcgttttgactttggtcaaaatcaaagctgcttcaagtttaatcaacaaaagtaatacgtaacatttttaactcaaagacaaatttattatagaaatatattcaattattaattttgacgaaactaatttggtatcataaatattactatatttgtctataaatttaaagtagtttgacttggcatgtaatccctccgtccctaaatatttgatgctgttgacttttttcttattcaaaaacttttatgaaatatgtaaaactatattatacataaaagtatatttaataatgaatgaaatgataggaaaagaatagataattgctgttggggggatggctccggatgacggagccaccctccgtcagtaggaagactcagctcgaagccatccaccacgagagaatgatcgaaggctgtagctaccatgatggttgactccgataaggggcttcagaatcaattaggagctcacgaatcatctcggagccgaccacgggtaccggagtgggccaacgactccggagcgagtcacgggcccgcagctaaccaatggcttcggagccaatcaaaggctccggagtgcccggggaactagagtgctcatcaagcatggaggaatggtccacgggtgtagaggggcgccattaatacgcactacgcatctgtcaaccacctctgacatcctgacagtggcaagaggcatccgctattatccggaagcatgcctttgcccaaataatagcccacaccctcggaaagcgtcaccacctccttaatggctagggattttaccagtagccctacgactggctcactggccagtcactccacatctgtttttagctagggtaaagatgtaacttccccttgtaccccttatatataaggaaaaagtacgaattaccccctgaactattgggtgagtacgaattaccccataaacccgaaaaccggatatttttcaccctcaactatcaataccggatgaaaaacccccctagcagctttgcaagcggttttggtatacgtggcagtctagtcagcaattcttttttttttaaatcagcggggcccacttgtcagtctccaaaactactatcccatagactagcgtggcactggcacaactggcgagcgacgggtacagcctgtcgactgatgaaccgctggcggaggagcacacggaggcgacgaagcggccactcgacgacggcgtggtcgagatcatcaacctcacggacgcgtccctcccgtcgtggagtgcgacgtcgccatcgtcggctcagactgcggcgggggcgtggcagccgcggtgctcgccggggccggccacaaggtggtggtcatcgagaagggcaactacttcacgtcgcgggactacacatccttcgagggtctgtcgatgaaccagctctacgagtctggtgggttcgtcaccacgatgaacggcggcgggctgctcctggccggatccacggtcggcctgcctcaagacgcccgagttcgtgctcagggagtgggcggccgcgcacgggctcccgctgcacaggcggggacgggcgaggcgagcgtggcggggacggccagctgtggcggtggaggcggaggtgcccgggcggttggtggcggcagcggaggcggaccgggcggcgggtgacggtggcggaggcggacagggctgcggcggcggcgtcgatggacacggtggacatgatgagactgaggcggggtcggccagaagcgtcggcgaagcgggcggcctccatctccgtcgccgaccgcctgctctgcctccatctctgtcgccggccacccgagctcgccctgcctccgtctcctccacctgcgcggatctcgccccccagctgctgttgcggccgccgccttcctcccgccgcagcgccgcgccccgccacagcctcccgcgacgccactggtcacccgagctcgcctccgccaccaccgcccgcctccctagcggccaaccgagtgggcagactccgcctaagatgacgccgatgcctaagagcggccggccgagcaagacagagaaagcaaagggattggggaggggagagggatgacatgtgggtctaggtgtttttttaattttatttgctgactggattgccacgttggcgccacgtgtgcaaattcaagtcgaaaacagctaaaaacagtgctgagggtttgtatagttgaaggtgaaagatgtccggttttatggttcaggaggtaatttggtcgaccacgatagttcaaaggtgtaattcgtactttttcctatatataaatatgtaaacattgtccacggttgggacacattcaatacagaacacatattaagcacactagttggattttgttccaacaattatttaaattttttttaataaaacgaacggtcaaacatattttaaaaaacgatctcaaatatttagggtcggagggagtaatataaaatggaaggaataataaacacgataaatcgaccaggtcgaaggagggaggcggtgtgaggtgcaccacagaagaggcggagggctttcggctcgacggcggccgggttccaaacttccaatcctagacagataggcaacgcaaacgtgccagccgccgtggaaggcaagacgatcggcggcggcattttg

SEQ ID NO: 69109 - DNA, 12578 bp, Oryza sativa
  unsure (1)..(12578): unsure at all n locations
actgcatcgagccatcgagggccaccgtcttctccgccgccggcggatggatggccctctcgctcctcgcgctacctctggcgccgccccactgcctgtgcttcaccgtccttcgcgtcgcgcggcgccccacgttctgccgcgcggagcgaattaatggaggcgaccacgacgaggagctcgacggggtgccaaatctgagccgaccaccgccggatcggatggacggccaaatctgcgtccttctgccgcgcgcagcagccgcgatggccggcgacgacgatgaggacctcgacttcgaggcgcgccacgccgcggccgggttgtcgatccgtgtcttcaggggcggcgaataccgcggccacggcccgttcccgtggcgcggaggctgatgccgccgcagccgccggcaacaggtgggcgcacgtcgacagcgacctgatccacttcagcaacgcgcgtacgccgccgccgtacgtcgtgctccatggttggcagcttccatagtcgttagtatagtaattaattgtctggtggaatcatacgcatattgattgccagtacgttggaatgtcctaatatcggagaaaatggatatttggtatcttcaaaactaggtttcgctattacatcatcatcaaattttcaaatggaatgtgctgacatgtgcttttgatctaaaacaggtcaaggaccttcaccatgcttcgaggaaatgagcaaaaaatggggatagctgttgttctatggtcaatttacaaatataggaataatgcatgttttaagcatgtcatccctgatgtggagattatgggtaccccatacccacacggcatggttatctgactggttataggggacaactaatatctatgaaatatgtaacggatcatgacttggggcgtctacgtcttcaccgaccggcttgcctccgccgccgccgactggtgtctctgcctgcatggctagtctattatgccgccgtcgtggggcgtctacgtcttcaccgaccggcttgccttcgtcgccgccgactggtgtctccgcctacacggctggcctattataccgccgttgttgggtgtctacgtcttcaccaccggcttgccttcgccgccgccgactggtgtttccgcctgcacggctggcctattatgccgccgttatcgggcttctacgtcttcaccgaccggccgcctcgtatgacgccaattggagctatcctcttcacggttgcccacgtcgtcgtcatcattctacttctttcgtcgccgactggttatgccgccgtcgactggtgtttttaccttcacaactacgcgtcttcgctaccggtttgcttctgttaccgccgattcgagttcacttcatcactgctatgcaactttgtcatcatggtggagcaacttcaacttcattgtcttctgcaccggcaatctctattgctgctacttcgcaagttttgctacttcaccgaccacgacgtctacatgagcctcaacatattgacgtgtcacgaaatttgacgtcgtcctaatctactactacaagtggttctacaattttcaagacttcaactcggacatcttcaacatgtatcctcactcaagcaatgagtactcgacgacaagctacagtttttgactctatattcagttgcttcccaactaaccaaagagtcgggggctatataaatacaagactcaaaatccgacaagttttatgtcaagataaagcaatcaattaatcaaggagtcaactctgggagtcattatcttcgtcttcacttccgagcaagctttctacttcatcaactccaattatttcaccggcaattttggcttctctgtcgtcgccacgatctacttcaaatttctctagtatcaagtttgagatttaatctacatattcgggaggatggagttatcaaccaatttcaacgagttggacaacaatttctacttttcttcaagtgaagcatctacaacagctacaactccaagttctattgccatctttataaatcaaggggtgttgcatcaatctttgttatgtacacgctcgcatcaaggaaactactcgagtttcaatatcttctcaacaatttgatggattattgtcactgacatcatcaccaacacctctgcttcatcggccctgacgtctccgctgttgctaatggatgattatgtcttcgccgacttattatttcaccttcacagttgacctactacgcaaacgctgatgagcatctttgtcattatcatcggctgctacaccgctattgactggatcaccgacatcgtcatcttcatcaacatcctgtcaagcctcttcaacatagcccactctactaatattgatgggcaacttcgtcatcatatttgatcatctctattgttgccaatcgtcattaccatcggttgcatttgttgtcgtcgactatttcctgcattttcatgattggaggatttcgtcatcgtcgttgatgcgcgtctacatcttcatcgttggcttgttttcatcgccaccgactggtattctcgccttcacggatggcttattatgttgccactagtgggcatcttcatcttcttcaccagctgcctcgtatgtcaccgactgattatttcgctgccatggttacacaactttattgttgggtgccttcatcttcattgttggctgacctgactgctgccgactggtttcttcacctctacggctgtgcaacttcatcacttttgattggtatcactatcttcactaccaccaatatttttgccacctctgttgggtaatattatctttatattggtcgtcttgtctctatgccaactacgtcagctaccatcaatggacaattgtgactacgatagaaggacaagctatatgctcaggggcttactacctcaaacacaagtatcataccttcaatttggacttgttccggatacatgcaacatgaattcatgatcatgggtctattttctgtgctcaaggactagactatttattattccccgtaaaggttatcaactgaatacttgcaccagtcgggattcaattgttatatctattttggagtatcccataagggataatcactcagatcagaagctattcatatgagctacacttggtctatatcacccggaagatttattactcgggagcatgttatatgcgtcatcctttaaagggtgtcgaaggcatattttttggcctaggcctaatatgtctgcagcccacattttcaggtgtggtctgtcacgttcttttagggacttaggcactttttgcttaggccaaagtgcacgtgatcaagtgcccaataccttaaaatccttttataccgcagttacttaactttttaggagttggtacaatgcatcttaaaagctgtcaaacagtaaagctttatatagctgccccgctgacttttttatatagtcaaggcgctgtttgggtttatcaagcaattgattggatacaatatcgttgctttttgcgatgtaagtgtgcatttttattgaccaatattatggcttaggctgattatatattgtggtcattttccaggcagctggtaaatcctttatgagtttatttacttggattttacaccacatatgctgtatatttctaggtgtggtgaaaccatgtgtcttttagggacttaagcacatctgttaaagcagtgtgcgcatgacttatgcccaatactttggaaatttctttattcacagcattcaagcttttttataactgttttgctatgtgaattttcaatgatgtagtcaactttaggttgctctcatcaaattttacaaagcagtcggtatatcatctggatcatgttatttagggattcacaccgcatatgctatatattgatatcaagtcacttggttgactataattatcaaaaaccactcggttggttggattatttattccttgactatatgcttggtttgttcaactaatcacatggtcggaggctacacctattaggtgcatatactcgatgcacctaaatttacattcaattatttttcagccctccacagtctttggatttggtaaaagtactcgagagaccatggcatagatgattgaagcactcggctctggagtaatctagttcgagagaagattatcttttcgactgtgaaggtctcaggggctactgtggagattatgggtaccccatacccacacggcatggttatccgactggttataggggataactaatatctatgaaatatttaacgaatcatgacttgggtattacgtttccctgtatattatggaacggcctaaagtcctggtttgataatattataaaatagatttaggaaaccgataccatattggttaaggtttctatcttgtaaccctgccccccaacctatataaggcgggcagggagccccctctaggggcatgagcacatatgactcaactagatcgatagatcaatacaacacccggcggattcaaatccccaaacaggagtagggtattacctctcatcgagagagcctgaacctgtctaaattatttgtctccgcatccatccacttttaggtctcgtgcgccacccccttttactattaccgaatttatgtttcgacacctgatgacccaactgacatcatcaactgaatgtcgaattgggcgatcctgcgtcgcgttttgggcttttggctggagaagatgtgcacgaagactttaaggttgaaaaaaagatatgcatctacaggtgggataaaagaagaggcttggatcctgaagtggagtcttttgtatgcagatcatgttgcatctcagtttcattgtttcttcaggaaaactatggaaatctggatgtttttgtatttataatatatatgctcgaataggttgttgttttttctgtctttctggaggcctggtccacgagtgcagaacactttatgcagctctatctcatttctcttaatggaaatggagggtatatccctttgataaaaaaaaatttaaaacgtgattcgacaaaatgtcaatctcgagcacatgctatttgccgctttgccattttcgtttttccagtgatttccaaaatgtttttttgcccttacgcgtggtgataagatgaaaatgcccctatctatggtaagatgaaatgtttttttgctctttttatttgacgaaacgaacgcagccggccacggcaacagccggcgcagagcttcttctcagcggcctcgtcactgtcgcggctctccttcacgagccacgccaccttggccttgggcagccgcatcagcctccatcggcgacaccgccgtcgccccccaatctcctactgcctttgcctcctctgctccctccaagccgtccccaccgaccgcctcctctcccacccactcccgtccaccgcgcacatctgcgtcgccgccccacctcctcgtccgtgactgtctctacgcccactcttgccgcctcctcggccccggccactcccgctcccacccccacctcgccgcctctctcatcgacctccttcactgcatcgtgctcgccctcgacccctgatgcagaggaacacgcctccgtgcccgacacgcttcatggccccatgccgccacctccactactctcaccactaccgcactctccaccttcacgccgctagccgccgccgccccaatctcccacctcctccgctccctccaagccgtccccgctgatggccccgacgtagcgcgcttgcctctgtggtcgacacgctcctctccgtcctcaccgaccgtggcctactcgacgacgccgctcaggtttttgatcaaaccaatccattgacacaaacgattgatgggcgaaaagtgggttgtttggatcttggagataagtgagttgttccggtcctggaggattgacggggagaactgcaagttttcggagccgagatatccattcgagtcactatgggcgtatttgttcaattgacacgtccgaaggaatcatcgttggacttactggatctttagctattcatgtgagaattgatcagctaatactcatccgtccaaaaaaaacccaatcatagctacaaacatggatatatagtgttcagattcgtagctaagtttgtctttttttttaggacagagtagtaatatttcccaagtatagtacagtacactaaataaaacgggagagcagtgtacaaaacatactacctccaatccaaaataagtgcacatttgagtattcgcgtccaacgtttgaccgtccgtcttatttgaaaaatttatgaaaaaatttaaaaatattaatcacacataaagtgctatgcatgttttaccaactaatagcagtaaaaatactattacatcaactgattcatatacactaacgaacaagaagtgcaaggagaaaagatgaataatgatccaaaacagaacagaagcatatggcatggcaaagaagcgaccccaactaattccttcctttgcaaccctcgtcatgactcatgattccaccataacagctatccgtattagtctctacttataaacagtgcacgctccaaattcatccgagaataaacgtcaccttagcatctaattgcagacagaacgatatatcaggttgaaatacataagagtgcatatgttacacattatccaaatgcatgccacattaatacaaagccacataggtttgtaccgtctcatagataaaaggtgcttagacttagtaccacaaaatacataaccatcaaggataacattcagacaggtgaatcacatgattcgaagggctaacagggatatggtaaagctaatattcagacaggtgattcacatgattgcgaagtgctaacagggtgaagaacacagcaccagacgcagaaacagcggacagcgccatgatcctgtaatatctcgcttcatctgcatgtcgtttagccaattcagcaagaaacctgatgtcctcttcaagagtagaggcacggcccttgccagtaggagttgtagtcttgggagatgctgtgccctatgcatggttccacatgaaggaagaaacataatcagattgctaggcattgccaagtgcaaacaaacggatgctgattgaagaaaaatgcccagccaacagatgaagtagctagcataactagtcgctcatttagtcagttgcacataccctcaactggtgcatcttgcacttgcctagcagttacatattccctctatccctaaatatttgacgctgttgacttttttaaacatatttgaccgtacatcatattcaaaaacttttgtgaaatatgtaaaactatatatatacataaaagtatatttaacaatgaatcaaatgataggaaaagaattgataattacttaaattttttaataaaacaaacggtcaaacatatttaaaaaagtcaacggcgttaaatatttagggacggagagagtacaaccagtatgtagatagagagtgacactaattctatttaccataacaaaccggatactcactacttacacgatcctatccatgcactcttaatataatatataaatattttgcttaccaagccagcaatttaagagacaatattatatgcatgcatgcatagacaaggtaagttaacatcaggcaggccatgaagcaattgagtagagaaaagagaaacttcgattgaaactttttccccaaattgtgctctctaatctgggtcgggtggggagagcgcgagatgaatcgaaacagatcctgaggccaggaagcgagcgagcggggctaattgcgcgcagctgacggtggattaaacctatgcgggatcgatcgatcgatctaacgaaaatagggaagctgagaaggggggcgaaggaagagagacaacctcgaggcggtggagggagcgcgatggcggcggcggcggcgcccggcgcagagcagccgggaccggcatgaccttcctcgcaagagtgcgcatcgccatagccgccatgccgccgacgtacggacgaacgggagcaaggtcgggggcggcggcgacagcgagctagggtttttctctctctctctctctctctctctcggtcgcttcgctgggaaggacgaaggcgtcttggttgagagccttgtgtgtttcttcgccttttccttttctctctcttttgttaccgctgccctacccgttactgggaccgactccagatgcgccaataggttcggcccagcccaccagcctgtaatcctgtatttatgctgttatagaaaaactatacatataaattttaatttcatattttaaaactttatacatacaaacttttattatttttttacgatcactctacatgaaagcatataaatctgaaccaacgtacatataaaatgttttgttgtaggtgtaaaatgtttgatgcataaacttgacaaaaggaagacatggttgttgaaataggaaatcttccatgtttctatagttaaattcactgtgtcgctttaggacaagcacattttcggcgtctactttaggctccgccatctttgtagtcttggtagcctagttttccctaattaattgtgcgttgtaaggtttagtcttattttctctttaaaatgtgacaccttcttctttatataaaatgtcggcaacagcctaaacgttcggaaaaaaaagtttgctagatagtccgaattttttatttatagtaattattgatccttaaataaaataaatagtaaatctcagattaaatttgtaaaaataggaaggacgttgttcccaatagcgtccagacttggacacacttctgaggagcgtccaaaggtggacgctgttccggacggcgtccaatctggttcacctcatcctcttgggttcggttgttcttcgacgttctccacaaccatttgcaggcgaaggtgcaccatcgccggctttcctctcctccctgcacggctagggcagaggagccaccaccgctgtccacctcgacgtctgggtggcccgcaccgacttccacctccacctgggaaggtactgagtccacctcggctccagcctccggggaggcggcccatcgctgtcctcctccacccttgagaccgtagccgcttgcctccatgcccaagaaaccaccatcgtcgttcccctccatgctgtcttccatcccttctcaagtacgccacaaggttgctgccaccgccttcagaggagatgcgagcctgttactcaactccgcagtgctcgtcggtggtagactggaagcccaaacgcctccattgcctctcaccgccctttgtgatgtgttctcttcaggtaattctttatttggagcttccattcctcagcagttcatggcctaccaaattaaagcaaaatgattagttcatttacttcagtacttggcaatacttgcatcaagttcagaaaaaaatctctggcttcacgaacaacaatattactgatgctaatgtccatcatgacatacccccaatgttgcattggtgatcgatcttcttgataaatttgaatgcaggttagaaaaaccggctactaattaataatgtcaattatgtgttatggatgccttggccagtcaatgtatcaaaactatccgaaaacaagacattggttcttattttgctttattttgtgtgctcaacgtctgtacttacaggctatactttcaaatattagtgaattccatgcataccactaccagttaattgtcatattctgtttatatgtattcttctgtacagcctgctagacgctaataggagtaaaaagatagagtaattgagtaaatgactgcatcacattgacaaaattgataacgtgtacagtctgtctgttagagaaagggatgaaggcaaagctattatatatgcacttcaatggctaaagacaggggtacagtacgtaaatattccattaaggacgcaaatcatcatttgttgatcctctcctttcggcgtggtgggtgaatggagaggagacttccgcacccagagaccccaaatgtgcgatccattctggccggacgcgttgcgcttgcgaaccaggatatggacgctgttgccaacaacgtcccgatctggacgcacttagttacagcgttcaatcctggacgctacagtcaagagcgtccttcctatataggtaaatcccaccccataattactaaatttttaatttaggtataattaattattacaaataaaaaaatcggctagatagtcttttggggcatgtgagtgctgcagccatttagagttgggacaacaaacatatcaaagtgaagaacactactactccctccgtacgtcccaaaagattcgtctcgtaattttacacgtaatatatgtaattattttttttatatttaatactccatgcatatttttaaatattcgatatgacagcatataaaattttgacggggcacgatctgtcgccatatattctgacggagggagtatggttcaggtctctttgaatttttgttaagactgatggctgatgctatctcggcttcccgtcgcttgtctgcaataatgttcttttgagctgatgggcgatatgggctgctgattgttgctttcatacggtatagtagtattaagggcctgtctatattccaccctaaaattttacatcatgtcatatcgaacgtttgaacgcatgcatgaagtattaaattatagactaaaaataactaattgtataggttgtgactaatttgcgagacaaatcttttaagcctaattgctccataatttaataatgtggtgtgacagtaaacatttgctaataacggattaattatgcttaataaaatcgtctcgcggtttactgtcggattctgtaatttatttttttattagcgtccaaatacccatacaacactttatataatatccgatgtgacacaccaaaactttacacccctgtatacaccccctaacattcaatccttctgcatatttgaaaaaaaaaagaaaataattgtttgaattgatatgatgtttttcaagttctataatctatacagggtcaaacattaatattaaattaatgtgatgtgagaactagttaatgctgtggatgatacgcctctgcttgctcgagcttgctgccttgctgcaccgctgtttgtgcgagcagtagagctacgggactctttcgatccctgccaaaaattttacgccatctcatatcaaacgtttgaaaaactaaataaagtataaaatataggttaaaaataactaattgtatatattacgattaatttatgagacaaatcttttaagtctaattgctccataatttattaatgtggtgctacagtaaacatttactaataacggattaattagacttaataaattcgtctcacagttcactgatgaattctgtaattagtttttttattagtgaccgaacaccccatacaacaccctatataatatatatccgatgtgacataccaaaattttacacctctaaatctaaactggttttccctggattgttagttgtttgaacctaatatatactatgcttcgagattacatcctttagttctaccggcgccctgcctctgcatgcataacagtattgtctcttaaagtatctatggctagcaagtctaagaggatatgtgcaactgactaggtcctatttagattctaatttttttcttcaaactttaaacttttccgtcacatcgaacttttctacacatacaaactttcaacttttccgttacattgttccaatttcttcaaacttctaattttagcgtggaactaaacacaacataaatgaactgactagttatgatgttcctccgctgcttggttttatatgaagcaacagctgtttatactgtttgcacttggcaatgcctagtaaatgtaatgtggtaacataataaattcataatgccatattgtcatagataaattaaaaaccggtttgattctaaaaaaccgccatcggttcactgttcccataaaaaccttccggttcaccggttttttaccggtttgattgcaggaacagtcttttttgctaaactgagccaccaagatgctagttcaggtttttttggtttaaccgtcagtccagtccggttttttttattatggtccaaagtgatacaatatggtaagaataggggatctaaagtgaaaataagggctaaaggtagttcagaaataaaattcggttagacatgggacctagggttcatgcaggagctagtctgctagtgctaacacccaagcacgtgagtcatgtgatagaaattcgccgcttatatataagttacctagaagttagaacgtgattacatttttagttattattataccgtctatagttatatttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn
